(12) United States Patent
Metsky et al.

(10) Patent No.: US 11,332,783 B2
(45) Date of Patent: May 17, 2022

(54) SAMPLE ANALYSIS, PRESENCE DETERMINATION OF A TARGET SEQUENCE

(71) Applicants: THE BROAD INSTITUTE, INC., Cambridge, MA (US); MASSACHUSETTS INSTITUTE OF TECHNOLOGY, Cambridge, MA (US); PRESIDENT AND FELLOWS OF HARVARD COLLEGE, Cambridge, MA (US)

(72) Inventors: Hayden Metsky, Cambridge, MA (US); Andreas Gnirke, Cambridge, MA (US); Christian Matranga, Cambridge, MA (US); Daniel Park, Cambridge, MA (US); Pardis Sabeti, Cambridge, MA (US)

(73) Assignees: The Broad Institute, Inc., Cambridge, MA (US); Massachusetts Institute of Technology, Cambridge, MA (US); President and Fellows of Harvard College, Cambridge, MA (US)

( * ) Notice: Subject to any disclaimer, the term of this patent is extended or adjusted under 35 U.S.C. 154(b) by 767 days.

(21) Appl. No.: 15/756,546

(22) PCT Filed: Aug. 26, 2016

(86) PCT No.: PCT/US2016/049071
§ 371 (c)(1),
(2) Date: Feb. 28, 2018

(87) PCT Pub. No.: WO2017/040316
PCT Pub. Date: Mar. 9, 2017

(65) Prior Publication Data
US 2018/0340215 A1    Nov. 29, 2018

Related U.S. Application Data

(60) Provisional application No. 62/211,541, filed on Aug. 28, 2015.

(51) Int. Cl.
| | | |
|---|---|---|
| *C12Q 1/686* | (2018.01) | |
| *C12Q 1/70* | (2006.01) | |
| *C12Q 1/6816* | (2018.01) | |
| *C12Q 1/6809* | (2018.01) | |
| *C07H 21/04* | (2006.01) | |
| *C12Q 1/6806* | (2018.01) | |

(52) U.S. Cl.
CPC ............ *C12Q 1/686* (2013.01); *C07H 21/04* (2013.01); *C12Q 1/6806* (2013.01); *C12Q 1/6809* (2013.01); *C12Q 1/6816* (2013.01); *C12Q 1/701* (2013.01); *Y02A 50/30* (2018.01)

(58) Field of Classification Search
None
See application file for complete search history.

(56) References Cited

U.S. PATENT DOCUMENTS

| | | |
|---|---|---|
| 2010/0029498 A1 | 2/2010 | Gnirke et al. |
| 2013/0190196 A1 | 7/2013 | Onderdonk et al. |
| 2013/0230857 A1 | 9/2013 | Gnirke et al. |
| 2014/0200163 A1 | 7/2014 | Mikkelsen et al. |
| 2014/0228223 A1 | 8/2014 | Gnirke et al. |
| 2015/0126377 A1 | 5/2015 | Gnirke et al. |

FOREIGN PATENT DOCUMENTS

| | | |
|---|---|---|
| WO | 2009/099602 A1 | 8/2009 |
| WO | 2017/040316 A1 | 3/2017 |

OTHER PUBLICATIONS

Borneman, James, et al. "Probe selection algorithms with applications in the analysis of microbial communities." Bioinformatics 17. suppl_1 (2001): S39-S48.*
Seven Bridges, blog posting, "Short read alignment: seeding," author: "Nate," downloaded from (https://www.sevenbridges.com/short-read-alignment-seeding/), 4 pages, Jun. 4 (Year: 2013).*
Wikipedia, "Set cover problem," downloaded from (https://en.wikipedia.org/wiki/Set_cover_problem), 1 page (Year: 2022).*
Geniez et al., "Targeted Genome Enrichment for Efficient Purification of Endosymbiont DNA from Host DNA", Symbiosis, vol. 58, No. (1-3), Dec. 2012, 201-207.
Gnirke et al., "Solution Hybrid Selection with Ultra-Long Oligonucleotides for Massively Parallel Targeted Sequencing", Nature Biotechnology, vol. 27, No. 2, Feb. 2009, 182-189.
Hoffmann et al., "Design and Coverage of High Throughput Genotyping Arrays Optimized for Individuals of East Asian, African American, and Latino Race/Ethnicity using Imputation and a Novel Hybrid SNP Selection Algorithm", Genomics, vol. 98, No. 6, Dec. 2011, 23 pages.
Matranga et al., "Enhanced Methods for Unbiased Deep Sequencing of Lassa and Ebola RNA Viruses from Clinical and Biological Samples", Genome Biology, vol. 15, No. 11, Nov. 18, 2014, 12 pages.
Melnikov et al., "Hybrid Selection for Sequencing Pathogen Genomes from Clinical Samples", Genome Biology, vol. 12, No. R73, Aug. 11, 2011, 9 pages.
International Search Report and Written Opinion for PCT International Application No. PCT/US2016/049071, dated Nov. 28, 2016, 11.

(Continued)

*Primary Examiner* — G Steven Vanni
(74) *Attorney, Agent, or Firm* — Johnson, Marcou, Isaacs & Nix, LLC; F. Brent Nix, Esq.; Michael B. Scher, Esq.

(57) ABSTRACT

The present invention provides a combination of genomic and computational technologies to provide rapid, portable sample analysis for sequencing or identifying a target sequence involving generating probes for use in analyzing a sample which may comprise a target sequence.

23 Claims, 20 Drawing Sheets

Specification includes a Sequence Listing.

(56) References Cited

OTHER PUBLICATIONS

Taghipour, et al., "Applying Surface-Based DNA Computing for Solving the Dominating Set Problem", American Journal of Molecular Biology, Jul. 2012, 286-290.
"International Preliminary Report on Patentability for PCT Application No. PCT/US2016/049071", BROD-0690WP, dated Mar. 15, 2018, 1-10.
Duitama, et al., "PrimerHunter: A Primer Design Tool for PCR-Based Virus Subtype Identification", Nucleic Acids Res, vol. 37, No. 8, Mar. 5, 2009, 2483-2492.
Jabado, et al., "Comprehensive Viral Oligonucleotide Probe Design Using Conserved Protein Regions", Nucleic Acids Research, vol. 36, No. 1, Dec. 13, 2007, 10.
Jabado, et al., "Greene SCPrimer: A Rapid Comprehensive Tool for Designating Degenerate Primers from Multiple Sequence Alignments", Nucleic Acids Reseach, vol. 34, No. 22, Nov. 28, 2006, 6605-6611.
Pearson, et al., "On the Primer Selection Problem in Polymerase Chain Reaction Experiments", Discrete Applied Mathematics, vol. 71, 1996, 231-246.
Phillippy, et al., "Efficient Oligonucleotide Probe Selection for Pan-Genomic Tiling Arrays", BMC Bioinformatics, vol. 10, No. 293, Sep. 16, 2009, 14.
Nate, "Short read alignmentseeding", Science, Seven Bridges, Back to Blog, Jun. 4, 2013, 4 pages.

\* cited by examiner

SAMPLE ANALYSIS, PRESENCE DETERMINATION OF A TARGET SEQUENCE

REFERENCE TO RELATED APPLICATIONS

This application is a national stage application of International Application No. PCT/US2016/049071 filed Aug. 26, 2016, which claims priority to U.S. Provisional Application No. 62/211,541 filed Aug. 28, 2015, the complete disclosures of which are hereby fully incorporated herein by reference.

STATEMENT OF GOVERNMENT SUPPORT

This invention was made with government support under grant numbers U19AI110818 and HHSN272200900049C awarded by the National Institutes of Health. The government has certain rights in the invention.

INCORPORATION BY REFERENCE

All documents cited or referenced herein ("herein cited documents"), and all documents cited or referenced in herein cited documents, together with any manufacturer's instructions, descriptions, product specifications, and product sheets for any products mentioned herein or in any document incorporated by reference herein, are hereby incorporated herein by reference, and may be employed in the practice of the invention. More specifically, all referenced documents are incorporated by reference to the same extent as if each individual document was specifically and individually indicated to be incorporated by reference.

FIELD OF THE INVENTION

The present invention provides a combination of genomic and computational technologies to provide rapid, portable sample analysis for sequencing or identifying a target sequence.

BACKGROUND OF THE INVENTION

Infectious diseases cause tremendous morbidity and mortality in tropical developing countries, and the need for a holistic approach to their detection and diagnosis is increasingly clear. The full range and prevalence of pathogens in such settings is not well understood, and the capacity to detect new or infrequent threats, like Ebola, is often lacking. The ability to diagnose a broad spectrum of pathogens is vital, since infection with multiple pathogens and resulting misdiagnoses are common.

Within this aim, sequencing is a powerful tool for analyzing a clinical sample. Clinical samples are biological mixtures that comprise little target sequences. The target sequences usually amount to less than 1% of the biological mixtures.

One method for overcoming the scarcity of target sequences is hybrid selection that makes it possible to capture target sequences out of the biological mixtures. Hybrid selection necessitates a set of probes selected from candidate probes that capture target sequences or fragments thereof when brought into contact therewith. The candidate probes are constructed so as to cover collectively the target sequences entirely or partially depending on the application of the analysis. However, occurrence of redundancies across candidate probes is usually high: a high number of candidate probes hybridize with a portion of one same target sequence. Utilizing a high number of candidate probes for hybrid selection is resource and time-consuming so that designing solutions for rapid and portable analysis can only be contemplated for the most common viruses. Therefore, efforts have been made to reduce the number of probes used for hybrid selection.

Reducing the number of probes currently consists in comparing the different candidate probes to one another in an iterative manner, i.e. within a list of probes, for one given probe, remove all other probes from the list of probes that is redundant to the given probe and continue with the next probe remaining in the list of probes. Two probes are considered redundant if they are shifted with respect to one another by a distance of less than a threshold shift and present a number of mismatches up to a mismatch threshold (see, e.g., FIG. 1).

Unfortunately, the output of this method, i.e. the selected probes, depends greatly on how the candidate probes are ordered. Further, considering n number of candidate probes, the number of selected probes can be a factor n away from optimal so that the total of selected probes used for analyzing a sample is high.

Citation or identification of any document in this application is not an admission that such document is available as prior art to the present invention.

SUMMARY OF THE INVENTION

Applicants' goal is to develop a comprehensive system, for detecting, diagnosing and monitoring infectious disease. Applicants' proposed system is intended to address multiple unmet needs in current health care delivery using three approaches: developing more rapid and cost-efficient sequencing to understand the history and mechanism of pathogen outbreaks; more rapid and cost-efficient identification of pathogens within a sample; the precise and more sensitive diagnostics that capture and discriminate between various pathogens; and providing far greater access to powerful diagnostic tools at the local level.

First, there is a need in patient care for more comprehensive diagnostic tests. Many pathogens produce non-specific symptoms like fever, headache, and nausea, making them difficult to distinguish clinically (Formenty et al., Journal of Infectious Diseases 179, S48 (1999); J. B. McCormick et al., J Infect Dis 155, 445 (1987)). For example, 30%-90% of hospitalized patients with acute fever in tropical Africa are diagnosed with malaria and treated accordingly, while only 7%-45% of them actually have laboratory-confirmed malaria. Better tests for individual diseases will be useful, but will not fully solve the problem: e.g., many patients with detectable malaria are actually sick because of other infections (M. Amexo, R. Tolhurst, G. Barnish, I. Bates, Malaria misdiagnosis: effects on the poor and vulnerable. Lancet 364, 1896 (2004); H. Reyburn et al., BMJ 329, 1212 (2004); D. Sur et al., Trans R Soc Trop Med Hyg 100, 725 (2006)). Such misdiagnoses can be fatal, as in a 1989 outbreak of Lassa fever in two Nigerian hospitals, where 22 people died (S. P. Fisher-Hoch et al., BMJ 311, 857 (Sep. 30, 1995)). Thus, Applicants develop a low-cost PCR-based panel for a range of infectious diseases as a routine diagnostic procedure for febrile patients.

Second, there is a need to better understand the array of existing pathogens and to detect emerging threats. Lassa virus, once thought to be a novel cause of sporadic disease outbreaks, has turned out to be endemic in much of West Africa, and there is even evidence that Ebola circulates undetected more widely than is supposed (R. J. Schoepp et al., Emerg Infect Dis 20, 1176 (2014); S. K. Gire et al., Science 338, 750 (2012).). Any samples that fail Applicants' diagnostic panel, therefore, are sent for deep metagenomic sequencing to detect other pathogens. A random selection of other samples are treated the same way, to provide a broad picture of the range of pathogens in the region, which in turn will make early detection of new or increasing pathogens possible.

Technological advances in sequencing and analyzing the genomes of a wide variety of microbes, including the costs of implementing genomic approaches at scale, make it possible to address these needs. But to fulfill that promise, the tools must be delivered to researchers and clinicians on the ground. Empowering local health care clinics and their communities, in turn, will help motivate patients to seek care at the clinic. In addition to saving lives, this enables us to continually monitor patients with unexplained fever, capturing diseases that previously went undiagnosed or misdiagnosed. After local diagnosis, samples can then be sent to advanced laboratories in the US—and hopefully soon Africa too—for in-depth analysis using high-throughput metagenomic sequencing. Discoveries of new pathogens are then be converted into affordable, field-deployable diagnostics to inform health care workers and the populations they serve, reducing the burden of disease and improving local capacity to detect and treat at the earliest possible stages. Robust data systems are needed to connect sample collections, the process of pathogen identification, and candidates for developing diagnostics and treatments. By comprehensively identifying pathogens circulating in the population this new infrastructure serves as an early warning for emerging and persistent diseases. With their own diagnostic capacity for a wide range of infectious agents, sites throughout Africa are able to support their communities and help to detect, monitor and characterize emerging diseases before they become global threats.

According to one aspect of the invention, a method for generating probes for use in analyzing a sample is provided and comprises a target sequence, which may comprise:

a. constructing candidate probes capable of hybridizing a reference sequence, said candidate probes collectively having a hybridization pattern along the length of the reference sequence;

b. determining an individual hybridization pattern for each candidate probe to provide a collection of individual hybridization patterns;

c. subjecting the individual hybridization patterns to a set cover solving process to reduce the number of candidate probes to provide selected probes; and d. synthesizing the selected probes.

In certain example embodiments, the candidate probes may collectively have a hybridization pattern along the entire length of the reference sequence.

According to another aspect of the invention, the set cover solving process may be a weighted set cover solving process, a partial set cover solving process or a partial weighted set cover solving process.

According to another aspect, a method of analyzing a sample which may comprise a target sequence is provided, which may comprise:

a. contacting the selected probes to the target sequence or a fragment thereof; and b. sequencing the target sequence or fragment thereof that hybridizes to one or more of the selected probes.

According to another aspect of the invention, the set cover solving process may be a greedy method. Alternate methods may also be used to solve set cover process.

According to another aspect of the invention, subjecting the individual hybridization patterns to a set cover solving process may comprise:

a. allocating a lower weight to those individual hybridization patterns that correspond to candidate probes that are specific to the target sequence; and b. allocating a higher weight to those individual hybridization patterns that correspond to candidate probes that are not specific to the target sequence.

According to another aspect of the invention, the method may further comprise minimizing a loss function depending on overhang parameters and mismatch parameters such that the total number of selected probes is no higher than a threshold number to provide input parameters to the set cover solving process.

According to another aspect, a method for generating probes for use in analyzing a sample which may comprise a target sequence is provided, which may comprise:

a. constructing candidate probes capable of hybridizing a reference sequence, said candidate probes collectively having a hybridization pattern along the length of the reference sequence;

b. assessing redundancy between candidate probes; and c. subjecting the candidate probes to a dominating set solving process to reduce the number of candidate probes to provide a selected probes, wherein any candidate probe is either a selected probe or redundant to a selected probe.

According to another aspect, the present invention also encompasses a composition which may comprise selected probes produced by any of the methods disclosed herein.

According to another aspect, a kit is provided, which may comprise a composition which may comprise selected probes produced by any of the methods disclosed herein and a solid phase operatively linked to the selected probes. In the case where biotin is employed as a labeling substance, preferably, after addition of a biotin-labeled antibody, streptavidin bound to an enzyme (e.g., peroxidase) is further added. In another embodiment, the hybridization may be in solution.

According to another aspect, a system for enrichment of genomic DNA of a target organism in a sample that may comprise both DNA of the target organism and non-specific DNA is provided which may comprise:

a. selected probes produced by any of the herein disclosed methods;

b. a sample containing DNA of said target organism and the non-specific DNA; and c. a solid phase operatively connected to the selected probes.

According to another aspect of the invention involving kits or systems, the solid phase may be a bead or a chip. In another embodiment, the hybridization may be in solution.

According to another aspect of the invention involving kits or systems, the selected probes may further comprise an adapter, such as a label.

According to another aspect of the invention, analysis of the target sequence or a fragment thereof hybridized to a selected probe may be by in solution hybrid selection. In this aspect, each of the selected probes may further comprise an adapter. In this aspect, each of the selected probes may comprise two adapters. In this aspect, a first adapter may be alternated with a second adapter. In this aspect, two of the selected probes may overlap.

According to another aspect of the invention, the candidate probe or the selected probe may be a nucleic acid sequence. In this aspect, the nucleic acid may be DNA, RNA, peptide nucleic acid ("PNA") or other non-naturally occurring nucleic acid.

According to another aspect of the invention, the sample may be obtained from a human. In this aspect, the sample may be a biological sample. In this aspect, the biological sample may be a blood, buccal, cell, cerebrospinal fluid, mucus, saliva, semen, tissue, tumor, feces, urine or vaginal sample.

According to another aspect of the invention, the target sequence may be a nucleotide sequence. In this aspect, the nucleotide sequence may be a DNA sequence or a RNA sequence. In this aspect, wherein the nucleotide sequence may be a pathogenic or viral sequence. In this aspect, the viral sequence may be an Ebola, measles, SARS, Chikungunya, hepatitis, Marburg, yellow fever, MERS, Dengue, Lassa, influenza, rhabdovirus or HIV viral sequence. In this aspect, viral sequence may be a Ebola Zaire Bundibugyo, Sudan, Reston and Taï Forest sequence. In this aspect, the hepatitis viral sequence may be a hepatitis A, hepatitis B or hepatitis C viral sequence. In this aspect, the influenza viral sequence may be an influenza A or influenza B viral sequence. In this aspect, the HIV viral sequence may be a HIV 1 or HIV 2 viral sequence.

The methods of the present invention may be applied to any organism with a nucleotide sequence—anything with sequence data. The organism is not limited to a viral or pathogenic organism. For example, methods of the present invention may apply to gut flora or gut microbiota, in particular the gut microbiome. The present invention is also contemplated for diagnostics, in particular in mixed samples. For example, the present invention may be utilized for determining and sequencing bacteria, pathogens and/or viruses present in an organism, water, soil, surface, or a population as well as in agricultural processes.

In certain example embodiments, probe oligos may be amplified, for example using PCR. Because probes may overlap and complements arise during PCR, overlapping probes may hybridize and effectively chain together. This problem can be prevented by assigning adapters to probes in a way that ensures that probes that might overlap are assigned different adapters and PCR'd separately. In certain example embodiments, this problem is solved with a heuristic that treats the problem as an "interval scheduling problem" in which hybridization patterns of each probe are examined and the hybridizations treated as intervals. The interval scheduling problem is then solved to find the maximum number of non-overlapping probes which can all be assigned the same adapter because they do not chain together. This process can continue, at each stage using a different adapter. The various adapters on both the 5' and 3' ends are given as input.

Accordingly, it is an object of the invention not to encompass within the invention any previously known product, process of making the product, or method of using the product such that Applicants reserve the right and hereby disclose a disclaimer of any previously known product, process, or method. It is further noted that the invention does not intend to encompass within the scope of the invention any product, process, or making of the product or method of using the product, which does not meet the written description and enablement requirements of the USPTO (35 U.S.C. § 112, first paragraph) or the EPO (Article 83 of the EPC), such that Applicants reserve the right and hereby disclose a disclaimer of any previously described product, process of making the product, or method of using the product. It may be advantageous in the practice of the invention to be in compliance with Art. 53(c) EPC and Rule 28(b) and (c) EPC. Nothing herein is to be construed as a promise.

It is noted that in this disclosure and particularly in the claims and/or paragraphs, terms such as "comprises", "comprised", "comprising" and the like can have the meaning attributed to it in U.S. Patent law; e.g., they can mean "includes", "included", "including", and the like; and that terms such as "consisting essentially of" and "consists essentially of" have the meaning ascribed to them in U.S. Patent law, e.g., they allow for elements not explicitly recited, but exclude elements that are found in the prior art or that affect a basic or novel characteristic of the invention.

These and other embodiments are disclosed or are obvious from and encompassed by, the following Detailed Description.

BRIEF DESCRIPTION OF THE DRAWINGS

The following detailed description, given by way of example, but not intended to limit the invention solely to the specific embodiments described, may best be understood in conjunction with the accompanying drawings.

FIGS. 12 and 13 graphically show the number of selected probes generated as output of Example 2.1, Example 2.2 and Comparative example 2.

FIG. 27 shows sequencing without hybrid selection and FIG. 28 shows sequencing with hybrid selection.

DETAILED DESCRIPTION OF THE INVENTION

Figure 1:
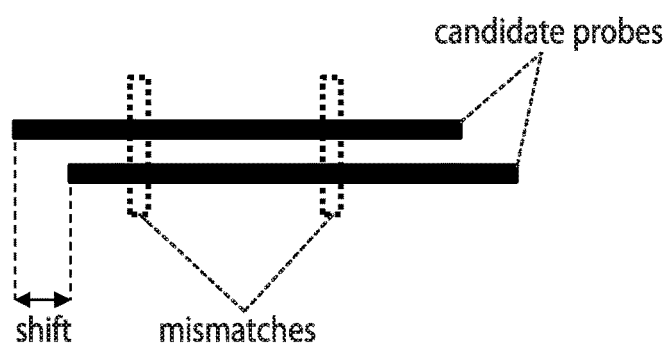
FIG. 1 shows that two probes are considered redundant if they are shifted with respect to one another by a distance of less than a threshold shift and present a number of mismatches up to a mismatch threshold.

Future pandemics threaten human progress and must be detected early. Applicants' goal is to achieve a sustainable, rapid-response surveillance system to detect infectious disease outbreaks as soon as they appear. To do so, Applicants must vastly improve both diagnostic tools and the human resources to deploy them. The present invention relates to developing rapid pathogen sequencing for comprehensive microbial detection.

Rapid advances in DNA sequencing technology provide an unprecedented capability to identify and characterize pathogens, and will soon enable comprehensive and unbiased pathogen surveillance for early detection and prevention of future epidemics. However, realizing its full potential for infectious disease surveillance and clinical diagnosis present additional challenges, which require further investment and focused effort. Applicants are developing scalable, rapid and field-deployable laboratory and computational methods to: (i) catalog and classify the microbes in patients' blood, (ii) determine the causal agent, and (iii) characterize the pathogen's properties.

The present invention relates to a method for generating probes for use in analyzing a sample which may comprise a target sequence, such as (a) constructing candidate probes capable of hybridizing a reference sequence, said candidate probes collectively having a hybridization pattern along the length of the reference sequence; (b1) determining an individual hybridization pattern for each candidate probe to provide a collection of individual hybridization patterns; (c1) subjecting the individual hybridization patterns to a set cover solving process to reduce the number of candidate probes to provide selected probes; and (d) synthesizing the selected probes.

In certain example embodiments, the methods for generating probes may comprise a set cover solution. The set cover solution may identify the minimal number of probes needed to cover an entire target sequence or set of target sequences, e.g. a set of genomic sequences. Set cover approaches have been used previously to identify primers and/or microarray probes, typically in the 20 to 50 base pair range. See, e.g. Pearson et al., www.cs.virginia.edu/~robins/papers/primers_dam11_final.pdf., Jabado et al. Nucleic Acids Res. 2006 34(22):6605-11, Jabado et al. Nucleic Acids Res. 2008, 36(1):e3 doi10.1093/nar/gkm1106, Duitama et al. Nucleic Acids Res. 2009, 37(8):2483-2492, Phillippy et al. BMC Bioinformatics. 2009, 10:293 doi: 10.1186/1471-2105-10-293. However, such approaches generally involved treating each primer/probe as k-mers and searching for exact matches or allowing for inexact matches using suffix arrays. In addition, the methods generally take a binary approach to detecting hybridization by selecting primers or probes such that each input sequence only needs to be bound by one primer or probe and the position of this binding along the sequence is irrelevant. Alternative methods may divide a target genome into pre-defined windows and effectively treat each window as a separate input sequence under the binary approach—i.e. they determine whether a given primer or probe binds within each window and require that all of the windows be bound by the state of some primer or probe. Effectively, these approaches treat each element of the "universe" in the set cover problem as being either an entire input sequence or a pre-defined window of an input sequence, and each element is considered "covered" if the start of a probe binds within the element. These approaches limit the fluidity to which different primer or probe designs are allowed to cover a given target sequence.

In contrast, the embodiments disclosed herein are directed to detecting longer probe lengths, for example, in the range of 70 bp to 200 bp that are suitable for hybrid selection sequencing. In addition, the methods disclosed herein take a pan-target sequence approach capable of defining a probe set that can identify and facilitate the sequencing of all sequences in a large and/or variable target sequence set. For example, the methods disclosed herein may be used to identify all variants of a given virus, or multiple different viruses in a single assay. Further, the method disclosed herein treat each element of the "universe" in the set cover problem as being a nucleotide of a target sequence, and each element is considered "covered" as long as a probe binds to some segment of a target genome that includes the element. Instead of the binary approach of previous methods, the methods disclosed herein better model how a probe, and in particular larger probes, may hybridize to a target sequence. Rather than only asking if a given sequence does or does not bind to a given window, embodiments disclosed herein first determine a hybridization pattern—i.e. where a given probe binds to a target sequence or target sequences—and then determines from those hybridization patterns the minimum number of probes needed to cover the set of target sequences to a degree sufficient to enable both enrichment from a sample and sequencing of any and all target sequences. These hybridization patterns may be determined by defining certain parameters that minimize a loss function, thereby enabling identification of minimal probes sets in a way that allows parameter to vary for each species, e.g. to reflect the diversity of each species, as well as in a computationally efficient manner that cannot be achieved using a straightforward application of a set cover solution, such as those previously applied in the primer and microarray probe design context.

A probe, a candidate probe or a selected probe may be a nucleic acid sequence, the nucleic acid being for example deoxyribonucleic acid (DNA), ribonucleic acid (RNA), peptide nucleic acid (PNA) or other non-naturally occurring nucleic acid.

The sample may be a biological sample, for example a blood, buccal, cell, cerebrospinal fluid, mucus, saliva, semen, tissue, tumor, feces, urine, and vaginal sample. It may be obtained from an animal, a plant or a fungus. The animal may be a mammal. The mammal may be a primate. The primate may be a human. In other embodiments, the sample may be an environmental sample, such as water, soil, or a surface such as industrial or medical surface.

"Target sequence" is intended to designate either one target sequence or more than one target sequence, i.e. any sequence of interest at which the analysis is aimed. Thus, the sample may comprise more than one target sequence and preferably a plurality of target sequences, the number of which may be 2, 3, 4, 5, 6, 7, 8, 9, 10, 11, 12, 13, 14, 15, 16, 17, 18, 19, 20 and above.

The target sequence may be a nucleotide sequence. The nucleotide sequence may be a DNA sequence, a RNA sequence or a mixture thereof. The nucleotide sequence may be a pathogenic or non-pathogenic sequence. The nucleotide sequence may be a bacterial sequence, a eukaryotic sequence, a viral sequence or a mixture thereof.

In certain example embodiments, the viral sequence may be a human respiratory syncytial virus, Sudan ebola virus, Bundibugyo virus, Tai Forest ebola virus, Reston ebola virus, Achimota, *Aedes* flavivirus, Aguacate virus, Akabane virus, Alethinophid reptarenavirus, Allpahuayo mammarenavirus, Amapari mammarenavirus, Andes virus, Apoi virus, Aravan virus, Aroa virus, Arumowot virus, Atlantic salmon paramyxovirus, Australian bat lyssavirus, Avian bornavirus, Avian metapneumovirus, Avian paramyxovirus, penguin or Falkland Islandsvirus, BK polyomavirus, Bagaza virus, Banna virus, Bat hepevirus, Bat sapovirus, Bear Canon mammarenavirus, Beilong virus, Betacoronavirus, Betapapillomavirus 1-6, Bhanja virus, Bokeloh bat lyssavirus, Borna disease virus, Bourbon virus, Bovine hepacivirus, Bovine parainfluenza virus 3, Bovine respiratory syncytial virus, Brazoran virus, Bunyamwera virus, California encephalitis virus, Candiru virus, Canine distemper virus, Canine pneumovirus, Cedar virus, Cell fusing agent virus, Cetacean morbillivirus, Chandipura virus, Chaoyang virus, Chapare mammarenavirus, Chikungunya virus, Colobus monkey papillomavirus, Colorado tick fever virus, Cowpox virus, Crimean-Congo hemorrhagic fever virus, *Culex* flavivirus, Cupixi mammarenavirus, Dengue virus, Dobrava-Belgrade virus, Donggang virus, Dugbe virus, Duvenhage virus, Eastern equine encephalitis virus, Entebbe bat virus, Enterovirus A-D, European bat lyssavirus 1-2, Eyach virus, Feline morbillivirus, Fer-de-Lance paramyxovirus, Fitzroy River virus, Flexal mammarenavirus, GB virus C, Gairo virus, Gemycircularvirus, Goose paramyxovirus SF02, Great Island virus, Guanarito mammarenavirus, Hantaan virus, Hantavirus Z10, Heartland virus, Hendra virus, Hepatitis A/B/C/E, Hepatitis delta virus, Human bocavirus, Human coronavirus, Human endogenous retrovirus K, Human enteric coronavirus, Human genital-associated circular DNA virus-1, Human herpesvirus 1-8, Human immunodeficiency virus 1/2, Huan mastadenovirus A-G, Human papillomavirus, Human parainfluenza virus 1-4, Human parechovirus, Human picobirnavirus, Human smacovirus, Ikoma lyssavirus, Ilheus virus, Influenza A-C, Ippy mammarenavirus, Irkut virus, J-virus, JC polyomavirus, Japanese encephalitis virus, Junin mammarenavirus, KI polyomavirus, Kadipiro virus, Kamiti River virus, Kedougou virus, Khuj and virus, Kokobera virus, Kyasanur forest disease virus, Lagos bat virus, Langat virus, Lassa mammarenavirus, Latino mammarenavirus, Leopards Hill virus, Liao ning virus, Ljungan virus, Lloviu virus, Louping ill virus, Lujo mammarenavirus, Luna mammarenavirus, Lunk virus, Lymphocytic choriomeningitis mammarenavirus, Lyssavirus Ozernoe, MSSI2.225 virus, Machupo mammarenavirus, Mamastrovirus 1, Manzanilla virus, Mapuera virus, Marburg virus, Mayaro virus, Measles virus, Menangle virus, Mercadeo virus, Merkel cell polyomavirus, Middle East respiratory syndrome coronavirus, Mobala mammarenavirus, Modoc virus, Mojiang virus, Mokola virus, Monkeypox virus, Montana myotis leukoencephalitis virus, Mopeia lassa virus reassortant 29, Mopeia mammarenavirus, Morogoro virus, Mossman virus, Mumps virus, Murine pneumonia virus, Murray Valley encephalitis virus, Nariva virus, Newcastle disease virus, Nipah virus, Norwalk virus, Norway rat hepacivirus, Ntaya virus, O'nyong-nyong virus, Oliveros mammarenavirus, Omsk hemorrhagic fever virus, Oropouche virus, Parainfluenza virus 5, Parana mammarenavirus, Parramatta River virus, Peste-des-petits-ruminants virus, Pichinde mammarenavirus, Pirital mammarenavirus, Piscihepevirus A, Porcine parainfluenza virus 1, porcine rubulavirus, Powassan virus, Primate T-lymphotropic virus 1-2, Primate erythroparvovirus 1, Punta Toro virus, Puumala virus, Quang Binh virus, Rabies virus, Razdan virus, Reptile bornavirus 1, Rhinovirus A-B, Rift Valley fever virus, Rinderpest virus, Rio Bravo virus, Rodent Torque Teno virus, Rodent hepacivirus, Ross River virus, Rotavirus A-I, Royal Farm virus, Rubella virus, Sabia mammarenavirus, Salem virus, Sandfly fever Naples virus, Sandfly fever Sicilian virus, Sapporo virus, Sathuperi virus, Seal anellovirus, Semliki Forest virus, Sendai virus, Seoul virus, Sepik virus, Severe acute respiratory syndrome-related coronavirus, Severe fever with thrombocytopenia syndrome virus, Shamonda virus, Shimoni bat virus, Shuni virus, Simbu virus, Simian torque teno virus, Simian virus 40-41, Sin Nombre virus, Sindbis virus, Small anellovirus, Sosuga virus, Spanish goat encephalitis virus, Spondweni virus, St. Louis encephalitis virus, Sunshine virus, TTV-like mini virus, Tacaribe mammarenavirus, Taila virus, Tamana bat virus, Tamiami mammarenavirus, Tembusu virus, Thogoto virus, Thottapalayam virus, Tick-borne encephalitis virus, Tioman virus, Torque teno *canis* virus, Torque teno douroucouli virus, Torque teno *felis* virus, Torque teno midi virus, Torque teno sus virus, Torque teno tamarin virus, Torque teno virus, Torque teno *zalophus* virus, Tuhoko virus, Tula virus, Tupaia paramyxovirus, Usutu virus, Uukuniemi virus, Vaccinia virus, Variola virus, Venezuelan equine encephalitis virus, Vesicular stomatitis Indiana virus, WU Polyomavirus, Wesselsbron virus, West Caucasian bat virus, West Nile virus, Western equine encephalitis virus, Whitewater Arroyo mammarenavirus, Yellow fever virus, Yokose virus, Yug Bogdanovac virus, Zaire ebolavirus, Zika virus, or *Zygosaccharomyces bailii* virus Z viral sequence. In certain example embodiments, the probe set comprises probes for hybrid selection that bind all of the viruses listed in this paragraph. In certain example embodiments, the probe set comprises one of more SEQ ID NOs: 12,343-362, 340. In certain other example embodiments, the probe set consists of SEQ ID NOs: 12,343-362,340.

In certain example embodiments, the viral sequence may be an Cjolungua. Crimean-Congo, Dengue, Ebola non-Zaire, Ebola Zaire, GB virus C, Hepatitis A, Hepatitis C, HIV-1, HIV-2, Influenza A, Influenza B, Lassa, Marburg, Measles, MERS, Rhabdovirus, Rift Valley fever, SARS, Yellow fever or a mixture thereof. The Ebola viral sequence may be an Ebola Zaire, Bundibugyo, Sudan, Reston and Tai Forest sequence, or a mixture thereof. The hepatitis viral sequence may be a hepatitis A, hepatitis B or hepatitis C viral sequence, or a mixture thereof. The influenza viral sequence may be an influenza A or influenza B viral sequence, or a mixture thereof. The HIV viral sequence may be a HIV 1 or HIV 2 viral sequence, or mixture thereof. The target sequence may be a genome. In certain example embodiments, the probe set may comprise probes for hybrid selection that bind all probes in this paragraph. In certain example embodiments, the probe set may comprise one or more of SEQ ID NOs: 362,341 to 452,330. In certain other example embodiments, the probe set may consist of SEQ ID NOs: 362,341 to 452,330.

In certain example embodiments, the viral sequence may be Zika and/or Chikungunya. In certain example embodiments, the probe set may comprise probes that detect multiple variants of Zika and/or Chikungunya. In certain example embodiments, the probe set may comprise one or more of SEQ ID NOs: 1 to 12,342. In certain other example embodiments, the probe set may consist of SEQ ID NOs: 1 to 12,342.

Bait design may be performed similarly as previously described (see, e.g., Gnirke, et al., Nature biotechnology 27:182-189, 2009, US patent publications No. US 2010/0029498, US 2013/0230857, US 2014/0200163, US 2014/0228223, and US 2015/0126377 and international patent publication No. WO 2009/099602). As used herein, the terms "bait sequence" and "candidate probe" may be used interchangeably and each may be further appended with adaptor oligonucleotides.

Typically bait sequences are designed from reference sequences, such that the baits are optimal for catching targets of the reference sequences. However, in some embodiments, bait sequences are designed using mixed bases or a universal base such as inosine or 5-nitroindole (i.e., degeneracy). For example, the mixed or universal base(s) can be included in the bait sequence at the position(s) of a common SNP or mutation, to optimize the bait sequences to catch both alleles (i.e., SNP and non-SNP; mutant and non-mutant). In other embodiments, all known sequence variations (or a subset thereof) can be targeted with multiple oligonucleotide baits, rather than by using mixed degenerate oligonucleotides.

The bait sequences in some embodiments are synthetic long oligonucleotides or are derived from (e.g., produced using) synthetic long oligonucleotides. In certain embodiments, the set of bait sequences is derived from oligonucleotides synthesized in a microarray and cleaved and eluted from the microarray.

In some embodiments, the bait sequences in the set of bait sequences are RNA molecules. In some embodiments the bait sequences are chemically or enzymatically modified or in vitro transcribed RNA molecules including but not limited to those that are more stable and resistant to RNase.

Bait sequences preferably are oligonucleotides between about 10 nucleotides and 1000 nucleotides in length, more preferably between about 50 nucleotides and 200 nucleotides in length, more preferably still between about 70 nucleotides and 140 nucleotides in length. In another preferred embodiment, oligonucleotides with non-naturally occurring linkages such as locked nucleic acid ("LNA") or peptide nucleotide acids between about 15 and 50 nucleotides are also contemplated. Intermediate lengths in addition to those mentioned above also can be used in the methods of the invention, such as oligonucleotides of about 10, 20, 30, 40, 50, 60, 70, 80, 90, 100, 110, 120, 130, 140, 150, 160, 170, 180, 190, 200, 210, 220, 230, 240, 250, 300, 400, 500, 600, 700, 800, and 900 nucleotides in length, as well as oligonucleotides of lengths between the above-mentioned lengths. For selection of exons and other short targets, preferred bait sequence lengths are oligonucleotides of about 50 to about 200 nucleotides, and more preferably about 70 to about 140 nucleotides. For selection of targets that are long compared to the length of the capture baits, such as genomic regions, preferred bait sequence lengths are typically in the same size range as the baits for short targets mentioned above, except that there is no need to limit the maximum size of bait sequences for the sole purpose of minimizing targeting of adjacent sequences. In certain embodiments of the foregoing methods, the number of bait sequences in the set of bait sequences is less than 1,000. In other embodiments, the number of bait sequences in the set of bait sequences is greater than 1,000, greater than 5,000, greater than 10,000, greater than 20,000, greater than 50,000, greater than 100,000, or greater than 500,000.

The invention also includes methods for producing a set of bait sequences. The methods include providing or obtaining a nucleic acid array (e.g., microarray chip) that contains a set of synthetic long oligonucleotides, and removing the oligonucleotides from the microarray (e.g., by cleavage or elution) to produce a set of bait sequences. Synthesis of oligonucleotides in an array format (e.g., chip) permits synthesis of a large number of sequences simultaneously, thereby providing a set of bait sequences for the methods of selection. The array synthesis also has the advantages of being customizable and capable of producing long oligonucleotides.

The hybridization bait sequences may be prepared from the whole genome of the target organism, for example, where the bait sequences are prepared by a method that includes fragmenting genomic DNA of the target organism (e.g., where the fragmented bait sequences are end-labeled with oligonucleotide sequences suitable for PCR amplification or DNA sequencing or where the bait sequences are prepared by a method including attaching an RNA promoter sequence to the genomic DNA fragments and preparing the bait by transcribing (e.g., using biotinylated ribonucleotides) the DNA fragments into RNA. The bait sequences may be prepared from specific regions of the target organism genome (e.g., are prepared synthetically). In certain embodiments, the bait sequences are labeled with an affinity tag. In certain example embodiments, the affinity tag is biotin, a hapten, or an affinity tag, or the bait sequences are generated using biotinylated primers, e.g., where the bait sequences are generated by nick-translation labeling of purified target organism DNA with biotinylated deoxynucleotides. In cases where the bait sequences are biotinylated, the target DNA can be captured using a streptavidin molecule attached to a solid phase. The bait sequences may be appended by adapter sequences suitable for PCR amplification, sequencing, or RNA transcription. The bait sequences may include an RNA promoter or are RNA molecules prepared from DNA containing an RNA promoter (e.g., a T7 RNA promoter).

In other embodiments, the set of bait sequences is produced using known nucleic acid amplification methods, such as PCR, or other amplification methods described herein or known to the skilled person. For example, a set of bait sequences (e.g., 10,000 bait sequences) can be specifically amplified using human DNA or pooled human DNA samples as the template, according to known methods, whereby spacing of the primers on the template sequence will dictate the length of the resulting oligonucleotide baits.

The invention also provides methods of producing a set of RNA bait sequences in which a set of bait sequences is produced as described above, an RNA polymerase promoter sequence at the end(s) of the bait sequences, and the RNA bait sequences are synthesized using RNA polymerase. In preferred embodiments, the RNA polymerase is a T7 polymerase, a SP6 polymerase, or a T3 polymerase. In other embodiments, the RNA polymerase promoter sequence is added at the ends of the bait sequences by re-amplifying the bait sequences, such as by PCR or other nucleic acid amplification methods.

Figure 2:
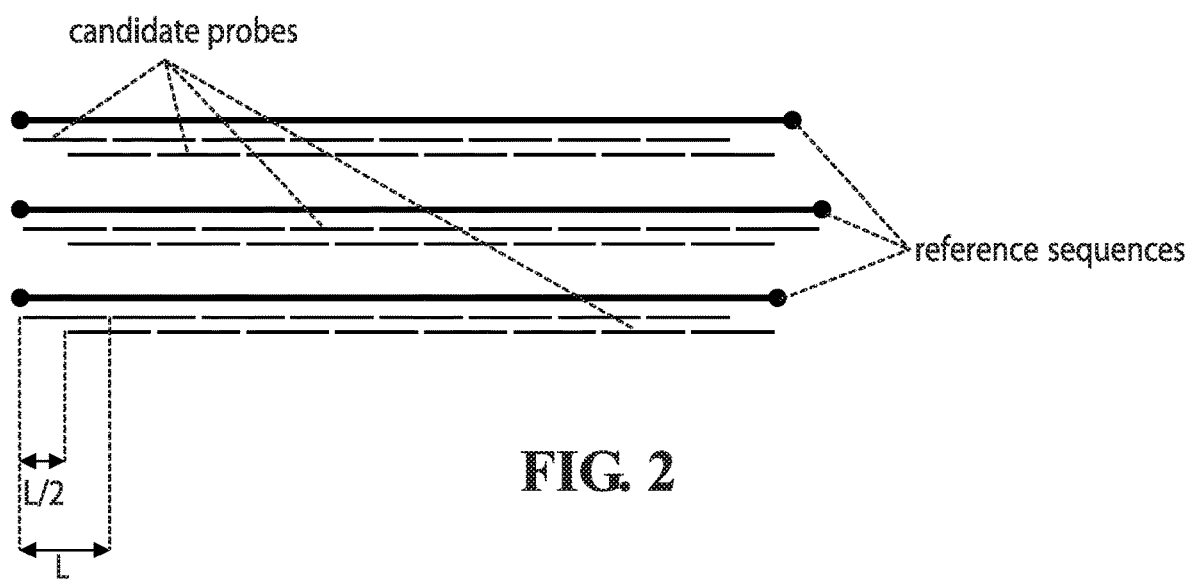
FIG. 2 shows a 2× tiling of candidate probes.

Constructing the candidate probes may comprise fragmenting the reference sequence into fragments of equal size that overlap one another, so that the overlap between two fragments is half the size of the fragment, for example a 2× tiling as illustrated in FIG. 2.

"Capable of hybridizing a reference sequence" is intended to mean capable of hybridizing the entire reference sequence or a fragment thereof.

"Individual hybridization pattern" is intended to designate the coverage capacity of one probe, i.e. the collection of subsequences of the reference sequence which the probe is capable of hybridizing or to which the probe is redundant. "Hybridization pattern along the length of the reference sequence" is intended to mean that the entire target sequence is covered. More generally, when used with respect to a plurality of probes, "hybridization pattern" is intended to designate the collective coverage capacity of the plurality of probes, i.e. the collection of subsequences of the reference sequence which at least one of the probes of the plurality of probes is capable of hybridizing or to which at least one of the probes is redundant.

Hybridization between the test sample and the bait sequence may be conducted under any conditions in which the bait sequences hybridize to the target organism's DNA (e.g., pathogen, commensal organism, or symbiont DNAs), but do not substantially hybridize to the contaminating DNA. This can involve selection under high stringency conditions. Following hybridization, the labeled baits can be separated based on the presence of the detectable label, and the unbound sequences are removed under appropriate wash conditions that remove the nonspecifically bound DNA, but do not substantially remove the DNA that hybridizes specifically.

In one embodiment, hybrid selection using either synthetic bait or whole genome baits (WGB) may be carried out as described previously (see, e.g., Gnirke, et al., Nature biotechnology 27:182-189, 2009, US patent publications No. US 2010/0029498, US 2013/0230857, US 2014/0200163, US 2014/0228223, and US 2015/0126377 and international patent publication No. WO 2009/099602).

In another embodiment, methods of US patent publication No. 2013/0190196 may be applied to detecting nucleic acid signatures, specifically RNA levels, directly from crude cellular samples with a high degree of sensitivity and specificity. Oligonucleotide probes to identify each pathogen of interest are selected by comparing the coding sequences from the pathogen of interest to all gene sequences in other organisms by BLAST software. Only probes of about 50 nucleotides, e.g., 80 nucleotides, 70 nucleotides, 60 nucleotides, 40 nucleotides, 30 nucleotides, and 20 nucleotides, with a perfect match to the pathogen of interest, but no match of >50% to any other organism are selected. Two probes corresponding to each mRNA of interest and within 100 base pairs of each other are selected.

As described in US patent publication No. 2013/0190196, two molecular probes are added to a crude sample lysate containing mRNA molecules. A capture probe comprises 50 nucleotides complementary to a given mRNA molecule, and can be conjugated to biotin. A reporter probe comprises a different 50 nucleotides complementary to a different part of the same mRNA molecule, and can be conjugated to a reporter molecule, e.g., a fluorescent tag or quantum dot. Each reporter molecule uniquely identifies a given mRNA molecule. The capture and reporter probes hybridize to their corresponding mRNA molecules within the lysate. Excess reporter is removed by bead purification that hybridizes to a handle on each oligomer, leaving only the hybridized mRNA complexes. The mRNA complexes can be captured and immobilized on a surface, e.g., a streptavidin-coated surface. An electric field can be applied to align the complexes all in the same direction on the surface before the surface is microscopically imaged. Such methods may also be applied to the present invention.

As described in US patent publication No. 2013/0190196, in an example involving tuberculosis (TB), wherein unique expression signatures for the detection of TB over other mycobacteria species have been defined. In general, the optimal genes for inclusion in a signature will fulfill the criteria of 1. having high expression levels (high mRNA copy number) to increase sensitivity, 2. being highly conserved across all TB strains as well as having highly conserved sequence, and 3. being highly specific for TB genome over all other mycobacteria species. Such genes were identified using a bioinformatic analysis of conserved genes in the available TB genomes that are not present in all other sequenced mycobacteria species (i.e., *M. marinum, M. avium-intracellulare, M. kansasii, M. fortuitum*, M. *abscessus*). Over 40 TB genomes from clinically isolated strains that have been sequenced at the Broad Institute are available for analysis. A second criterion for selection of molecular probes for the detection of TB bacilli in sputum is that they hybridize to highly abundant, stable mRNAs to allow maximum sensitivity. Such mRNAs are anticipated to correspond to essential housekeeping genes. Genes have been selected using a combination of bioinformatic analysis of existing, publicly available expression data in a database created at the Broad Institute and Stanford University (tbdb.org) and experimental expression profiles on TB strain H37Rv using expression profiling to confirm a high level of expression of candidate genes under conditions permissive for replication (logarithmic growth) and non-replication induced by carbon starvation, stationary phase, and hypoxia. Expression profiling experiments on H37Rv are performed using a carbon starvation model of TB that has been established (starvation for 5 weeks in 7H9/tyloxapol), stationary phase growth, and the Wayne model for anaerobic growth (slowly agitated cultures in sealed tubes). Solexa/Illumina sequencing is used to determine expression profiles by converting mRNA to cDNA and using sequencing to count cDNA molecules. This quantitative method for identifying expression levels is more likely to reflect levels obtained using digital gene expression than microarray data and is a method that has been established with the Broad Institute Sequencing Platform. It is possible to multiplex 12 samples per sequencing lane given 75 bp reads and 10 million reads per lane. Because the digital gene expression technology is based on the hybridization of two 50 nucleotide probes to the mRNA of interest, two 50 base pair regions in the genes are identified from (Ai) and (Aii) that are unique within the genome to minimize non-specific hybridization and that contain minimal polymorphisms as evidenced from sequenced TB genomes. The probes are selected bioinformatically to fit within a 5 degree melting temperature window and with minimal mRNA secondary structure. The probes are tested against mRNA isolated from replicating and non-replicating TB (including multiple strains i.e., H37Rv, CDC1551, F11, Erdman), *M. marinum, M. avium-intracellulare, M. kansasii*, and *M. fortuitum* to confirm the specificity of the entire probe set using available technology. Probes may be selected for these other mycobacterial species, which will allow for identification of these pathogens from sputum as well. The ability to identify intracellular bacilli is tested in a macrophage model of infection, to demonstrate the ability to detect TB mRNA in the presence of host mRNA. Finally, the sensitivity of the assay was determined by titrating down the number of TB bacilli (and thus mRNA present in cell lysates) in the sample tested. All experiments using digital gene expression is confirmed using quantitative RT-PCR against the same gene set. Improvement and refinement of the set occurs in an iterative manner. Such methods may also be applied to the present invention.

Figure 3:
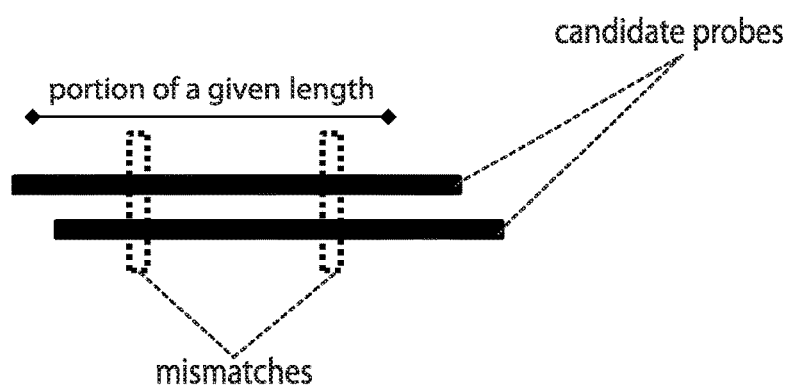
FIG. 3 shows that two probes may be said to be redundant if each of them presents a portion of a given length that is the same as the portion of a given length of the other probe, wherein the portions are considered the same even if there are up to a threshold number of mismatch.
Figure 4:
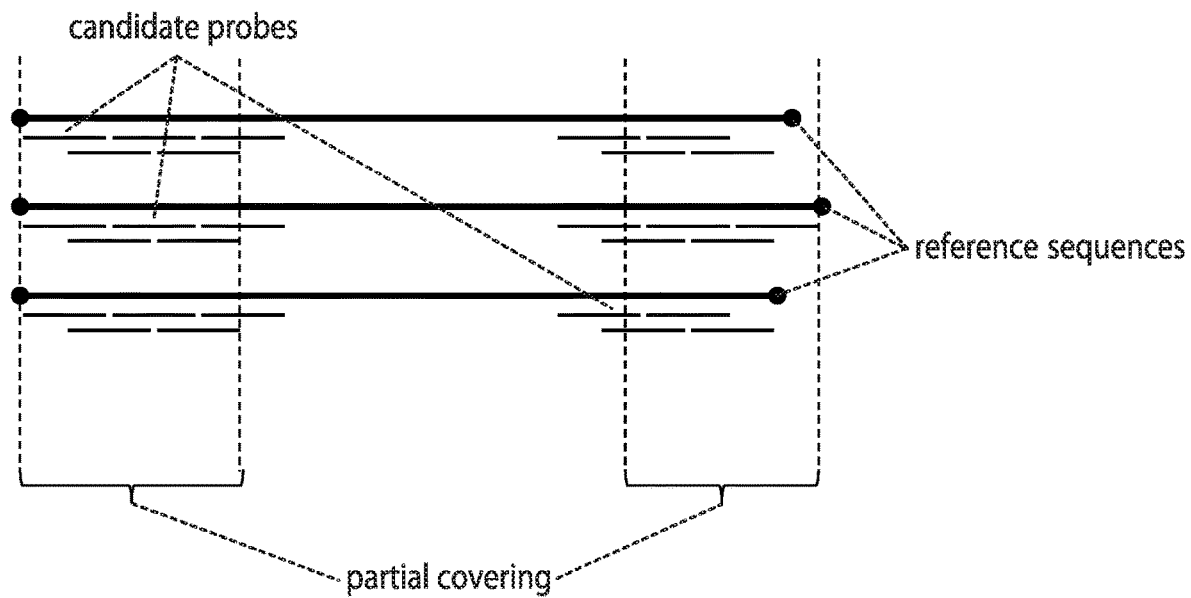
FIG. 4 shows an example in the case of tiling where the target sequence is only tiled on desired portions.

Two probes may be said to be redundant if each of them presents a portion of a given length that is the same as the portion of a given length of the other probe, wherein the portions are considered the same even if there are up to a threshold number of mismatch (see FIG. 3). Therefore, in comparison with the prior art, no criterion on the shift is taken into consideration, what is a result of the set cover solving process. The number of allowed mismatches may be 0, 1, 2, 3, 4, 5, 6, 7, 8, 9 or up to given length of the probe.

The present invention also encompasses tiling methods to obtain desirable probes for mixed samples and measurements that advantageously may not involving sequencing. For example, the nanoString® nCounter® lncRNA assays may be contemplated for analyzing and quantifying RNAs of the present invention. A microarray based upon Affymetrix Axiom genotyping technology (see, e.g., Hoffman et al., Genomics. 2011 August; 98(2): 79-89) is also contemplated, in particular, for identifying SNPs and polymorphisms. The invention also encompasses use of a SureSelect Target Enrichment System developed by Agilent Technologies, a SeqCap EZ target capture kit developed by Roche Nimble-Gen, a TruSeq® Enrichment Kit developed by Illumina and other hybridization-based methods and kits for enriching sequencing targets of interest in a sample.

The set cover solving process does not even need a definition of redundancy between two candidate probes but rather the redundancy is between a probe and a region of a target sequence. The number of mismatches is an input to the program as a whole which is more directly used in determining a hybridization pattern rather than directly used in solving an instance of a set cover problem. While misalignments caused by indels (deletions or insertions) occurring within a population of target sequences were not considered in determining whether a candidate probe was redundant, this aspect could be considered.

The set cover solving process is any process that approximates the solution to the set cover problem or a problem equivalent to the set cover problem (see, e.g., Thomas H. Cormen, Charles E. Leiserson, Ronald L. Rivest, and Clifford Stein. 2009. Introduction to Algorithms 3rd ed. The MIT Press.; and Vijay Vazirani. 2001. Approximation Algorithms. Springer-Verlag, Berlin. The set cover problem may be described as follows: given a set of elements {1, 2 . . . i . . . m}, called the universe U, and a collection S of n subsets whose union covers the universe, the set cover problem is to identify the smallest set of subsets whose union equals the universe.

In the present invention, an element may be a nucleotide existing in a location within the reference sequence or sequences, the universe may be the reference sequence, each subset may be the individual hybridization pattern of a candidate probe, the union of the hybridization patterns of the candidate probes equals the reference sequence. Thus, the set cover solving process may approximate the smallest number of candidate probes that collectively have a hybridization pattern along the length of the reference sequence.

"Reference sequence" is intended to encompass the singular and the plural. As such, when referring to a reference sequence, the cases where more than one reference sequence is also contemplated. Preferably, the reference sequence is a plurality of reference sequences, the number of which may be over 30; 50; 70; 100; 200; 300; 500; 1,000 and above. In certain example embodiments, the reference sequence is a genomic sequence. In certain example embodiments, the reference sequence is a plurality of genomic sequences. In certain example embodiments, the reference sequence is a plurality of genomic sequences from the same species or viral strain. In certain other example embodiments, the reference sequence is a plurality of genomic sequences from different species or viral strains.

The set cover solving process makes it possible to reduce substantially, if not dramatically, the number of selected probes that are needed to analyze a sample. Preferably, the number of selected probes is over 700; 900; 1,000; 1,400; 1,600; 2,000; 2,400; 2,700; 3,000; 3,500; 4,000; 4,700; 5,000; 5,300; 7,500; 10,000; 13,000; 15,000; 65,000; preferably lower than 90,000. In certain example embodiments, the number of selected is probes is between 100,000 to 500,000.

In one embodiment, the reference sequence may be a collection of genomes of one type of virus, the genomes collectively form a universe of elements that are the nucleotides (position within the genomes being considered as differentiating nucleotides of the same type). In another embodiment, each genome may make up one universe so that the problem as a whole becomes a multi-universe problem. Multi-universe may be a unique generalization of the set cover problem. In this instance, separate universes may be helpful for thinking about partial set cover, so this way a partial cover yields a desired partial coverage of each genome (i.e., each universe). If the problem is imagined as being composed of a single universe, thinking about partial coverage may be considered as covering a desired fraction of the concatenation of all the genomes, rather than a desired fraction of each genome.

If X designates a genome and y designates a position within the corresponding genome, an element of the universe can be represented by (X, y), which is understood as the nucleotide in position y in genome X. Candidate probes are obtaining by fragmenting the collection of genomes. The individual hybridization patterns are subsets of the universe. The individual hybridization pattern of a candidate probe of length L can be represented as {(A, ai), (A, ai+1) . . . (A, ai+L), (A, aj), (A, aj+1) . . . (A, aj+L), (B, bi), (B, bi+1) . . . (B, bi+L) . . . }, otherwise represented as {A: (ai . . . ai+L), (aj . . . aj+L); B:(b1 . . . b1+L) . . . } (subset covering nucleotides in position ai to ai+L and aj to aj+L in genome A, nucleotides in position bi to bi+L in genome B . . . ).

In certain example embodiments, a set of target sequences are provided. In certain example embodiments the target sequences are variants of a single species. In certain other example embodiments, the target sequences are from multiple different species. In certain example embodiments, the target sequences are viral sequences. The viral sequences may be variants of the same viral strain, different viruses, or a combination thereof. A hybridization pattern is determined for the target sequences. To model a hybridization pattern a number of different parameters may be defined to determining whether a given probe is considered to hybridized to a given portion of a target sequence or sequences. In addition, a percent of coverage parameter may be set to define the percent of the target sequence that should be covered by the probe set. This value may range from a fraction of a percent to 100% of the genome. In certain example embodiments this may range from 0.01% to 10%, 1% to 5%, 1% to 10%, 1% to 15%, 1% to 20%, 1% to 25%, 1% to 30%, 1% to 35%, 1% to 40%, 1% to 45%, 1% to 50%, 1% to 55%, 1% to 60%, 1% to 65%, 1% to 70%, 1% to 75%, 1% to 80%, 1% to 85%, 1% to 90%, 1% to 95%, 1% to 100%. 50% to 100%, 55% to 100%, 60% to 100%, 65% to 100%, 70% to 100%, 75% to 100%, 80% to 100%, 85% to 100%, 90% to 100%, or 95% to 100%.

In certain example embodiments, a number of mismatch parameters is defined. The number of mismatches defines a number of mismatches that may be present between a probe and a given portion of a target sequence. This value may range from 0 to 10 base pairs.

In certain example embodiments, another parameter, called the "island of exact match" 1ubstring" may be used to model hybridization between a probe and nucleic acid fragment. Let its value be x. When determining whether a probe covers a sequence, a value is set that defines a stretch of at least x bp in the probe that exactly matches (i.e., with no mismatches) a stretch of a target sequence. Along with the other parameters, this is applied as a filter to decide whether a probe should be deemed as hybridizing to a portion of a target sequence. The value may vary, but usually set it to be 30 bp. Setting its value to 0 would effectively remove this filter when determining hybridization patterns.

In certain other example embodiments, a longest common substring parameter may be set. This parameter defines that a probe only hybridizes only if the longest common substring up to a certain amount of mismatches is at least that parameter. For example if the parameter is set to 80 base pair with 3 mismatches, then a probe will still be considered to hybridized to a portion of a target sequence if there is string of 80 base pairs that match the target sequence even if within that stretch there are up to 3 mismatches. So a 80 base pair sting that matches except for two mismatches would be considered to hybridized but an 80 base pair string that matches except for 4 mismatches would not be considered to hybridize. This parameter may range from a string of 20 to 175 base pairs with anywhere from 0 to 9 mismatches in that string.

In certain other example embodiments, an overhang or cover extension parameter may be set. This parameter indicates that once a probe is found to hybridize, that probe will be considered to cover, or account for, X additional base pairs upstream and down stream of where the probe has bound. This parameter allows the number of total probes required to be reduced further because it will be understood that a probe, e.g. 100 base pair, will not only account for the 100 base pairs portion it directly binds to but may be reliably considered to capture a fragment that is at least 50 base pairs longer than the 100 base pair string. This parameter may vary between 0 and 200. In certain example embodiments, this parameter is set to 50.

This can be used, for example, in sequencing genomes of a virus for which a collection of genomes is available from previous studies, such as Ebola Zaire virus. The collection of available genomes from previous studies is taken as reference target. One aim may be the study and monitoring of the evolution of the virus, for example throughout an outbreak in order to determine proper actions to be taken for containing the outbreak and stopping it by sequencing regularly, if not systematically, the genome of the virus that infects a patient known to have contracted it.

The set cover solving process may be a weighted set cover solving process, i.e. each of the individual hybridization patterns is allocated a weight.

For example, a lower weight is allocated to those individual hybridization patterns that correspond to candidate probes that are specific to the target sequence and a higher weight is allocated to those individual hybridization patterns that correspond to candidate probes that are not specific to the target sequence. Thus, the method may further comprise determining the specificity of each candidate probe with regard to the target sequence. For example, determining the stringency of hybridization may be indicative of the specificity of the candidate probes. The higher weight is determined based on when a probe hybridizes to some other reference sequence (not a target), e.g., when blacklisting genomes or when doing identification. Another mismatch parameter may be utilized when assigning higher weights, which is usually a looser and more tolerant value. For example, there may be a mismatch parameter with a value of 3 for determining whether a probe hybridizes to a region of a target sequence, but a separate tolerant mismatch parameter with a value of 10 for determining whether a probe hits a blacklisted sequence or more than one virus type in identification. The reason is desired increased sensitivity in determining these kinds of hits and more specificity in determining where probes cover target sequences.

The weighted set cover solving process makes it possible to reduce substantially, if not dramatically, the number of selected probes needed to deplete one or more contaminants contained in the sample. Indeed, as mentioned above, the target sequences usually amount to only a small fraction of the sample. Thus, it might be interesting to generate selected probes that do not hit or hybridize one or more contaminants or fragments thereof. The one or more contaminants may be considered as blacklisted sequence or sequences that are unwanted and the analysis of which is not contemplated. To this aim, a higher weight is allocated to those individual hybridization patterns corresponding to candidate probes that hit at least one blacklisted sequence. "Hit" is intended to mean that the candidate probes linked to the blacklisted sequence, for example by hybridizing it. When an individual hybridization pattern is allocated a higher weight, it does not necessarily mean that the corresponding candidate probe is dismissed from being selected.

In this aim, the method may further comprise determining which candidate probes are specific to the target sequence and which candidate probes are not. For example, determining the stringency of hybridization may be indicative of the specificity of the candidate probes. The higher weight is determined based on when a probe hybridizes to some other reference sequence (not a target), e.g., when blacklisting genomes or when doing identification. Another mismatch parameter may be utilized when assigning higher weights, which is usually a looser and more tolerant value. For example, there may be a mismatch parameter with a value of 3 for determining whether a probe hybridizes to a region of a target sequence, but a separate tolerant mismatch parameter with a value of 10 for determining whether a probe hits a blacklisted sequence or more than one virus type in identification. The reason is desired increased sensitivity in determining these kinds of hits and more specific in determining where probes cover target sequences.

Thus, the reference sequence forms a universe of elements that are the nucleotides (position within the genomes being considered as differentiating nucleotides of the same type). If X designates the reference sequence and y designates a position within the corresponding genome, an element of the universe can be represented by (X, y), which is understood as the nucleotide in position y in the reference sequence X, or simply (y) because all y belongs to the same reference sequence. Candidate probes are obtaining by fragmenting the reference sequence. It is then determined which candidate probes are specific to the target sequence and which are not. The individual hybridization patterns are subsets of the universe. The individual hybridization pattern of a candidate probe of length L and which is specific to the target sequence can be represented as (w, {(ai), (ai+1) ... (ai+L), (aj), (aj+1) ... (aj+L)}), otherwise represented as (w, {(ai ... ai+L), (aj aj+L)}) (subset covering nucleotides in position ai to ai+L ... and aj to aj+L to which a weight w is given). The individual hybridization pattern of a candidate probe of length L and which is not specific to the target sequence would be represented in the same manner but will receive weight W instead, wherein W>w, preferably W>>w, more preferably W is infinity and w is 1.

If the reference sequence is a collection of reference sequences, then the individual hybridization pattern of a candidate probe of length L and which is specific to the target sequence can be represented as (V, {(A, ai), (A, ai+1) ... (A, ai+L), (A, aj), (A, aj+1) ... (A, aj+L), (B, bi), (B, bi+1) ... (B, bi+L)}), otherwise represented as (V, {A:(ai ... ai+L), (aj ... aj+L); B:(bi ... bi+L) ... }) (subset covering nucleotides in position ai to ai+L and aj to aj+L in genome A, nucleotides in position bi to bi+L in genome B ... to which a weight V is given).

Allocating the same weight to all the individual hybridization patterns amounts to an un-weighted set cover solving process, in other words a set cover solving process without allocation of any weight such as described above. Both weighted set cover solving process and un-weighted set cover solving process are contemplated by the invention.

A higher number of allowed mismatches than for the un-weighted set cover solving process may be used, which is considered to be a separate, more tolerant parameter choice—in addition to the regular mismatch parameter that would be used (in the un-weighted problem) for determining hybridizations to target sequences. But, if the higher number does not replace the lower number; it is an additional parameter.

The set cover solving process may be a partial set cover solving process, i.e. a full coverage of the target sequence is not necessary so that a desired percentage of coverage of the target sequence is sufficient. In other words, the selected probes collectively have a hybridization pattern that covers a desired portion of the hybridization pattern. This approach may be useful for such purposes as identifying consensus regions between target sequences or alternatively of identifying highly variant regions between target sequences, for example for the purposes of SNP profiling. The percentage of coverage may be between 0%-100% or any range in between, for example the percentage of coverage may be from 1% to 99%, from 2% to 98%, from 5% to 95%, from 10% to 90%, from 20% to 80%, from 30% to 70%, from 40% to 60%, or about 50%. The percentage of coverage is advantageously about 0% to 10% for identification of shorter highly conserved regions or shorter highly variable regions or about 90% to about 100% over a full genome. The partial coverage may be determined at the step of constructing candidate probes capable of hybridizing a reference sequence. The input genomes may be modified to be just a portion of the original, and the set cover solving process could cover all 100% of that input. This could effectively yield a partial coverage of the original genomes. However, it is desirable to provide the entire (full) genomes, and supply some desired partial coverage as an initial parameter. The candidate probes are typically not affected by this partial coverage parameter (i.e., there are no fewer) as it is the set cover solution that decides which candidate probes to select to achieve the partial cover.

The set cover solving process may be a weighted partial set cover solving process, i.e. each of the individual hybridization patters is allocated a weight and a full coverage of the target sequence is not necessary so that a percentage of coverage of the target sequence is sufficient.

The weighted partial set cover solving process is a powerful tool to reduce substantially, if not dramatically, the number of selected probes that are needed to discover which target sequence is present in a given sample that may comprise a plurality of different sequences, potentially thousands of different sequences; e.g. a biological sample potentially which may comprise viral sequences of different viruses.

A way to do so is to allocate a higher weight to individual hybridization patterns corresponding to candidate probes that hit sequences of more than one species of virus or fragments thereof and to a lower weight to individual hybridization patterns corresponding to candidate probes that hit sequences of only one species of virus or fragment thereof. Preferably, the higher weight is infinite and the lower weight is 1. This results in the selected probes coming from regions of the sequences that is conserved within one species but divergent from other species.

One example of a process that approximates the solution to the set cover problem is the greedy method. The greedy method is an iterative method wherein at each iteration the solution that appears the best is chosen. When applied to the set cover problem, at each iteration the subset with the widest coverage of the yet uncovered universe is selected and the elements covered by the subset with the widest coverage are deleted from the yet uncovered universe. This is repeated until all the selected subsets collectively cover the entire universe, in other words the yet uncovered universe is empty.

Within the scope of the invention, this means that, at each iteration, the candidate probe with the widest individual hybridization pattern within yet uncovered portions of the reference sequence is selected as one of the selected probes. The selection is repeated amongst the remaining candidate probes until the selected probes collectively have a hybridization pattern along the length of the reference sequence, or in other words there are no more uncovered portion of the reference sequence.

Alternatively, in the case of partial set cover solving process or weighted partial set cover solving process, the iteration is repeated until the selected probes collectively have a hybridization pattern of a given percentage P of the reference sequence, i.e. P percent of the reference sequence is covered by the collective hybridization pattern of the selected probes.

Thus, compared to previous methods, where the list of probes is built down by eliminating unwanted candidate probes therefrom, the set cover solving process makes it possible to build up the list of selected probes by adding one selected probe to the list at each iteration.

What has been described for virus sequences also holds true for bacteria sequences or any other pathogenic sequences such as fungal sequences.

The method may further comprise minimizing a loss function depending on overhang parameters and mismatch parameters (or any parameters that alters the number of output probes) such that the total number of selected probes is no higher than a threshold number to provide input parameters to the set cover solving process. An overhang parameter ("cover extension") determines the number of nucleotides of one or both ends of a target sequence or a fragment thereof that remain unpaired once the target sequence or the fragment thereof hybridizes a selected probe. The higher the overhang parameter is, the lower the number of selected probes output by the set cover solving process. The value of the overhang parameters can range from 0 to 200 bp; and any sub-range therein. A mismatch parameter is the acceptable number of mismatches between a selected probe and the target sequence or the fragment thereof. The higher the mismatch parameter is, the lower the number of selected probes. In certain example embodiments, the mismatch parameter may have a range from 0 to 9.

In case of a plurality of target sequence types, one overhang parameter and one mismatch parameter is assigned to each target sequence or types thereof. The values of the overhang and mismatch parameters may be indicative of the diversity of the target sequence especially when selecting these parameters under the constraint of having a fixed number of probes.

The loss function is constructed so that the higher the value of the overhang parameter, the higher the value of the loss function and the higher the value of the mismatch parameter, the higher the value of the loss function.

The use of a constraint while minimizing the loss function ensures that the number of selected probes remains lower than a reasonable amount depending on the application of the selected probes. The desired coverage is usually fixed, which is indeed a parameter, separately (since there is less flexibility about it).

Step (b1) and (c1) of the method may be respectively replaced by (b2) assessing redundancy between candidate probes and (c2) subjecting the candidate probes to a dominating set solving process to reduce the number of candidate probes to provide a selected probes, any candidate probe being either a selected probe or redundant to a selected probe.

Figure 5:
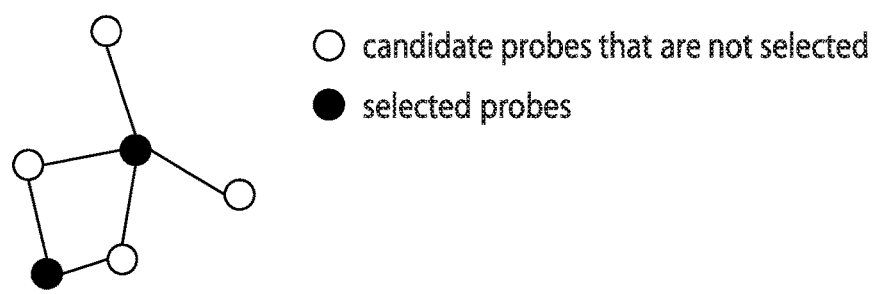
FIG. 5 shows one graph and one solution of the dominating set problem.
Figure 6:
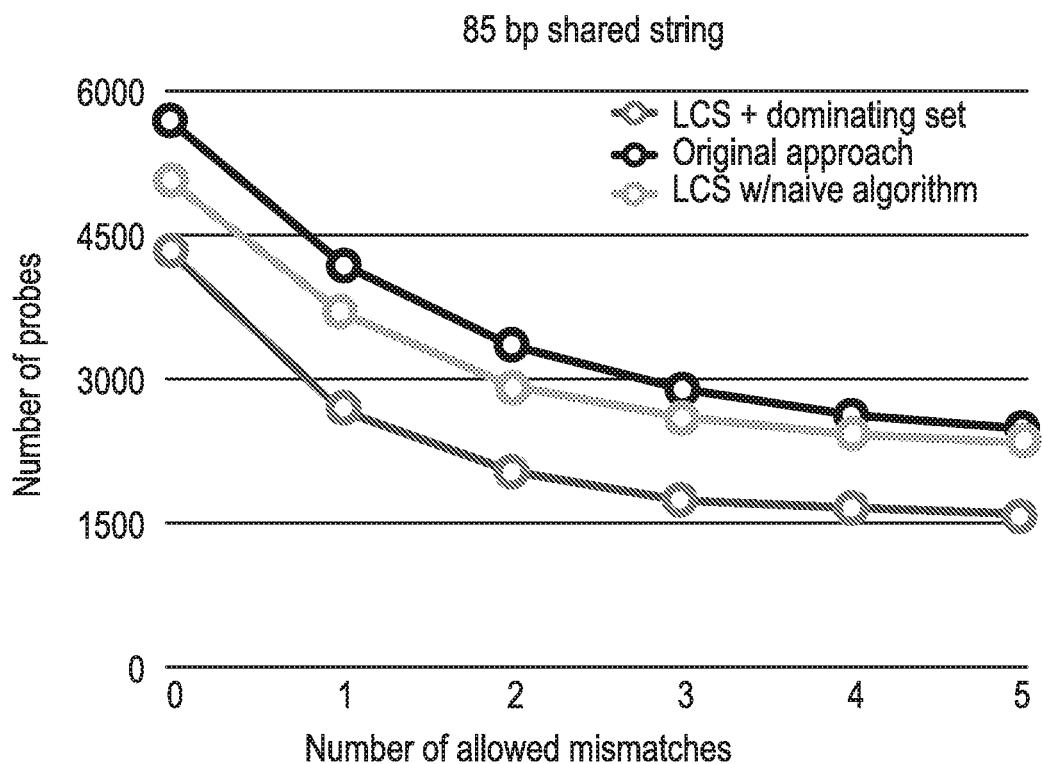
FIGS. 6-11 graphically show the number of selected probes generated as output of Example 1.1, Example 1.2 and Comparative example 1.
Figure 7:
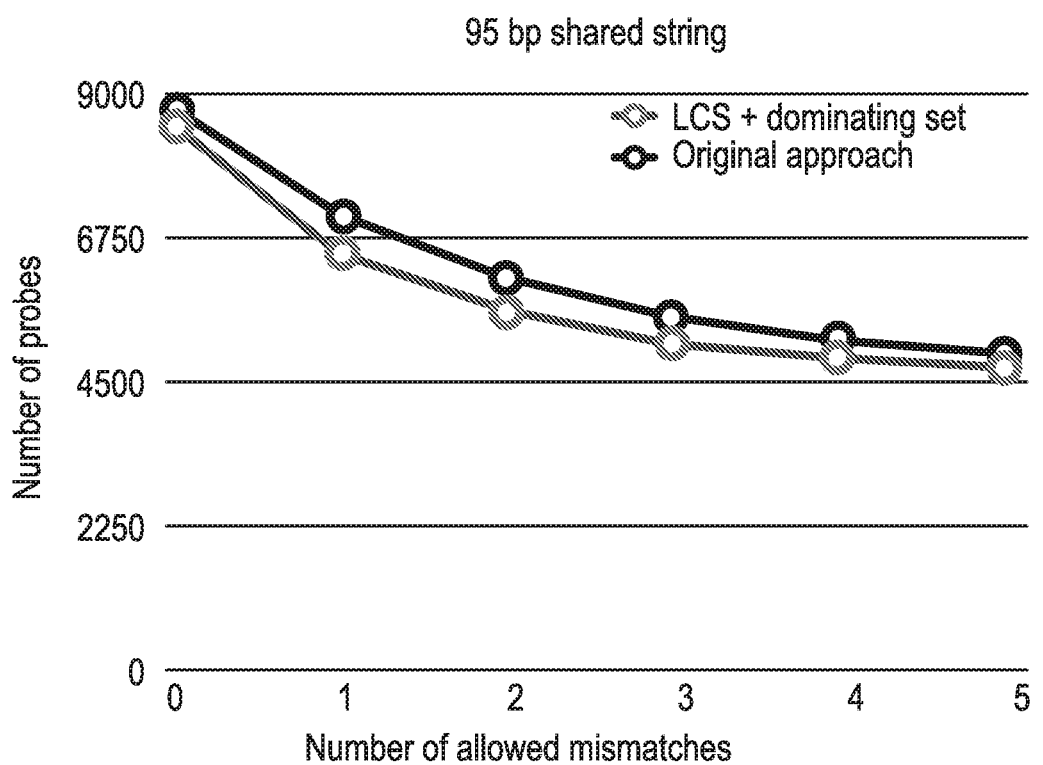
Figure 8:
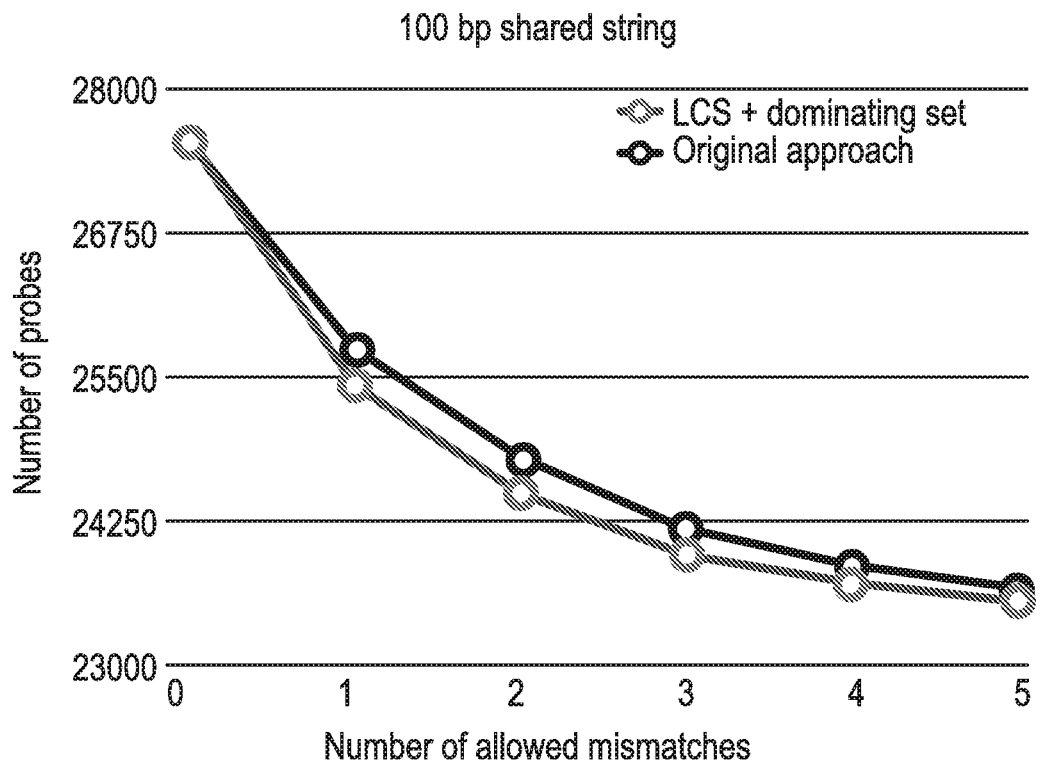
Figure 9:
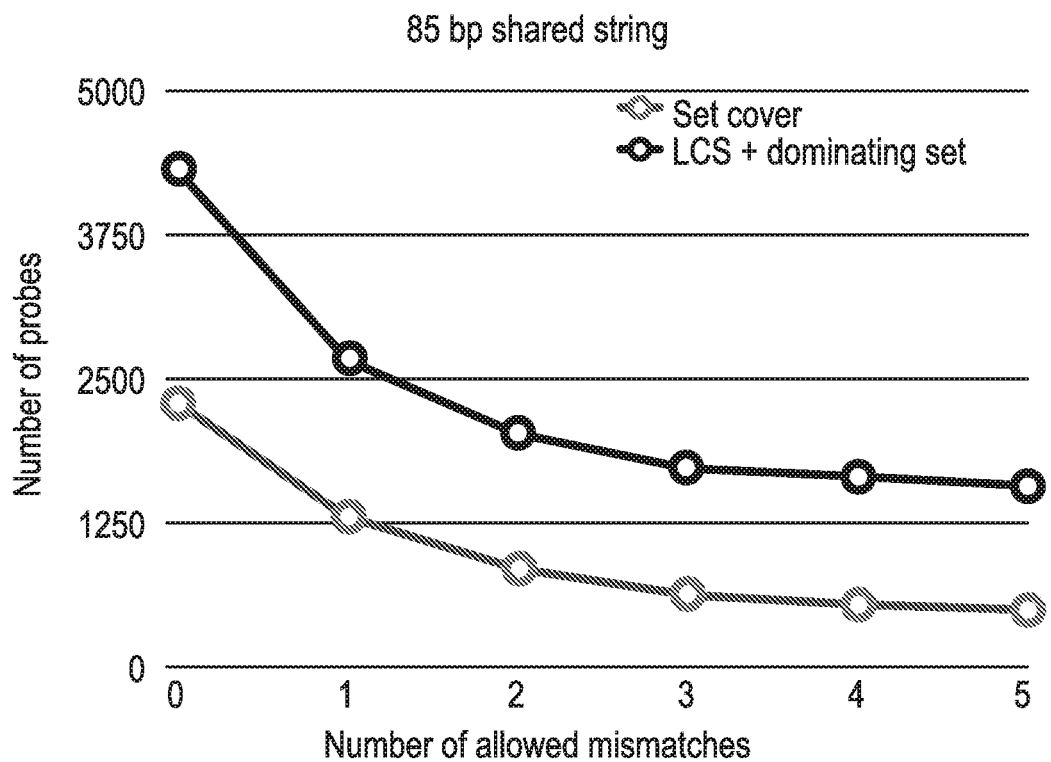
Figure 10:
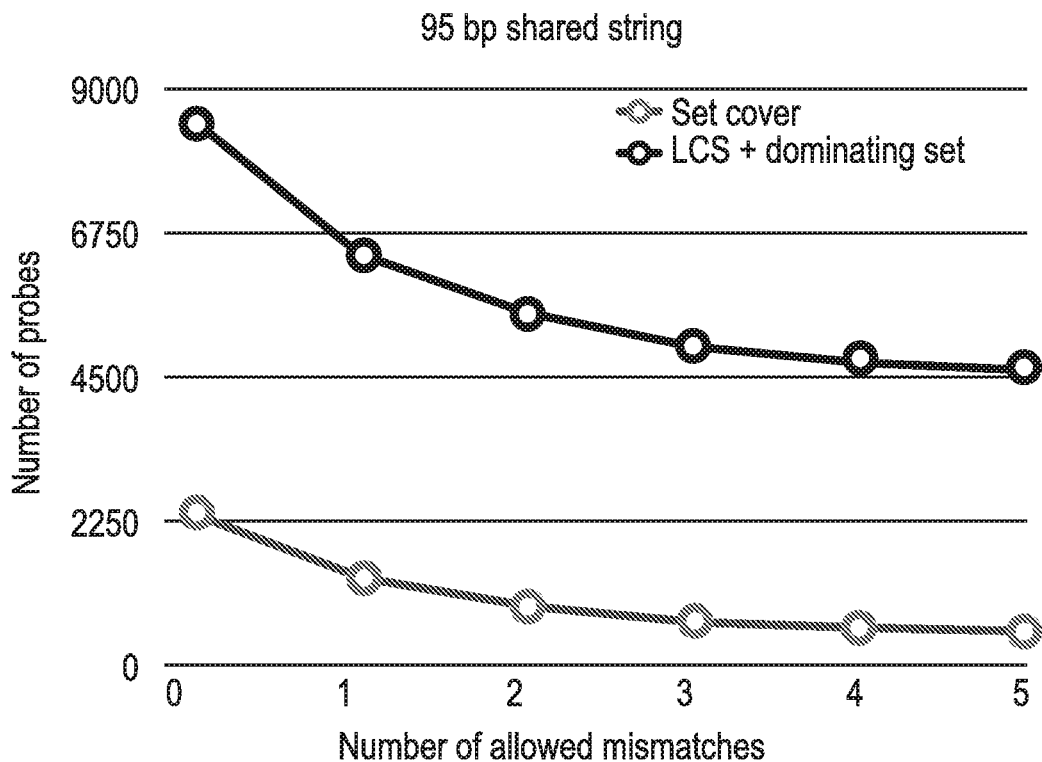
Figure 11:
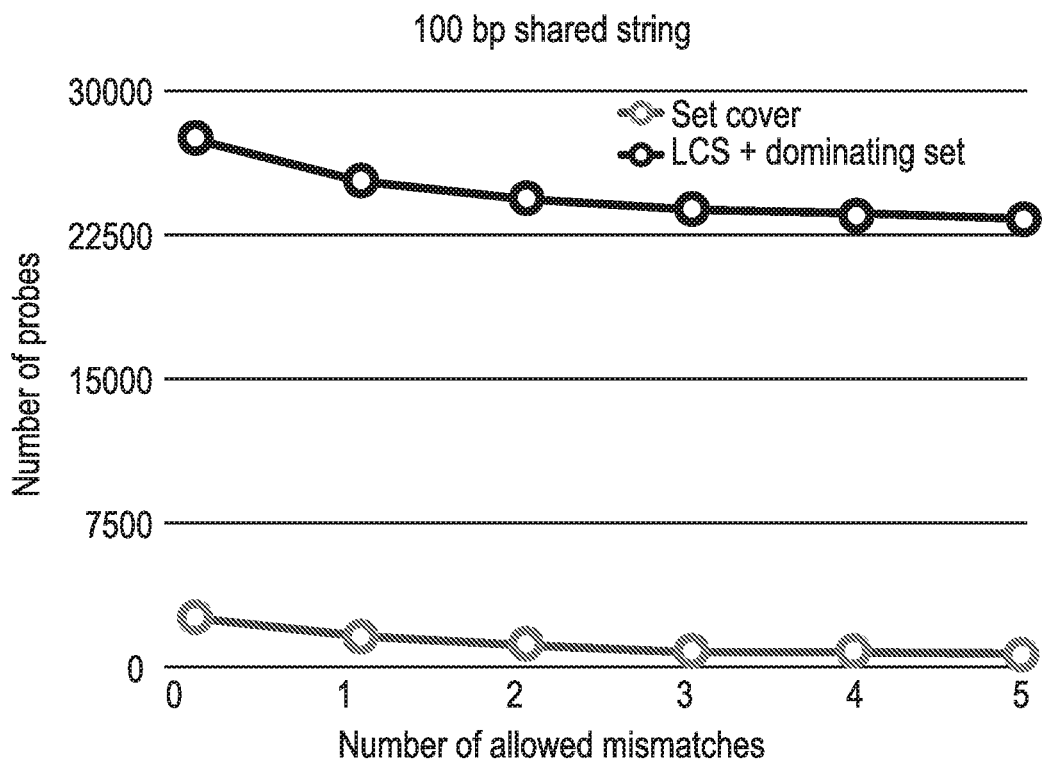

The solving process may further be a dominating set solving process, which solves the dominating set problem. The dominating set problem concerns a graph with a number of nodes linked to each other according to a certain pattern. The graph may comprise vertices and edges connecting two vertices to each other (FIG. 5 showing one graph and one solution of the dominating set problem). The dominating set problem may be described as finding a minimal set of vertices D, call the dominating vertices, such that each vertex in the graph is either in D or is adjacent to a vertex in D. A practical solution to the problem would approximate the smallest number. In the case of the present invention, each candidate probe is a vertex and if two candidate probes are redundant to each other, they are connected together by an edge. The graph does not need to be actually built; it is only mentioned to provide a visual reference to the reader.

The dominating set solving process is a process that solves the dominating set problem or any problem equivalent to the dominating set problem. Other problems include, but not limited to, framing a set cover problem as an "integer linear program" ("ILP"), a type of model in optimization which shows how the solution can be approximated with a technique called "linear programming relaxation" ("LP relaxation"). Specifically, the kind of relaxation used is called "LP-rounding" which is an example of another (non-greedy) way to approximate a solution to the set cover problem. (see, e.g., Chapter 13 and 14 of "Approximation Algorithms" by Vijay Vazirani. The article "On the hardness of approximating minimization problems" by Lund and Yannakakis (Lund, Carsten & Yannakakis, Mihalis. (1994). On the Hardness of Approximating Minimization Problems. J. ACM. 41. 960-981 lists some other problems 'equivalent' to set cover and also includes one of the first 'inapproximability results' for set cover. Unless certain widely believed conjectures in math turn out to be false, no method can give a solution to the problem that is "too much better" than the one given by the greedy algorithm. The result of another method cannot be better than the greedy algorithm by anything more than a constant factor.

The selected probes can be used in a composition form, as part of a kit or a system for enrichment of genomic DNA of a target organism in a sample that may comprise both DNA of the target organism and non-specific DNA. The kit may comprise the selected probes, e.g. in a composition form, and a solid phase operably linked to the selected probes. The system may comprise the selected probes, i.e. in a composition form; a sample containing DNA of said target organism and the non-specific DNA; and a solid phase operably connected to the selected probes.

The solid phase may be a chip or beads. The selected probes may further comprise an adapter, for example a label. Each selected probes may comprise two adapter. Preferably, a first adapter is alternated with a second adapter.

The selected probes that are generated by the method for generating probes for use in analyzing a sample which may comprise a target sequence described above can be used in a method of analyzing a sample which may comprise a target sequence or a fragment thereof. This method may comprise (a) contacting the selected probes to the target sequence or a fragment thereof; and (b) analyzing the target sequence or fragment thereof that hybridizes to one or more of the selected probes.

Analyzing the target sequence or fragment thereof that hybridizes to one or more of the selected probes may be a sequencing analysis further which may comprise sequencing the target sequence or fragment thereof that hybridizes to one or more of the selected probes. Various sequencing processes may be used and are described as follows.

RNA sequencing (RNA-Seq) is a powerful tool for transcriptome profiling, but is hampered by sequence-dependent bias and inaccuracy at low copy numbers intrinsic to exponential PCR amplification. To mitigate these complications to allow truly digital RNA-Seq, a large set of barcode sequences is added in excess, and nearly every cDNA molecule is uniquely labeled by random attachment of barcode sequences to both ends (Shiroguchi K, et al. Proc Natl Acad Sci USA. 2012 Jan. 24;109(4):1347-52). After PCR, paired-end deep sequencing is applied to read the two barcodes and cDNA sequences. Rather than counting the number of reads, RNA abundance is measured based on the number of unique barcode sequences observed for a given cDNA sequence (Shiroguchi K, et al. Proc Natl Acad Sci USA. 2012 Jan. 24;109(4):1347-52). The barcodes may be optimized to be unambiguously identifiable, even in the presence of multiple sequencing errors. This method allows counting with single-copy resolution despite sequence-dependent bias and PCR-amplification noise, and is analogous to digital PCR but amendable to quantifying a whole transcriptome (Shiroguchi K, et al. Proc Natl Acad Sci USA. 2012 Jan. 24;109(4):1347-52).

Fixation of cells or tissue may involve the use of cross-linking agents, such as formaldehyde, and may involve embedding cells or tissue in a paraffin wax or polyacrylamide support matrix (Chung K, et al. Nature. 2013 May 16; 497(7449): 322-7).

Amplification may involve thermocycling or isothermal amplification (such as through the methods RPA or LAMP). Cross-linking may involve overlap-extension PCR or use of ligase to associate multiple amplification products with each other.

For purpose of this invention, amplification means any method employing a primer and a polymerase capable of replicating a target sequence with reasonable fidelity. Amplification may be carried out by natural or recombinant DNA polymerases such as TaqGold™, T7 DNA polymerase, Klenow fragment of *E. coli* DNA polymerase, and reverse transcriptase. A preferred amplification method is PCR. In particular, the isolated RNA can be subjected to a reverse transcription assay that is coupled with a quantitative polymerase chain reaction (RT-PCR) in order to quantify the expression level of a sequence associated with a signaling biochemical pathway.

Detection of the gene expression level can be conducted in real time in an amplification assay. In one aspect, the amplified products can be directly visualized with fluorescent DNA-binding agents including but not limited to DNA intercalators and DNA groove binders. Because the amount of the intercalators incorporated into the double stranded DNA molecules is typically proportional to the amount of the amplified DNA products, one can conveniently determine the amount of the amplified products by quantifying the fluorescence of the intercalated dye using conventional optical systems in the art. DNA-binding dye suitable for this application include SYBR green, SYBR blue, DAPI, propidium iodine, Hoeste, SYBR gold, ethidium bromide, acridines, proflavine, acridine orange, acriflavine, fluorocoumarin, ellipticine, daunomycin, chloroquine, distamycin D, chromomycin, homidium, mithramycin, ruthenium polypyridyls, anthramycin, and the like.

In another aspect, other fluorescent labels such as sequence specific probes can be employed in the amplification reaction to facilitate the detection and quantification of the amplified products. Probe-based quantitative amplification relies on the sequence specific detection of a desired amplified product. It utilizes fluorescent, target-specific probes (e.g., TaqMan® probes) resulting in increased specificity and sensitivity. Methods for performing probe-based quantitative amplification are well established in the art and are taught in U.S. Pat. No. 5,210,015.

Sequencing may be performed on any high-throughput platform with read-length (either single- or paired-end) sufficient to cover both template and cross-linking event UID's. Methods of sequencing oligonucleotides and nucleic acids are well known in the art (see, e.g., WO93/23564, WO98/28440 and WO98/13523; U.S. Pat. Nos. 5,525,464; 5,202,231; 5,695,940; 4,971,903; 5,902,723; 5,795,782; 5,547,839 and 5,403,708; Sanger et al., Proc. Natl. Acad. Sci. USA 74:5463 (1977); Drmanac et al., Genomics 4:114 (1989); Koster et al., Nature Biotechnology 14:1123 (1996); Hyman, Anal. Biochem. 174:423 (1988); Rosenthal, International Patent Application Publication 761107 (1989); Metzker et al., Nucl. Acids Res. 22:4259 (1994); Jones, Biotechniques 22:938 (1997); Ronaghi et al., Anal. Biochem. 242:84 (1996); Ronaghi et al., Science 281:363 (1998); Nyren et al., Anal. Biochem. 151:504 (1985); Canard and Arzumanov, Gene 11:1 (1994); Dyatkina and Arzumanov, Nucleic Acids Symp Ser 18:117 (1987); Johnson et al., Anal. Biochem. 136:192 (1984); and Elgen and Rigler, Proc. Natl. Acad. Sci. USA 91(13):5740 (1994), all of which are expressly incorporated by reference).

The present invention may be applied to (1) single-cell transcriptomics: cDNA synthesized from mRNA is barcoded and cross-linked during in situ amplification, (2) single-cell proteomics: cDNA or DNA synthesized from RNA- or DNA-tagged antibodies of one or multiple specificities maps the abundance and distributions of different protein-antigens and (3) whole-tissue transcriptomic/proteomic mapping (molecular microscopy or VIPUR microscopy): using the frequency of cross-contamination between cells to determine their physical proximity, and via applications (1) single-cell transcriptomics and (2) single-cell proteomics, determining the global spatial distribution of mRNA, protein, or other biomolecules in a biological sample. This may be used, for example, to screen for anti-cancer/pathogen immunoglobulins (by analyzing co-localization of B-cells and T-cells within affected tissue) for immunotherapy.

The terms "polynucleotide", "nucleotide", "nucleotide sequence", "nucleic acid" and "oligonucleotide" are used interchangeably. They refer to a polymeric form of nucleotides of any length, either deoxyribonucleotides or ribonucleotides, or analogs thereof. Polynucleotides may have any three dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA, ribosomal RNA, short interfering RNA (siRNA), short-hairpin RNA (shRNA), micro-RNA (miRNA), ribozymes, cDNA, recombinant polynucleotides, branched polynucleotides, plasmids, vectors, isolated DNA of any sequence, isolated RNA of any sequence, nucleic acid probes, and primers. The term also encompasses nucleic-acid-like structures with synthetic backbones, see, e.g., Eckstein, 1991; Baserga et al., 1992; Milligan, 1993; WO 97/03211; WO 96/39154; Mata, 1997; Strauss-Soukup, 1997; and Samstag, 1996. A polynucleotide may comprise one or more modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component.

As used herein the term "variant" should be taken to mean the exhibition of qualities that differ, such as, but not limited to, genetic variations including SNPs, insertion deletion events, and the like.

The terms "non-naturally occurring" or "engineered" are used interchangeably and indicate the involvement of the hand of man. The terms, when referring to nucleic acid molecules or polypeptides mean that the nucleic acid molecule or the polypeptide is at least substantially free from at least one other component with which they are naturally associated in nature and as found in nature.

"Complementarity" refers to the ability of a nucleic acid to form hydrogen bond(s) with another nucleic acid sequence by either traditional Watson-Crick or other non-traditional types. A percent complementarity indicates the percentage of residues in a nucleic acid molecule which can form hydrogen bonds (e.g., Watson-Crick base pairing) with a second nucleic acid sequence (e.g., 5, 6, 7, 8, 9, 10 out of 10 being 50%, 60%, 70%, 80%, 90%, and 100% complementary). "Perfectly complementary" means that all the contiguous residues of a nucleic acid sequence will hydrogen bond with the same number of contiguous residues in a second nucleic acid sequence. "Substantially complementary" as used herein refers to a degree of complementarity that is at least 60%, 65%, 70%, 75%, 80%, 85%, 90%, 95%, 97%, 98%, 99%, or 100% over a region of 8, 9, 10, 11, 12, 13, 14, 15, 16, 17, 18, 19, 20, 21, 22, 23, 24, 25, 30, 35, 40, 45, 50, or more nucleotides, or refers to two nucleic acids that hybridize under stringent conditions.

As used herein, "stringent conditions" for hybridization refer to conditions under which a nucleic acid having complementarity to a target sequence predominantly hybridizes with the target sequence, and substantially does not hybridize to non-target sequences. Stringent conditions are generally sequence-dependent, and vary depending on a number of factors. In general, the longer the sequence, the higher the temperature at which the sequence specifically hybridizes to its target sequence. Non-limiting examples of stringent conditions are described in detail in Tijssen (1993), Laboratory Techniques In Biochemistry And Molecular Biology-Hybridization With Nucleic Acid Probes Part I, Second Chapter "Overview of principles of hybridization and the strategy of nucleic acid probe assay", Elsevier, N.Y.

"Hybridization" refers to a reaction in which one or more polynucleotides react to form a complex that is stabilized via hydrogen bonding between the bases of the nucleotide residues. The hydrogen bonding may occur by Watson Crick base pairing, Hoogsteen binding, or in any other sequence specific manner. The complex may comprise two strands forming a duplex structure, three or more strands forming a multi stranded complex, a single self-hybridizing strand, or any combination of these. A hybridization reaction may constitute a step in a more extensive process, such as the initiation of PCR, or the cleavage of a polynucleotide by an enzyme. A sequence capable of hybridizing with a given sequence is referred to as the "complement" of the given sequence.

As used herein, the term "genomic locus" or "locus" (plural loci) is the specific location of a gene or DNA sequence on a chromosome. A "gene" refers to stretches of DNA or RNA that encode a polypeptide or an RNA chain that has functional role to play in an organism and hence is the molecular unit of heredity in living organisms. For the purpose of this invention it may be considered that genes include regions which regulate the production of the gene product, whether or not such regulatory sequences are adjacent to coding and/or transcribed sequences. Accordingly, a gene includes, but is not necessarily limited to, promoter sequences, terminators, translational regulatory sequences such as ribosome binding sites and internal ribosome entry sites, enhancers, silencers, insulators, boundary elements, replication origins, matrix attachment sites and locus control regions.

As used herein, "expression of a genomic locus" or "gene expression" is the process by which information from a gene is used in the synthesis of a functional gene product. The products of gene expression are often proteins, but in non-protein coding genes such as rRNA genes or tRNA genes, the product is functional RNA. The process of gene expression is used by all known life—eukaryotes (including multicellular organisms), prokaryotes (bacteria and archaea) and viruses to generate functional products to survive. As used herein "expression" of a gene or nucleic acid encompasses not only cellular gene expression, but also the transcription and translation of nucleic acid(s) in cloning systems and in any other context. As used herein, "expression" also refers to the process by which a polynucleotide is transcribed from a DNA template (such as into and mRNA or other RNA transcript) and/or the process by which a transcribed mRNA is subsequently translated into peptides, polypeptides, or proteins. Transcripts and encoded polypeptides may be collectively referred to as "gene product." If the polynucleotide is derived from genomic DNA, expression may include splicing of the mRNA in a eukaryotic cell.

As described in aspects of the invention, sequence identity is related to sequence homology. Homology comparisons may be conducted by eye, or more usually, with the aid of readily available sequence comparison programs. These commercially available computer programs may calculate percent (%) homology between two or more sequences and may also calculate the sequence identity shared by two or more amino acid or nucleic acid sequences.

Sequence homologies may be generated by any of a number of computer programs known in the art, for example BLAST or FASTA, etc. A suitable computer program for carrying out such an alignment is the GCG Wisconsin Bestfit package (University of Wisconsin, U.S.A; Devereux et al., 1984, Nucleic Acids Research 12:387). Examples of other software than may perform sequence comparisons include, but are not limited to, the BLAST package (see Ausubel et al., 1999 ibid—Chapter 18), FASTA (Atschul et al., 1990, J. Mol. Biol., 403-410) and the GENEWORKS suite of comparison tools. Both BLAST and FASTA are available for offline and online searching (see Ausubel et al., 1999 ibid, pages 7-58 to 7-60). However it is preferred to use the GCG Bestfit program. % homology may be calculated over contiguous sequences, i.e., one sequence is aligned with the other sequence and each amino acid or nucleotide in one sequence is directly compared with the corresponding amino acid or nucleotide in the other sequence, one residue at a time. This is called an "ungapped" alignment. Typically, such ungapped alignments are performed only over a relatively short number of residues. Although this is a very simple and consistent method, it fails to take into consideration that, for example, in an otherwise identical pair of sequences, one insertion or deletion may cause the following amino acid residues to be put out of alignment, thus potentially resulting in a large reduction in % homology when a global alignment is performed. Consequently, most sequence comparison methods are designed to produce optimal alignments that take into consideration possible insertions and deletions without unduly penalizing the overall homology or identity score. This is achieved by inserting "gaps" in the sequence alignment to try to maximize local homology or identity. However, these more complex methods assign "gap penalties" to each gap that occurs in the alignment so that, for the same number of identical amino acids, a sequence alignment with as few gaps as possible—reflecting higher relatedness between the two compared sequences—may achieve a higher score than one with many gaps. "Affinity gap costs" are typically used that charge a relatively high cost for the existence of a gap and a smaller penalty for each subsequent residue in the gap. This is the most commonly used gap scoring system. High gap penalties may, of course, produce optimized alignments with fewer gaps. Most alignment programs allow the gap penalties to be modified. However, it is preferred to use the default values when using such software for sequence comparisons. For example, when using the GCG Wisconsin Bestfit package the default gap penalty for amino acid sequences is −12 for a gap and −4 for each extension. Calculation of maximum % homology therefore first requires the production of an optimal alignment, taking into consideration gap penalties. A suitable computer program for carrying out such an alignment is the GCG Wisconsin Bestfit package (Devereux et al., 1984 Nuc. Acids Research 12 p 387). Examples of other software than may perform sequence comparisons include, but are not limited to, the BLAST package (see Ausubel et al., 1999 Short Protocols in Molecular Biology, 4th Ed.—Chapter 18), FASTA (Altschul et al., 1990 J. Mol. Biol. 403-410) and the GENEWORKS suite of comparison tools. Both BLAST and FASTA are available for offline and online searching (see Ausubel et al., 1999, Short Protocols in Molecular Biology, pages 7-58 to 7-60). However, for some applications, it is preferred to use the GCG Bestfit program. A new tool, called BLAST 2 Sequences is also available for comparing protein and nucleotide sequences (see FEMS Microbiol Lett. 1999 174(2): 247-50; FEMS Microbiol Lett. 1999 177(1): 187-8 and the website of the National Center for Biotechnology information at the website of the National Institutes for Health). Although the final % homology may be measured in terms of identity, the alignment process itself is typically not based on an all-or-nothing pair comparison. Instead, a scaled similarity score matrix is generally used that assigns scores to each pair-wise comparison based on chemical similarity or evolutionary distance. An example of such a matrix commonly used is the BLOSUM62 matrix—the default matrix for the BLAST suite of programs. GCG Wisconsin programs generally use either the public default values or a custom symbol comparison table, if supplied (see user manual for further details). For some applications, it is preferred to use the public default values for the GCG package, or in the case of other software, the default matrix, such as BLOSUM62.

Alternatively, percentage homologies may be calculated using the multiple alignment feature in DNASIS™ (Hitachi Software), based on an algorithm, analogous to CLUSTAL (Higgins D G & Sharp P M (1988), Gene 73(1), 237-244). Once the software has produced an optimal alignment, it is possible to calculate % homology, preferably % sequence identity. The software typically does this as part of the sequence comparison and generates a numerical result.

Embodiments of the invention include sequences (both polynucleotide or polypeptide) which may comprise homologous substitution (substitution and replacement are both used herein to mean the interchange of an existing amino acid residue or nucleotide, with an alternative residue or nucleotide) that may occur i.e., like-for-like substitution in the case of amino acids such as basic for basic, acidic for acidic, polar for polar, etc. Non-homologous substitution may also occur i.e., from one class of residue to another or alternatively involving the inclusion of unnatural amino acids such as ornithine (hereinafter referred to as Z), diaminobutyric acid ornithine (hereinafter referred to as B), norleucine ornithine (hereinafter referred to as O), pyridyl-alanine, thienylalanine, naphthylalanine and phenylglycine.

The practice of the present invention employs, unless otherwise indicated, conventional techniques of immunology, biochemistry, chemistry, molecular biology, microbiology, cell biology, genomics and recombinant DNA, which are within the skill of the art. See Sambrook, Fritsch and Maniatis, MOLECULAR CLONING: A LABORATORY MANUAL, 2nd edition (1989); CURRENT PROTOCOLS IN MOLECULAR BIOLOGY (F. M. Ausubel, et al. eds., (1987)); the series METHODS IN ENZYMOLOGY (Academic Press, Inc.): PCR 2: A PRACTICAL APPROACH (M. J. MacPherson, B. D. Hames and G. R. Taylor eds. (1995)), Harlow and Lane, eds. (1988) ANTIBODIES, A LABORATORY MANUAL, and ANIMAL CELL CULTURE (R. I. Freshney, ed. (1987)).

Hybridization can be performed under conditions of various stringency. Suitable hybridization conditions for the practice of the present invention are such that the recognition interaction between the probe and sequences associated with a signaling biochemical pathway is both sufficiently specific and sufficiently stable. Conditions that increase the stringency of a hybridization reaction are widely known and published in the art. See, for example, (Sambrook, et al., (1989); Nonradioactive In Situ Hybridization Application Manual, Boehringer Mannheim, second edition). The hybridization assay can be formed using probes immobilized on any solid support, including but are not limited to nitrocellulose, glass, silicon, and a variety of gene arrays. A preferred hybridization assay is conducted on high-density gene chips as described in U.S. Pat. No. 5,445,934.

For a convenient detection of the probe-target complexes formed during the hybridization assay, the nucleotide probes are conjugated to a detectable label. Detectable labels suitable for use in the present invention include any composition detectable by photochemical, biochemical, spectroscopic, immunochemical, electrical, optical or chemical means. A wide variety of appropriate detectable labels are known in the art, which include fluorescent or chemiluminescent labels, radioactive isotope labels, enzymatic or other ligands. In preferred embodiments, one will likely desire to employ a fluorescent label or an enzyme tag, such as digoxigenin, β-galactosidase, urease, alkaline phosphatase or peroxidase, avidin/biotin complex.

The detection methods used to detect or quantify the hybridization intensity will typically depend upon the label selected above. For example, radiolabels may be detected using photographic film or a phosphoimager. Fluorescent markers may be detected and quantified using a photodetector to detect emitted light. Enzymatic labels are typically detected by providing the enzyme with a substrate and measuring the reaction product produced by the action of the enzyme on the substrate; and finally colorimetric labels are detected by simply visualizing the colored label.

Examples of the labeling substance which may be employed include labeling substances known to those skilled in the art, such as fluorescent dyes, enzymes, coenzymes, chemiluminescent substances, and radioactive substances. Specific examples include radioisotopes (e.g., 32P, 14C, 125I, 3H, and 131I), fluorescein, rhodamine, dansyl chloride, umbelliferone, luciferase, peroxidase, alkaline phosphatase, β-galactosidase, β-glucosidase, horseradish peroxidase, glucoamylase, lysozyme, saccharide oxidase, microperoxidase, biotin, and ruthenium. In the case where biotin is employed as a labeling substance, preferably, after addition of a biotin-labeled antibody, streptavidin bound to an enzyme (e.g., peroxidase) is further added.

Advantageously, the label is a fluorescent label. Examples of fluorescent labels include, but are not limited to, Atto dyes, 4-acetamido-4'-isothiocyanatostilbene-2,2'disulfonic acid; acridine and derivatives: acridine, acridine isothiocyanate; 5-(2'-aminoethyl)aminonaphthalene-1-sulfonic acid (EDANS); 4-amino-N-[3-vinyl sulfonyl)phenyl]naphthalimide-3,5 disulfonate; N-(4-anilino-1-naphthyl)maleimide; anthranilamide; BODIPY; Brilliant Yellow; coumarin and derivatives; coumarin, 7-amino-4-methylcoumarin (AMC, Coumarin 120), 7-amino-4-trifluoromethylcoumarin (Coumaran 151); cyanine dyes; cyanosine; 4',6-diamidino-2-phenylindole (DAPI); 5'5"-dibromopyrogallol-sulfonphthalein (Bromopyrogallol Red); 7-diethylamino-3-(4'-isothiocyanatophenyl)-4-methylcoumarin; diethylenetriamine pentaacetate; 4,4'-diisothiocyanatodihydro-stilbene-2,2'-disulfonic acid; 4,4'-diisothiocyanatostilbene-2,2'-disulfonic acid; 5-[dimethylamino]naphthalene-1-sulfonyl chloride (DNS, dansylchloride);

4-dimethylaminophenylazophenyl-4'-isothiocyanate (DABITC); eosin and derivatives; eosin, eosin isothiocyanate, erythrosin and derivatives; erythrosin B, erythrosin, isothiocyanate; ethidium; fluorescein and derivatives; 5-carboxyfluorescein (FAM), 5-(4,6-dichlorotriazin-2-yl)aminofluorescein (DTAF), 2',7'-dimethoxy-4'5'-dichloro-6-carboxyfluorescein, fluorescein, fluorescein isothiocyanate, QFITC, (XRITC); fluorescamine; IR144; IR1446; Malachite Green isothiocyanate; 4-methylumbelliferoneortho cresolphthalein; nitrotyrosine; pararosaniline; Phenol Red; B-phycoerythrin; o-phthaldialdehyde; pyrene and derivatives: pyrene, pyrene butyrate, succinimidyl 1-pyrene; butyrate quantum dots; Reactive Red 4 (Cibacron™ Brilliant Red 3B-A) rhodamine and derivatives: 6-carboxy-X-rhodamine (ROX), 6-carboxyrhodamine (R6G), lissamine rhodamine B sulfonyl chloride rhodamine (Rhod), rhodamine B, rhodamine 123, rhodamine X isothiocyanate, sulforhodamine B, sulforhodamine 101, sulfonyl chloride derivative of sulforhodamine 101 (Texas Red); N,N,N',N' tetramethyl-6-carboxyrhodamine (TAMRA); tetramethyl rhodamine; tetramethyl rhodamine isothiocyanate (TRITC); riboflavin; rosolic acid; terbium chelate derivatives; Cy3; Cy5; Cy5.5; Cy7; IRD 700; IRD 800; La Jolta Blue; phthalocyanine; and naphthalocyanine The fluorescent label may be a fluorescent protein, such as blue fluorescent protein, cyan fluorescent protein, green fluorescent protein, red fluorescent protein, yellow fluorescent protein or any photoconvertible protein. Colorimetric labeling, bioluminescent labeling and/or chemiluminescent labeling may further accomplish labeling. Labeling further may include energy transfer between molecules in the hybridization complex by perturbation analysis, quenching, or electron transport between donor and acceptor molecules, the latter of which may be facilitated by double stranded match hybridization complexes. The fluorescent label may be a perylene or a terylene. In the alternative, the fluorescent label may be a fluorescent bar code.

In an advantageous embodiment, the label may be light sensitive, wherein the label is light-activated and/or light cleaves the one or more linkers to release the molecular cargo. The light-activated molecular cargo may be a major light-harvesting complex (LHCII). In another embodiment, the fluorescent label may induce free radical formation.

In an advantageous embodiment, agents may be uniquely labeled in a dynamic manner (see, e.g., international patent application serial no. PCT/US2013/61182 filed Sep. 23, 2012). The unique labels are, at least in part, nucleic acid in nature, and may be generated by sequentially attaching two or more detectable oligonucleotide tags to each other and each unique label may be associated with a separate agent. A detectable oligonucleotide tag may be an oligonucleotide that may be detected by sequencing of its nucleotide sequence and/or by detecting non-nucleic acid detectable moieties to which it may be attached.

The oligonucleotide tags may be detectable by virtue of their nucleotide sequence, or by virtue of a non-nucleic acid detectable moiety that is attached to the oligonucleotide such as but not limited to a fluorophore, or by virtue of a combination of their nucleotide sequence and the nonnucleic acid detectable moiety.

In some embodiments, a detectable oligonucleotide tag may comprise one or more nonoligonucleotide detectable moieties. Examples of detectable moieties may include, but are not limited to, fluorophores, microparticles including quantum dots (Empodocles, et al., Nature 399:126-130, 1999), gold nanoparticles (Reichert et al., Anal. Chem. 72:6025-6029, 2000), biotin, DNP (dinitrophenyl), fucose, digoxigenin, haptens, and other detectable moieties known to those skilled in the art. In some embodiments, the detectable moieties may be quantum dots. Methods for detecting such moieties are described herein and/or are known in the art.

Thus, detectable oligonucleotide tags may be, but are not limited to, oligonucleotides which may comprise unique nucleotide sequences, oligonucleotides which may comprise detectable moieties, and oligonucleotides which may comprise both unique nucleotide sequences and detectable moieties.

A unique label may be produced by sequentially attaching two or more detectable oligonucleotide tags to each other. The detectable tags may be present or provided in a plurality of detectable tags. The same or a different plurality of tags may be used as the source of each detectable tag may be part of a unique label. In other words, a plurality of tags may be subdivided into subsets and single subsets may be used as the source for each tag.

In some embodiments, a detectable oligonucleotide tag may comprise one or more non-oligonucleotide detectable moieties. Examples of detectable moieties include, but are not limited to, fluorophores, microparticles including quantum dots (Empodocles, et al., Nature 399:126-130, 1999), gold nanoparticles (Reichert et al., Anal. Chem. 72:6025-6029, 2000), biotin, DNP (dinitrophenyl), fucose, digoxigenin, haptens, and other detectable moieties known to those skilled in the art. In some embodiments, the detectable moieties are quantum dots. Methods for detecting such moieties are described herein and/or are known in the art.

Thus, detectable oligonucleotide tags may be, but are not limited to, oligonucleotides which may comprise unique nucleotide sequences, oligonucleotides which may comprise detectable moieties, and oligonucleotides which may comprise both unique nucleotide sequences and detectable moieties.

A unique nucleotide sequence may be a nucleotide sequence that is different (and thus distinguishable) from the sequence of each detectable oligonucleotide tag in a plurality of detectable oligonucleotide tags. A unique nucleotide sequence may also be a nucleotide sequence that is different (and thus distinguishable) from the sequence of each detectable oligonucleotide tag in a first plurality of detectable oligonucleotide tags but identical to the sequence of at least one detectable oligonucleotide tag in a second plurality of detectable oligonucleotide tags. A unique sequence may differ from other sequences by multiple bases (or base pairs). The multiple bases may be contiguous or non-contiguous. Methods for obtaining nucleotide sequences (e.g., sequencing methods) are described herein and/or are known in the art.

In some embodiments, detectable oligonucleotide tags comprise one or more of a ligation sequence, a priming sequence, a capture sequence, and a unique sequence (optionally referred to herein as an index sequence). A ligation sequence is a sequence complementary to a second nucleotide sequence which allows for ligation of the detectable oligonucleotide tag to another entity which may comprise the second nucleotide sequence, e.g., another detectable oligonucleotide tag or an oligonucleotide adapter. A priming sequence is a sequence complementary to a primer, e.g., an oligonucleotide primer used for an amplification reaction such as but not limited to PCR. A capture sequence is a sequence capable of being bound by a capture entity. A capture entity may be an oligonucleotide which may comprise a nucleotide sequence complementary to a capture sequence, e.g. a second detectable oligonucleotide tag. A capture entity may also be any other entity capable of binding to the capture sequence, e.g. an antibody, hapten or peptide. An index sequence is a sequence which may comprise a unique nucleotide sequence and/or a detectable moiety as described above.

"Complementary" is a term which is used to indicate a sufficient degree of complementarity between two nucleotide sequences such that stable and specific binding occurs between one and preferably more bases (or nucleotides, as the terms are used interchangeably herein) of the two sequences. For example, if a nucleotide in a first nucleotide sequence is capable of hydrogen bonding with a nucleotide in second nucleotide sequence, then the bases are considered to be complementary to each other. Complete (i.e., 100%) complementarity between a first nucleotide sequence and a second nucleotide is preferable, but not required for ligation, priming, or capture sequences.

The present invention also relates to a computer system involved in carrying out the methods of the invention relating to both computations and sequencing.

A computer system (or digital device) may be used to receive, transmit, display and/or store results, analyze the results, and/or produce a report of the results and analysis. A computer system may be understood as a logical apparatus that can read instructions from media (e.g. software) and/or network port (e.g. from the internet), which can optionally be connected to a server having fixed media. A computer system may comprise one or more of a CPU, disk drives, input devices such as keyboard and/or mouse, and a display (e.g. a monitor). Data communication, such as transmission of instructions or reports, can be achieved through a communication medium to a server at a local or a remote location. The communication medium can include any means of transmitting and/or receiving data. For example, the communication medium can be a network connection, a wireless connection, or an internet connection. Such a connection can provide for communication over the World Wide Web. It is envisioned that data relating to the present invention can be transmitted over such networks or connections (or any other suitable means for transmitting information, including but not limited to mailing a physical report, such as a print-out) for reception and/or for review by a receiver. The receiver can be but is not limited to an individual, or electronic system (e.g. one or more computers, and/or one or more servers).

In some embodiments, the computer system may comprise one or more processors. Processors may be associated with one or more controllers, calculation units, and/or other units of a computer system, or implanted in firmware as desired. If implemented in software, the routines may be stored in any computer readable memory such as in RAM, ROM, flash memory, a magnetic disk, a laser disk, or other suitable storage medium. Likewise, this software may be delivered to a computing device via any known delivery method including, for example, over a communication channel such as a telephone line, the internet, a wireless connection, etc., or via a transportable medium, such as a computer readable disk, flash drive, etc. The various steps may be implemented as various blocks, operations, tools, modules and techniques which, in turn, may be implemented in hardware, firmware, software, or any combination of hardware, firmware, and/or software. When implemented in hardware, some or all of the blocks, operations, techniques, etc. may be implemented in, for example, a custom integrated circuit (IC), an application specific integrated circuit (ASIC), a field programmable logic array (FPGA), a programmable logic array (PLA), etc.

A client-server, relational database architecture can be used in embodiments of the invention. A client-server architecture is a network architecture in which each computer or process on the network is either a client or a server. Server computers are typically powerful computers dedicated to managing disk drives (file servers), printers (print servers), or network traffic (network servers). Client computers include PCs (personal computers) or workstations on which users run applications, as well as example output devices as disclosed herein. Client computers rely on server computers for resources, such as files, devices, and even processing power. In some embodiments of the invention, the server computer handles all of the database functionality. The client computer can have software that handles all the front-end data management and can also receive data input from users.

A machine readable medium which may comprise computer-executable code may take many forms, including but not limited to, a tangible storage medium, a carrier wave medium or physical transmission medium. Non-volatile storage media include, for example, optical or magnetic disks, such as any of the storage devices in any computer(s) or the like, such as may be used to implement the databases, etc. shown in the drawings. Volatile storage media include dynamic memory, such as main memory of such a computer platform. Tangible transmission media include coaxial cables; copper wire and fiber optics, including the wires that comprise a bus within a computer system. Carrier-wave transmission media may take the form of electric or electromagnetic signals, or acoustic or light waves such as those generated during radio frequency (RF) and infrared (IR) data communications. Common forms of computer-readable media therefore include for example: a floppy disk, a flexible disk, hard disk, magnetic tape, any other magnetic medium, a CD-ROM, DVD or DVD-ROM, any other optical medium, punch cards paper tape, any other physical storage medium with patterns of holes, a RAM, a ROM, a PROM and EPROM, a FLASH-EPROM, any other memory chip or cartridge, a carrier wave transporting data or instructions, cables or links transporting such a carrier wave, or any other medium from which a computer may read programming code and/or data. Many of these forms of computer readable media may be involved in carrying one or more sequences of one or more instructions to a processor for execution.

The subject computer-executable code can be executed on any suitable device which may comprise a processor, including a server, a PC, or a mobile device such as a smartphone or tablet. Any controller or computer optionally includes a monitor, which can be a cathode ray tube ("CRT") display, a flat panel display (e.g., active matrix liquid crystal display, liquid crystal display, etc.), or others. Computer circuitry is often placed in a box, which includes numerous integrated circuit chips, such as a microprocessor, memory, interface circuits, and others. The box also optionally includes a hard disk drive, a floppy disk drive, a high capacity removable drive such as a writeable CD-ROM, and other common peripheral elements. Inputting devices such as a keyboard, mouse, or touch-sensitive screen, optionally provide for input from a user. The computer can include appropriate software for receiving user instructions, either in the form of user input into a set of parameter fields, e.g., in a GUI, or in the form of preprogrammed instructions, e.g., preprogrammed for a variety of different specific operations.

The present invention also contemplates multiplex assays. The present invention is especially well suited for multiplex assays. For example, the invention encompasses use of a SureSelectXT, SureSelectXT2 and SureSelectQXT Target Enrichment System for Illumina Multiplexed Sequencing developed by Agilent Technologies, a SeqCap EZ kit developed by Roche NimbleGen, a TruSeq® Enrichment Kit developed by Illumina and other hybridization-based target enrichment methods and kits that add sample-specific sequence tags either before or after the enrichment step, as well as Illumina HiSeq, Mi Seq and NexSeqLife Technology Ion Torrent. Pacific Biosciences PacBio RSII, Oxford Nanopore MinIon, Promethlon and GridIon and other massively parallel Multiplexed Sequencing Platforms.

Usable methods for hybrid selection are described in Melnikov, et al., Genome Biology 12:R73, 2011; Geniez, et al., Symbiosis 58:201-207, 2012; and Matranga, et al., Genome Biology 15:519, 2014). Bait design and hybrid selection was done similarly to a previously published method (see, e.g., Gnirke, et al., Nature biotechnology 27:182-189, 2009, US patent publications No. US 2010/0029498, US 2013/0230857, US 2014/0200163, US 2014/0228223, and US 2015/0126377 and international patent publication No. WO 2009/099602). Briefly, baits may be designed by first concatenating all consensus sequences (such as LASV) into two single bait sets (such as one for Nigerian clades and another for the Sierra Leone clade). Duplicate probes, defined as a DNA sequence with 0 mismatches, were removed. The baits sequences were tiled across the genome (such as LASV) creating a probe every 50 bases. Two sets of adapters were used for each bait set. Adapters alternated with each 50 base probe to improve the efficiency of PCR amplification of probes. The oligo array was synthesized on a CustomArray B3 Synthesizer, as recommended by the manufacturer. The oligonucleotides were cleaved-off the array and amplified by PCR with primers containing T7 RNA polymerase promoters. Biotinylated baits were then prepared through in vitro transcription (MEGAshortscript, Ambion). RNA baits for each clade were prepared separately and mixed at the equal RNA concentration prior to hybridization. Libraries of the genome (such as LASV) were added to the baits and hybridized over a 72 hrs. After capture and washing, libraries were amplified by PCR using the Illumina adapter sequences. Libraries were then pooled and sequenced on the MiSeq platform.

In one aspect of the invention, a method for analyzing a pathogen sequence, such as a bacterial or viral sequence, is provided. The method may comprise sequencing the pathogen sequence according to the method for analyzing a sample which may comprise a target sequence as described above, wherein the target sequence is the pathogen sequence. Preferably the pathogen sequence is a genome of the pathogen or a fragment thereof. The method further may comprise determining the evolution of the pathogen from the sequenced pathogen sequence. Determining the evolution of the pathogen may comprise identification of pathogen mutations in the sequenced pathogen sequence, e.g. nucleotide deletion, nucleotide insertion, nucleotide substitution. Amongst the latter, there are nonsynonymous, synonymous, and noncoding substitutions. Mutations are more frequently nonsynonymous during an outbreak. The method may further comprise determining the substitution rate between two pathogen sequences analyzed as described above. Whether the mutations are deleterious or even adaptive would require functional analysis, however, the rate of nonsynonymous mutations suggests that continued progression of this epidemic could afford an opportunity for viral adaptation, underscoring the need for rapid containment. Thus, the method may further comprise assessing the risk of viral adaptation, wherein the number nonsynonymous mutations is determined. (Gire, et al., Science 345, 1369, 2014).

Because effectiveness of therapeutic response to an outbreak can greatly depend on the knowledge of the pathogen responsible for the outbreak so that proper diagnostics, vaccines and therapies can be conceived, it is of utmost importance that mutations of the pathogen be monitored because mutations alter protein sequences released by the pathogen and which therapeutic response often target. In the case of the 2013-2015 EBOV outbreak, genomic sequencing further allowed the identification of numerous mutations emerging in the EBOV Makona genome over time (Gire, et al., 2014). As a consequence, the evolutionary rate of the Makona variant over the timespan of the early phase of the outbreak could be estimated, and predictions made about the potential of this new EBOV variant to escape current candidate vaccines, therapeutics, and diagnostics (Kugelman, Sanchez-Lockhart, et al., 2015).

For example, during the 2014 EBOV outbreak, Gire et al. reveal 341 fixed substitutions (35 nonsynonymous, 173 synonymous, and 133 noncoding) between the 2014 EBOV and all previously published EBOV sequences, with an additional 55 single-nucleotide polymorphisms (SNPs; 15 nonsynonymous, 25 synonymous, and 15 noncoding), fixed within individual patients, within the West African outbreak. Mutations are also more frequently nonsynonymous during the outbreak. Whether they are deleterious or even adaptive would require functional analysis, however, the rate of nonsynonymous mutations suggests that continued progression of this epidemic could afford an opportunity for viral adaptation, underscoring the need for rapid containment. (Gire, et al., 2014)

In one aspect of the invention, a method for analyzing the evolution of a pathogen outbreak is provided. The method may comprise sequencing a target sequence contained in a plurality of samples from more than one subject according to the method for analyzing a sample which may comprise a target sequence as described above, wherein the target sequence is a pathogen sequence of the pathogen causing the outbreak, and wherein the sequencing the target sequence is done for each of the plurality of samples. The method further may comprise determining a pattern of pathogen transmission, in other words a mechanism involves in a disease outbreak caused by a pathogen.

The pattern of pathogen transmission may comprise continued new transmissions from the natural reservoir of the pathogen or subject-to-subject transmissions (e.g. human-to-human transmission) following a single transmission from the natural reservoir or a mixture of both. In one embodiment, the pathogen transmission is a bacterial or viral transmission, in such case, the target sequence is preferably a bacterial or a viral genomes or fragments thereof. In one embodiment, the pattern of the pathogen transmission is the early pattern of the pathogen transmission, i.e. at the beginning of the pathogen outbreak. Determining the pattern of the pathogen transmission at the beginning of the outbreak enables to increase the success of stopping the outbreak at the very start thereof and as such dimming the specter of local and international dissemination.

Determining the patterns of pathogen transmission, such as viral transmission, notably during the beginning of the outbreak, is a key step towards stopping the epidemic episode at the very start thereof and as such dimming the specter of local and international dissemination. (Gire, et al., 2014)

Determining the pattern of the pathogen transmission may comprise analyzing a pathogen sequence according to the method described above. Determining the pattern of the pathogen transmission may further comprise detecting shared intra-host variations of the pathogen sequence between the subjects and determining whether the shared intra-host variations show temporal patterns. Patterns in observed intrahost and interhost variation provide important insight about transmission and epidemiology (Gire, et al., 2014).

Detection of shared intra-host variations between the subjects that show temporal patterns is an indication of transmission links between subject (in particular between humans) because it can be explained by subject infection from multiple sources (superinfection), sample contamination recurring mutations (with or without balancing selection to reinforce mutations), or co-transmission of slightly divergent viruses that arose by mutation earlier in the transmission chain (Park, et al., Cell 161(7):1516-1526, 2015). Detection of shared intra-host variations between subjects may comprise detection of intra-host variants located at common single nucleotide polymorphism (SNP) positions. Positive detection of intra-host variants located at common (SNP) positions is indicative of superinfection and contamination as primary explanations for the intra-host variants. Superinfection and contamination can be parted on the basis of SNP frequency appearing as inter-host variants (Park, et al., 2015). Otherwise superinfection and contamination can be ruled out. In this latter case, detection of shared intra-host variations between subjects may further comprise assessing the frequencies of synonymous and nonsynonymous variants and comparing the frequency of synonymous and nonsynonymous variants to one another. Equal frequency of synonymous and nonsynonymous variants is indicative of the intra-host variants evolving neutrally. If frequencies of synonymous and nonsynonymous variants are divergent, the intra-host variants are likely to be maintained by balancing selection. If frequencies of synonymous and nonsynonymous variants are low, this is indicative of recurrent mutation. If frequencies of synonymous and nonsynonymous variants are high, this is indicative of co-transmission (Park, et al., 2015).

Like Ebola virus, Lassa virus (LASV) can cause hemorrhagic fever with high case fatality rates. Andersen et al. generated a genomic catalog of almost 200 LASV sequences from clinical and rodent reservoir samples (Andersen, et al., Cell Volume 162, Issue 4, p 738-750, 13 Aug. 2015). Andersen et al. show that whereas the 2013-2015 EVD epidemic is fueled by human-to-human transmissions, LASV infections mainly result from reservoir-to-human infections. Andersen et al. elucidated the spread of LASV across West Africa and show that this migration was accompanied by changes in LASV genome abundance, fatality rates, codon adaptation, and translational efficiency.

The method may further comprise phylogenetically comparing a first pathogen sequence to a second pathogen sequence, and determining whether there is a phylogenic link between the first and second pathogen sequences. The second pathogen sequence may be an earlier reference sequence. If there is a phylogenic link, the method may further comprise rooting the phylogeny of the first pathogen sequence to the second pathogen sequence. Thus, it is possible to construct the lineage of the first pathogen sequence. (Park, et al., 2015)

The method may further comprise determining whether the mutations are deleterious or adaptive. Deleterious mutations are indicative of transmission-impaired viruses and dead-end infections, thus normally only present in an individual subject. Mutations unique to one individual subject are those that occur on the external branches of the phylogenetic tree, whereas internal branch mutations are those present in multiple samples (i.e. in multiple subjects). Higher rate of nonsynonymous substitution is a characteristic of external branches of the phylogenetic tree. (Park, et al., 2015)

In internal branches of the phylogenetic tree, selection has had more opportunity to filter out deleterious mutants. Internal branches, by definition, have produced multiple descendent lineages and are thus less likely to include mutations with fitness costs. Thus, lower rate of nonsynonymous substitution is indicative of internal branches. (Park, et al., 2015)

Synonymous mutations, which likely have less impact on fitness, occurred at more comparable frequencies on internal and external branches. (Park, et al., 2015)

By analyzing the sequenced target sequence, such as viral genomes, it is possible to discover the mechanisms responsible for the severity of the epidemic episode such as during the 2014 Ebola outbreak. For example, Gire et al. made a phylogenetic comparison of the genomes of the 2014 outbreak to all 20 genomes from earlier outbreaks suggests that the 2014 West African virus likely spread from central Africa within the past decade. Rooting the phylogeny using divergence from other ebolavirus genomes was problematic (6, 13). However, rooting the tree on the oldest outbreak revealed a strong correlation between sample date and root-to-tip distance, with a substitution rate of $8 \times 10^{-4}$ per site per year (13). This suggests that the lineages of the three most recent outbreaks all diverged from a common ancestor at roughly the same time, around 2004, which supports the hypothesis that each outbreak represents an independent zoonotic event from the same genetically diverse viral population in its natural reservoir. They also found out that the 2014 EBOV outbreak might be caused by a single transmission from the natural reservoir, followed by human-to-human transmission during the outbreak. Their results also suggested that the epidemic episode in Sierra Leon might stem from the introduction of two genetically distinct viruses from Guinea around the same time. (Gire, et al., 2014)

It has been also possible to determine how the Lassa virus spread out from its origin point, in particular thanks to human-to-human transmission and even retrace the history of this spread 400 years back (Andersen, et al., Cell 162(4): 738-50, 2015).

In relation to the work needed during the 2013-2015 EBOV outbreak and the difficulties encountered by the medical staff at the site of the outbreak, and more generally, the method of the invention makes it possible to carry out sequencing using fewer selected probes such that sequencing can be accelerated, thus shortening the time needed from sample taking to results procurement. Further, kits and systems can be designed to be usable on the field so that diagnostics of a patient can be readily performed without need to send or ship samples to another part of the country or the world.

In any method described above, sequencing the target sequence or fragment thereof may used any of the sequencing processes described above. Further, sequencing the target sequence or fragment thereof may be a near-real-time sequencing. Sequencing the target sequence or fragment thereof may be carried out according to previously described methods (Experimental Procedures: Matranga et al., 2014; and Gire, et al., 2014). Sequencing the target sequence or fragment thereof may comprise parallel sequencing of a plurality of target sequences. Sequencing the target sequence or fragment thereof may comprise Illumina sequencing.

Analyzing the target sequence or fragment thereof that hybridizes to one or more of the selected probes may be an identifying analysis, wherein hybridization of a selected probe to the target sequence or a fragment thereof indicates the presence of the target sequence within the sample.

Currently, primary diagnostics are based on the symptoms a patient has. However, various diseases may share identical symptoms so that diagnostics rely much on statistics. For example, malaria triggers flu-like symptoms: headache, fever, shivering, joint pain, vomiting, hemolytic anemia, jaundice, hemoglobin in the urine, retinal damage, and convulsions. These symptoms are also common for septicemia, gastroenteritis, and viral diseases. Amongst the latter, Ebola hemorrhagic fever has the following symptoms fever, sore throat, muscular pain, headaches, vomiting, diarrhea, rash, decreased function of the liver and kidneys, internal and external hemorrhage.

When a patient is presented to a medical unit, for example in tropical Africa, basic diagnostics will conclude to malaria because statistically, malaria is the most probable disease within that region of Africa. The patient is consequently treated for malaria although the patient might not actually have contracted the disease and the patient ends up not being correctly treated. This lack of correct treatment can be life-threatening especially when the disease the patient contracted presents a rapid evolution. It might be too late before the medical staff realizes that the treatment given to the patient is ineffective and comes to the correct diagnostics and administers the adequate treatment to the patient.

The method of the invention provides a solution to this situation. Indeed, because the number of selected probes can be dramatically reduced, this makes it possible to provide on a single chip selected probes divided into groups, each group being specific to one disease, such that a plurality of diseases, e.g. viral infection, can be diagnosed at the same time. Thanks to the invention, more than 3 diseases can be diagnosed on a single chip, preferably more than 4, 5, 6, 7, 8, 9, 10, 11, 12, 13, 14, 15, 16, 17, 18, 19, 20 diseases at the same time, preferably the diseases that most commonly occur within the population of a given geographical area. Since each group of selected probes is specific to one of the diagnosed diseases, a more accurate diagnostics can be performed, thus diminishing the risk of administrating a wrong treatment to the patient.

In other cases, a disease such as a viral infection may occur without any symptoms, or had caused symptoms but they faded out before the patient is presented to the medical staff. In such cases, either the patient does not seek any medical assistance or the diagnostics is complicated due to the absence of symptoms on the day of the presentation.

The present invention may also be used in concert with other methods of diagnosing disease, identifying pathogens and optimizing treatment based upon detection of nucleic acids, such as mRNA in crude, non-purified samples (see, e.g., US patent publication No. 2013/0190196).

The method of the invention also provides a powerful tool to address this situation. Indeed, since a plurality of groups of selected probes, each group being specific to one of the most common diseases that occur within the population of the given area, are comprised within a single chip, the medical staff only need to contact a biological sample taken from the patient with the chip. Reading the chip reveals the diseases the patient has contracted.

In some cases, the patient is presented to the medical staff for diagnostics of particular symptoms. The method of the invention makes it possible not only to identify which disease causes these symptoms but at the same time determine whether the patient suffers from another disease he was not aware of.

This information might be of utmost importance when searching for the mechanisms of an outbreak. Indeed, groups of patients with identical viruses also show temporal patterns suggesting a subject-to-subject transmission links.

Analyzing the target sequence or a fragment thereof that hybridizes to a selected probe may be carried out by in solution hybrid selection. Each of the selected probes may further comprise an adapter. Each of the selected probes may comprise two adapters. In this latter case, a first adapter may be alternated with a second adapter. In all described case, two of the selected probes may overlap.

Although the present invention and its advantages have been described in detail, it should be understood that various changes, substitutions and alterations can be made herein without departing from the spirit and scope of the invention as defined in the appended claims.

The present invention will be further illustrated in the following Examples which are given for illustration purposes only and are not intended to limit the invention in any way.

EXAMPLES

Example 1

For Example 1, a collection of 140 publically available genomes (double stranded) of Ebola Zaire virus (EBOV) with an approximate genome length of 19,000 bp was used as the reference sequence. Selection of probes was carried out using the method with the dominating set solving process or the set cover solving process. So far, Applicants have experimented with probes of length 100 bp.

In one embodiment, a parameter may be a cover_length. This is a parameter used alongside the mismatches parameter. In the set cover context, a probe covers a portion of a target sequence (i.e., that portion is included in the probe's hybridization pattern) if it shares a substring with less than or equal to the specified number of mismatches and whose length is greater than or equal to cover_length. In the dominating set context, two probes are redundant if they share a substring with less than or equal to the specified number of mismatches and whose length is greater than or equal to cover_length.

This cover_length parameter does make a big difference with the dominating set problem (i.e., determining whether two probes are redundant). But it turns out not to make as much of a difference with the set cover approach which is why the parameter is fixed at the length of the probe (100 bp) and not varied. When the figures mention 85 bp, 95 bp, and 100 bp that is in reference to the value of the cover_length, not the length of the probe.

Candidate probes were constructed by fragmenting each of the genomes into fragments of desired length (100 bp was used, however other lengths, such as 85 bp, 95 bp, may also be used as well as fragments of about 15 to about 150 bp or fragments of about 70 bp to about 130 bp are also contemplated), the fragments overlapping one another so that the overlap between two fragments was half the length of the fragments (2× tiling). Each candidate probe is one of these fragments. The candidate probes collectively have a hybridization pattern along all genomes.

The number of candidate probes was then reduced according to different processes as described hereafter and to different value of acceptable number of mismatches (0, 1, 2, 3, 4, and 5).

Example 1.1: Dominating Set Solving Process

The redundancy between candidate probes was assessed by comparing each probe to the others. Two candidate probes were considered redundant if one of them presents a portion of a given length that was the same as the portion of a given length of the other probe, wherein the portions were considered the same even if there were up to a considered value of acceptable number of mismatches.

The candidate probes were subjected to a dominating set solving process to reduce the number of candidate probes to provide a set of selected probes.

Example 1.2: Set Cover Solving Process

For each candidate probe, its individual hybridization pattern was determined. The candidate probes were aligned back to the target sequences in a manner similar to how many short-read aligners work. In short, it seeds an alignment (by quickly finding an exact match between a short part of a probe and the target sequence), and then verifies whether this is a true alignment by expanding outward. It is a true alignment if the candidate probe and the portion of the target sequence share a substring of length at least cover length with at most a specified number of mismatches. When cover length is fixed at the length of a probe, 100 bp, this means that the candidate probe and the portion of the target sequence are the same up to the specified number of mismatches. "Short read alignment: seeding" is an introduction to short read alignment with seeding, and is similar to the herein described approach, although spaces/gaps were not allowed. The individual hybridization patterns were subjected to a greedy method for solving a set cover problem. Alternate embodiments might use other methods to solve set cover problem. Other methods include, but are not limited to, framing a set cover problem as an 'integer linear program' ('ILP') and solving via 'LP relaxation'.

In the set cover problem, the genomes collectively form a universe of elements that are the nucleotides (positions within the genomes being considered as differentiating nucleotides of the same type). The individual hybridization patterns were taken as subsets of the universe.

Comparative Example 1

The same collection of 140 genomes of Ebola Zaire virus was used as the reference sequence. Candidate probes of the same length were constructed therefrom.

The number of candidate probes was then reduced according to prior art process: the candidate probes were arbitrarily ordered to build a list. Any probe that is redundant to the first candidate probe is removed from the list. Then, any probe that is redundant to the next remaining candidate probe is removed from the list. This is repeated until the bottom of the list is reached.

Results

The following tables show the number of selected probes generated as output of Example 1.1, Example 1.2 and Comparative example 1 (FIGS. 6 to 11 graphically illustrate the results):

TABLE 1 number of selected probes for candidate probe length of 85 bp

| | Number of mismatches | | | | | |
|---|---|---|---|---|---|---|
| | 0 | 1 | 2 | 3 | 4 | 5 |
| Example 1.1 | 4316 | 2658 | 2014 | 1714 | 1630 | 1560 |
| Example 1.2 | 2268 | 1282 | 828 | 612 | 524 | 480 |
| Comparative example 1 | 5664 | 4180 | 3346 | 2680 | 2592 | 2440 |

TABLE 2 number of selected probes for candidate probe length of 95 bp

| | Number of mismatches | | | | | |
|---|---|---|---|---|---|---|
| | 0 | 1 | 2 | 3 | 4 | 5 |
| Example 1.1 | 8486 | 6442 | 5526 | 4998 | 4788 | 4634 |
| Example 1.2 | 2384 | 1358 | 910 | 664 | 564 | 508 |
| Comparative example 1 | 8730 | 7050 | 6046 | 5414 | 5060 | 4818 |

TABLE 3 number of selected probes for candidate probe length of 100 bp

| | Number of mismatches | | | | | |
|---|---|---|---|---|---|---|
| | 0 | 1 | 2 | 3 | 4 | 5 |
| Example 1.1 | 27612 | 25446 | 24482 | 23934 | 23686 | 23516 |
| Example 1.2 | 2506 | 1442 | 980 | 752 | 650 | 582 |
| Comparative example 1 | 27612 | 25762 | 24786 | 24162 | 23826 | 23606 |

The following tables show the percentage of reduction with regard to the prior art Comparative Example 1

TABLE 4 reduction percentage for candidate probe length of 85 bp

| | Number of mismatches | | | | | |
|---|---|---|---|---|---|---|
| | 0 | 1 | 2 | 3 | 4 | 5 |
| Example 1.1 | 76.2 | 63.6 | 60.2 | 64.0 | 62.9 | 63.9 |
| Example 1.2 | 40.0 | 30.7 | 24.7 | 22.8 | 20.2 | 19.7 |

TABLE 5 reduction percentage for candidate probe length of 95 bp

| | Number of mismatches | | | | | |
|---|---|---|---|---|---|---|
| | 0 | 1 | 2 | 3 | 4 | 5 |
| Example 1.1 | 97.2 | 91.4 | 91.4 | 92.3 | 94.6 | 96.2 |
| Example 1.2 | 27.3 | 19.3 | 15.1 | 12.3 | 11.1 | 10.5 |

TABLE 6 reduction percentage for candidate probe length of 100 bp

| | Number of mismatches | | | | | |
|---|---|---|---|---|---|---|
| | 0 | 1 | 2 | 3 | 4 | 5 |
| Example 1.1 | 100.0 | 98.8 | 98.8 | 99.1 | 99.4 | 99.6 |
| Example 1.2 | 9.1 | 5.6 | 4.0 | 3.1 | 2.7 | 2.5 |

Example 2

For Example 2, a collection of different number of genomes (double stranded) of Ebola Zaire virus (EBOV) with an approximate genome length of 19,000 bp was used as the reference sequence. Selection of probes was carried out using the method with the dominating set solving process or the set cover solving process. The candidate probe length was 100 bp and 0 mismatches were allowed.

Other details of Example 2 are the same as Example 1. Example 2.1 used the dominating set solving problem whereas Example 2.2 used the set cover solving process.

Comparative Example 2

For Example 2, a collection of different number of genomes (double stranded) of Ebola Zaire virus (EBOV) with an approximate genome length of 19,000 bp was used as the reference sequence. Selection of probes was carried out using the method with the dominating set solving process or the set cover solving process. The cover_length parameter was 100 bp (however other lengths, such as 85 bp, 95 bp, may also be used as well as fragments of about 15 to about 150 bp or fragments of about 70 bp to about 130 bp are also contemplated) and 0 mismatches were allowed. Full coverage was considered for the construction of candidate probes.

Other details o Example 1 are the same as Example 1.
Results

Figures 12, 13:
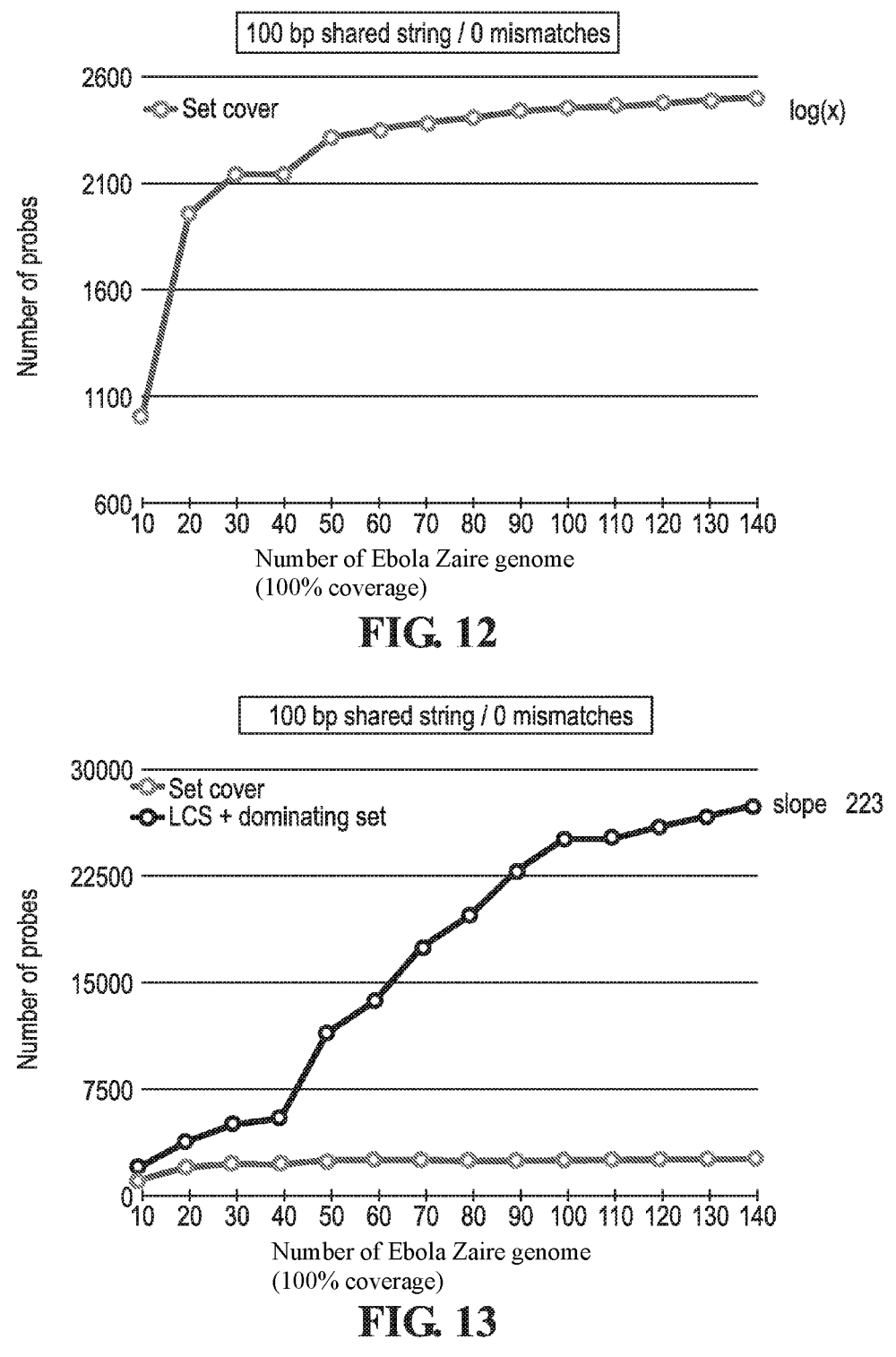

The following tables show the number of selected probes generated as output of Example 2.1, Example 2.2 (FIGS. 12 and 13 graphically illustrate the results):

TABLE 6

| | Number of probes | | |
|---|---|---|---|
| | | Example 2.1 | Example 2.2 |
| Number of Ebola Zaire genomes as reference | 10 | 1922 | 1002 |
| | 20 | 3784 | 1964 |
| | 30 | 4994 | 2146 |
| | 40 | 5358 | 2152 |
| | 50 | 11432 | 2326 |
| | 60 | 13746 | 2356 |
| | 70 | 17506 | 2386 |
| | 80 | 19832 | 2412 |
| | 90 | 22902 | 2446 |
| | 100 | 25156 | 2462 |
| | 110 | 25258 | 2468 |
| | 120 | 26052 | 2484 |
| | 130 | 26838 | 2496 |
| | 140 | 27612 | 2506 |

Like previous approaches, the number of probes using dominating set solving process linearly increases with the number of Ebola Zaire genomes (with a slope of about 223), however, the number of probes using set cover solving process logarithmically increases with the number of Ebola Zaire genomes.

Example 3

Figure 14:
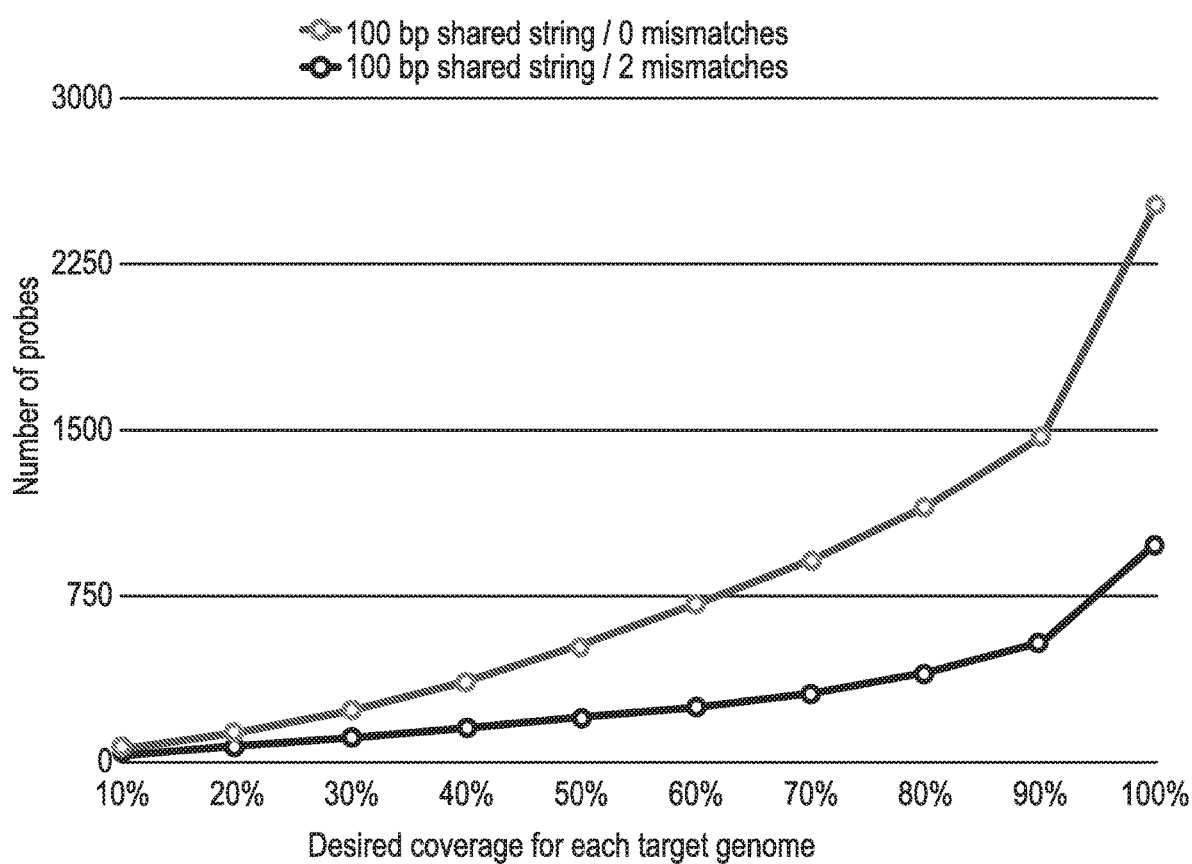
FIG. 14 graphically shows the number of selected probes generated as output of Example 3 with 0 allowed mismatches or 2 allowed mismatches.

For Example 3, a collection of 140 genomes (double stranded) of Ebola Zaire virus (EBOV) with an approximate genome length of 19,000 bp was used as the reference sequence. Candidate probe length was 100 bp. And values of acceptable number of mismatches of 0 and 2 were assessed. Selection of probes was carried out using the partial set cover solving process. Other details of Example 3 are the same as Example 1.2.
Results The following tables show the number of selected probes generated as output of Example 3 with 0 allowed mismatches or 2 allowed mismatches (FIG. 14 graphically illustrates the results):

TABLE 7

| | Number of probes | | |
|---|---|---|---|
| | | Number of allowed mismatches | |
| | | 0 | 2 |
| Percentage of desired coverage of the target sequence | 10% | 56 | 38 |
| | 20% | 126 | 76 |
| | 30% | 228 | 114 |
| | 40% | 358 | 152 |
| | 50% | 518 | 190 |
| | 60% | 704 | 246 |
| | 70% | 910 | 304 |
| | 80% | 1144 | 402 |
| | 90% | 1466 | 538 |
| | 100% | 2506 | 980 |

Example 4

For Example 4, a collection of publically available genomes (double stranded) of 20 different virus types was used as the reference sequence. For each virus type, a different number of genomes were used depending on availability (previously sequenced genomes). Candidate probe length was 100 bp and up to 3 mismatches were allowed.

Selection of probes was carried out using the method with the set cover solving process (full coverage of the reference sequence). A list of viruses that were put into the pan-viral probe set is presented below.

| Virus | Mismatches allowed | Extension allowed | Number probes |
|---|---|---|---|
| Chikungunya | 2 | 0 | 1882 |
| Crimean-Congo | 2 | 30 | 6228 |
| Dengue | 3 | 20 | 4280 |
| Ebola non-Zaire | 1 | 30 | 4918 |
| Ebola Zaire (incl. 2014) | 1 | 10 | 1284 |
| GB virus C | 1 | 0 | 2996 |
| Hepatitis A | 2 | 0 | 2172 |
| Hepatitis C | 5 | 50 | 13120 |
| HIV-1 (w/o LTR) | 6 | 40 | 15428 |
| HIV-2 (w/o LTR) | 1 | 30 | 3314 |
| Influenza A and B | 3 | 30 | 9084 |
| Lassa | 4 | 30 | 6170 |
| Marburg | 2 | 0 | 2422 |
| Measles | 2 | 0 | 1340 |
| MERS | 1 | 0 | 2716 |

-continued

| Virus | Mismatches allowed | Extension allowed | Number probes |
|---|---|---|---|
| Rhabdovirus | 3 | 50 | 7138 |
| Rift valley fever | 2 | 0 | 1528 |
| SARS | 1 | 10 | 1022 |
| Yellow fever | 2 | 0 | 2948 |
| TOTAL | | | 89990 |

That table also includes the optimized parameters (chosen by minimizing a loss function) and the number of selected probes for each virus.

Other details are the same as for Example 1.2.

Results

The following table sums up the results that were obtained.

TABLE 8

Number of selected probes for each of virus type

| Virus type | Approximate genome length (bp) | Number of genomes used as reference sequence | Number of selected probes |
|---|---|---|---|
| Ebola Zaire | 19,000 | 239 | 748 |
| Measles | 16,000 | 53 | 942 |
| SARS | 30,000 | 143 | 984 |
| Chikungunya | 12,000 | 213 | 1,404 |
| Hepatitis A | 7,500 | 34 | 1,632 |
| Marburg | 19,000 | 78 | 2,010 |
| Yellow fever | 11,000 | 55 | 2,454 |
| MERS | 30,000 | 204 | 2,764 |
| Ebola non-Zaire | 19,000 | 53 | 4,740 |
| Dengue | 10,500 | 302 | 5,376 |
| Lassa | 10,500 | 222 | 13,642 |
| Influenza A + B | 13,500 | 1,125 | 13,658 |
| Rhabdovirus | 12,000 | 243 | 15,558 |
| HIV 1 + 2 | 8,000-11,000 | 1,779 | 116,364 |

Thus, if HIV 1+2 virus type is set aside, the total number of selected probes is 65,912, which is lower than the number of spots usually available on commercialized chips (for example about 90,000 spots available on a CustomArray B3 Synthesizer). Thus, this makes it possible to design a portable chip for virus identification at the site of sample taking as a help with diagnosing the virus type or types the patient has contracted. See also the table below for a pan-viral probe set where the parameters are varied across viruses (instead of keeping 3 mismatches for all), which includes HIV 1+2, as well as Hepatitis-C (another very diverse virus), and uses just under 90,000 probes.

Figure 15:
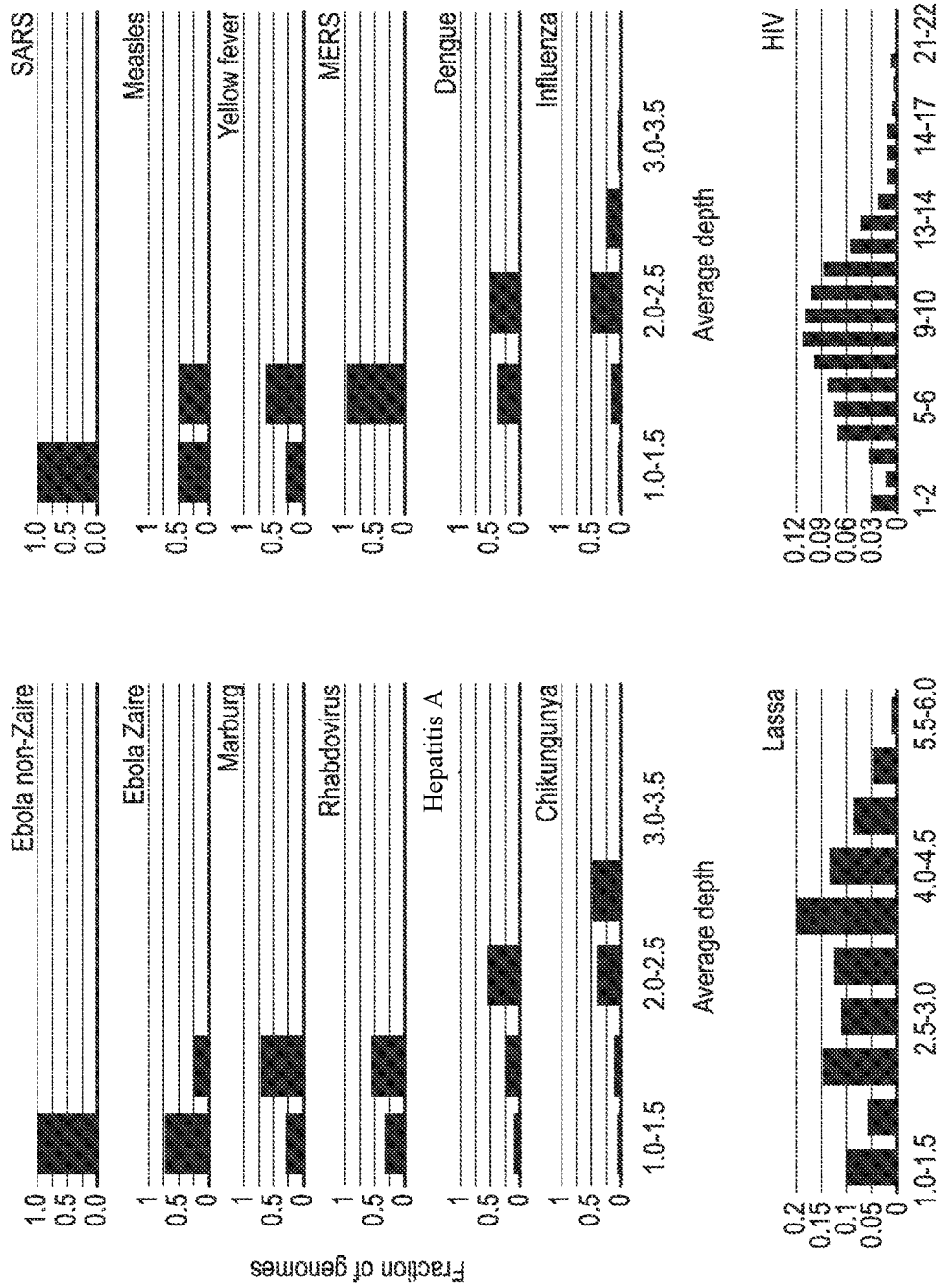
FIG. 15 shows the average depth obtained by the selected probes for each of the virus types.
Figure 16:
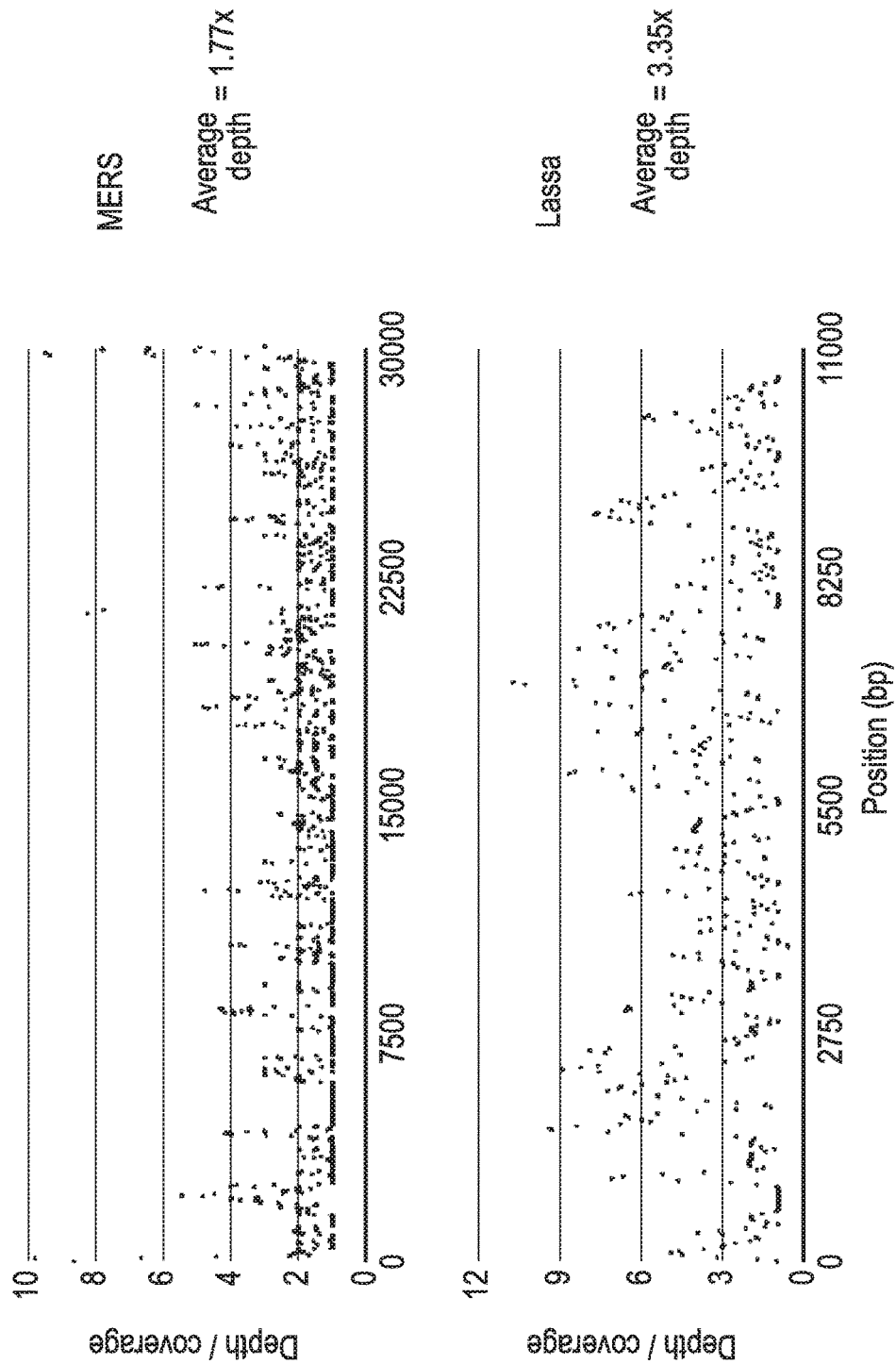
FIG. 16 shows the depth within genomes of two virus types: MERS and Lassa viruses.
Figure 17:
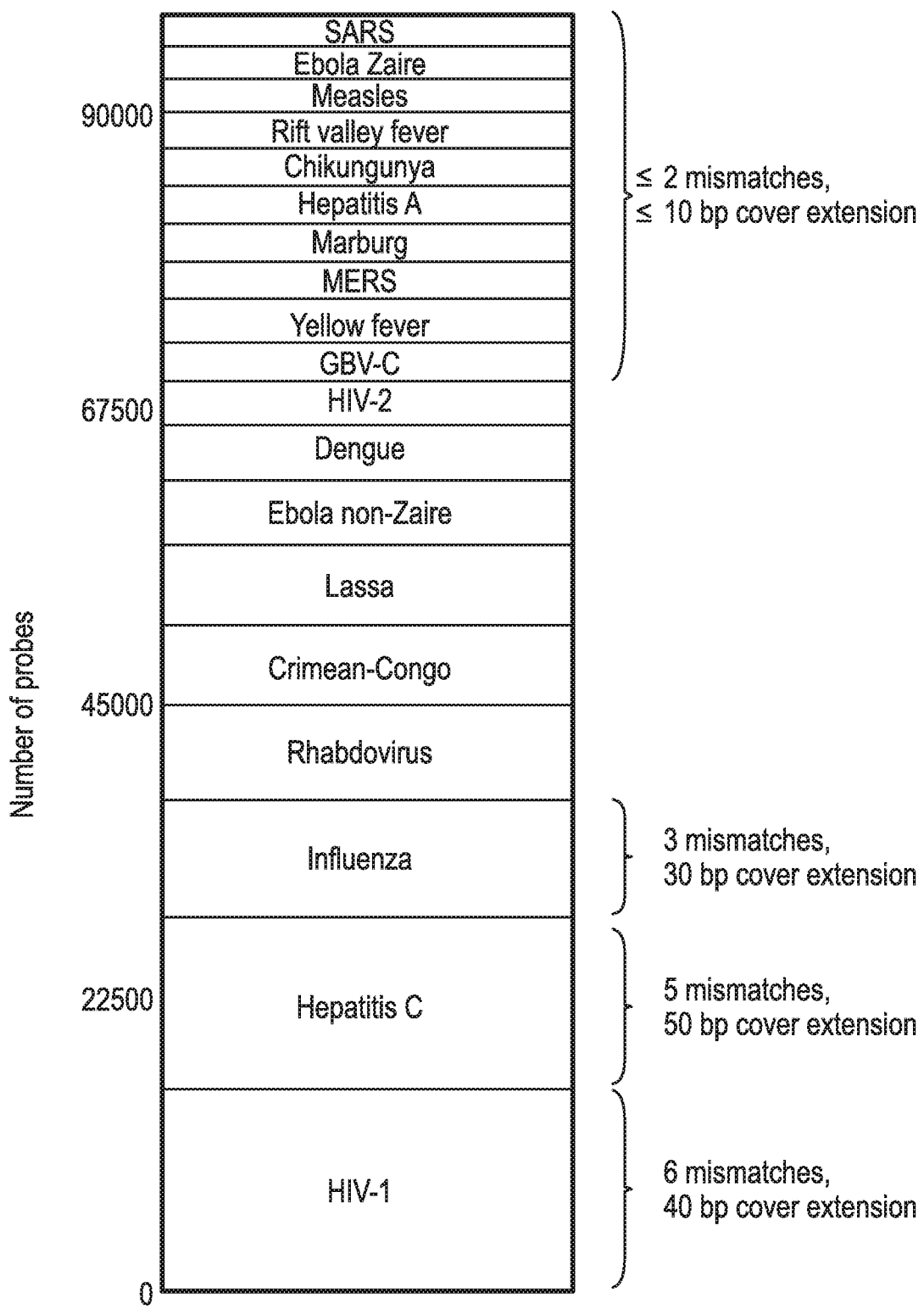
FIG. 17 shows the number of probes in a pan-viral probe set as well as set cover parameters used when generating probes for different viruses, in accordance with certain example embodiments.

As the results of Example 4 show, if only partial coverage is required, the number of selected probes can be further reduced so that the total number of selected probes for all 20 virus types can be reduced below 90,000. This is possible, with weighted partial set cover solving process and by selecting candidate probes that hit only one of the virus types. The natural application of weighted partial set cover is designing probes for identification among the viruses (namely, a very small number of probes). There was identification (targeting 1,000 bp of each target genome) with 3,542 probes for all of the viruses listed below:

FIG. 15 shows the average depth obtained by the selected probes for each of the virus types. FIG. 16 shows the depth within genomes of two virus types: MERS and Lassa viruses. FIG. 17 provides a graphic representation of the number of probes selected for each virus using the set cover solving process as described herein. The cover extension and mismatch parameters used for various viruses are also shown. As indicated in FIG. 17 the more diverse viruses, like HIV-1, included more probes.

FIGS. 18-21 show the results of 4 clinical isolates tested using the above pan-viral probe set. For each, the top bar chart shows the fraction of sequenced reads belonging to the virus, with a higher number of reads indicating a higher level of enrichment. The bottom left chart shows the fraction of the virus' genome from which a de novo assembly could be derived. The bottom-right chart shows the median cover over the de novo assembled genome.

Figure 18:
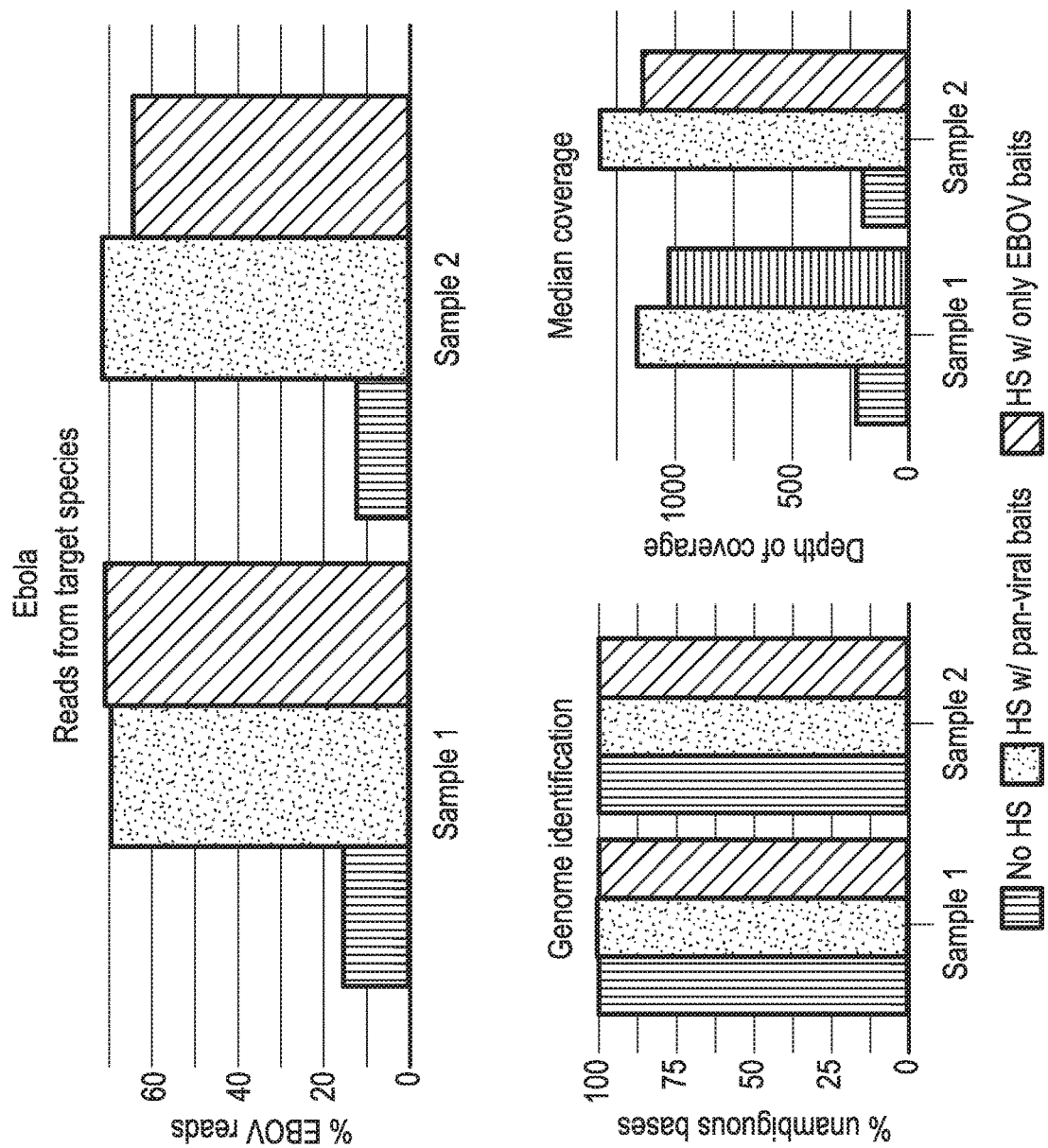
FIGS. 18-21 show the results of using the pan-viral probe to screen four different viruses, in accordance with certain example embodiments. For each figure the top bar chart shows the fraction of sequenced reads belong to the virus (higher reads indicates more enrichment of the virus). The bottom-left bar chart shows the fraction of the virus' genome that was de novo assembled from the sequencing reads obtained from the assay. "No HS" indicates no hybrid selection. "HS w/pan-viral baits" indicates hybrid selection and use of probes designed in accordance with certain example embodiments. "HS w/only EBOV baits" indicates hybrid selection using a naïve tiling approach and that contains a lot of redundant probes.
Figure 19:
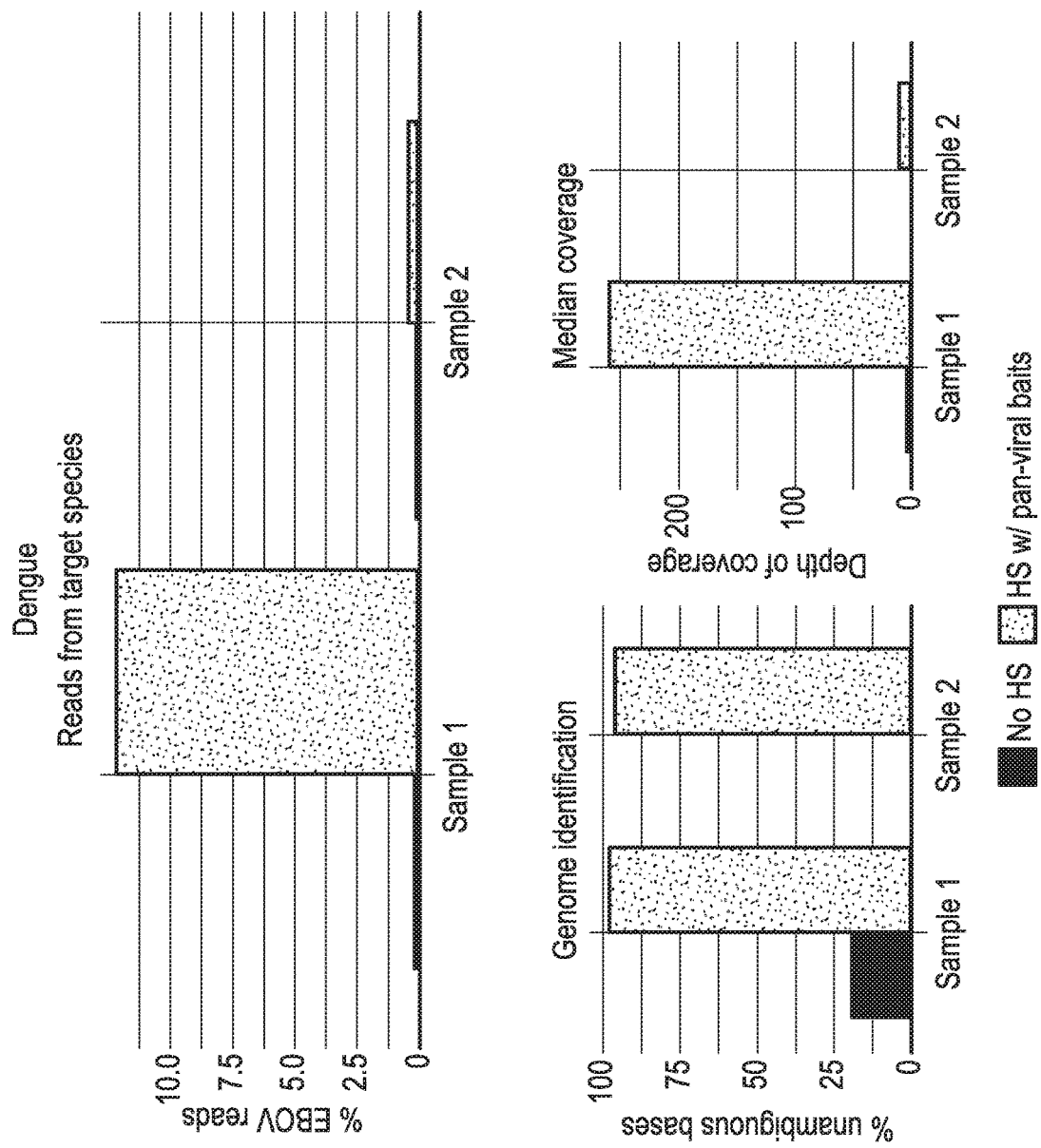
Figure 20:
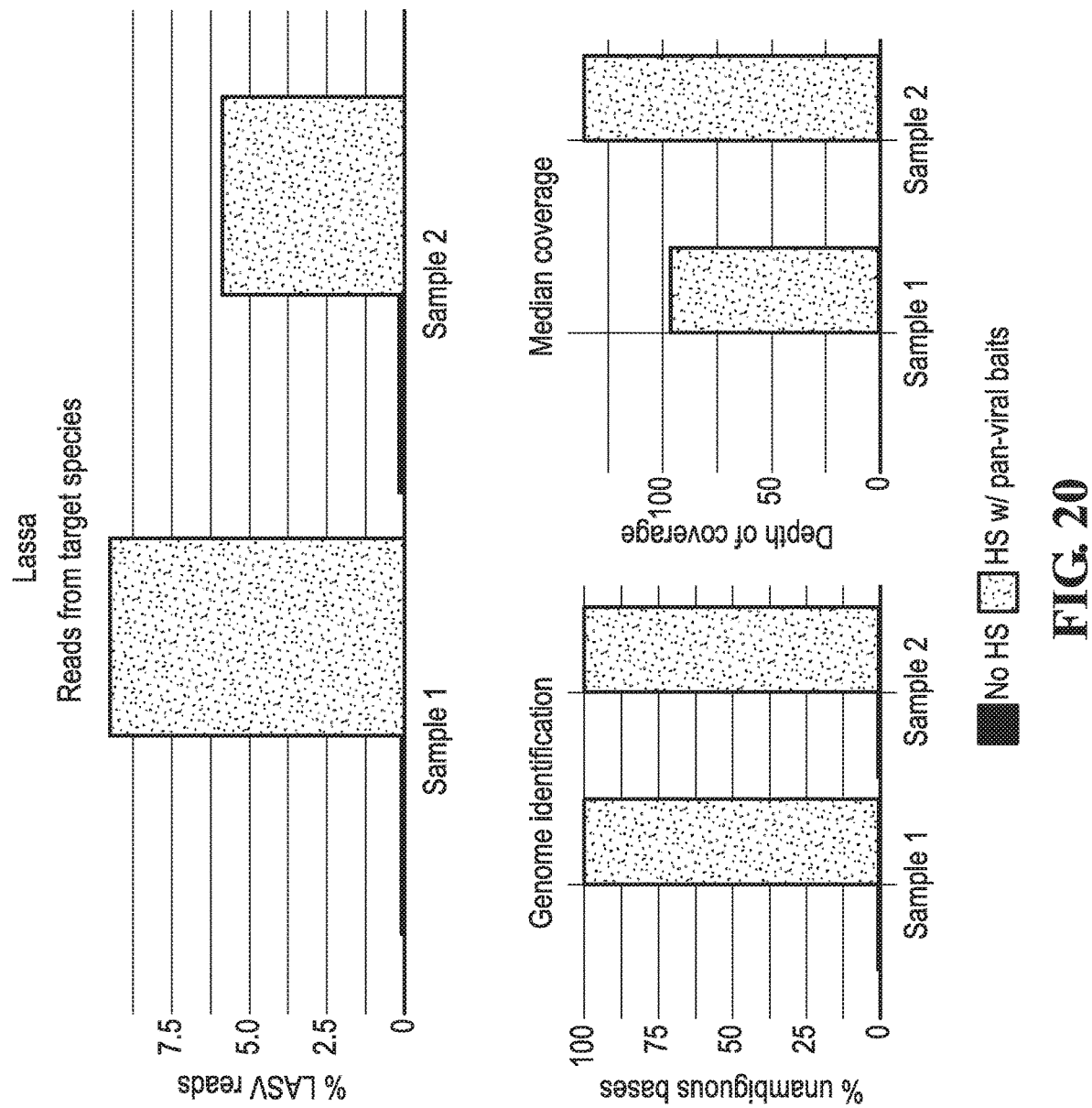
Figure 21:
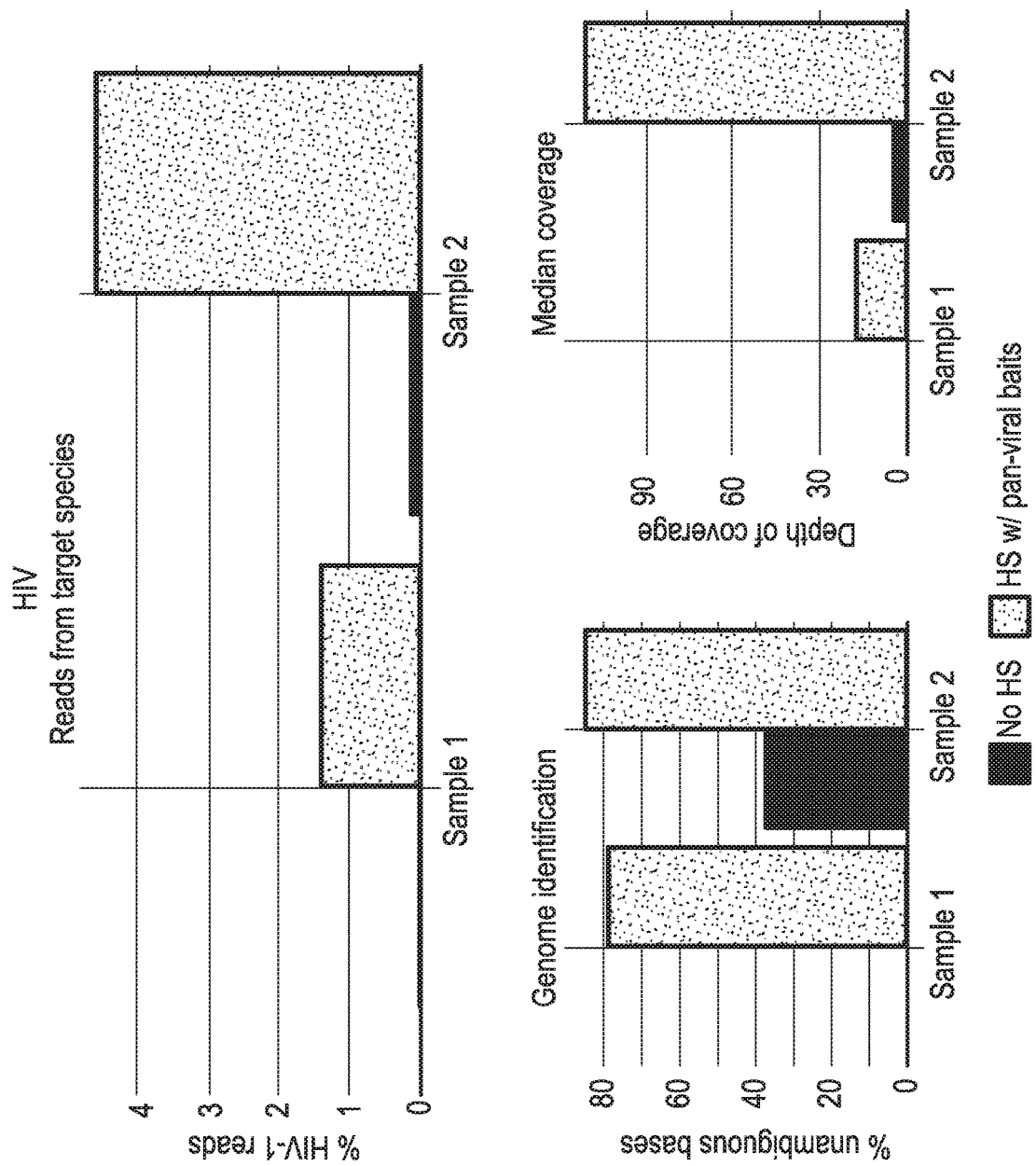

For Ebola Zaire in FIG. 18, results were obtained without hybrid selection ("No HS"), with hybrid selection and pan-viral probe set disclosed above ("HS w/pan-viral baits") and hybrid selection with Ebola Zaire specific probes designed using a naïve tiling approach ("HS w/only EBOV baits"). As shown in FIG. 18, the pan-viral probe set (1,284 probes) is as sensitive in enrichment as the probe set specifically designed only for Ebola Zaire. Further, the pan-viral probe set achieved this level of sensitivity by including only 1,284 probes to Ebola Zaire, whereas the Ebola Zaire specific probe set derived using the naïve tiling method required 27,654 probes.

Clear enrichment can also be seen in Dengue, Lassa, and HIV (FIGS. 19-21, respectively), where use of the pan-viral probe set was able to rescue sample and sequence genomes that could not be sequenced without hybrid selection.

Figure 22:
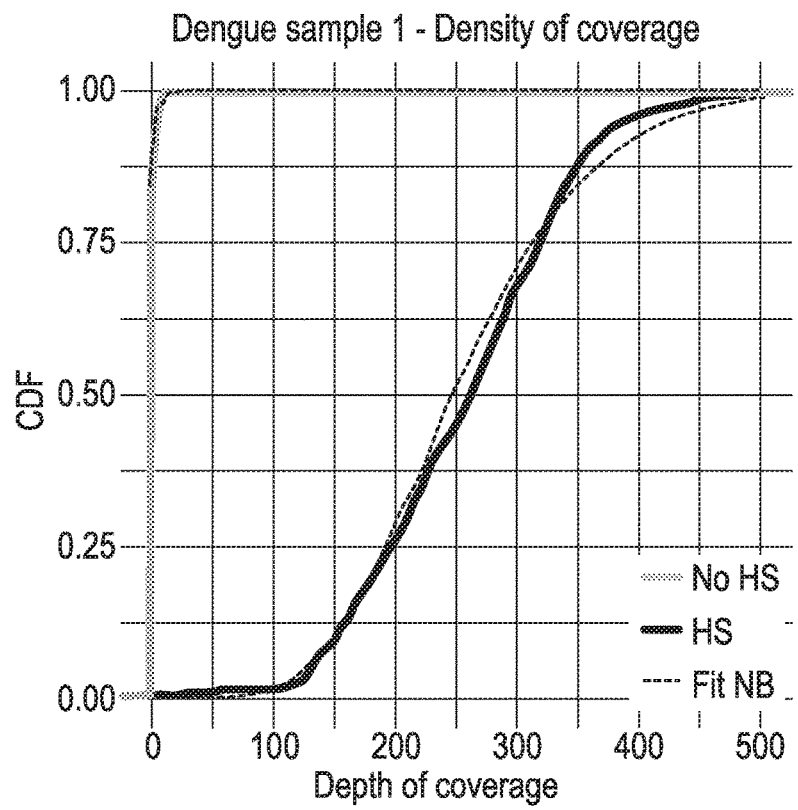
FIGS. 22 and 23 shows cumulative distribution functions (CDF) of coverage across the assembled genome for one of the Dengue samples and one of the Ebola samples. Red line is without hybrid selection, blue line is with hybrid selection and black line is a best-fit negative binomial to the CDFs.
Figure 23:
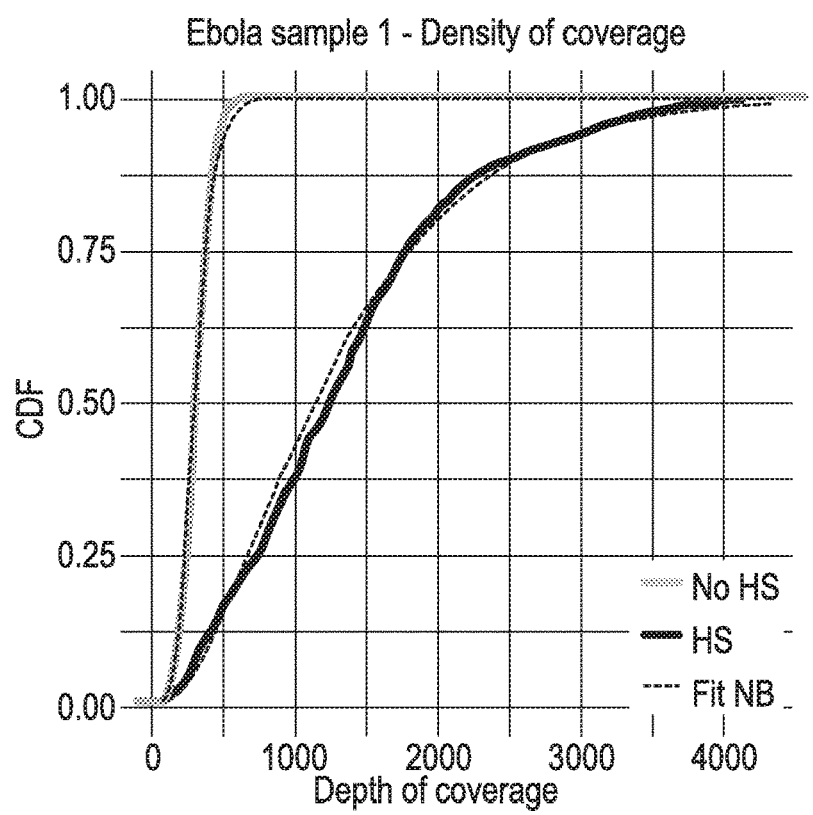

FIGS. 22 and 23 show cumulative distribution functions of coverage across the assembled genome for one of the Dengue samples and one of the Ebola samples. Since coverage is 0 in the samples without hybrid selection, the red lines hug the y-axis most of the way up. A negative binomial is often used to model read coverage in a genome. The comparison of the blue lines with the black ones shows that the hybrid selection does not introduce huge spikes in coverage in certain regions of the genome.

Figure 24:
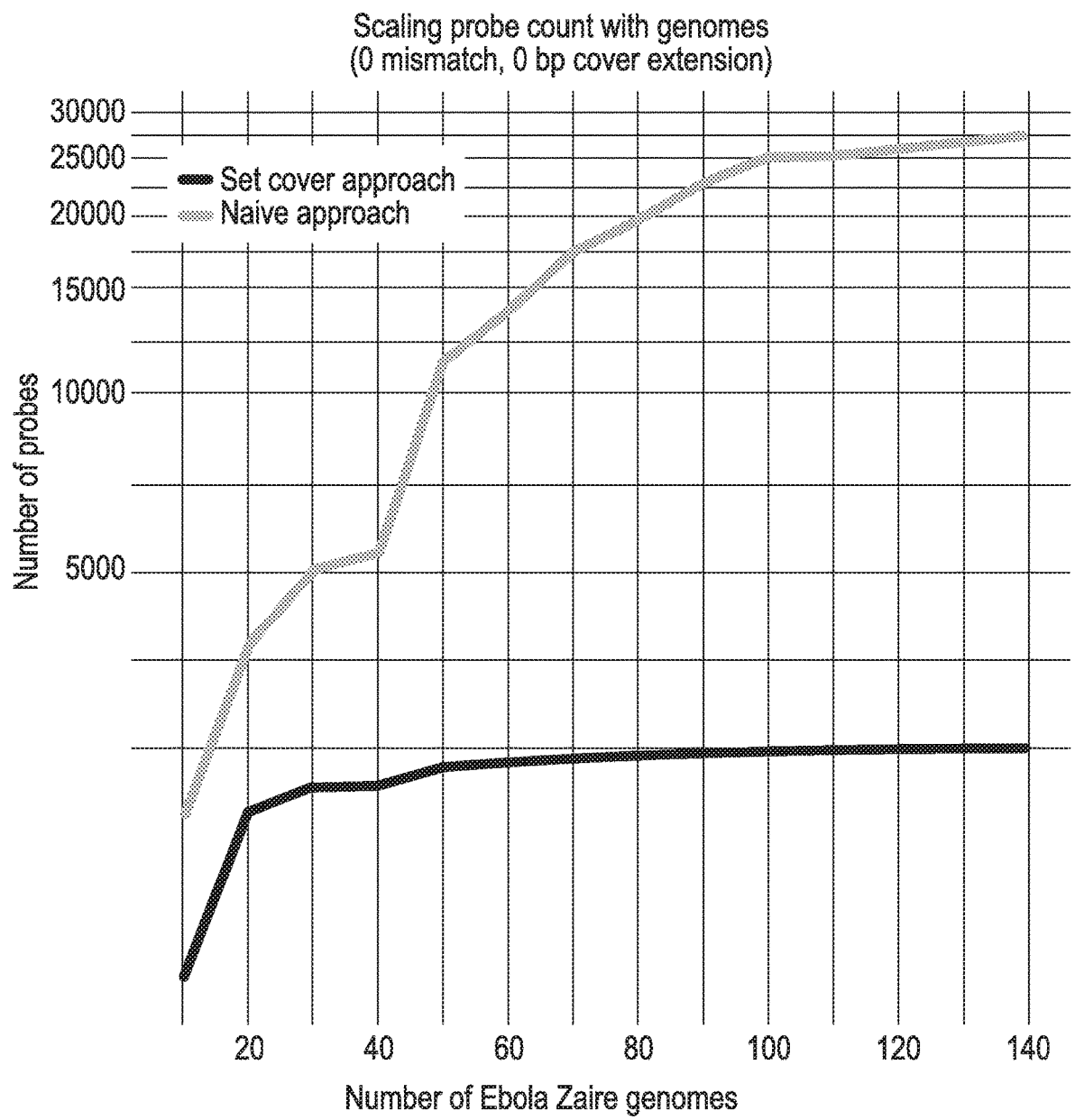
FIG. 24 shows the number of probes necessary to target Ebola Zaire genomes in a semi-naïve approach (Naïve approach) and using the method of the invention (Set cover approach) as a function of the number of Ebola Zaire genomes that are targeted.

FIG. 24 shows that the number of probes required by the method of the invention to target Ebola Zaire genomes is much lower versus the number of probes required using a semi-naïve approach as the number of targeted genomes increases in comparison. The ratio is about 11 fold more probes with the semi-naïve approach than with the methods disclosed herein.

Figure 25:
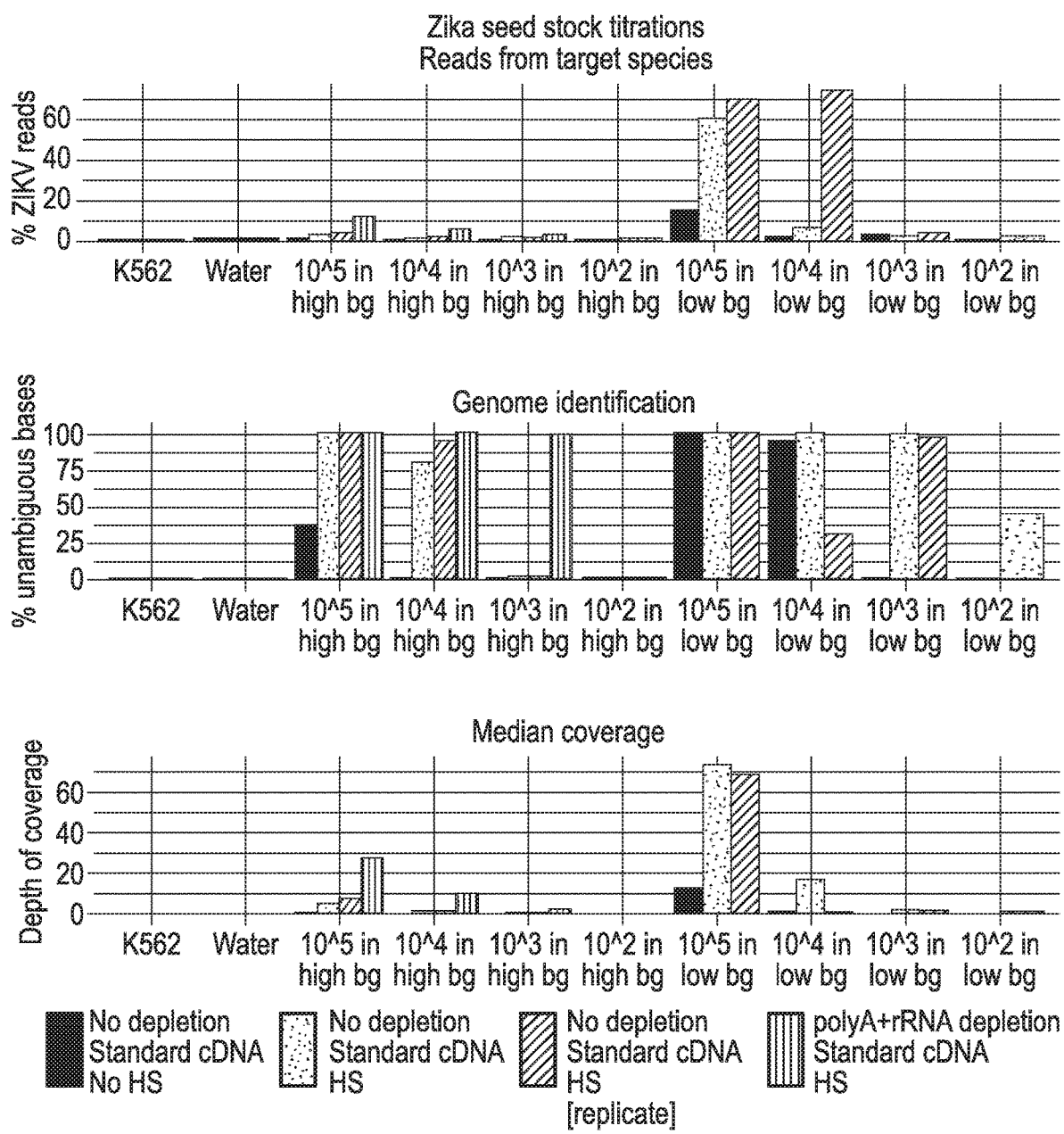
FIG. 25 shows results for further testing on Zika virus. The top bar plot shows the fraction of reads that are Zika. The middle one shows the fraction of the Zika genome which could be de novo assembled. The bottom shows the median coverage over the assembled genome. The x-axis labels are the number of copies of Zika per and "low/high bg" means a low/high amount of background material.

Mock libraries were generated from Zika seedstock to test sequencing methods. Probes were generated to the reference Zika genomes as described above. Referring to FIG. 25, the top bar plot shows the fraction of reads that are Zika. The middle bar graph show the fraction of the Zika genome that could be de novo assembled. The bottom bar graph shows the median coverage over the assembled genome. The x-axis labels are the copies of Zika per μL, and "low/high bg" means a low/high amount of background material. As shown by this figure, hybrid selection is necessary for sequencing samples in high background at all concentrations, and in low background at 103 cp/μL of Zika and below.

Figure 26:
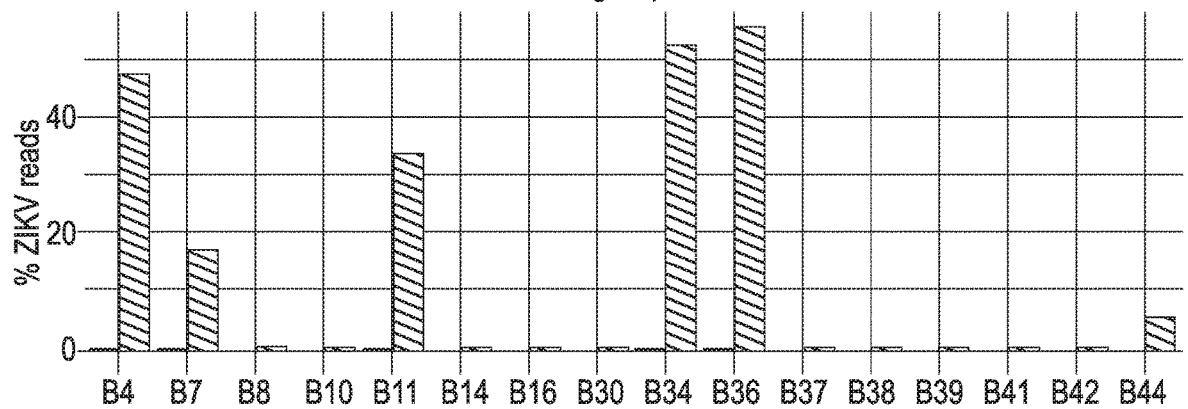
FIG. 26 shows the same type of information as FIG. 25 but using a reference-based process rather than de novo assembly. The shown results are assembly results on clinical Zika samples from a Zika infested area in South America.
Figure 26:
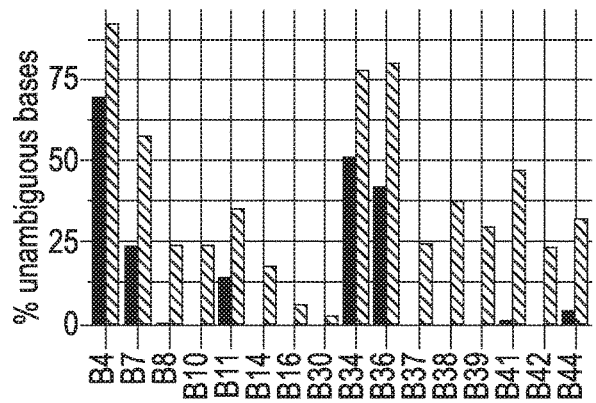
Figure 26:
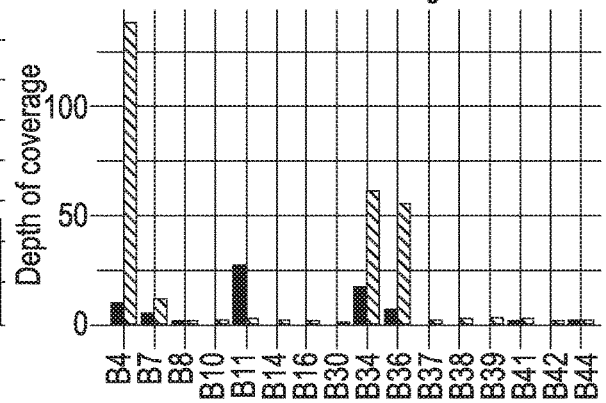

FIG. 26 shows the same types of information as FIG. 25. According to these results, only partial genomes could be obtained without hybrid selection and only in a few samples. In some samples (B4, B7, B34, B36, B11, B41, B44), hybrid selection helps to increase the fraction of the genome that can be assembled.

Figure 27:
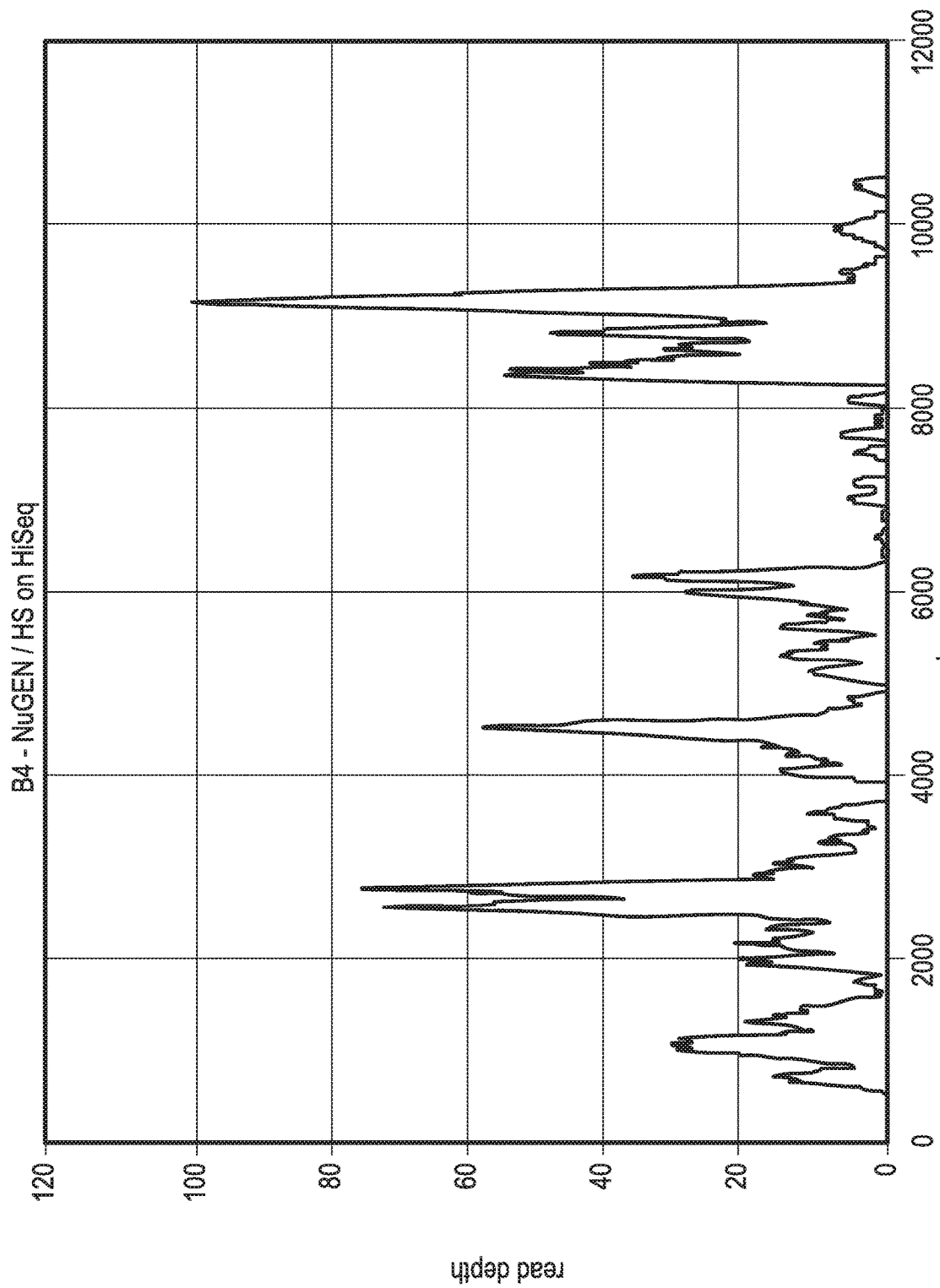
FIGS. 27 and 28 show coverage plots of reads mapped to the Zika genome in a clinical sample from the Zika infested area in South America.
Figure 28:
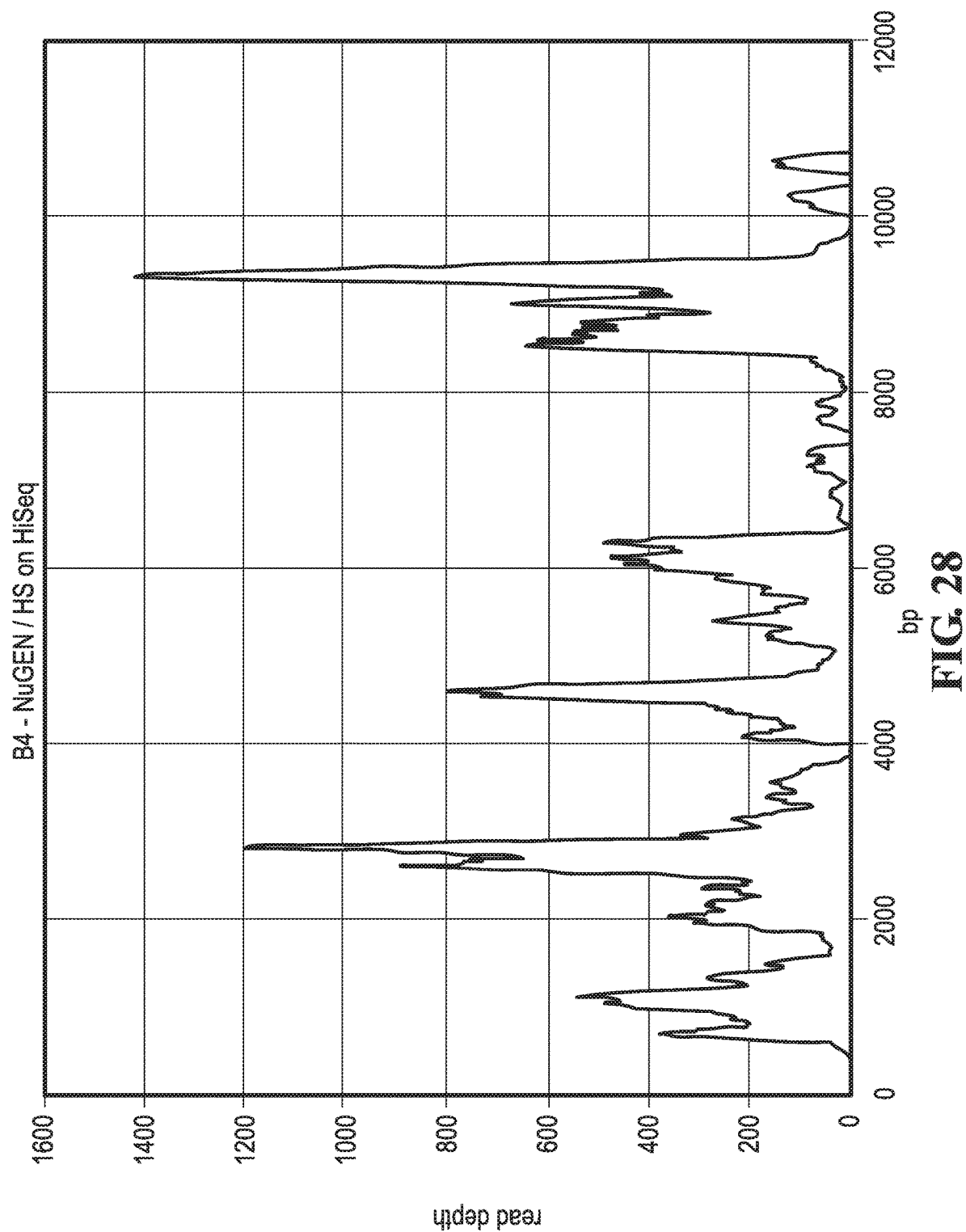

FIGS. 27 and 28 show coverage plots of reads mapped to the Zika genome in 16 clinical samples from the Zika infested area in South America. As can be seen from both figures, the benefit of hybrid selection is clearly observable, notably through the higher coverage in FIG. 28.

Example 6

A list of targeted viruses used to design the probe set to target all human-infecting viruses is given below. The list was developed based on NCBI's viral accession list. The first column is a regex string matching viral taxa in that list. The second column is a pair of numbers (m, c) where m is the number of mismatches used for that virus in designing probes, and c is the "cover extension" used.

(Human)?(R|r)espiratory syncytial virus (2, 20)
(Sudan ebolavirus|Bundibugyo virus|Tai Forest ebolavirus-|Reston ebolavirus) (2, 0)
Achimota virus([0-9]+)? (0, 0)
*Aedes* flavivirus (1, 0)
Aguacate virus (0, 0)
Akabane virus (1, 0)
Alethinophid [0-9]+reptarenavirus (0, 0)
Allpahuayo mammarenavirus (0, 0)
Amapari mammarenavirus (0, 0)
Andes virus (0, 0)
Apoi virus (0, 0)
Aravan virus (0, 0)
Aroa virus (0, 0)
Arumowot virus (0, 0)
Atlantic salmon paramyxovirus (0, 0)
Australian bat lyssavirus (1, 0)
Avian bornavirus (0, 0)
Avian metapneumovirus (1, 0)
Avian paramyxovirus(es)?([0-9]+| penguin/Falkland Islands/324/2007)? (1, 30)
BK polyomavirus (1, 10)
Bagaza virus (1, 0)
Banna virus (1, 0)
Bat hepevirus (0, 0)
Bat sapovirus TLC58/HK (0, 0)
Bear Canyon mammarenavirus (0, 0)
Beilong virus (0, 0)
Betacoronavirus 1 (2, 20)
Betapapillomavirus 1 (1, 0)
Betapapillomavirus 2 (1, 0)
Betapapillomavirus 3 (0, 0)
Betapapillomavirus 4 (0, 0)
Betapapillomavirus 5 (0, 0)
Betapapillomavirus 6 (0, 0)
Bhanja virus (0, 0)
Bokeloh bat lyssavirus (0, 0)
Borna disease virus (1, 0)
Bourbon virus (0, 0)
Bovine hepacivirus (1, 0)
Bovine parainfluenza virus 3 (1, 0)
Bovine respiratory syncytial virus (0, 0)
Brazoran virus (0, 0)
Bunyamwera virus (1, 20)
California encephalitis virus (2, 20)
Candiru virus (1, 0)
Canine distemper virus (2, 10)
Canine pneumovirus (0, 0)
Cedar virus (0, 0)
Cell fusing agent virus (1, 0)
Cetacean morbillivirus (0, 0)
Chandipura virus (1, 0)
Chaoyang virus (1, 0)
Chapare mammarenavirus (0, 0)
Chikungunya virus (2, 10)
Colobus monkey papillomavirus (0, 0)
Colorado tick fever virus (0, 0)
Cowpox virus (2, 30)
Crimean-Congo hemorrhagic fever virus (2, 30)
*Culex* flavivirus (1, 0)
Cupixi mammarenavirus (0, 0)
Dengue virus (3, 30)
Dobrava-Belgrade virus (1, 0)
Donggang virus (0, 0)
Dugbe virus (1, 0)
Duvenhage virus (1, 0)
Eastern equine encephalitis virus (1, 0)
Entebbe bat virus (0, 0)
Enterovirus A (3, 40)
Enterovirus B (2, 40)
Enterovirus C (2, 40)
Enterovirus D (2, 20)
European bat lyssavirus 1 (1, 10)
European bat lyssavirus 2 (1, 0)
Eyach virus (0, 0)
Feline morbillivirus (1, 0)
Fer-de-Lance paramyxovirus (0, 0)
Fitzroy River virus (0, 0)
Flexal mammarenavirus (0, 0)
GB virus C (3, 30)
Gairo virus (0, 0)
Gemycircularvirus SL1 (1, 0)
Goose paramyxovirus SF02 (0, 0)
Great Island virus (1, 0)
Guanarito mammarenavirus (1, 0)
Hantaan virus (1, 0)
Hantavirus Z10 (1, 0)
Heartland virus (1, 0)
Hendra virus (1, 0)
Hepatitis A virus (2, 20)
Hepatitis B virus (4, 40)
Hepatitis C virus (4, 50)
Hepatitis E virus (3, 40)
Hepatitis delta virus (3, 10)
Human bocavirus (1, 10)
Human coronavirus 229E (1, 0)
Human coronavirus HKU1 (1, 10)
Human coronavirus NL63 (1, 10)
Human endogenous retrovirus K (1, 0)
Human enteric coronavirus strain 4408 (0, 0)
Human genital-associated circular DNA virus-1 (0, 0)
Human herpesvirus 1 (1, 20)
Human herpesvirus 2 (1, 30)
Human herpesvirus 3 (1, 20)
Human herpesvirus 4 (2, 30)
Human herpesvirus 5 (3, 40)
Human herpesvirus 6[AB] (1, 0)
Human herpesvirus 7 (0, 20)
Human herpesvirus 8 (0, 30)
Human immunodeficiency virus 1 (4, 50)
Human immunodeficiency virus 2 (3, 0)
Human mastadenovirus A (1, 20)
Human mastadenovirus B (2, 20)
Human mastadenovirus C (2, 20)
Human mastadenovirus D (2, 20)
Human mastadenovirus E (2, 20)
Human mastadenovirus F (1, 0)
Human mastadenovirus G (1, 0)
Human metapneumovirus (2, 20)
Human papillomavirus(type [0-9]+)? (1, 0)
Human parainfluenza virus 1 (1, 10)
Human parainfluenza virus 2 (1, 10)

Human parainfluenza virus 3 (2, 10)
Human parainfluenza virus 4 (1, 0)
Human parechovirus (2, 0)
Human picobirnavirus (0, 0)
Human smacovirus 1 (1, 0)
Ikoma lyssavirus (0, 0)
Ilheus virus (0, 0)
Influenza A virus (3, 30)
Influenza B virus (1, 0)
Influenza C virus (0, 0)
Ippy mammarenavirus (0, 0)
Irkut virus (0, 0)
J-virus (0, 0)
JC polyomavirus (1, 10)
Japanese encephalitis virus (2, 20)
Junin mammarenavirus (1, 0)
KI polyomavirus (1, 0)
Kadipiro virus (0, 0)
Kamiti River virus (1, 0)
Kedougou virus (0, 0)
Khuj and virus (0, 0)
Kokobera virus (1, 0)
Kyasanur forest disease virus (1, 0)
Lagos bat virus (1, 0)
Langat virus (1, 0)
Lassa mammarenavirus (3, 30)
Latino mammarenavirus (1, 0)
Leopards Hill virus (1, 0)
Liao ning virus (0, 0)
Ljungan virus (1, 0)
Lloviu cuevavirus (0, 0)
Louping ill virus (1, 0)
Lujo mammarenavirus (0, 0)
Luna mammarenavirus (0, 0)
Lunk virus NKS-1 (0, 0)
Lymphocytic choriomeningitis mammarenavirus (1, 0)
Lyssavirus Ozernoe (0, 0)
MSSI2\0.225 virus (0, 0)
Machupo mammarenavirus (0, 0)
Mamastrovirus 1 (2, 20)
Manzanilla virus (1, 0)
Mapuera virus (0, 0)
Marburg marburgvirus (2, 20)
Mayaro virus (1, 0)
Measles virus (2, 0)
Menangle virus (1, 0)
Mercadeo virus (1, 0)
Merkel cell polyomavirus (1, 10)
Middle East respiratory syndrome coronavirus (1, 20)
Mobala mammarenavirus (0, 0)
Modoc virus (0, 0)
Mojiang virus (0, 0)
Mokola virus (1, 0)
Monkeypox virus (1, 20)
Montana *myotis* leukoencephalitis virus (0, 0)
Mopeia Lassa virus reassortant 29 (1, 0)
Mopeia mammarenavirus (1, 0)
Morogoro virus (0, 0)
Mossman virus (0, 0)
Mumps virus (2, 20)
Murine pneumonia virus (1, 0)
Murray Valley encephalitis virus (1, 0)
Nariva virus (0, 0)
Newcastle disease virus (3, 40)
Nipah virus (1, 0)
Norwalk virus (2, 40)
Norway rat hepacivirus([0-9]+)? (0, 0)
Ntaya virus (1, 0)
O'nyong-nyong virus (1, 0)
Oliveros mammarenavirus (0, 0)
Omsk hemorrhagic fever virus (1, 0)
Oropouche virus (1, 0)
Parainfluenza virus 5 (1, 0)
Parana mammarenavirus (1, 0)
Parramatta River virus (0, 0)
Peste-des-petits-ruminants virus (2, 20)
Pichinde mammarenavirus (1, 0)
Pirital mammarenavirus (1, 0)
Piscihepevirus A (0, 0)
Porcine parainfluenza virus 1 (1, 0)
Porcine rubulavirus (0, 0)
Powassan virus (1, 0)
Primate T-lymphotropic virus 1 (1, 0)
Primate T-lymphotropic virus 2 (1, 0)
Primate erythroparvovirus 1 (1, 10)
Punta Toro virus (1, 0)
Puumala virus (1, 20)
Quang Binh virus (0, 0)
Rabies virus (3, 30)
Razdan virus (0, 0)
Reptile bornavirus 1 (0, 0)
Rhinovirus A (1, 50)
Rhinovirus B (1, 30)
Rift Valley fever virus (2, 0)
Rinderpest virus (1, 0)
Rio Bravo virus (1, 0)
Rodent Torque teno virus([0-9]+)? (1, 0)
Rodent hepacivirus (0, 0)
Ross River virus (1, 10)
Rotavirus A (5, 50)
Rotavirus B (1, 20)
Rotavirus C (2, 30)
Rotavirus F (0, 0)
Rotavirus G (1, 0)
Rotavirus H (1, 0)
Rotavirus I (1, 0)
Royal Farm virus (1, 0)
Rubella virus (2, 0)
Sabia mammarenavirus (0, 0)
Salem virus (0, 0)
Sandfly fever Naples virus (1, 20)
Sandfly fever Sicilian virus (1, 0)
Sapporo virus (1, 0)
Sathuperi virus (1, 0)
Seal anellovirus(TFFN/USA/2006|[0-9]+)? (0, 0)
Semliki Forest virus (1, 10)
Sendai virus (1, 0)
Seoul virus (2, 10)
Sepik virus (0, 0)
Severe acute respiratory syndrome-related coronavirus (2, 20)
Severe fever with thrombocytopenia syndrome virus (2, 10)
Shamonda virus (1, 0)
Shimoni bat virus (0, 0)
Shuni virus (1, 0)
Simbu virus (0, 0)
Simian torque teno virus([0-9]+)? (0, 0)
Simian virus 40 (1, 0)
Simian virus 41 (0, 0)
Sin Nombre virus (1, 0)
Sindbis virus (1, 0)
Small anellovirus (0, 0)
Sosuga virus (0, 0)
Spanish goat encephalitis virus (0, 0)

Spondweni virus (0, 0)
St\. Louis encephalitis virus (1, 0)
Sunshine virus (0, 0)
TTV-like mini virus (0, 0)
Tacaribe mammarenavirus (1, 0)
Tailam virus (0, 0)
Tamana bat virus (0, 0)
Tamiami mammarenavirus (1, 0)
Tembusu virus (1, 20)
Thogoto virus (1, 0)
Thottapalayam virus (1, 0)
Tick-borne encephalitis virus (2, 20)
Tioman virus (0, 0)
Torque teno *canis* virus (1, 0)
Torque teno douroucouli virus (0, 0)
Torque teno *felis* virus (1, 0)
Torque teno midi virus([0-9]+) (0, 0)
Torque teno mini virus(ALA22|ALH8|[0-9]+)? (1, 0)
Torque teno sus virus([a-z0-9]+)? (1, 20)
Torque teno tamarin virus (0, 0)
Torque teno virus([0-9]+)? (1, 20)
Torque teno *zalophus* virus([0-9]+)? (0, 0)
Tuhoko virus([0-9]+)? (0, 0)
Tula virus (1, 0)
Tupaia paramyxovirus (0, 0)
Usutu virus (1, 0)
Uukuniemi virus (1, 20)
Vaccinia virus (1, 30)
Variola virus (1, 0)
Venezuelan equine encephalitis virus (2, 0)
Vesicular stomatitis Indiana virus (1, 10)
WU Polyomavirus (1, 0)
Wesselsbron virus (1, 0)
West Caucasian bat virus (0, 0)
West Nile virus (2, 20)
Western equine encephalitis virus (1, 10)
Whitewater Arroyo mammarenavirus (1, 0)
Yellow fever virus (2, 20)
Yokose virus (0, 0)
Yug Bogdanovac virus (0, 0)
Zaire ebolavirus (2, 10)
Zika virus (2, 10)
*Zygosaccharomyces bailii* virus Z (0, 0)

Having thus described in detail preferred embodiments of the present invention, it is to be understood that the invention defined by the above paragraphs is not to be limited to particular details set forth in the above description as many apparent variations thereof are possible without departing from the spirit or scope of the present invention.

SEQUENCE LISTING (452330 sequences)

SEQ ID NO: 1 - DNA, 140 bp, Artificial Sequence
  Synthetic
atacgccatgctgggtctccatgaaaaacccaaagaagagatccggaggattccggattgtcaatatgctaaaacgcggagtagcccgtgtaaaccccttggggggtttgaagaggctgccgtacttgggagtcggccat

SEQ ID NO: 2 - DNA, 140 bp, Artificial Sequence
  Synthetic
atggccgactcccaagtacggcagcctcttcaaaccccccaaggggtttacacgggctactccgcgttttagcatattgacaatccggaatcctccggatctcttctttgggtttttcatggagacccagcatggcgtat

SEQ ID NO: 3 - DNA, 140 bp, Artificial Sequence
  Synthetic
aggccctggctgctgatatgaaaacgcggagtagcccgtgtaaaccccttggggggtttgaagaggctgccggccggacttctgctgggccatggacccatcagaatggttttggcgatagaccttttgggacagcggtg

SEQ ID NO: 4 - DNA, 140 bp, Artificial Sequence
  Synthetic
caccgctgtcccaaaaggtctatcgccaaaaccattctgatgggtccatggcccagcagaagtccggccggcagcctcttcaaaccccccaaggggtttacacgggctactccgcgttttcatatcagcagccagggcct

SEQ ID NO: 5 - DNA, 140 bp, Artificial Sequence
  Synthetic
atacgccatgctgggtctccctagcctttttgagattcacagcaatcaagccatcactgggcctcatcaatagatggggttccgtggggaagaaggaggctatggaaataataaaaaagtcgtacttgggagtcggccat

SEQ ID NO: 6 - DNA, 140 bp, Artificial Sequence
  Synthetic
atggccgactcccaagtacgacttttttattatttccatagcctccttcttccccacggaaccccatctattgatgaggcccagtgatggcttgattgctgtgaatctcaaaaaggctagggagacccagcatggcgtat

SEQ ID NO: 7 - DNA, 140 bp, Artificial Sequence
  Synthetic
atacgccatgctgggtctcctcaagaaagaccttgctgccatgttgagaattatcaatgctaggaaggagaggaagagacgtggcgctgacaccagcatcggaatcgtcggcctcctgctcgtacttgggagtcggccat

SEQ ID NO: 8 - DNA, 140 bp, Artificial Sequence
  Synthetic
atggccgactcccaagtacgagcaggaggccgacgattccgatgctggtgtcagcgccacgtctcttcctctccttcctagcattgataattctcaacatggcagcaaggtctttcttgaggagacccagcatggcgtat

SEQ ID NO: 9 - DNA, 140 bp, Artificial Sequence
  Synthetic
atacgccatgctgggtctccgaccacagccatggcagccgagatcaccagacgtgggagtgcatactacatgtacttggacaggagcgatgctggtaaggccatttcttttgctaccacacgtacttgggagtcggccat

SEQ ID NO: 10 - DNA, 140 bp, Artificial Sequence
  Synthetic
atggccgactcccaagtacgtgtggtagcaaaagaaatggccttaccagcatcgctcctgtccaagtacatgtagtatgcactcccacgtctggtgatctcggctgccatggctgtggtcggagacccagcatggcgtat

SEQ ID NO: 11 - DNA, 140 bp, Artificial Sequence
  Synthetic
aggccctggctgctgatatgtgtacttggacaggagcgatgctggtaaggccatttcttttgctaccacattgggggtgaacaaatgccatgtacagatcatggacctcgggcacatgtggaccttttgggacagcggtg

SEQ ID NO: 12 - DNA, 140 bp, Artificial Sequence
  Synthetic
caccgctgtcccaaaaggtccacatgtgcccgaggtccatgatctgtacatggcatttgttcacccccaatgtggtagcaaaagaaatggccttaccagcatcgctcctgtccaagtacacatatcagcagccagggcct

SEQ ID NO: 13 - DNA, 140 bp, Artificial Sequence
  Synthetic
atacgccatgctgggtctcctgacgccaccatgagttatgagtgccccatgctggacgagggagtggagccagatgacgtcgattgctggtgcaacacgacatcaacttgggttgtgtaccgtacttgggagtcggccat

SEQ ID NO: 14 - DNA, 140 bp, Artificial Sequence
  Synthetic
atggccgactcccaagtacggtacacaacccaagttgatgtcgtgttgcaccagcaatcgacgtcatctggctccactccctcgtccagcatggggcactcataactcatggtggcgtcaggagacccagcatggcgtat

SEQ ID NO: 15 - DNA, 140 bp, Artificial Sequence
  Synthetic
atacgccatgctgggtctccggaacctgtcaacataaaaaaggtgaagcacgacgatccagaagagccgtgacgcttccttctcactccacaaggaagctgcaaacgcgatcacagacttcgtacttgggagtcggccat

SEQ ID NO: 16 - DNA, 140 bp, Artificial Sequence
  Synthetic
atggccgactcccaagtacgaagtctgtgatcgcgtttgcagcttccttgtggagtgagaaggaagcgtcacggctcttctggatcgtcgtgcttcaccttttttatgttgacaggttccggagacccagcatggcgtat

SEQ ID NO: 17 - DNA, 140 bp, Artificial Sequence
  Synthetic
atacgccatgctgggtctccggctagaatcaagagaatacacaaagcacctgatcaaggttgagaattggatattcaggaaccccgggtttgcgctagtggctgtagctattgcctggctcgtacttgggagtcggccat

SEQ ID NO: 18 - DNA, 140 bp, Artificial Sequence
  Synthetic
atggccgactcccaagtacgagccaggcaatagctacagccactagcgcaaacccggggttcctgaatatccaattctcaaccttgatcaggtgctttgtgtattctcttgattctagccggagacccagcatggcgtat

SEQ ID NO: 19 - DNA, 140 bp, Artificial Sequence
  Synthetic
atacgccatgctgggtctcccctgggaagctcgacgagccaaaaagtcatatacttggtaatgatattgttgattgccccggcatacagcatcaggtgcataggagttagcaatagagaccgtacttgggagtcggccat

SEQ ID NO: 20 - DNA, 140 bp, Artificial Sequence
  Synthetic
atggccgactcccaagtacggtctctattgctaactcctatgcacctgatgctgtatgccggggcaatcaacaatatcattaccaagtatatgactttttggctcgtcgagcttcccaggggagacccagcatggcgtat

SEQ ID NO: 21 - DNA, 140 bp, Artificial Sequence
  Synthetic
aggccctggctgctgatatgtgattgccccggcatacagcatcaggtgcataggagttagcaatagagacttcgtggagggcatgtcaggtgggacctgggttgatgttgtcttggaacagaccttttgggacagcggtg

SEQ ID NO: 22 - DNA, 140 bp, Artificial Sequence
  Synthetic
caccgctgtcccaaaaggtctgttccaagacaacatcaacccaggtcccacctgacatgccctccacgaagtctctattgctaactcctatgcacctgatgctgtatgccggggcaatcacatatcagcagccagggcct

SEQ ID NO: 23 - DNA, 140 bp, Artificial Sequence
  Synthetic
atacgccatgctgggtctcctgggggttgcgtcaccgtgatggcacaggacaagccaacagttgacatcgagttggtcacgacaacggttagcaacatggccgaggtaagatcctactgccgtacttgggagtcggccat

SEQ ID NO: 24 - DNA, 140 bp, Artificial Sequence
  Synthetic
atggccgactcccaagtacggcagtaggatcttacctcggccatgttgctaaccgttgtcgtgaccaactcgatgtcaactgttggcttgtcctgtgccatcacggtgacgcaacccccaggagacccagcatggcgtat

SEQ ID NO: 25 - DNA, 140 bp, Artificial Sequence
  Synthetic
aggccctggctgctgatatgagttggtcacgacaacggttagcaacatggccgaggtaagatcctactgctatgaggcatcaatatcggacatggcttcggacagccgctgtccaacacagaccttttgggacagcggtg

SEQ ID NO: 26 - DNA, 140 bp, Artificial Sequence
  Synthetic
caccgctgtcccaaaaggtctgtgttggacagcggctgtccgaagccatgtccgatattgatgcctcatagcagtaggatcttacctcggccatgttgctaaccgttgtcgtgaccaactcatatcagcagccagggcct

SEQ ID NO: 27 - DNA, 140 bp, Artificial Sequence
  Synthetic
atacgccatgctgggtctccaggtgaagcctaccttgacaagcagtcagacactcaatatgtctgcaagagaacattggtggatagaggttggggaaatgggtgtggactttttggcaaacgtacttgggagtcggccat

SEQ ID NO: 28 - DNA, 140 bp, Artificial Sequence
  Synthetic
atggccgactcccaagtacgtttgccaaaaagtccacacccatttccccaacctctatccaccaatgttctcttgcagacatattgagtgtctgactgcttgtcaaggtaggcttcacctggagacccagcatggcgtat

SEQ ID NO: 29 - DNA, 140 bp, Artificial Sequence
  Synthetic
atacgccatgctgggtctccgggagcttggtgacatgtgccaagtttacgtgctccaagaaaatgacaggcaagagcatccagccggagaacttggagtaccggataatgctatcagtgccgtacttgggagtcggccat

SEQ ID NO: 30 - DNA, 140 bp, Artificial Sequence
  Synthetic
atggccgactcccaagtacggcactgatagcattatccggtactccaagttctccggctggatgctcttgcctgtcattttcttggagcacgtaaacttggcacatgtcaccaagctcccggagacccagcatggcgtat

SEQ ID NO: 31 - DNA, 140 bp, Artificial Sequence
  Synthetic
atacgccatgctgggtctccgacgaaaacagagcaaaagtcgaggtcacacccaattcaccaagagcagaagcaaccttgggaggttttggaagcttgggacttgactgtgaaccaaggacgtacttgggagtcggccat

SEQ ID NO: 32 - DNA, 140 bp, Artificial Sequence
  Synthetic
atggccgactcccaagtacgtccttggttcacagtcaagtcccaagcttccaaaacctcccaaggttgcttctgctcttggtgaattgggtgtgacctcgacttttgctctgttttcgtcggagacccagcatggcgtat

SEQ ID NO: 33 - DNA, 140 bp, Artificial Sequence
  Synthetic
aggccctggctgctgatatgagcaaccttgggaggttttggaagcttgggacttgactgtgaaccaaggacaggccttgacttctcagatctgtattacctgaccatgaacaataagcatgaccttttgggacagcggtg

SEQ ID NO: 34 - DNA, 140 bp, Artificial Sequence
  Synthetic
caccgctgtcccaaaaggtcatgcttattgttcatggtcaggtaatacagatctgagaagtcaaggcctgtccttggttcacagtcaagtcccaagcttccaaaacctcccaaggttgctcatatcagcagccagggcct

SEQ ID NO: 35 - DNA, 140 bp, Artificial Sequence
  Synthetic
atacgccatgctgggtctcctggttggtgcacaaggagtggtttcatgacatcccattaccttggcatgctggtgcagacactggaactccacactggaacaacaaagaggcattggtggcgtacttgggagtcggccat

SEQ ID NO: 36 - DNA, 140 bp, Artificial Sequence
  Synthetic
atggccgactcccaagtacgccaccaatgcctctttgttgttccagtgtggagttccagtgtctgcaccagcatgccaaggtaatgggatgtcatgaaaccactccttgtgcaccaaccaggagacccagcatggcgtat

SEQ ID NO: 37 - DNA, 140 bp, Artificial Sequence
  Synthetic
aggccctggctgctgatatgtggtgcagacactggaactccacactggaacaacaaagaggcattggtggagtttaaggacgcccacgccaagaggcaaactgttgtggttctggggagcgaccttttgggacagcggtg

SEQ ID NO: 38 - DNA, 140 bp, Artificial Sequence
  Synthetic
caccgctgtcccaaaaggtcgctccccagaaccacaacagtttgcctcttggcgtgggcgtccttaaactccaccaatgcctctttgttgttccagtgtggagttccagtgtctgcaccacatatcagcagccagggcct

SEQ ID NO: 39 - DNA, 140 bp, Artificial Sequence
  Synthetic
atacgccatgctgggtctcccaagagggagctgttcacacggccctcgctggagctttggaggctgagatggatggtgcaaagggaaggctattctctggccatttgaaatgccgcctaacgtacttgggagtcggccat

SEQ ID NO: 40 - DNA, 140 bp, Artificial Sequence
  Synthetic
atggccgactcccaagtacgttaggcggcatttcaaatggccagagaatagccttccctttgcaccatccatctcagcctccaaagctccagcgagggccgtgtgaacagctccctcttgggagacccagcatggcgtat

SEQ ID NO: 41 - DNA, 140 bp, Artificial Sequence
  Synthetic
aggccctggctgctgatatgggatggtgcaaagggaaggctattctctggccatttgaaatgccgcctaaaaatggacaagcttaggttgaagggtgtgtcatattccctgtgtaccgcagaccttttgggacagcggtg

SEQ ID NO: 42 - DNA, 140 bp, Artificial Sequence
  Synthetic
caccgctgtcccaaaaggtctgcggtacacagggaatatgacacacccttcaacctaagcttgtccatttttaggcggcatttcaaatggccagagaatagccttccctttgcaccatcccatatcagcagccagggcct

SEQ ID NO: 43 - DNA, 140 bp, Artificial Sequence
  Synthetic
atacgccatgctgggtctccaaatggacaagcttaggttgaagggtgtgtcatattccctgtgtaccgcagtgtgtaccgcagcgaaggtcccagctgaaacattgcatggaacagtcaccgtacttgggagtcggccat

SEQ ID NO: 44 - DNA, 140 bp, Artificial Sequence
  Synthetic
atggccgactcccaagtacggtgactgttccatgcaatgtttcagctgggaccttcgctgcggtacacactgcggtacacagggaatatgacacacccttcaacctaagcttgtccatttggagacccagcatggcgtat

SEQ ID NO: 45 - DNA, 140 bp, Artificial Sequence
  Synthetic
aggccctggctgctgatatgagtggaggtgcagtatgcagggacagatggaccctgcaaggtcccagcccagatggcggtagacatgcagaccctgaccccagttggaaggctgataaccgaccttttgggacagcggtg

SEQ ID NO: 46 - DNA, 140 bp, Artificial Sequence
  Synthetic
caccgctgtcccaaaaggtcggttatcagccttccaactggggtcagggtctgcatgtctaccgccatctgggctgggaccttgcagggtccatctgtccctgcatactgcacctccactcatatcagcagccagggcct

SEQ ID NO: 47 - DNA, 140 bp, Artificial Sequence
  Synthetic
atacgccatgctgggtctccgctcgacccaccatttggggattcttacattgtcataggagtcggggacaagaaaatcacccatcactggcatcggagtggtagcaccatcggaaaggcacgtacttgggagtcggccat

SEQ ID NO: 48 - DNA, 140 bp, Artificial Sequence
  Synthetic
atggccgactcccaagtacgtgcctttccgatggtgctaccactccgatgccagtgatgggtgattttcttgtccccgactcctatgacaatgtaagaatccccaaatggtgggtcgagcggagacccagcatggcgtat

SEQ ID NO: 49 - DNA, 140 bp, Artificial Sequence
  Synthetic
aggccctggctgctgatatgagaaaatcacccatcactggcatcggagtggtagcaccatcggaaaggcatttgaagccactgtgagaggtgccaagagaatggcagtcttgggggacacgaccttttgggacagcggtg

SEQ ID NO: 50 - DNA, 140 bp, Artificial Sequence
  Synthetic
caccgctgtcccaaaaggtcgtgtcccccaagactgccattctcttggcacctctcacagtggcttcaaatgcctttccgatggtgctaccactccgatgccagtgatgggtgattttctcatatcagcagccagggcct

SEQ ID NO: 51 - DNA, 140 bp, Artificial Sequence
  Synthetic
atacgccatgctgggtctcctttgaagccactgtgagaggtgccaagagaatggcagtcttgggggacacagcctgggactttggatcagttgggggtgtgtttaattcattgggtaaggcgtacttgggagtcggccat

SEQ ID NO: 52 - DNA, 140 bp, Artificial Sequence
  Synthetic
atggccgactcccaagtacgccttacccaatgaattaaacacacccccaactgatccaaagtcccaggctgtgtcccccaagactgccattctcttggcacctctcacagtggcttcaaaggagacccagcatggcgtat

SEQ ID NO: 53 - DNA, 140 bp, Artificial Sequence
  Synthetic
atacgccatgctgggtctccgtattcaccagatctttggagcagcttttaaatcactgtttggaggaatgtcctggttctcacagatcctcataggcacactgttggtgtggttaggtctcgtacttgggagtcggccat

SEQ ID NO: 54 - DNA, 140 bp, Artificial Sequence
  Synthetic
atggccgactcccaagtacgagacctaaccacaccaacagtgtgcctatgaggatctgtgagaaccaggacattcctccaaacagtgatttaaaagctgctccaaagatctggtgaatacggagacccagcatggcgtat

SEQ ID NO: 55 - DNA, 140 bp, Artificial Sequence
  Synthetic
atacgccatgctgggtctccgaacacaaagaatggatctatctccctcacatgcttagccctggggggagtgatgatcttcctttccacggctgtttctgctgatgttgggtgctcggtgcgtacttgggagtcggccat

SEQ ID NO: 56 - DNA, 140 bp, Artificial Sequence
  Synthetic
atggccgactcccaagtacgcaccgagcacccaacatcagcagaaacagccgtggaaaggaagatcatcactccccccagggctaagcatgtgagggagatagatccattctttgtgttcggagacccagcatggcgtat

SEQ ID NO: 57 - DNA, 140 bp, Artificial Sequence
  Synthetic
atacgccatgctgggtctccgacttctcaaaaaaggaaacgagatgtggcacgggggtgttcgtctacaatgacgttgaagcctggagggaccggtacaagtaccatcctgactcccccccgtacttgggagtcggccat

SEQ ID NO: 58 - DNA, 140 bp, Artificial Sequence
  Synthetic
atggccgactcccaagtacgggggggagtcaggatggtacttgtaccggtccctccaggcttcaacgtcattgtagacgaacacccccgtgccacatctcgtttccttttttgagaagtcggagacccagcatggcgtat

SEQ ID NO: 59 - DNA, 140 bp, Artificial Sequence
  Synthetic
aggccctggctgctgatatgtgacgttgaagcctggagggaccggtacaagtaccatcctgactccccccgcagattggcagcagctgtcaagcaggcttgggaagaggggatttgtggggaccttttgggacagcggtg

SEQ ID NO: 60 - DNA, 140 bp, Artificial Sequence
  Synthetic
caccgctgtcccaaaaggtccccacaaatcccctcttcccaagcctgcttgacagctgctgccaatctgcggggggagtcaggatggtacttgtaccggtccctccaggcttcaacgtcacatatcagcagccagggcct

SEQ ID NO: 61 - DNA, 140 bp, Artificial Sequence
  Synthetic
aggccctggctgctgatatgatctcctccgtttcgagaatggaaaacatcatgtggaaatcagtggaaggggagcttaatgcaatcctagaggagaatggagtccaactgacagttgtaggaccttttgggacagcggtg

SEQ ID NO: 62 - DNA, 140 bp, Artificial Sequence
  Synthetic
caccgctgtcccaaaaggtcctacaactgtcagttggactccattctcctctaggattgcattaagctccccttccactgatttccacatgatgttttccattctcgaaacggaggagatcatatcagcagccagggcct

SEQ ID NO: 63 - DNA, 140 bp, Artificial Sequence
  Synthetic
atacgccatgctgggtctcctggggtctgtaaaaaaccctatgtggagaggtccacaaagattgccagtgcccgtgaatgagctgccccatggctggaaagcctgggggaaatcgtacttcgtacttgggagtcggccat

SEQ ID NO: 64 - DNA, 140 bp, Artificial Sequence
  Synthetic
atggccgactcccaagtacgaagtacgatttcccccaggctttccagccatggggcagctcattcacgggcactggcaatctttgtggacctctccacatagggttttttacagaccccaggagacccagcatggcgtat

SEQ ID NO: 65 - DNA, 140 bp, Artificial Sequence
  Synthetic
aggccctggctgctgatatgcccgtgaatgagctgccccatggctggaaagcctgggggaaatcgtactttgtcagagcggcaaagaccaacaacagttttgttgtcgacggtgacacacgaccttttgggacagcggtg

SEQ ID NO: 66 - DNA, 140 bp, Artificial Sequence
  Synthetic
caccgctgtcccaaaaggtcgtgtgtcaccgtcgacaacaaaactgttgttggtctttgccgctctgacaaagtacgatttcccccaggctttccagccatggggcagctcattcacgggcatatcagcagccagggcct

SEQ ID NO: 67 - DNA, 140 bp, Artificial Sequence
  Synthetic
atacgccatgctgggtctcctgaaggagtgtccgctcaaacatagagcatggaatagcttccttgtggaggatcacgggtttgggatcttccacaccagtgtttggctgaaggtcagagacgtacttgggagtcggccat

SEQ ID NO: 68 - DNA, 140 bp, Artificial Sequence
  Synthetic
atggccgactcccaagtacgtctctgaccttcagccaaacactggtgtggaagatcccaaacccgtgatcctccacaaggaagctattccatgctctatgtttgagcggacactccttcaggagacccagcatggcgtat

SEQ ID NO: 69 - DNA, 140 bp, Artificial Sequence
  Synthetic
aggccctggctgctgatatggatcacgggtttgggatcttccacaccagtgtttggctgaaggtcagagaggactactcattagagtgtgacccagccgtcataggaacagctgtcaagggaccttttgggacagcggtg

SEQ ID NO: 70 - DNA, 140 bp, Artificial Sequence
  Synthetic
caccgctgtcccaaaaggtcccttgacagctgttcctatgacggctgggtcacactctaatgagtagtcctctctgaccttcagccaaacactggtgtggaagatcccaaacccgtgatccatatcagcagccagggcct

SEQ ID NO: 71 - DNA, 140 bp, Artificial Sequence
  Synthetic
atacgccatgctgggtctccgaaaggaagctgcacacagtgatctaggctattggattgagagtgaaaagaatgacacatggaggctgaggagggctcatctgattgagatgaaaacatgcgtacttgggagtcggccat

SEQ ID NO: 72 - DNA, 140 bp, Artificial Sequence
  Synthetic
atggccgactcccaagtacgcatgttttcatctcaatcagatgagccctcctcagcctccatgtgtcattcttttcactctcaatccaatagcctagatcactgtgtgcagcttcctttcggagacccagcatggcgtat

SEQ ID NO: 73 - DNA, 140 bp, Artificial Sequence
  Synthetic
atacgccatgctgggtctcctgagtggccaaagtctcacacactgtggacagatggagtggaagaaagtgatctgatcatacccaagtccttagctggtccactcagccaccacaacacccgtacttgggagtcggccat

SEQ ID NO: 74 - DNA, 140 bp, Artificial Sequence
  Synthetic
atggccgactcccaagtacgggtgttgtggtggctgagtggaccagctaaggacttgggtatgatcagatcactttcttccactccatctgtccacagtgtgtgagactttggccactcaggagacccagcatggcgtat

SEQ ID NO: 75 - DNA, 140 bp, Artificial Sequence
  Synthetic
atacgccatgctgggtctccagagagggttacagaactcaagtgaaagggccatggcatagtgaagagctcgaaatccggtttgaggagtgcccaggaaccaaggttcacgtggaggagacgtacttgggagtcggccat

SEQ ID NO: 76 - DNA, 140 bp, Artificial Sequence
  Synthetic
atggccgactcccaagtacgtctcctccacgtgaaccttggttcctgggcactcctcaaaccggatttcgagctcttcactatgccatggccctttcacttgagttctgtaaccctctctggagacccagcatggcgtat

SEQ ID NO: 77 - DNA, 140 bp, Artificial Sequence
  Synthetic
atacgccatgctgggtctcccatgcggaactagaggaccatctctgagatcaactactgcaagtggaagggtcatagaggaatggtgctgtagggaatgcacaatgcctccactatcgttcgtacttgggagtcggccat

SEQ ID NO: 78 - DNA, 140 bp, Artificial Sequence
  Synthetic
atggccgactcccaagtacgaacgatagtggaggcattgtgcattccctacagcaccattcctctatgacccttccacttgcagtagttgatctcagagatggtcctctagttccgcatgggagacccagcatggcgtat

SEQ ID NO: 79 - DNA, 140 bp, Artificial Sequence
  Synthetic
aggccctggctgctgatatggtcatagaggaatggtgctgtagggaatgcacaatgcctccactatcgttccgggcgaaagacggctgctggtatggaatggagataaggcccagaaagggaccttttgggacagcggtg

SEQ ID NO: 80 - DNA, 140 bp, Artificial Sequence
  Synthetic
caccgctgtcccaaaaggtccctttctgggccttatctccattccataccagcagccgtctttcgcccggaacgatagtggaggcattgtgcattccctacagcaccattcctctatgaccatatcagcagccagggcct

SEQ ID NO: 81 - DNA, 140 bp, Artificial Sequence
  Synthetic
atacgccatgctgggtctccaaccagagagcaacttagtaaggtctatggtgacagcaggatcaaccgatcatatggatcacttctctcttggagtgcttgtgattctactcatggtgcacgtacttgggagtcggccat

SEQ ID NO: 82 - DNA, 140 bp, Artificial Sequence
  Synthetic
atggccgactcccaagtacgtgcaccatgagtagaatcacaagcactccaagagagaagtgatccatatgatcggttgatcctgctgtcaccatagaccttactaagttgctctctggttggagacccagcatggcgtat

SEQ ID NO: 83 - DNA, 140 bp, Artificial Sequence
  Synthetic
atacgccatgctgggtctccggaaggtttgaagaagagaatgaccacaaagatcataatgagcacatcaatggcagtgctggtagccatggtcttgggaggattctcaatgagtgacctgcgtacttgggagtcggccat

SEQ ID NO: 84 - DNA, 140 bp, Artificial Sequence
  Synthetic
atggccgactcccaagtacgcaggtcactcattgagaatcctcccaagaccatggctaccagcactgccattgatgtgctcattatgatctttgtggtcattctcttcttcaaaccttccggagacccagcatggcgtat

SEQ ID NO: 85 - DNA, 140 bp, Artificial Sequence
  Synthetic
atacgccatgctgggtctccgctaagcttgtgatcctgatgggtgccactttcgcagaaatgaacactggaggagatgtggctcacttggcattggttgcggcatttaaagtcagaccagcgtacttgggagtcggccat

SEQ ID NO: 86 - DNA, 140 bp, Artificial Sequence
  Synthetic
atggccgactcccaagtacgctggtctgactttaaatgccgcaaccaatgccaagtgagccacatctcctccagtgttcatttctgcgaaagtggcacccatcaggatcacaagcttagcggagacccagcatggcgtat

SEQ ID NO: 87 - DNA, 140 bp, Artificial Sequence
  Synthetic
aggccctggctgctgatatgaggagatgtggctcacttggcattggttgcggcatttaaagtcagaccagccttgttggtttccttcatcttcagagccaactggacaccccgtgagagcgaccttttgggacagcggtg

SEQ ID NO: 88 - DNA, 140 bp, Artificial Sequence
  Synthetic
caccgctgtcccaaaaggtcgctctcacggggtgtccagttggctctgaagatgaaggaaaccaacaaggctggtctgactttaaatgccgcaaccaatgccaagtgagccacatctcctcatatcagcagccagggcct

SEQ ID NO: 89 - DNA, 140 bp, Artificial Sequence
  Synthetic
atacgccatgctgggtctccatgctgctagccctggcttcgtgtctcctgcagactgcgatctccgctcttgaaggcgagctgatggtcctcgttaatggatttgctttggcctggttggcgtacttgggagtcggccat

SEQ ID NO: 90 - DNA, 140 bp, Artificial Sequence
  Synthetic
atggccgactcccaagtacgccaaccaggccaaagcaaatccattaacgaggaccatcagctcgccttcaagagcggagatcgcagtctgcaggagacacgaagccagggctagcagcatggagacccagcatggcgtat

SEQ ID NO: 91 - DNA, 140 bp, Artificial Sequence
  Synthetic
aggccctggctgctgatatgtgaaggcgagctgatggtcctcgttaatggatttgctttggcctggttggcaatacgagcaatggccgtgccacgcactgacaatatcgctctagcaattgaccttttgggacagcggtg

SEQ ID NO: 92 - DNA, 140 bp, Artificial Sequence
  Synthetic
caccgctgtcccaaaaggtcaattgctagagcgatattgtcagtgcgtggcacggccattgctcgtattgccaaccaggccaaagcaaatccattaacgaggaccatcagctcgccttcacatatcagcagccagggcct

SEQ ID NO: 93 - DNA, 140 bp, Artificial Sequence
  Synthetic
atacgccatgctgggtctccctggctgctctaacaccattagccagaggcacactgctcgtggcatggagagcgggcctcgccacttgtggagggttcatgctcctttccctgaaagggacgtacttgggagtcggccat

SEQ ID NO: 94 - DNA, 140 bp, Artificial Sequence
  Synthetic
atggccgactcccaagtacgtccctttcagggaaaggagcatgaaccctccacaagtggcgaggcccgctctccatgccacgagcagtgtgcctctggctaatggtgttagagcagccagggagacccagcatggcgtat

SEQ ID NO: 95 - DNA, 140 bp, Artificial Sequence
  Synthetic
atacgccatgctgggtctccaaggtagtgtgaagaagaacctgccttttgtcatggccttggggttgaccgctgtgaggatagtggaccccatcaatgtggtaggactactgttactcaccgtacttgggagtcggccat

SEQ ID NO: 96 - DNA, 140 bp, Artificial Sequence
  Synthetic
atggccgactcccaagtacggtgagtaacagtagtcctaccacattgatggggtccactatcctcacagcggtcaaccccaaggccatgacaaaaggcaggttcttcttcacactaccttggagacccagcatggcgtat

SEQ ID NO: 97 - DNA, 140 bp, Artificial Sequence
  Synthetic
atacgccatgctgggtctccacggagtggaaaacggagctggccccctagtgaagtgcttacagctgttggcctgatatgtgcactggccggagggtttgccaaggcagatatagagatgcgtacttgggagtcggccat

SEQ ID NO: 98 - DNA, 140 bp, Artificial Sequence
  Synthetic
atggccgactcccaagtacgcatctctatatctgccttggcaaaccctccggccagtgcacatatcaggccaacagctgtaagcacttcactagggggccagctccgttttccactccgtggagacccagcatggcgtat

SEQ ID NO: 99 - DNA, 140 bp, Artificial Sequence
  Synthetic
aggccctggctgctgatatggctgggcccatggctgcagtaggcctgctaattgtcagttatgtggtctcgggaaagagtgtggacatgtacatcgaaagagcaggtgatatcacatggggaccttttgggacagcggtg

SEQ ID NO: 100 - DNA, 140 bp, Artificial Sequence
  Synthetic
caccgctgtcccaaaaggtccccatgtgatatcacctgctctttcgatgtacatgtccacactctttcccgagaccacataactgacaattagcaggcctactgcagccatgggcccagccatatcagcagccagggcct

SEQ ID NO: 101 - DNA, 140 bp, Artificial Sequence
  Synthetic
aggccctggctgctgatatggggaaagagtgtggacatgtacatcgaaagagcaggtgatatcacatgggaaaaagacacggaagtcactggaaacagtcctcggcttgacgtggcactagaccttttgggacagcggtg

SEQ ID NO: 102 - DNA, 140 bp, Artificial Sequence
  Synthetic
caccgctgtcccaaaaggtctagtgccacgtcaagccgaggactgtttccagtgacttccgtgtctttttcccatgtgatatcacctgctctttcgatgtacatgtccacactctttccccatatcagcagccagggcct

SEQ ID NO: 103 - DNA, 140 bp, Artificial Sequence
  Synthetic
aggccctggctgctgatatggggaaagagtgtggacatgtacatcgaaagagcaggtgatatcacatgggaaaaagactcggaagtcactggaaacagtcctcggcttgacgtggcactagaccttttgggacagcggtg

SEQ ID NO: 104 - DNA, 140 bp, Artificial Sequence
  Synthetic
caccgctgtcccaaaaggtctagtgccacgtcaagccgaggactgtttccagtgacttccgagtctttttcccatgtgatatcacctgctctttcgatgtacatgtccacactctttccccatatcagcagccagggcct

SEQ ID NO: 105 - DNA, 140 bp, Artificial Sequence
  Synthetic
aggccctggctgctgatatggggaaagagtgtggacatgtacatcgaaagagcaggtgatatcacatgggaaaaagacccggaagtcactggaaacagtcctcggcttgacgtggcactagaccttttgggacagcggtg

SEQ ID NO: 106 - DNA, 140 bp, Artificial Sequence
  Synthetic
caccgctgtcccaaaaggtctagtgccacgtcaagccgaggactgtttccagtgacttccgggtctttttcccatgtgatatcacctgctctttcgatgtacatgtccacactctttccccatatcagcagccagggcct

SEQ ID NO: 107 - DNA, 140 bp, Artificial Sequence
  Synthetic
aggccctggctgctgatatggggaaagagtgtggacatgtacatcgaaagagcaggtgatatcacatgggaaaaagacgcggaagtcactggaaacagtcctcggcttgacgtggcactagaccttttgggacagcggtg

SEQ ID NO: 108 - DNA, 140 bp, Artificial Sequence
  Synthetic
caccgctgtcccaaaaggtctagtgccacgtcaagccgaggactgtttccagtgacttccgcgtctttttcccatgtgatatcacctgctctttcgatgtacatgtccacactctttccccatatcagcagccagggcct

SEQ ID NO: 109 - DNA, 140 bp, Artificial Sequence
  Synthetic
atacgccatgctgggtctccgatgagagtggtgatttctccttggtagaggaggatggcccacccatgagagagatcatactcaaggtggtcctgatggccatctgtggcatgaacccaacgtacttgggagtcggccat

SEQ ID NO: 110 - DNA, 140 bp, Artificial Sequence
  Synthetic
atggccgactcccaagtacgttgggttcatgccacagatggccatcaggaccaccttgagtatgatctctctcatgggtgggccatcctcctctaccaaggagaaatcaccactctcatcggagacccagcatggcgtat

SEQ ID NO: 111 - DNA, 140 bp, Artificial Sequence
  Synthetic
aggccctggctgctgatatgagagatcatactcaaggtggtcctgatggccatctgtggcatgaacccaatagccatacccttcgctgcaggagcgtggtatgtgtatgtaaagactggagaccttttgggacagcggtg

SEQ ID NO: 112 - DNA, 140 bp, Artificial Sequence
  Synthetic
caccgctgtcccaaaaggtctccagtctttacatacacataccacgctcctgcagcgaagggtatggctattgggttcatgccacagatggccatcaggaccaccttgagtatgatctctcatatcagcagccagggcct

SEQ ID NO: 113 - DNA, 140 bp, Artificial Sequence
  Synthetic
atacgccatgctgggtctccaaaaggagtggtgccctctgggacgtgcctgctcccaaagaagtgaaaaaaggagagactacagatggagtgtacagagtgatgactcgcagactgctggcgtacttgggagtcggccat

SEQ ID NO: 114 - DNA, 140 bp, Artificial Sequence
  Synthetic
atggccgactcccaagtacgccagcagtctgcgagtcatcactctgtacactccatctgtagtctctccttttttcacttctttgggagcaggcacgtcccagagggcaccactccttttggagacccagcatggcgtat

SEQ ID NO: 115 - DNA, 140 bp, Artificial Sequence
  Synthetic
aggccctggctgctgatatgaggagagactacagatggagtgtacagagtgatgactcgcagactgctgggttcaacacaggttggagtgggagtcatgcaagagggagtcttccacaccgaccttttgggacagcggtg

SEQ ID NO: 116 - DNA, 140 bp, Artificial Sequence
  Synthetic
caccgctgtcccaaaaggtcggtgtggaagactccctcttgcatgactcccactccaacctgtgttgaacccagcagtctgcgagtcatcactctgtacactccatctgtagtctctcctcatatcagcagccagggcct

SEQ ID NO: 117 - DNA, 140 bp, Artificial Sequence
  Synthetic
atacgccatgctgggtctccatgtggcacgtcacaaaaggagccgcattgaggagcggtgaaggaagacttgatccatattggggggacgtcaagcaggacttggtgtcatattgtgggccgtacttgggagtcggccat

SEQ ID NO: 118 - DNA, 140 bp, Artificial Sequence
  Synthetic
atggccgactcccaagtacggcccacaatatgacaccaagtcctgcttgacgtccccccaatatggatcaagtcttccttcaccgctcctcaatgcggctccttttgtgacgtgccacatggagacccagcatggcgtat

SEQ ID NO: 119 - DNA, 140 bp, Artificial Sequence
  Synthetic
atacgccatgctgggtctcccgtggaagttggatgcagcctgggatggactaagtgaagtgcagcttttggccgtaccccccggagagagggctagaaacattcagactctgcctggaatcgtacttgggagtcggccat

SEQ ID NO: 120 - DNA, 140 bp, Artificial Sequence
  Synthetic
atggccgactcccaagtacgattccaggcagagtctgaatgtttctagccctctctccggggggtacggccaaaagctgcacttcacttagtccatcccaggctgcatccaacttccacgggagacccagcatggcgtat

SEQ ID NO: 121 - DNA, 140 bp, Artificial Sequence
  Synthetic
aggccctggctgctgatatggccgtaccccccggagagagggctagaaacattcagactctgcctggaatattcaagacaaaggatggggacatcggagcagtcgctctagactaccccggaccttttgggacagcggtg

SEQ ID NO: 122 - DNA, 140 bp, Artificial Sequence
  Synthetic
caccgctgtcccaaaaggtccggggtagtctagagcgactgctccgatgtccccatcctttgtcttgaatattccaggcagagtctgaatgtttctagccctctctccggggggtacggccatatcagcagccagggcct

SEQ ID NO: 123 - DNA, 140 bp, Artificial Sequence
  Synthetic
atacgccatgctgggtctcccaggaacctcaggatctccaatcctagacaaatgcggaagagtgataggactttatggcaatggggttgtgatcaagaatggaagctatgttagtgccatcgtacttgggagtcggccat

SEQ ID NO: 124 - DNA, 140 bp, Artificial Sequence
  Synthetic
atggccgactcccaagtacgatggcactaacatagcttccattcttgatcacaaccccattgccataaagtcctatcactcttccgcatttgtctaggattggagatcctgaggttcctgggagacccagcatggcgtat

SEQ ID NO: 125 - DNA, 140 bp, Artificial Sequence
  Synthetic
aggccctggctgctgatatgctttatggcaatggggttgtgatcaagaatggaagctatgttagtgccataacccagggaaaaagggaggaggaggctccagttgagtgctttgaaccctgaccttttgggacagcggtg

SEQ ID NO: 126 - DNA, 140 bp, Artificial Sequence
  Synthetic
caccgctgtcccaaaaggtcagggttcaaagcactcaactggagcctcctcctccctttttccctgggttatggcactaacatagcttccattcttgatcacaaccccattgccataaagcatatcagcagccagggcct

SEQ ID NO: 127 - DNA, 140 bp, Artificial Sequence
  Synthetic
aggccctggctgctgatatgcgatgctgaggaagaagcagctaacagtcttggatctgcatccaggagccgggaaaaccaggagggttcttcctgaaatagtccgtgaagccataaagaagaccttttgggacagcggtg

SEQ ID NO: 128 - DNA, 140 bp, Artificial Sequence
  Synthetic
caccgctgtcccaaaaggtcttctttatggcttcacggactatttcaggaagaaccctcctggttttcccggctcctggatgcagatccaagactgttagctgcttcttcctcagcatcgcatatcagcagccagggcct

SEQ ID NO: 129 - DNA, 140 bp, Artificial Sequence
  Synthetic
aggccctggctgctgatatgaacgtcacccattctgggacagaaatcgttgatttgatgtgccatgccactttcacttcacgcttactacaacccatcagagtccctaattacaatctcagaccttttgggacagcggtg

SEQ ID NO: 130 - DNA, 140 bp, Artificial Sequence
  Synthetic
caccgctgtcccaaaaggtctgagattgtaattagggactctgatgggttgtagtaagcgtgaagtgaaagtggcatggcacatcaaatcaacgatttctgtcccagaatgggtgacgttcatatcagcagccagggcct

SEQ ID NO: 131 - DNA, 140 bp, Artificial Sequence
  Synthetic
atacgccatgctgggtctccacatcatggatgaagcccacttcacagacccctcaagtatagctgcaagaggatacatatcaacaagggttgaaatgggcgaggcggctgccatttttatcgtacttgggagtcggccat

SEQ ID NO: 132 - DNA, 140 bp, Artificial Sequence
  Synthetic
atggccgactcccaagtacgataaaaatggcagccgcctcgcccatttcaacccttgttgatatgtatcctcttgcagctatacttgaggggtctgtgaagtgggcttcatccatgatgtggagacccagcatggcgtat

SEQ ID NO: 133 - DNA, 140 bp, Artificial Sequence
  Synthetic
atacgccatgctgggtctccgactgccacaccaccaggaacccgtgatgcgtttcctgactctaactcaccaatcatggacacagaagtggaagtcccagagagagcctggagctcaggccgtacttgggagtcggccat

SEQ ID NO: 134 - DNA, 140 bp, Artificial Sequence
  Synthetic
atggccgactcccaagtacggcctgagctccaggctctctctgggacttccacttctgtgtccatgattggtgagttagagtcaggaaacgcatcacgggttcctggtggtgtggcagtcggagacccagcatggcgtat

SEQ ID NO: 135 - DNA, 140 bp, Artificial Sequence
  Synthetic
atacgccatgctgggtctcctttgactgggtgacggaccattctgggaaaacaatttggtttgttccaagtgtgagatctggagaagaaagcgcagcctgtctgacaaaggctggaaagccgtacttgggagtcggccat

SEQ ID NO: 136 - DNA, 140 bp, Artificial Sequence
  Synthetic
atggccgactcccaagtacggctttccagcctttgtcagacaggctgcgctttcttctccagatctcacacttggaacaaaccaaattgttttcccagaatggtccgtcacccagtcaaaggagacccagcatggcgtat

SEQ ID NO: 137 - DNA, 140 bp, Artificial Sequence
  Synthetic
atacgccatgctgggtctccgggttatacagctcagcaggaagacttttgagacagagtttcagaagacaaaaaatcaagagtgggactttgtcataacaactgacatttcagagatgggcgtacttgggagtcggccat

SEQ ID NO: 138 - DNA, 140 bp, Artificial Sequence
  Synthetic
atggccgactcccaagtacgcccatctctgaaatgtcagttgttatgacaaagtcccactcttgattttttgtcttctgaaactctgtctcaaaagtcttcctgctgagctgtataacccggagacccagcatggcgtat

SEQ ID NO: 139 - DNA, 140 bp, Artificial Sequence
  Synthetic
aggccctggctgctgatatgaaaaatcaagagtgggactttgtcataacaactgacatttcagagatgggtgccaatttcaaggctgaccgggtcatagattccaggagatgcctaaagcgaccttttgggacagcggtg

SEQ ID NO: 140 - DNA, 140 bp, Artificial Sequence
  Synthetic
caccgctgtcccaaaaggtcgctttaggcatctcctggaatctatgacccggtcagccttgaaattggcacccatctctgaaatgtcagttgttatgacaaagtcccactcttgatttttcatatcagcagccagggcct

SEQ ID NO: 141 - DNA, 140 bp, Artificial Sequence
  Synthetic
atacgccatgctgggtctcccagtcatactcgatggtgagagagtcatcctggctgggcccatgcctgtcacgcatgccagtgctgctcagaggagaggacgtataggcaggaaccccaacgtacttgggagtcggccat

SEQ ID NO: 142 - DNA, 140 bp, Artificial Sequence
  Synthetic
atggccgactcccaagtacgttggggttcctgcctatacgtcctctcctctgagcagcactggcatgcgtgacaggcatgggcccagccaggatgactctctcaccatcgagtatgactgggagacccagcatggcgtat

SEQ ID NO: 143 - DNA, 140 bp, Artificial Sequence
  Synthetic
atacgccatgctgggtctcccaaacctggagatgagtacatgtatggaggtgggtgtgcagagactgatgaagaccatgcacactggcttgaagcaagaatgcttcttgacaacatttaccgtacttgggagtcggccat

SEQ ID NO: 144 - DNA, 140 bp, Artificial Sequence
  Synthetic
atggccgactcccaagtacggtaaatgttgtcaagaagcattcttgcttcaagccagtgtgcatggtcttcatcagtctctgcacacccacctccatacatgtactcatctccaggtttgggagacccagcatggcgtat

SEQ ID NO: 145 - DNA, 140 bp, Artificial Sequence
  Synthetic
atacgccatgctgggtctccctccaggatggcctcatagcctcgctctatcggcctgaggccgacaaggtagccgccattgagggagagttcaagctgaggacagagcaaaggaagacctcgtacttgggagtcggccat

SEQ ID NO: 146 - DNA, 140 bp, Artificial Sequence
  Synthetic
atggccgactcccaagtacgaggtcttcctttgctctgtcctcagcttgaactctccctcaatggcggctaccttgtcggcctcaggccgatagagcgaggctatgaggccatcctggagggagacccagcatggcgtat

SEQ ID NO: 147 - DNA, 140 bp, Artificial Sequence
  Synthetic
aggccctggctgctgatatgagccgccattgagggagagttcaagctgaggacagagcaaaggaagacctttgtggaactcatgaagagaggagaccttcccgtttggctggcctatcaagaccttttgggacagcggtg

SEQ ID NO: 148 - DNA, 140 bp, Artificial Sequence
  Synthetic
caccgctgtcccaaaaggtcttgataggccagccaaacgggaaggtctcctctcttcatgagttccacaaaggtcttcctttgctctgtcctcagcttgaactctccctcaatggcggctcatatcagcagccagggcct

SEQ ID NO: 149 - DNA, 140 bp, Artificial Sequence
  Synthetic
aggccctggctgctgatatgcactaccaacaacaccataatggaagacagtgtaccagcagaggtgtggaccaagtatggagagaagagagtgcttaaaccgaggtggatggatgctagggaccttttgggacagcggtg

SEQ ID NO: 150 - DNA, 140 bp, Artificial Sequence
  Synthetic
caccgctgtcccaaaaggtccctagcatccatccacctcggtttaagcactctcttctctccatacttggtccacacctctgctggtacactgtcttccattatggtgttgttggtagtgcatatcagcagccagggcct

SEQ ID NO: 151 - DNA, 140 bp, Artificial Sequence
  Synthetic
atacgccatgctgggtctccgtctgttcagatcatgcggctttgaagtcgttcaaagaatttgccgctgggaagagaggagcggctttgggagtgatggatgccctgggaacattgccagcgtacttgggagtcggccat

SEQ ID NO: 152 - DNA, 140 bp, Artificial Sequence
  Synthetic
atggccgactcccaagtacgctggcaatgttcccagggcatccatcactcccaaagccgctcctctcttcccagcggcaaattctttgaacgacttcaaagccgcatgatctgaacagacggagacccagcatggcgtat

SEQ ID NO: 153 - DNA, 140 bp, Artificial Sequence
  Synthetic
atacgccatgctgggtctccgacacatgacagagaggtttcaggaagccattgacaatctcgctgtgctcatgcgagcagagactggaagtaggccctacaaagcagcggcagctcaactcgtacttgggagtcggccat

SEQ ID NO: 154 - DNA, 140 bp, Artificial Sequence
  Synthetic
atggccgactcccaagtacgagttgagctgccgctgctttgtagggcctacttccagtctctgctcgcatgagcacagcgagattgtcaatggcttcctgaaacctctctgtcatgtgtcggagacccagcatggcgtat

SEQ ID NO: 155 - DNA, 140 bp, Artificial Sequence
  Synthetic
atacgccatgctgggtctccgccggagaccctagagaccatcatgcttttgggcttattgggaacagtttcgctaggaatcttctttgtcttgatgcggaacaagggcatcgggaagatgcgtacttgggagtcggccat

SEQ ID NO: 156 - DNA, 140 bp, Artificial Sequence
  Synthetic
atggccgactcccaagtacgcatcttcccgatgcccttgttccgcatcaagacaaagaagattcctagcgaaactgttcccaataagcccaaaagcatgatggtctctagggtctccggcggagacccagcatggcgtat

SEQ ID NO: 157 - DNA, 140 bp, Artificial Sequence
  Synthetic
atacgccatgctgggtctccggcttcggaatggtaacccttggggccagcgcatggctcatgtggctttcggaaattgaaccagccagaatcgcatgtgtcctcattgtcgtgtttttgtcgtacttgggagtcggccat

SEQ ID NO: 158 - DNA, 140 bp, Artificial Sequence
  Synthetic
atggccgactcccaagtacgacaaaaacacgacaatgaggacacatgcgattctggctggttcaatttccgaaagccacatgagccatgcgctggccccaagggttaccattccgaagccggagacccagcatggcgtat

SEQ ID NO: 159 - DNA, 140 bp, Artificial Sequence
  Synthetic
aggccctggctgctgatatgggaaattgaaccagccagaatcgcatgtgtcctcattgtcgtgtttttgttactggtggtgctcatacccgagccagagaagcaaagatctccccaggatgaccttttgggacagcggtg

SEQ ID NO: 160 - DNA, 140 bp, Artificial Sequence
  Synthetic
caccgctgtcccaaaaggtcatcctggggagatctttgcttctctggctcgggtatgagcaccaccagtaacaaaaacacgacaatgaggacacatgcgattctggctggttcaatttcccatatcagcagccagggcct

SEQ ID NO: 161 - DNA, 140 bp, Artificial Sequence
  Synthetic
atacgccatgctgggtctccaatcaaatggcaatcatcatcatggtggcagttggccttctgggtttgataacagcaaatgaactcggatggctggaaaggacaaaaagtgatatagctccgtacttgggagtcggccat

SEQ ID NO: 162 - DNA, 140 bp, Artificial Sequence
  Synthetic
atggccgactcccaagtacggagctatatcactttttgtcctttccagccatccgagttcatttgctgttatcaaacccagaaggccaactgccaccatgatgatgattgccatttgattggagacccagcatggcgtat

SEQ ID NO: 163 - DNA, 140 bp, Artificial Sequence
  Synthetic
aggccctggctgctgatatgaacagcaaatgaactcggatggctggaaaggacaaaaagtgatatagctcatctaatgggaaggaaagaagaggggacaaccataggattctcaatggatgaccttttgggacagcggtg

SEQ ID NO: 164 - DNA, 140 bp, Artificial Sequence
  Synthetic
caccgctgtcccaaaaggtcatccattgagaatcctatggttgtcccctcttctttccttcccattagatgagctatatcactttttgtcctttccagccatccgagttcatttgctgttcatatcagcagccagggcct

SEQ ID NO: 165 - DNA, 140 bp, Artificial Sequence
  Synthetic
atacgccatgctgggtctccattgatctgcggccagcctccgcctgggctatttatgccgcattgacaactctcatcaccccagccgtccaacatgcggtaaccacctcatacaacaactcgtacttgggagtcggccat

SEQ ID NO: 166 - DNA, 140 bp, Artificial Sequence
  Synthetic
atggccgactcccaagtacgagttgttgtatgaggtggttaccgcatgttggacggctggggtgatgagagttgtcaatgcggcataaatagcccaggcggaggctggccgcagatcaatggagacccagcatggcgtat

SEQ ID NO: 167 - DNA, 140 bp, Artificial Sequence
  Synthetic
aggccctggctgctgatatgtctcatcaccccagccgtccaacatgcggtaaccacctcatacaacaactactccctgatggcgatggccacacaagctggagtgctgtttggcatgggcgaccttttgggacagcggtg

SEQ ID NO: 168 - DNA, 140 bp, Artificial Sequence
  Synthetic
caccgctgtcccaaaaggtcgcccatgccaaacagcactccagcttgtgtggccatcgccatcagggagtagttgttgtatgaggtggttaccgcatgttggacggctggggtgatgagacatatcagcagccagggcct

SEQ ID NO: 169 - DNA, 140 bp, Artificial Sequence
  Synthetic
atacgccatgctgggtctccactccctgatggcgatggccacacaagctggagtgctgtttggcatgggcaaagggatgccattttatgcatgggactttggagtcccgctgctaatgatcgtacttgggagtcggccat

SEQ ID NO: 170 - DNA, 140 bp, Artificial Sequence
  Synthetic
atggccgactcccaagtacgatcattagcagcgggactccaaagtcccatgcataaaatggcatccctttgcccatgccaaacagcactccagcttgtgtggccatcgccatcagggagtggagacccagcatggcgtat

SEQ ID NO: 171 - DNA, 140 bp, Artificial Sequence
  Synthetic
atacgccatgctgggtctccgggttgctactcacaattaacacccctgaccctgatagtggccatcattctgcttgtggcacactacatgtacttgatcccaggtttgcaggcagcagcacgtacttgggagtcggccat

SEQ ID NO: 172 - DNA, 140 bp, Artificial Sequence
  Synthetic
atggccgactcccaagtacgtgctgctgcctgcaaacctgggatcaagtacatgtagtgtgccacaagcagaatgatggccactatcagggtcaggggtgttaattgtgagtagcaacccggagacccagcatggcgtat

SEQ ID NO: 173 - DNA, 140 bp, Artificial Sequence
  Synthetic
atacgccatgctgggtctccgcacgtgctgcccagaagaggacagcagctggcatcatgaagaatcccgttgtggatggaatagtggtgactgacattgacacaatgacaattgaccccccgtacttgggagtcggccat

SEQ ID NO: 174 - DNA, 140 bp, Artificial Sequence
  Synthetic
atggccgactcccaagtacggggggtcaattgtcattgtgtcaatgtcagtcaccactattccatccacaacgggattcttcatgatgccagctgctgtcctcttctgggcagcacgtgcggagacccagcatggcgtat

SEQ ID NO: 175 - DNA, 140 bp, Artificial Sequence
  Synthetic
aggccctggctgctgatatgtgtggatggaatagtggtgactgacattgacacaatgacaattgacccccaagtggagaagaagatgggacaagtgttactcatagcagtagctgtctccgaccttttgggacagcggtg

SEQ ID NO: 176 - DNA, 140 bp, Artificial Sequence
  Synthetic
caccgctgtcccaaaaggtcggagacagctactgctatgagtaacacttgtcccatcttcttctccacttgggggtcaattgtcattgtgtcaatgtcagtcaccactattccatccacacatatcagcagccagggcct

SEQ ID NO: 177 - DNA, 140 bp, Artificial Sequence
  Synthetic
atacgccatgctgggtctccaagtggagaagaagatgggacaagtgttactcatagcagtagctgtctccagtgctgtgctgctgcggaccgcttggggatggggggaggctggggctctcgtacttgggagtcggccat

SEQ ID NO: 178 - DNA, 140 bp, Artificial Sequence
  Synthetic
atggccgactcccaagtacgagagccccagcctccccccatccccaagcggtccgcagcagcacagcactggagacagctactgctatgagtaacacttgtcccatcttcttctccacttggagacccagcatggcgtat

SEQ ID NO: 179 - DNA, 140 bp, Artificial Sequence
  Synthetic
atacgccatgctgggtctccgatcacagcagcaacctccaccttatgggaaggctctccaaacaaatactggaactcctccacagccacctcactgtgcaacatctttagaggaagttatcgtacttgggagtcggccat

SEQ ID NO: 180 - DNA, 140 bp, Artificial Sequence
  Synthetic
atggccgactcccaagtacgataacttcctctaaagatgttgcacagtgaggtggctgtggaggagttccagtatttgtttggagagccttcccataaggtggaggttgctgctgtgatcggagacccagcatggcgtat

SEQ ID NO: 181 - DNA, 140 bp, Artificial Sequence
  Synthetic
atacgccatgctgggtctccttggcaggggcttcccttatttacacagtgacaagaaatgccggtctggttaagagacgtggaggtggaacgggagagaccctgggagagaagtggaaagcgtacttgggagtcggccat

SEQ ID NO: 182 - DNA, 140 bp, Artificial Sequence
  Synthetic
atggccgactcccaagtacgctttccacttctctcccagggtctctcccgttccacctccacgtctcttaaccagaccggcatttcttgtcactgtgtaaataagggaagcccctgccaaggagacccagcatggcgtat

SEQ ID NO: 183 - DNA, 140 bp, Artificial Sequence
  Synthetic
aggccctggctgctgatatgtaagagacgtggaggtggaacgggagagaccctgggagagaagtggaaagcccgcctgaaccagatgtcggccttggagttttactcttacaaaaagtcagaccttttgggacagcggtg

SEQ ID NO: 184 - DNA, 140 bp, Artificial Sequence
  Synthetic
caccgctgtcccaaaaggtctgactttttgtaagagtaaaactccaaggccgacatctggttcaggcgggctttccacttctctcccagggtctctcccgttccacctccacgtctcttacatatcagcagccagggcct

SEQ ID NO: 185 - DNA, 140 bp, Artificial Sequence
  Synthetic
atacgccatgctgggtctccggcatcaccgaagtgtgtagggaggaggcgcgccgcgccctcaaggatggagtggccacaggaggacatgctgtatcccggggaagcgcaaagcttagatcgtacttgggagtcggccat

SEQ ID NO: 186 - DNA, 140 bp, Artificial Sequence
  Synthetic
atggccgactcccaagtacgatctaagctttgcgcttccccgggatacagcatgtcctcctgtggccactccatccttgagggcgcggcgcgcctcctccctacacacttcggtgatgccggagacccagcatggcgtat

SEQ ID NO: 187 - DNA, 140 bp, Artificial Sequence
  Synthetic
atacgccatgctgggtctccggttggtagagagaggatacctgcagccccatggaaaggttgttgaccttggatgtggcagaggaggctggagttattacgctgccaccatccgtaaagtcgtacttgggagtcggccat

SEQ ID NO: 188 - DNA, 140 bp, Artificial Sequence
  Synthetic
atggccgactcccaagtacgactttacggatggtggcagcgtaataactccagcctcctctgccacatccaaggtcaacaacctttccatggggctgcaggtatcctctctctaccaaccggagacccagcatggcgtat

SEQ ID NO: 189 - DNA, 140 bp, Artificial Sequence
  Synthetic
atacgccatgctgggtctccgcaggaggtcagaggatacacaaagggaggtcctggtcatgaagaacccatgctggtgcaaagctatgggtggaacatagttcgcctcaagagtggagtgcgtacttgggagtcggccat

SEQ ID NO: 190 - DNA, 140 bp, Artificial Sequence
  Synthetic
atggccgactcccaagtacgcactccactcttgaggcgaactatgttccacccatagctttgcaccagcatgggttcttcatgaccaggacctccctttgtgtatcctctgacctcctgcggagacccagcatggcgtat

SEQ ID NO: 191 - DNA, 140 bp, Artificial Sequence
  Synthetic
aggccctggctgctgatatgtgctggtgcaaagctatgggtggaacatagttcgcctcaagagtggagtggacgtcttccacatggcggctgagccgtgtgacactctgctgtgtgacatgaccttttgggacagcggtg

SEQ ID NO: 192 - DNA, 140 bp, Artificial Sequence
  Synthetic
caccgctgtcccaaaaggtcatgtcacacagcagagtgtcacacggctcagccgccatgtggaagacgtccactccactcttgaggcgaactatgttccacccatagctttgcaccagcacatatcagcagccagggcct

SEQ ID NO: 193 - DNA, 140 bp, Artificial Sequence
  Synthetic
atacgccatgctgggtctcccggcgagtcatcatctagtcctgaagtggaagagacgcgaacactcagagtgctctccatggtgggagactggcttgagaaaagaccaggggccttctgccgtacttgggagtcggccat

SEQ ID NO: 194 - DNA, 140 bp, Artificial Sequence
  Synthetic
atggccgactcccaagtacggcagaaggcccctggtcttttctcaagccagtctcccaccatggagagcactctgagtgttcgcgtctcttccacttcaggactagatgatgactcgccgggagacccagcatggcgtat

SEQ ID NO: 195 - DNA, 140 bp, Artificial Sequence
  Synthetic
atacgccatgctgggtctccataaaggtgctgtgcccatacaccagcacaatgatggagaccatggagcgactgcaacgtaggcatgggggaggattggtcagagtgccattgtcccgcacgtacttgggagtcggccat

SEQ ID NO: 196 - DNA, 140 bp, Artificial Sequence
  Synthetic
atggccgactcccaagtacgtgcgggacaatggcactctgaccaatcctcccccatgcctacgttgcagtcgctccatggtctccatcattgtgctggtgtatgggcacagcacctttatggagacccagcatggcgtat

SEQ ID NO: 197 - DNA, 140 bp, Artificial Sequence
  Synthetic
atacgccatgctgggtctccactccacacatgagatgtattgggtctctggagccaaaagtaacatcataaagagtgtgtccaccacaagtcagctcctcttgggacgcatggatgggcccgtacttgggagtcggccat

SEQ ID NO: 198 - DNA, 140 bp, Artificial Sequence
  Synthetic
atggccgactcccaagtacgggcccatccatgcgtcccaagaggagctgacttgtggtggacacactctttatgatgttacttttggctccagagacccaatacatctcatgtgtggagtggagacccagcatggcgtat

SEQ ID NO: 199 - DNA, 140 bp, Artificial Sequence
  Synthetic
atacgccatgctgggtctcctaggaggccagtgaaatatgaggaggatgtgaacctcggctcaggcacacgagctgtggcaagctgcgctgaggctcccaacatgaagatcattggtaggcgtacttgggagtcggccat

SEQ ID NO: 200 - DNA, 140 bp, Artificial Sequence
  Synthetic
atggccgactcccaagtacgcctaccaatgatcttcatgttgggagcctcagcgcagcttgccacagctcgtgtgcctgagccgaggttcacatcctcctcatatttcactggcctcctaggagacccagcatggcgtat

SEQ ID NO: 201 - DNA, 140 bp, Artificial Sequence
  Synthetic
atacgccatgctgggtctcccgcattgagagaatccgcaatgaacatgcagagacatggttctttgatgaaaaccacccatacaggacatgggcctaccatgggagctacgaagcccccacgtacttgggagtcggccat

SEQ ID NO: 202 - DNA, 140 bp, Artificial Sequence
  Synthetic
atggccgactcccaagtacgtgggggcttcgtagctcccatggtaggcccatgtcctgtatgggtggttttcatcaaagaaccatgtctctgcatgttcattgcggattctctcaatgcgggagacccagcatggcgtat

SEQ ID NO: 203 - DNA, 140 bp, Artificial Sequence
  Synthetic
atacgccatgctgggtctcccgcaggggtcagcgtcatccctcgtgaacggggttgttagactcttgtcaaaaccctgggatgtggtgactggagttacaggaatagctatgactgacaccgtacttgggagtcggccat

SEQ ID NO: 204 - DNA, 140 bp, Artificial Sequence
  Synthetic
atggccgactcccaagtacggtgtcagtcatagctattcctgtaactccagtcaccacatcccagggttttgacaagagtctaacaaccccgttcacgagggatgacgctgacccctgcgggagacccagcatggcgtat

SEQ ID NO: 205 - DNA, 140 bp, Artificial Sequence
  Synthetic
aggccctggctgctgatatgaaaccctgggatgtggtgactggagttacaggaatagctatgactgacaccacgccatacggccaacaaagagtcttcaaggaaaaagtggacactaggggaccttttgggacagcggtg

SEQ ID NO: 206 - DNA, 140 bp, Artificial Sequence
  Synthetic
caccgctgtcccaaaaggtcccctagtgtccactttttccttgaagactctttgttggccgtatggcgtggtgtcagtcatagctattcctgtaactccagtcaccacatcccagggtttcatatcagcagccagggcct

SEQ ID NO: 207 - DNA, 140 bp, Artificial Sequence
  Synthetic
atacgccatgctgggtctcctgccagatccccaagaaggcactcgccaagtaatgaacatggtctcgtcttggctatggaaggagctgggaaaacgcaagcggccacgtgtctgcaccaacgtacttgggagtcggccat

SEQ ID NO: 208 - DNA, 140 bp, Artificial Sequence
  Synthetic
atggccgactcccaagtacgttggtgcagacacgtggccgcttgcgttttcccagctccttccatagccaagacgagaccatgttcattacttggcgagtgccttcttggggatctggcaggagacccagcatggcgtat

SEQ ID NO: 209 - DNA, 140 bp, Artificial Sequence
  Synthetic
atacgccatgctgggtctccagaagagttcattaataaggtgcgcagcaatgcagcactgggagcaatatttgaagaggaaaaagaatggaagacagctgtagaagctgtgaatgatccacgtacttgggagtcggccat

SEQ ID NO: 210 - DNA, 140 bp, Artificial Sequence
  Synthetic
atggccgactcccaagtacgtggatcattcacagcttctacagctgtcttccattctttttcctcttcaaatattgctcccagtgctgcattgctgcgcaccttattaatgaactcttctggagacccagcatggcgtat

SEQ ID NO: 211 - DNA, 140 bp, Artificial Sequence
  Synthetic
aggccctggctgctgatatgttgaagaggaaaaagaatggaagacagctgtagaagctgtgaatgatccaagattttgggctctagtggacaaggaaagagaacaccacctgagaggagagaccttttgggacagcggtg

SEQ ID NO: 212 - DNA, 140 bp, Artificial Sequence
  Synthetic
caccgctgtcccaaaaggtctctcctctcaggtggtgttctctttccttgtccactagagcccaaaatcttggatcattcacagcttctacagctgtcttccattctttttcctcttcaacatatcagcagccagggcct

SEQ ID NO: 213 - DNA, 140 bp, Artificial Sequence
  Synthetic
atacgccatgctgggtctccgtgtcacagctgtgtgtacaacatgatgggtaaaagagaaaagaagcaaggagaattcgggaaagcaaaaggcagccgcgcaatctggtacatgtggttgcgtacttgggagtcggccat

SEQ ID NO: 214 - DNA, 140 bp, Artificial Sequence
  Synthetic
atggccgactcccaagtacgcaaccacatgtaccagattgcgcggctgccttttgctttcccgaattctccttgcttcttttctcttttacccatcatgttgtacacacagctgtgacacggagacccagcatggcgtat

SEQ ID NO: 215 - DNA, 140 bp, Artificial Sequence
  Synthetic
aggccctggctgctgatatggagaattcgggaaagcaaaaggcagccgcgcaatctggtacatgtggttgggagccagatttttggagtttgaagctcttggattcttgaacgaggaccagaccttttgggacagcggtg

SEQ ID NO: 216 - DNA, 140 bp, Artificial Sequence
  Synthetic
caccgctgtcccaaaaggtctggtcctcgttcaagaatccaagagcttcaaactccaaaaatctggctcccaaccacatgtaccagattgcgcggctgccttttgctttcccgaattctccatatcagcagccagggcct

SEQ ID NO: 217 - DNA, 140 bp, Artificial Sequence
  Synthetic
aggccctggctgctgatatgaaaggcttggatatatcctagaagaaatgaaccgggcaccaggaggaaagatgtatgcagatgacaccgctggctgggacacccgcattagcaagtttgagaccttttgggacagcggtg

SEQ ID NO: 218 - DNA, 140 bp, Artificial Sequence
  Synthetic
caccgctgtcccaaaaggtctcaaacttgctaatgcgggtgtcccagccagcggtgtcatctgcatacatctttcctcctggtgcccggttcatttcttctaggatatatccaagcctttcatatcagcagccagggcct

SEQ ID NO: 219 - DNA, 140 bp, Artificial Sequence
  Synthetic
atacgccatgctgggtctcctctagagaatgaagccctgatcactaaccagatggaagaagggcacagagctctggcgttggccgtgattaaatacacataccaaaacaaagtggtgaagcgtacttgggagtcggccat

SEQ ID NO: 220 - DNA, 140 bp, Artificial Sequence
  Synthetic
atggccgactcccaagtacgcttcaccactttgttttggtatgtgtatttaatcacggccaacgccagagctctgtgcccttcttccatctggttagtgatcagggcttcattctctagaggagacccagcatggcgtat

SEQ ID NO: 221 - DNA, 140 bp, Artificial Sequence
  Synthetic
aggccctggctgctgatatgctctggcgttggccgtgattaaatacacataccaaaacaaagtggtgaaggttctcagaccagctgaaggagggaaaacagtcatggacatcatctcaaggaccttttgggacagcggtg

SEQ ID NO: 222 - DNA, 140 bp, Artificial Sequence
  Synthetic
caccgctgtcccaaaaggtccttgagatgatgtccatgactgttttccctccttcagctggtctgagaaccttcaccactttgttttggtatgtgtatttaatcacggccaacgccagagcatatcagcagccagggcct

SEQ ID NO: 223 - DNA, 140 bp, Artificial Sequence
  Synthetic
aggccctggctgctgatatggttctcagaccagctgaaggagggaaaacagtcatggacatcatctcaagacaagaccagagagggagcggacaagttgttacttatgctctcaacacatgaccttttgggacagcggtg

SEQ ID NO: 224 - DNA, 140 bp, Artificial Sequence
  Synthetic
caccgctgtcccaaaaggtcatgtgttgagagcataagtaacaacttgtccgctccctctctggtcttgtcttgagatgatgtccatgactgttttccctccttcagctggtctgagaaccatatcagcagccagggcct

SEQ ID NO: 225 - DNA, 140 bp, Artificial Sequence
  Synthetic
aggccctggctgctgatatgacaagaccagagagggagcggacaagttgttacttatgctctcaacacattcaccaacctggtggtgcagcttatccggaacatggaggctgaggaagtggaccttttgggacagcggtg

SEQ ID NO: 226 - DNA, 140 bp, Artificial Sequence
  Synthetic
caccgctgtcccaaaaggtccacttcctcagcctccatgttccggataagctgcaccaccaggttggtgaatgtgttgagagcataagtaacaacttgtccgctccctctctggtcttgtcatatcagcagccagggcct

SEQ ID NO: 227 - DNA, 140 bp, Artificial Sequence
  Synthetic
atacgccatgctgggtctcctcaccaacctggtggtgcagcttatccggaacatggaggctgaggaagtgctagagatgcatgatctatggttgttgaggaagccagagaaagtgaccagcgtacttgggagtcggccat

SEQ ID NO: 228 - DNA, 140 bp, Artificial Sequence
  Synthetic
atggccgactcccaagtacgctggtcactttctctggcttcctcaacaaccatagatcatgcatctctagcacttcctcagcctccatgttccggataagctgcaccaccaggttggtgaggagacccagcatggcgtat

SEQ ID NO: 229 - DNA, 140 bp, Artificial Sequence
  Synthetic
aggccctggctgctgatatgatggttgcagagcaatggatgggacagactcaaacggatggcagttagtggagatgactgcgttgtaaagccaattgatgataggtttgcacatgccctcgaccttttgggacagcggtg

SEQ ID NO: 230 - DNA, 140 bp, Artificial Sequence
  Synthetic
caccgctgtcccaaaaggtcgagggcatgtgcaaacctatcatcaattggctttacaacgcagtcatctccactaactgccatccgtttgagtctgtcccatccattgctctgcaaccatcatatcagcagccagggcct

SEQ ID NO: 231 - DNA, 140 bp, Artificial Sequence
  Synthetic
aggccctggctgctgatatggagatgactgcgttgtaaagccaattgatgataggtttgcacatgccctcaggttcttgaatgacatgggaaaggttaggaaagacacacaggaatggaagaccttttgggacagcggtg

SEQ ID NO: 232 - DNA, 140 bp, Artificial Sequence
  Synthetic
caccgctgtcccaaaaggtcttccattcctgtgtgtctttcctaacctttcccatgtcattcaagaacctgagggcatgtgcaaacctatcatcaattggctttacaacgcagtcatctccatatcagcagccagggcct

SEQ ID NO: 233 - DNA, 140 bp, Artificial Sequence
  Synthetic
atacgccatgctgggtctccaggttcttgaatgacatgggaaaggttaggaaagacacacaggaatggaaaccctcgactggatggagcaattgggaagaggtcccgttctgttctcacccgtacttgggagtcggccat

SEQ ID NO: 234 - DNA, 140 bp, Artificial Sequence
  Synthetic
atggccgactcccaagtacgggtgagaacagaacgggacctcttcccaattgctccatccagtcgagggtttccattcctgtgtgtctttcctaacctttcccatgtcattcaagaacctggagacccagcatggcgtat

SEQ ID NO: 235 - DNA, 140 bp, Artificial Sequence
  Synthetic
atacgccatgctgggtctccacttcaacaagctgcacctcaaggacgggagatccattgtggtcccctgccgccaccaagatgaactgattggccgagcccgtgtctcaccaggggcaggcgtacttgggagtcggccat

SEQ ID NO: 236 - DNA, 140 bp, Artificial Sequence
  Synthetic
atggccgactcccaagtacgcctgcccctggtgagacacgggctcggccaatcagttcatcttggtggcggcaggggaccacaatggatctcccgtccttgaggtgcagcttgttgaagtggagacccagcatggcgtat

SEQ ID NO: 237 - DNA, 140 bp, Artificial Sequence
  Synthetic
atacgccatgctgggtctccatggagcatccgggagactgcttgtcttgcaaaatcatatgcacagatgtggcagcttctttatttccacaaaagagacctccgactgatggccaatgcccgtacttgggagtcggccat

SEQ ID NO: 238 - DNA, 140 bp, Artificial Sequence
  Synthetic
atggccgactcccaagtacgggcattggccatcagtcggaggtctcttttgtggaaataaagaagctgccacatctgtgcatatgattttgcaagacaagcagtctcccggatgctccatggagacccagcatggcgtat

SEQ ID NO: 239 - DNA, 140 bp, Artificial Sequence
  Synthetic
aggccctggctgctgatatgggcagcttctttatttccacaaaagagacctccgactgatggccaatgccatttgttcggctgtgccagttgactgggtaccaactgggagaaccacctggaccttttgggacagcggtg

SEQ ID NO: 240 - DNA, 140 bp, Artificial Sequence
  Synthetic
caccgctgtcccaaaaggtccaggtggttctcccagttggtacccagtcaactggcacagccgaacaaatggcattggccatcagtcggaggtctcttttgtggaaataaagaagctgcccatatcagcagccagggcct

SEQ ID NO: 241 - DNA, 140 bp, Artificial Sequence
  Synthetic
atacgccatgctgggtctccgtcaatccatggaaagggagaatggatgactactgaggacatgctcatggtgtggaatagagtgtggattgaggagaacgaccacatggaggacaagacccgtacttgggagtcggccat

SEQ ID NO: 242 - DNA, 140 bp, Artificial Sequence
  Synthetic
atggccgactcccaagtacgggtcttgtcctccatgtggtcgttctcctcaatccacactctattccacaccatgagcatgtcctcagtagtcatccattctccctttccatggattgacggagacccagcatggcgtat

SEQ ID NO: 243 - DNA, 140 bp, Artificial Sequence
  Synthetic
aggccctggctgctgatatgtgtggaatagagtgtggattgaggagaacgaccacatggaggacaagacccctgtaacaaaatggacagacattccctatttggggaaaagggaggacttgaccttttgggacagcggtg

SEQ ID NO: 244 - DNA, 140 bp, Artificial Sequence
  Synthetic
caccgctgtcccaaaaggtcaagtcctcccttttccccaaatagggaatgtctgtccattttgttacaggggtcttgtcctccatgtggtcgttctcctcaatccacactctattccacacatatcagcagccagggcct

SEQ ID NO: 245 - DNA, 140 bp, Artificial Sequence
  Synthetic
aggccctggctgctgatatgatggtgtggatcccttatagggcacagacctcgcaccacttgggctgagaacatcaaagacacagtcaacatggtgcgtaggatcataggtgatgaagaagaccttttgggacagcggtg

SEQ ID NO: 246 - DNA, 140 bp, Artificial Sequence
  Synthetic
caccgctgtcccaaaaggtcttcttcatcacctatgatcctacgcaccatgttgactgtgtctttgatgttctcagcccaagtggtgcgaggtctgtgccctataagggatccacaccatcatatcagcagccagggcct

SEQ ID NO: 247 - DNA, 140 bp, Artificial Sequence
  Synthetic
aggccctggctgctgatatgggtgcgtaggatcataggtgatgaagaaaagtacatggactacctatccacccaagtacgctacttgggtgaggaagggtccacacctggagtgctgtaagaccttttgggacagcggtg

SEQ ID NO: 248 - DNA, 140 bp, Artificial Sequence
  Synthetic
caccgctgtcccaaaaggtcttacagcactccaggtgtggacccttcctcacccaagtagcgtacttgggtggataggtagtccatgtacttttcttcatcacctatgatcctacgcacccatatcagcagccagggcct

SEQ ID NO: 249 - DNA, 140 bp, Artificial Sequence
  Synthetic
aggccctggctgctgatatggaaatagtccgtgaagccataaagaagagacttcgcacattgatcctagcaccaaccagggtcgttgctgctgagatggaggaagccctaagaggacttcgaccttttgggacagcggtg

SEQ ID NO: 250 - DNA, 140 bp, Artificial Sequence
  Synthetic
caccgctgtcccaaaaggtcgaagtcctcttagggcttcctccatctcagcagcaacgaccctggttggtgctaggatcaatgtgcgaagtctcttctttatggcttcacggactatttccatatcagcagccagggcct

SEQ ID NO: 251 - DNA, 140 bp, Artificial Sequence
  Synthetic
atacgccatgctgggtctccgtgcgttacatgacaacagcagtcaacgtcacccattctgggacagaaatcgttgatttgatgtgccatgccactttcacttcacgcttactacaacccacgtacttgggagtcggccat

SEQ ID NO: 252 - DNA, 140 bp, Artificial Sequence
  Synthetic
atggccgactcccaagtacgtgggttgtagtaagcgtgaagtgaaagtggcatggcacatcaaatcaacgatttctgtcccagaatgggtgacgttgactgctgttgtcatgtaacgcacggagacccagcatggcgtat

SEQ ID NO: 253 - DNA, 140 bp, Artificial Sequence
  Synthetic
atacgccatgctgggtctccgttgttactgttgctgactcagactgcgacagttcgagtttgaagcgaaagctagcaacagtatcaacaggttttatttggatttggaaacgagagtttccgtacttgggagtcggccat

SEQ ID NO: 254 - DNA, 140 bp, Artificial Sequence
  Synthetic
atggccgactcccaagtacggaaactctcgtttccaaatccaaataaaacctgttgatactgttgctagctttcgcttcaaactcgaactgtcgcagtctgagtcagcaacagtaacaacggagacccagcatggcgtat

SEQ ID NO: 255 - DNA, 140 bp, Artificial Sequence
  Synthetic
aggccctggctgctgatatgatgctaaaacgcggagtagcccgtgtgagcccctttgggggcttgaagaggctgccagccggacttctgctgggtcatgggcccatcaggatggtcttgggaccttttgggacagcggtg

SEQ ID NO: 256 - DNA, 140 bp, Artificial Sequence
  Synthetic
caccgctgtcccaaaaggtcccaagaccatcctgatgggcccatgacccagcagaagtccggctggcagcctcttcaagcccccaaaggggctcacacgggctactccgcgttttagcatcatatcagcagccagggcct

SEQ ID NO: 257 - DNA, 140 bp, Artificial Sequence
  Synthetic
aggccctggctgctgatatggctgccagccggacttctgctgggtcatgggcccatcaggatggtcttggcaattctagcctttttgagattcacggcaatcaagccatcactgggtctcgaccttttgggacagcggtg

SEQ ID NO: 258 - DNA, 140 bp, Artificial Sequence
  Synthetic
caccgctgtcccaaaaggtcgagacccagtgatggcttgattgccgtgaatctcaaaaaggctagaattgccaagaccatcctgatgggcccatgacccagcagaagtccggctggcagccatatcagcagccagggcct

SEQ ID NO: 259 - DNA, 140 bp, Artificial Sequence
  Synthetic
aggccctggctgctgatatggaagttcaagaaagatctggctgccatgctgagaataatcaatgctaggaaggagaagaagagacggggcgcagatactagtgtcggaattgttggcctcgaccttttgggacagcggtg

SEQ ID NO: 260 - DNA, 140 bp, Artificial Sequence
  Synthetic
caccgctgtcccaaaaggtcgaggccaacaattccgacactagtatctgcgccccgtctcttcttctccttcctagcattgattattctcagcatggcagccagatctttcttgaacttccatatcagcagccagggcct

SEQ ID NO: 261 - DNA, 140 bp, Artificial Sequence
  Synthetic
atacgccatgctgggtctccctatatgtacttggacagaaacgatgctggggaggccatatcttttccaaccacattggggatgaataagtgttatatacagatcatggatcttggacaccgtacttgggagtcggccat

SEQ ID NO: 262 - DNA, 140 bp, Artificial Sequence
  Synthetic
atggccgactcccaagtacggtgtccaagatccatgatctgtatataacacttattcatccccaatgtggttggaaaagatatggcctccccagcatcgtttctgtccaagtacatatagggagacccagcatggcgtat

SEQ ID NO: 263 - DNA, 140 bp, Artificial Sequence
  Synthetic
aggccctggctgctgatatgccacattggggatgaataagtgttatatacagatcatggatcttggacacatgtgtgatgccaccatgagctatgaatgccctatgctggatgagggggtgaccttttgggacagcggtg

SEQ ID NO: 264 - DNA, 140 bp, Artificial Sequence
  Synthetic
caccgctgtcccaaaaggtcaccccctcatccagcatagggcattcatagctcatggtggcatcacacatgtgtccaagatccatgatctgtatataacacttattcatccccaatgtggcatatcagcagccagggcct

SEQ ID NO: 265 - DNA, 140 bp, Artificial Sequence
  Synthetic
atacgccatgctgggtctccggaaccagatgacgtcgattgttggtgcaacacgacgtcaacttgggttgtgtacggaacctgccatcacaaaaaaggtgaagcacggagatctagaagacgtacttgggagtcggccat

SEQ ID NO: 266 - DNA, 140 bp, Artificial Sequence
  Synthetic
atggccgactcccaagtacgtcttctagatctccgtgcttcaccttttttgtgatggcaggttccgtacacaacccaagttgacgtcgtgttgcaccaacaatcgacgtcatctggttccggagacccagcatggcgtat

SEQ ID NO: 267 - DNA, 140 bp, Artificial Sequence
  Synthetic
aggccctggctgctgatatgactgctgattgccccggcatacagcatcaggtgcataggagtcagcaatagggactttgtggaaggtatgtcaggtgggacttgggttgatattgtcttggaccttttgggacagcggtg

SEQ ID NO: 268 - DNA, 140 bp, Artificial Sequence
  Synthetic
caccgctgtcccaaaaggtccaagacaatatcaacccaagtcccacctgacataccttccacaaagtccctattgctgactcctatgcacctgatgctgtatgccggggcaatcagcagtcatatcagcagccagggcct

SEQ ID NO: 269 - DNA, 140 bp, Artificial Sequence
  Synthetic
aggccctggctgctgatatggaacatggaggttgtgtcaccgtaatggcacaggacaaaccgactgtcgacatagagctggttacaacaacagtcagcaacatggcggaggtaagatcctgaccttttgggacagcggtg

SEQ ID NO: 270 - DNA, 140 bp, Artificial Sequence
  Synthetic
caccgctgtcccaaaaggtcaggatcttacctccgccatgttgctgactgttgttgtaaccagctctatgtcgacagtcggtttgtcctgtgccattacggtgacacaacctccatgttccatatcagcagccagggcct

SEQ ID NO: 271 - DNA, 140 bp, Artificial Sequence
  Synthetic
aggccctggctgctgatatgcaaaagaacgttagtggacagaggctggggaaatggatgtggactttttggcaaagggagtctggtgacatgcgctaagtttgcatgctccaagaaaatggaccttttgggacagcggtg

SEQ ID NO: 272 - DNA, 140 bp, Artificial Sequence
  Synthetic
caccgctgtcccaaaaggtccattttcttggagcatgcaaacttagcgcatgtcaccagactccctttgccaaaaagtccacatccatttccccagcctctgtccactaacgttcttttgcatatcagcagccagggcct

SEQ ID NO: 273 - DNA, 140 bp, Artificial Sequence
  Synthetic
aggccctggctgctgatatgagttcatggctcccagcacagtgggatgatcgttaatgacacaggacatgaaactgatgagaatagagcgaaggttgagataacgcccaattcaccaagagaccttttgggacagcggtg

SEQ ID NO: 274 - DNA, 140 bp, Artificial Sequence
  Synthetic
caccgctgtcccaaaaggtctcttggtgaattgggcgttatctcaaccttcgctctattctcatcagtttcatgtcctgtgtcattaacgatcatcccactgtgctgggagccatgaactcatatcagcagccagggcct

SEQ ID NO: 275 - DNA, 140 bp, Artificial Sequence
  Synthetic
aggccctggctgctgatatgaaactgatgagaatagagcgaaggttgagataacgcccaattcaccaagagccgaagccaccctggggggttttggaagcctaggacttgattgtgaaccgaccttttgggacagcggtg

SEQ ID NO: 276 - DNA, 140 bp, Artificial Sequence
  Synthetic
caccgctgtcccaaaaggtcggttcacaatcaagtcctaggcttccaaaaccccccagggtggcttcggctcttggtgaattgggcgttatctcaaccttcgctctattctcatcagtttcatatcagcagccagggcct

SEQ ID NO: 277 - DNA, 140 bp, Artificial Sequence
  Synthetic
aggccctggctgctgatatggaggacaggccttgacttttcagatttgtattacttgactatgaataacaagcactggttggttcacaaggagtggttccacgacattccattaccttgggaccttttgggacagcggtg

SEQ ID NO: 278 - DNA, 140 bp, Artificial Sequence
  Synthetic
caccgctgtcccaaaaggtcccaaggtaatggaatgtcgtggaaccactccttgtgaaccaaccagtgcttgttattcatagtcaagtaatacaaatctgaaaagtcaaggcctgtcctccatatcagcagccagggcct

SEQ ID NO: 279 - DNA, 140 bp, Artificial Sequence
  Synthetic
aggccctggctgctgatatgagcactggttggttcacaaggagtggttccacgacattccattaccttggcacgctggggcagacaccggaactccacactggaacaacaaagaagcactgaccttttgggacagcggtg

SEQ ID NO: 280 - DNA, 140 bp, Artificial Sequence
  Synthetic
caccgctgtcccaaaaggtcagtgcttctttgttgttccagtgtggagttccggtgtctgccccagcgtgccaaggtaatggaatgtcgtggaaccactccttgtgaaccaaccagtgctcatatcagcagccagggcct

SEQ ID NO: 281 - DNA, 140 bp, Artificial Sequence
  Synthetic
aggccctggctgctgatatggagatggatggtgcaaagggaaggctgtcctctggccacttgaaatgtcgcctgaaaatggataaacttagattgaagggcgtgtcatactccttgtgtagaccttttgggacagcggtg

SEQ ID NO: 282 - DNA, 140 bp, Artificial Sequence
  Synthetic
caccgctgtcccaaaaggtctacacaaggagtatgacacgcccttcaatctaagtttatccattttcaggcgacatttcaagtggccagaggacagccttccctttgcaccatccatctccatatcagcagccagggcct

SEQ ID NO: 283 - DNA, 140 bp, Artificial Sequence
  Synthetic
aggccctggctgctgatatggtcacagtggaggtacagtacgcagggacagatggaccttgcaaggttccagctcagatggcggtggacatgcaaactctgaccccagttgggaggttgagaccttttgggacagcggtg

SEQ ID NO: 284 - DNA, 140 bp, Artificial Sequence
  Synthetic
caccgctgtcccaaaaggtctcaacctcccaactggggtcagagtttgcatgtccaccgccatctgagctggaaccttgcaaggtccatctgtccctgcgtactgtacctccactgtgaccatatcagcagccagggcct

SEQ ID NO: 285 - DNA, 140 bp, Artificial Sequence
  Synthetic
atacgccatgctgggtctcccaagggcatccatcaaatttttggagcagctttcaaatcattgtttggaggaatgtcctggttctcacaaattctcattggaacgttgctgatgtggttgcgtacttgggagtcggccat

SEQ ID NO: 286 - DNA, 140 bp, Artificial Sequence
  Synthetic
atggccgactcccaagtacgcaaccacatcagcaacgttccaatgagaatttgtgagaaccaggacattcctccaaacaatgatttgaaagctgctccaaaaatttgatggatgcccttgggagacccagcatggcgtat

SEQ ID NO: 287 - DNA, 140 bp, Artificial Sequence
  Synthetic
aggccctggctgctgatatggaatgtcctggttctcacaaattctcattggaacgttgctgatgtggttgggtctgaacacaaagaatggatctatttcccttatgtgcttggccttagggaccttttgggacagcggtg

SEQ ID NO: 288 - DNA, 140 bp, Artificial Sequence
  Synthetic
caccgctgtcccaaaaggtccctaaggccaagcacataagggaaatagatccattctttgtgttcagacccaaccacatcagcaacgttccaatgagaatttgtgagaaccaggacattccatatcagcagccagggcct

SEQ ID NO: 289 - DNA, 140 bp, Artificial Sequence
  Synthetic
atacgccatgctgggtctcctataacgacgttgaagcctggagggacaggtacaagtaccatcctgactccccccgtagattggcagcagcagtcaagcaagcctgggaagatggtatctcgtacttgggagtcggccat

SEQ ID NO: 290 - DNA, 140 bp, Artificial Sequence
  Synthetic
atggccgactcccaagtacgagataccatcttcccaggcttgcttgactgctgctgccaatctacggggggagtcaggatggtacttgtacctgtccctccaggcttcaacgtcgttataggagacccagcatggcgtat

SEQ ID NO: 291 - DNA, 140 bp, Artificial Sequence
  Synthetic
aggccctggctgctgatatgcgttgtgggatctgtaaaaaaccccatgtggagaggtccacagagattgcccgtgcctgtgaacgagctgccccacggctggaaggcttgggggaaatcggaccttttgggacagcggtg

SEQ ID NO: 292 - DNA, 140 bp, Artificial Sequence
  Synthetic
caccgctgtcccaaaaggtccgatttcccccaagccttccagccgtggggcagctcgttcacaggcacgggcaatctctgtggacctctccacatggggttttttacagatcccacaacgcatatcagcagccagggcct

SEQ ID NO: 293 - DNA, 140 bp, Artificial Sequence
  Synthetic
atacgccatgctgggtctccccgtgcctgtgaacgagctgccccacggctggaaggcttgggggaaatcgcacttcgtcagagcagcaaagacaaataacagctttgtcgtggatggtgacgtacttgggagtcggccat

SEQ ID NO: 294 - DNA, 140 bp, Artificial Sequence
  Synthetic
atggccgactcccaagtacgtcaccatccacgacaaagctgttatttgtctttgctgctctgacgaagtgcgatttcccccaagccttccagccgtggggcagctcgttcacaggcacggggagacccagcatggcgtat

SEQ ID NO: 295 - DNA, 140 bp, Artificial Sequence
  Synthetic
atacgccatgctgggtctcccacactgaaggaatgcccactcaaacatagagcatggaacagctttcttgtggaggatcatgggttcggggtatttcacactagtgtctggctcaaggttcgtacttgggagtcggccat

SEQ ID NO: 296 - DNA, 140 bp, Artificial Sequence
  Synthetic
atggccgactcccaagtacgaaccttgagccagacactagtgtgaaataccccgaacccatgatcctccacaagaaagctgttccatgctctatgtttgagtgggcattccttcagtgtgggagacccagcatggcgtat

SEQ ID NO: 297 - DNA, 140 bp, Artificial Sequence
  Synthetic
aggccctggctgctgatatgtggaggatcatgggttcggggtatttcacactagtgtctggctcaaggttagagaagattattcattagagtgtgatccagccgttattggaacagctgtgaccttttgggacagcggtg

SEQ ID NO: 298 - DNA, 140 bp, Artificial Sequence
  Synthetic
caccgctgtcccaaaaggtcacagctgttccaataacggctggatcacactctaatgaataatcttctctaaccttgagccagacactagtgtgaaataccccgaacccatgatcctccacatatcagcagccagggcct

SEQ ID NO: 299 - DNA, 140 bp, Artificial Sequence
  Synthetic
atacgccatgctgggtctccagagaagattattcattagagtgtgatccagccgttattggaacagctgttaagggaaaggaggctgtacacagtgatctaggctactggattgagagtgcgtacttgggagtcggccat

SEQ ID NO: 300 - DNA, 140 bp, Artificial Sequence
  Synthetic
atggccgactcccaagtacgcactctcaatccagtagcctagatcactgtgtacagcctcctttcccttaacagctgttccaataacggctggatcacactctaatgaataatcttctctggagacccagcatggcgtat

SEQ ID NO: 301 - DNA, 140 bp, Artificial Sequence
  Synthetic
atacgccatgctgggtctccacatgtgaatggccaaagtcccacacattgtggacagatggaatagaagagagtgatctgatcatacccaagtctttagctgggccactcagccatcacacgtacttgggagtcggccat

SEQ ID NO: 302 - DNA, 140 bp, Artificial Sequence
  Synthetic
atggccgactcccaagtacgtgtgatggctgagtggcccagctaaagacttgggtatgatcagatcactctcttctattccatctgtccacaatgtgtgggactttggccattcacatgtggagacccagcatggcgtat

SEQ ID NO: 303 - DNA, 140 bp, Artificial Sequence
  Synthetic
aggccctggctgctgatatggagcttgaaattcggtttgaggaatgcccaggcactaaggtccacgtggaggaaacatgtggaacaagaggaccatctctgagatcaaccactgcaagcggaccttttgggacagcggtg

SEQ ID NO: 304 - DNA, 140 bp, Artificial Sequence
  Synthetic
caccgctgtcccaaaaggtccgcttgcagtggttgatctcagagatggtcctcttgttccacatgtttcctccacgtggaccttagtgcctgggcattcctcaaaccgaatttcaagctccatatcagcagccagggcct

SEQ ID NO: 305 - DNA, 140 bp, Artificial Sequence
  Synthetic
atacgccatgctgggtctccgaagggtgatcgaggaatggtgctgcagggagtgcacaatgcccccactgtcgttccgggctaaagatggctgttggtatggaatggagataaggcccagcgtacttgggagtcggccat

SEQ ID NO: 306 - DNA, 140 bp, Artificial Sequence
  Synthetic
atggccgactcccaagtacgctgggccttatctccattccataccaacagccatctttagcccggaacgacagtgggggcattgtgcactccctgcagcaccattcctcgatcacccttcggagacccagcatggcgtat

SEQ ID NO: 307 - DNA, 140 bp, Artificial Sequence
  Synthetic
aggccctggctgctgatatggtgcaggaagggctgaagaagagaatgaccacaaagatcatcataagcacatcaatggcagtgctggtagctatgatcctgggaggattttcaatgagtggaccttttgggacagcggtg

SEQ ID NO: 308 - DNA, 140 bp, Artificial Sequence
  Synthetic
caccgctgtcccaaaaggtccactcattgaaaatcctcccaggatcatagctaccagcactgccattgatgtgcttatgatgatctttgtggtcattctcttcttcagcccttcctgcaccatatcagcagccagggcct

SEQ ID NO: 309 - DNA, 140 bp, Artificial Sequence
  Synthetic
aggccctggctgctgatatgactggaggagatgtagctcatctggcgctgatagcggcattcaaagtcagaccagcgttgctggtatctttcatcttcagagctaattggacaccccgtggaccttttgggacagcggtg

SEQ ID NO: 310 - DNA, 140 bp, Artificial Sequence
  Synthetic
caccgctgtcccaaaaggtccacggggtgtccaattagctctgaagatgaaagataccagcaacgctggtctgactttgaatgccgctatcagcgccagatgagctacatctcctccagtcatatcagcagccagggcct

SEQ ID NO: 311 - DNA, 140 bp, Artificial Sequence
  Synthetic
aggccctggctgctgatatggccttggaaggcgacctgatggttctcatcaatggttttgctttggcctggttggcaatacgagcgatggttgttccacgcactgataacatcaccttgggaccttttgggacagcggtg

SEQ ID NO: 312 - DNA, 140 bp, Artificial Sequence
  Synthetic
caccgctgtcccaaaaggtcccaaggtgatgttatcagtgcgtggaacaaccatcgctcgtattgccaaccaggccaaagcaaaaccattgatgagaaccatcaggtcgccttccaaggccatatcagcagccagggcct

SEQ ID NO: 313 - DNA, 140 bp, Artificial Sequence
  Synthetic
atacgccatgctgggtctcccaatcctggctgctctgacaccactggcccggggcacactgcttgtggcgtggagagcaggccttgctacttgcggggggtttatgctcctctctctgaacgtacttgggagtcggccat

SEQ ID NO: 314 - DNA, 140 bp, Artificial Sequence
  Synthetic
atggccgactcccaagtacgttcagagagaggagcataaaccccccgcaagtagcaaggcctgctctccacgccacaagcagtgtgccccgggccagtggtgtcagagcagccaggattgggagacccagcatggcgtat

SEQ ID NO: 315 - DNA, 140 bp, Artificial Sequence
  Synthetic
atacgccatgctgggtctccgggaaaaggcagtgtgaagaagaacttaccatttgtcatggccctgggactaaccgctgtgaggctggtcgaccccatcaacgtggtggggctgctgttgcgtacttgggagtcggccat

SEQ ID NO: 316 - DNA, 140 bp, Artificial Sequence
  Synthetic
atggccgactcccaagtacgcaacagcagccccaccacgttgatggggtcgaccagcctcacagcggttagtcccagggccatgacaaatggtaagttcttcttcacactgccttttcccggagacccagcatggcgtat

SEQ ID NO: 317 - DNA, 140 bp, Artificial Sequence
  Synthetic
aggccctggctgctgatatgctcacaaggagtgggaagcggagctggccccctagcgaagtactcacagctgttggcctgatatgcgcattggctggagggttcgccaaggcagatataggaccttttgggacagcggtg

SEQ ID NO: 318 - DNA, 140 bp, Artificial Sequence
  Synthetic
caccgctgtcccaaaaggtcctatatctgccttggcgaaccctccagccaatgcgcatatcaggccaacagctgtgagtacttcgctagggggccagctccgcttcccactccttgtgagcatatcagcagccagggcct

SEQ ID NO: 319 - DNA, 140 bp, Artificial Sequence
  Synthetic
atacgccatgctgggtctccagatggctgggcccatggccgcggtcggtctgctaattgtcagttacgtggtctcaggaaagagtgtggacatgtacattgaaagagcaggtgacatcaccgtacttgggagtcggccat

SEQ ID NO: 320 - DNA, 140 bp, Artificial Sequence
  Synthetic
atggccgactcccaagtacggtgatgtcacctgctctttcaatgtacatgtccacactctttcctgagaccacgtaactgacaattagcagaccgaccgcggccatgggcccagccatctggagacccagcatggcgtat

SEQ ID NO: 321 - DNA, 140 bp, Artificial Sequence
  Synthetic
aggccctggctgctgatatggtctcaggaaagagtgtggacatgtacattgaaagagcaggtgacatcacatgggaaaaagatgcggaagtcactggaaacagtccccggctcgatgtgggaccttttgggacagcggtg

SEQ ID NO: 322 - DNA, 140 bp, Artificial Sequence
  Synthetic
caccgctgtcccaaaaggtcccacatcgagccggggactgtttccagtgacttccgcatctttttcccatgtgatgtcacctgctctttcaatgtacatgtccacactctttcctgagaccatatcagcagccagggcct

SEQ ID NO: 323 - DNA, 140 bp, Artificial Sequence
  Synthetic
atacgccatgctgggtctcccgctagatgagagtggtgatttctccctggtggaggatgacggtccccccatgagagagatcatactcaaggtggtcctgatgaccatctgtggcatgaacgtacttgggagtcggccat

SEQ ID NO: 324 - DNA, 140 bp, Artificial Sequence
  Synthetic
atggccgactcccaagtacgttcatgccacagatggtcatcaggaccaccttgagtatgatctctctcatggggggaccgtcatcctccaccagggagaaatcaccactctcatctagcgggagacccagcatggcgtat

SEQ ID NO: 325 - DNA, 140 bp, Artificial Sequence
  Synthetic
aggccctggctgctgatatgatgagagagatcatactcaaggtggtcctgatgaccatctgtggcatgaacccaatagccataccctttgcagctggagcgtggtacgtatacgtgaagagaccttttgggacagcggtg

SEQ ID NO: 326 - DNA, 140 bp, Artificial Sequence
  Synthetic
caccgctgtcccaaaaggtctcttcacgtatacgtaccacgctccagctgcaaagggtatggctattgggttcatgccacagatggtcatcaggaccaccttgagtatgatctctctcatcatatcagcagccagggcct

SEQ ID NO: 327 - DNA, 140 bp, Artificial Sequence
  Synthetic
atacgccatgctgggtctccctggaaaaaggagtggtgctctatgggatgtgcctgctcccaaggaagtaaaaaagggggagaccacagatggagtgtacagagtaatgactcgtagactcgtacttgggagtcggccat

SEQ ID NO: 328 - DNA, 140 bp, Artificial Sequence
  Synthetic
atggccgactcccaagtacgagtctacgagtcattactctgtacactccatctgtggtctcccccttttttacttccttgggagcaggcacatcccatagagcaccactcctttttccagggagacccagcatggcgtat

SEQ ID NO: 329 - DNA, 140 bp, Artificial Sequence
  Synthetic
atacgccatgctgggtctccacactatgtggcacgtcacaaaaggatccgcgctgagaagcggtgaagggagacttgatccatactggggagatgtcaagcaggatctggtgtcatactgcgtacttgggagtcggccat

SEQ ID NO: 330 - DNA, 140 bp, Artificial Sequence
  Synthetic
atggccgactcccaagtacgcagtatgacaccagatcctgcttgacatctccccagtatggatcaagtctcccttcaccgcttctcagcgcggatccttttgtgacgtgccacatagtgtggagacccagcatggcgtat

SEQ ID NO: 331 - DNA, 140 bp, Artificial Sequence
  Synthetic
atacgccatgctgggtctcctggtccatggaagctagatgccgcctgggacgggcacagcgaggtgcagctcttggccgtgccccccggagagagagcgaggaacatccagactctgccccgtacttgggagtcggccat

SEQ ID NO: 332 - DNA, 140 bp, Artificial Sequence
  Synthetic
atggccgactcccaagtacggggcagagtctggatgttcctcgctctctctccggggggcacggccaagagctgcacctcgctgtgcccgtcccaggcggcatctagcttccatggaccaggagacccagcatggcgtat

SEQ ID NO: 333 - DNA, 140 bp, Artificial Sequence
  Synthetic
aggccctggctgctgatatgtcttggccgtgccccccggagagagagcgaggaacatccagactctgcccggaatatttaagacaaaggatggggacattggagcggttgcgctggattagaccttttgggacagcggtg

SEQ ID NO: 334 - DNA, 140 bp, Artificial Sequence
  Synthetic
caccgctgtcccaaaaggtctaatccagcgcaaccgctccaatgtccccatcctttgtcttaaatattccgggcagagtctggatgttcctcgctctctctccggggggcacggccaagacatatcagcagccagggcct

SEQ ID NO: 335 - DNA, 140 bp, Artificial Sequence
  Synthetic
atacgccatgctgggtctccggaatatttaagacaaaggatggggacattggagcggttgcgctggattacccagcaggaacttcaggatctccaatcctagacaagtgtgggagagtgacgtacttgggagtcggccat

SEQ ID NO: 336 - DNA, 140 bp, Artificial Sequence
  Synthetic
atggccgactcccaagtacgtcactctcccacacttgtctaggattggagatcctgaagttcctgctgggtaatccagcgcaaccgctccaatgtccccatcctttgtcttaaatattccggagacccagcatggcgtat

SEQ ID NO: 337 - DNA, 140 bp, Artificial Sequence
  Synthetic
aggccctggctgctgatatgttcatgaccgccacgccaccaggaacccgtgacgcatttccggactccaactcaccaattatggacaccgaagtggaagtcccagagagagcctggagctgaccttttgggacagcggtg

SEQ ID NO: 338 - DNA, 140 bp, Artificial Sequence
  Synthetic
caccgctgtcccaaaaggtcagctccaggctctctctgggacttccacttcggtgtccataattggtgagttggagtccggaaatgcgtcacgggttcctggtggcgtggcggtcatgaacatatcagcagccagggcct

SEQ ID NO: 339 - DNA, 140 bp, Artificial Sequence
  Synthetic
atacgccatgctgggtctccctcaccaattatggacaccgaagtggaagtcccagagagagcctggagctcaggctttgattgggtgacggattattctggaaaaacagtttggtttgttcgtacttgggagtcggccat

SEQ ID NO: 340 - DNA, 140 bp, Artificial Sequence
  Synthetic
atggccgactcccaagtacgaacaaaccaaactgtttttccagaataatccgtcacccaatcaaagcctgagctccaggctctctctgggacttccacttcggtgtccataattggtgagggagacccagcatggcgtat

SEQ ID NO: 341 - DNA, 140 bp, Artificial Sequence
  Synthetic
atacgccatgctgggtctccccaagcgtgaggaacggcaatgagatcgcagcttgtctgacaaaggctggaaaacgggtcatacagctcagcagaaagacttttgagacagagttccagacgtacttgggagtcggccat

SEQ ID NO: 342 - DNA, 140 bp, Artificial Sequence
  Synthetic
atggccgactcccaagtacgtctggaactctgtctcaaaagtctttctgctgagctgtatgacccgttttccagcctttgtcagacaagctgcgatctcattgccgttcctcacgcttggggagacccagcatggcgtat

SEQ ID NO: 343 - DNA, 140 bp, Artificial Sequence
  Synthetic
aggccctggctgctgatatgaaaacgggtcatacagctcagcagaaagacttttgagacagagttccagaaaacaaaacatcaagagtgggactttgtcgtgacaactgacatttcagaggaccttttgggacagcggtg

SEQ ID NO: 344 - DNA, 140 bp, Artificial Sequence
  Synthetic
caccgctgtcccaaaaggtcctctgaaatgtcagttgtcacgacaaagtcccactcttgatgttttgttttctggaactctgtctcaaaagtctttctgctgagctgtatgacccgttttcatatcagcagccagggcct

SEQ ID NO: 345 - DNA, 140 bp, Artificial Sequence
  Synthetic
atacgccatgctgggtctccctgtcacacatgccagcgctgcccagaggagggggcgcataggcaggaatcccaacaaacctggagatgagtatctgtatggaggtgggtgcgcagagaccgtacttgggagtcggccat

SEQ ID NO: 346 - DNA, 140 bp, Artificial Sequence
  Synthetic
atggccgactcccaagtacggtctctgcgcacccacctccatacagatactcatctccaggtttgttgggattcctgcctatgcgccccctcctctgggcagcgctggcatgtgtgacagggagacccagcatggcgtat

SEQ ID NO: 347 - DNA, 140 bp, Artificial Sequence
  Synthetic
aggccctggctgctgatatggccaggacacatgacagagagattccaggaagccattgacaacctcgctgtgctcatgcgggcagagactggaagcaggccttacaaagccgcggcggccgaccttttgggacagcggtg

SEQ ID NO: 348 - DNA, 140 bp, Artificial Sequence
  Synthetic
caccgctgtcccaaaaggtcggccgccgcggctttgtaaggcctgcttccagtctctgcccgcatgagcacagcgaggttgtcaatggcttcctggaatctctctgtcatgtgtcctggccatatcagcagccagggcct

SEQ ID NO: 349 - DNA, 140 bp, Artificial Sequence
  Synthetic
aggccctggctgctgatatgagatgggctttggaatggtgactcttggggccagcgcatggctcatgtggctctcggaaattgagccagccagaattgcatgtgtcctcattgttgtgttgaccttttgggacagcggtg

SEQ ID NO: 350 - DNA, 140 bp, Artificial Sequence
  Synthetic
caccgctgtcccaaaaggtcaacacaacaatgaggacacatgcaattctggctggctcaatttccgagagccacatgagccatgcgctggccccaagagtcaccattccaaagcccatctcatatcagcagccagggcct

SEQ ID NO: 351 - DNA, 140 bp, Artificial Sequence
  Synthetic
atacgccatgctgggtctccctctcggaaattgagccagccagaattgcatgtgtcctcattgttgtgttcctattgctggtggtgctcatacctgagccagaaaagcaaagatctcccccgtacttgggagtcggccat

SEQ ID NO: 352 - DNA, 140 bp, Artificial Sequence
  Synthetic
atggccgactcccaagtacgggggagatctttgcttttctggctcaggtatgagcaccaccagcaataggaacacaacaatgaggacacatgcaattctggctggctcaatttccgagagggagacccagcatggcgtat

SEQ ID NO: 353 - DNA, 140 bp, Artificial Sequence
  Synthetic
atacgccatgctgggtctccaggacaaccaaatggcaatcatcatcatggtagcagtaggtcttctgggcttgattaccgccaatgaactcggatggttggagagaacaaagagtgacctcgtacttgggagtcggccat

SEQ ID NO: 354 - DNA, 140 bp, Artificial Sequence
  Synthetic
atggccgactcccaagtacgaggtcactctttgttctctccaaccatccgagttcattggcggtaatcaagcccagaagacctactgctaccatgatgatgattgccatttggttgtcctggagacccagcatggcgtat

SEQ ID NO: 355 - DNA, 140 bp, Artificial Sequence
  Synthetic
aggccctggctgctgatatgttgattaccgccaatgaactcggatggttggagagaacaaagagtgacctaagccatctaatgggaaggagagaggagggggcaaccatgggattctcaagaccttttgggacagcggtg

SEQ ID NO: 356 - DNA, 140 bp, Artificial Sequence
  Synthetic
caccgctgtcccaaaaggtcttgagaatcccatggttgccccctcctctctccttcccattagatggcttaggtcactctttgttctctccaaccatccgagttcattggcggtaatcaacatatcagcagccagggcct

SEQ ID NO: 357 - DNA, 140 bp, Artificial Sequence
  Synthetic
atacgccatgctgggtctcctggacattgacctgcggccagcctcagcttgggccatctatgctgccttgacaactttcattaccccagccgtccaacatgcagtgaccacttcatacaacgtacttgggagtcggccat

SEQ ID NO: 358 - DNA, 140 bp, Artificial Sequence
  Synthetic
atggccgactcccaagtacgttgtatgaagtggtcactgcatgttggacggctggggtaatgaaagttgtcaaggcagcatagatggcccaagctgaggctggccgcaggtcaatgtccaggagacccagcatggcgtat

SEQ ID NO: 359 - DNA, 140 bp, Artificial Sequence
  Synthetic
aggccctggctgctgatatgacaactttcattaccccagccgtccaacatgcagtgaccacttcatacaacaactactccttaatggcgatggccacgcaagctggagtgttgtttggtagaccttttgggacagcggtg

SEQ ID NO: 360 - DNA, 140 bp, Artificial Sequence
  Synthetic
caccgctgtcccaaaaggtctaccaaacaacactccagcttgcgtggccatcgccattaaggagtagttgttgtatgaagtggtcactgcatgttggacggctggggtaatgaaagttgtcatatcagcagccagggcct

SEQ ID NO: 361 - DNA, 140 bp, Artificial Sequence
  Synthetic
atacgccatgctgggtctcccaactactccttaatggcgatggccacgcaagctggagtgttgtttggtatgggcaaagggatgccattctacgcatgggactttggagtcccgctgctacgtacttgggagtcggccat

SEQ ID NO: 362 - DNA, 140 bp, Artificial Sequence
  Synthetic
atggccgactcccaagtacgtagcagcgggactccaaagtcccatgcgtagaatggcatccctttgcccataccaaacaacactccagcttgcgtggccatcgccattaaggagtagttgggagacccagcatggcgtat

SEQ ID NO: 363 - DNA, 140 bp, Artificial Sequence
  Synthetic
aggccctggctgctgatatgtgggcaaagggatgccattctacgcatgggactttggagtcccgctgctaatgataggttgctactcacaattaacgcccctgaccctaatagtggccatgaccttttgggacagcggtg

SEQ ID NO: 364 - DNA, 140 bp, Artificial Sequence
  Synthetic
caccgctgtcccaaaaggtcatggccactattagggtcaggggcgttaattgtgagtagcaacctatcattagcagcgggactccaaagtcccatgcgtagaatggcatccctttgcccacatatcagcagccagggcct

SEQ ID NO: 365 - DNA, 140 bp, Artificial Sequence
  Synthetic
atacgccatgctgggtctcccattttgctcgtggcgcactacatgtacttgatcccagggctgcaggcagcagctgcgcgtgctgcccagaagagaacggcagctggcatcatgaagaaccgtacttgggagtcggccat

SEQ ID NO: 366 - DNA, 140 bp, Artificial Sequence
  Synthetic
atggccgactcccaagtacggttcttcatgatgccagctgccgttctcttctgggcagcacgcgcagctgctgcctgcagccctgggatcaagtacatgtagtgcgccacgagcaaaatgggagacccagcatggcgtat

SEQ ID NO: 367 - DNA, 140 bp, Artificial Sequence
  Synthetic
atacgccatgctgggtctcccctgttgtggatggaatagtggtgactgacattgacacaatgacaattgacccccaagtggagaaaaagatgggacaggtgctactcatggcagtagccgcgtacttgggagtcggccat

SEQ ID NO: 368 - DNA, 140 bp, Artificial Sequence
  Synthetic
atggccgactcccaagtacgcggctactgccatgagtagcacctgtcccatctttttctccacttgggggtcaattgtcattgtgtcaatgtcagtcaccactattccatccacaacaggggagacccagcatggcgtat

SEQ ID NO: 369 - DNA, 140 bp, Artificial Sequence
  Synthetic
aggccctggctgctgatatgtctccagcgccatactgtcgcggaccgcctgggggtggggggaggctggggccctgatcacagccgcaacttccactttgtgggaaggctctccgaacaagaccttttgggacagcggtg

SEQ ID NO: 370 - DNA, 140 bp, Artificial Sequence
  Synthetic
caccgctgtcccaaaaggtcttgttcggagagccttcccacaaagtggaagttgcggctgtgatcagggccccagcctccccccacccccaggcggtccgcgacagtatggcgctggagacatatcagcagccagggcct

SEQ ID NO: 371 - DNA, 140 bp, Artificial Sequence
  Synthetic
atacgccatgctgggtctccgccctgatcacagccgcaacttccactttgtgggaaggctctccgaacaagtactggaactcctctacagccacttcactgtgtaacatttttaggggaacgtacttgggagtcggccat

SEQ ID NO: 372 - DNA, 140 bp, Artificial Sequence
  Synthetic
atggccgactcccaagtacgttcccctaaaaatgttacacagtgaagtggctgtagaggagttccagtacttgttcggagagccttcccacaaagtggaagttgcggctgtgatcagggcggagacccagcatggcgtat

SEQ ID NO: 373 - DNA, 140 bp, Artificial Sequence
  Synthetic
atacgccatgctgggtctccttggtcaagagacgtgggggtggaacaggagagaccctgggagagaaatggaaggcccgcttgaaccagatgtcggccctggagttctactcctacaaaacgtacttgggagtcggccat

SEQ ID NO: 374 - DNA, 140 bp, Artificial Sequence
  Synthetic
atggccgactcccaagtacgttttgtaggagtagaactccagggccgacatctggttcaagcgggccttccatttctctcccagggtctctcctgttccacccccacgtctcttgaccaaggagacccagcatggcgtat

SEQ ID NO: 375 - DNA, 140 bp, Artificial Sequence
  Synthetic
aggccctggctgctgatatggagatggttggtggagcggggatacctgcagccctatggaaaggtcattgatcttggatgtggcagagggggctggagttactacgccgccaccatccgcgaccttttgggacagcggtg

SEQ ID NO: 376 - DNA, 140 bp, Artificial Sequence
  Synthetic
caccgctgtcccaaaaggtcgcggatggtggcggcgtagtaactccagccccctctgccacatccaagatcaatgacctttccatagggctgcaggtatccccgctccaccaaccatctccatatcagcagccagggcct

SEQ ID NO: 377 - DNA, 140 bp, Artificial Sequence
  Synthetic
atacgccatgctgggtctccatcttggatgtggcagagggggctggagttactacgccgccaccatccgcaaagttcaagaagtgaaaggatacacaaaaggaggccctggtcatgaagacgtacttgggagtcggccat

SEQ ID NO: 378 - DNA, 140 bp, Artificial Sequence
  Synthetic
atggccgactcccaagtacgtcttcatgaccagggcctccttttgtgtatcctttcacttcttgaactttgcggatggtggcggcgtagtaactccagccccctctgccacatccaagatggagacccagcatggcgtat

SEQ ID NO: 379 - DNA, 140 bp, Artificial Sequence
  Synthetic
aggccctggctgctgatatgaaagttcaagaagtgaaaggatacacaaaaggaggccctggtcatgaagaacccgtgttggtgcaaagctatgggtggaacatagtccgtcttaagagtggaccttttgggacagcggtg

SEQ ID NO: 380 - DNA, 140 bp, Artificial Sequence
  Synthetic
caccgctgtcccaaaaggtccactcttaagacggactatgttccacccatagctttgcaccaacacgggttcttcatgaccagggcctccttttgtgtatcctttcacttcttgaactttcatatcagcagccagggcct

SEQ ID NO: 381 - DNA, 140 bp, Artificial Sequence
  Synthetic
aggccctggctgctgatatgtttgtataaaagtgttgtgcccatacaccagcactatgatggaaaccctggagcgactgcagcgtaggtatgggggaggactggtcagagtgccactctcgaccttttgggacagcggtg

SEQ ID NO: 382 - DNA, 140 bp, Artificial Sequence
  Synthetic
caccgctgtcccaaaaggtcgagagtggcactctgaccagtcctcccccatacctacgctgcagtcgctccagggtttccatcatagtgctggtgtatgggcacaacacttttatacaaacatatcagcagccagggcct

SEQ ID NO: 383 - DNA, 140 bp, Artificial Sequence
  Synthetic
aggccctggctgctgatatggagcgactgcagcgtaggtatgggggaggactggtcagagtgccactctcccgcaactctacacatgagatgtactgggtctctggagcgaaaagcaacagaccttttgggacagcggtg

SEQ ID NO: 384 - DNA, 140 bp, Artificial Sequence
  Synthetic
caccgctgtcccaaaaggtctgttgcttttcgctccagagacccagtacatctcatgtgtagagttgcgggagagtggcactctgaccagtcctcccccatacctacgctgcagtcgctccatatcagcagccagggcct

SEQ ID NO: 385 - DNA, 140 bp, Artificial Sequence
  Synthetic
atacgccatgctgggtctcccacgcgggctgtggtaagctgcgctgaagctcccaacatgaagatcattggtaaccgcattgaaaggatccgcagtgagcacgcggaaacgtggttctttcgtacttgggagtcggccat

SEQ ID NO: 386 - DNA, 140 bp, Artificial Sequence
  Synthetic
atggccgactcccaagtacgaaagaaccacgtttccgcgtgctcactgcggatcctttcaatgcggttaccaatgatcttcatgttgggagcttcagcgcagcttaccacagcccgcgtgggagacccagcatggcgtat

SEQ ID NO: 387 - DNA, 140 bp, Artificial Sequence
  Synthetic
aggccctggctgctgatatggtaaccgcattgaaaggatccgcagtgagcacgcggaaacgtggttctttgacgagaaccacccatataggacatgggcttaccatggaagctatgaggcgaccttttgggacagcggtg

SEQ ID NO: 388 - DNA, 140 bp, Artificial Sequence
  Synthetic
caccgctgtcccaaaaggtcgcctcatagcttccatggtaagcccatgtcctatatgggtggttctcgtcaaagaaccacgtttccgcgtgctcactgcggatcctttcaatgcggttaccatatcagcagccagggcct

SEQ ID NO: 389 - DNA, 140 bp, Artificial Sequence
  Synthetic
atacgccatgctgggtctccgacgagaaccacccatataggacatgggcttaccatggaagctatgaggcccccacacaagggtcagcgtcctctctaataaacggggttgtcaggctcccgtacttgggagtcggccat

SEQ ID NO: 390 - DNA, 140 bp, Artificial Sequence
  Synthetic
atggccgactcccaagtacgggagcctgacaaccccgtttattagagaggacgctgacccttgtgtgggggcctcatagcttccatggtaagcccatgtcctatatgggtggttctcgtcggagacccagcatggcgtat

SEQ ID NO: 391 - DNA, 140 bp, Artificial Sequence
  Synthetic
atacgccatgctgggtctcctgtcaaaaccctgggatgtggtgactggagtcacaggaatagccatgaccgacaccacaccgtatggtcagcaaagagttttcaaggaaaaagtggacaccgtacttgggagtcggccat

SEQ ID NO: 392 - DNA, 140 bp, Artificial Sequence
  Synthetic
atggccgactcccaagtacggtgtccactttttccttgaaaactctttgctgaccatacggtgtggtgtcggtcatggctattcctgtgactccagtcaccacatcccagggttttgacaggagacccagcatggcgtat

SEQ ID NO: 393 - DNA, 140 bp, Artificial Sequence
  Synthetic
aggccctggctgctgatatggacaccacaccgtatggtcagcaaagagttttcaaggaaaaagtggacactagggtgccagacccccaagaaggtactcgtcaggttatgagcatggtctgaccttttgggacagcggtg

SEQ ID NO: 394 - DNA, 140 bp, Artificial Sequence
  Synthetic
caccgctgtcccaaaaggtcagaccatgctcataacctgacgagtaccttcttgggggtctggcaccctagtgtccactttttccttgaaaactctttgctgaccatacggtgtggtgtccatatcagcagccagggcct

SEQ ID NO: 395 - DNA, 140 bp, Artificial Sequence
  Synthetic
aggccctggctgctgatatgatccaaggttctgggctctagtggacaaggaaagagagcaccacctgagaggagagtgccagagttgtgtgtacaacatgatgggaaaaagagaaaagaagaccttttgggacagcggtg

SEQ ID NO: 396 - DNA, 140 bp, Artificial Sequence
  Synthetic
caccgctgtcccaaaaggtcttcttttctctttttcccatcatgttgtacacacaactctggcactctcctctcaggtggtgctctctttccttgtccactagagcccagaaccttggatcatatcagcagccagggcct

SEQ ID NO: 397 - DNA, 140 bp, Artificial Sequence
  Synthetic
atacgccatgctgggtctccggagagtgccagagttgtgtgtacaacatgatgggaaaaagagaaaagaaacaaggggaatttggaaaggccaagggcagccgcgccatctggtatatgtcgtacttgggagtcggccat

SEQ ID NO: 398 - DNA, 140 bp, Artificial Sequence
  Synthetic
atggccgactcccaagtacgacatataccagatggcgcggctgcccttggcctttccaaattccccttgtttcttttctctttttcccatcatgttgtacacacaactctggcactctccggagacccagcatggcgtat

SEQ ID NO: 399 - DNA, 140 bp, Artificial Sequence
  Synthetic
aggccctggctgctgatatgattacaaagactcggatatgtcctagaagagatgagtcgcataccaggaggaaggatgtatgcagatgacactgctggctgggacacccgcatcagcagggaccttttgggacagcggtg

SEQ ID NO: 400 - DNA, 140 bp, Artificial Sequence
  Synthetic
caccgctgtcccaaaaggtccctgctgatgcgggtgtcccagccagcagtgtcatctgcatacatccttcctcctggtatgcgactcatctcttctaggacatatccgagtctttgtaatcatatcagcagccagggcct

SEQ ID NO: 401 - DNA, 140 bp, Artificial Sequence
  Synthetic
aggccctggctgctgatatgtttgatctggagaatgaagctctaatcaccaaccaaatggagaaagggcacagggccttggcattggccataatcaagtacacataccaaaacaaagtgggaccttttgggacagcggtg

SEQ ID NO: 402 - DNA, 140 bp, Artificial Sequence
  Synthetic
caccgctgtcccaaaaggtcccactttgttttggtatgtgtacttgattatggccaatgccaaggccctgtgccctttctccatttggttggtgattagagcttcattctccagatcaaacatatcagcagccagggcct

SEQ ID NO: 403 - DNA, 140 bp, Artificial Sequence
  Synthetic
atacgccatgctgggtctcccacatttaccaacctagtggtgcaactcattcggaatatggaggctgaggaagtcctagagatgcaagacttgtggctgctgcggaggtcagagaaagtgcgtacttgggagtcggccat

SEQ ID NO: 404 - DNA, 140 bp, Artificial Sequence
  Synthetic
atggccgactcccaagtacgcactttctctgacctccgcagcagccacaagtcttgcatctctaggacttcctcagcctccatattccgaatgagttgcaccactaggttggtaaatgtgggagacccagcatggcgtat

SEQ ID NO: 405 - DNA, 140 bp, Artificial Sequence
  Synthetic
atacgccatgctgggtctccgcgggatggagcatccgggagactgcttgcctagcaaaatcatatgcgcaaatgtggcagctcctttatttccacagaagggacctccgactgatggccacgtacttgggagtcggccat

SEQ ID NO: 406 - DNA, 140 bp, Artificial Sequence
  Synthetic
atggccgactcccaagtacgtggccatcagtcggaggtcccttctgtggaaataaaggagctgccacatttgcgcatatgattttgctaggcaagcagtctcccggatgctccatcccgcggagacccagcatggcgtat

SEQ ID NO: 407 - DNA, 140 bp, Artificial Sequence
  Synthetic
aggccctggctgctgatatggacttgtggtgtggatctctcatagggcacagaccgcgcaccacctgggctgagaacattaaaaacacagtcaacatggtgcgcaggatcataggtgatggaccttttgggacagcggtg

SEQ ID NO: 408 - DNA, 140 bp, Artificial Sequence
  Synthetic
caccgctgtcccaaaaggtccatcacctatgatcctgcgcaccatgttgactgtgtttttaatgttctcagcccaggtggtgcgcggtctgtgccctatgagagatccacaccacaagtccatatcagcagccagggcct

SEQ ID NO: 409 - DNA, 140 bp, Artificial Sequence
  Synthetic
aggccctggctgctgatatggaagggtctacacctggagtgctgtaagcaccaatcttaatgttgtcaggcctgctagtcagccacagcttggggaaagctgtgcagcctgtgaccccccgaccttttgggacagcggtg

SEQ ID NO: 410 - DNA, 140 bp, Artificial Sequence
  Synthetic
caccgctgtcccaaaaggtcggggggtcacaggctgcacagctttccccaagctgtggctgactagcaggcctgacaacattaagattggtgcttacagcactccaggtgtagacccttccatatcagcagccagggcct

SEQ ID NO: 411 - DNA, 140 bp, Artificial Sequence
  Synthetic
aggccctggctgctgatatgcaggagaagctgggaaaccaagcctatagtcaggccgagaacgccatggcacggaagaagccatgctgcctgtgagcccctcagaggacactgagtcaaagaccttttgggacagcggtg

SEQ ID NO: 412 - DNA, 140 bp, Artificial Sequence
  Synthetic
caccgctgtcccaaaaggtctttgactcagtgtcctctgaggggctcacaggcagcatggcttcttccgtgccatggcgttctcggcctgactataggcttggtttcccagcttctcctgcatatcagcagccagggcct

SEQ ID NO: 413 - DNA, 140 bp, Artificial Sequence
  Synthetic
atacgccatgctgggtctccacggaagaagccatgctgcctgtgagcccctcagaggacactgagtcaaaaaaccccacgcgcttggaggcgcaggatgggaaaagaaggtggcgaccttcgtacttgggagtcggccat

SEQ ID NO: 414 - DNA, 140 bp, Artificial Sequence
  Synthetic
atggccgactcccaagtacgaaggtcgccaccttcttttcccatcctgcgcctccaagcgcgtggggttttttgactcagtgtcctctgaggggctcacaggcagcatggcttcttccgtggagacccagcatggcgtat

SEQ ID NO: 415 - DNA, 140 bp, Artificial Sequence
  Synthetic
aggccctggctgctgatatgatgggaaaagaaggtggcgaccttccccacccttcaatctggggcctgaactggagatcagctgtggatctccagaagagggactagtggttagaggagagaccttttgggacagcggtg

SEQ ID NO: 416 - DNA, 140 bp, Artificial Sequence
  Synthetic
caccgctgtcccaaaaggtctctcctctaaccactagtccctcttctggagatccacagctgatctccagttcaggccccagattgaagggtggggaaggtcgccaccttcttttcccatcatatcagcagccagggcct

SEQ ID NO: 417 - DNA, 140 bp, Artificial Sequence
  Synthetic
atacgccatgctgggtctccatgaaaaacccaaagaggaaatccggaggattccggattgtcaatatgctaaaacgcggagtagcccgtgtaaaccccttggggggtttgaagaggctgccgtacttgggagtcggccat

SEQ ID NO: 418 - DNA, 140 bp, Artificial Sequence
  Synthetic
atggccgactcccaagtacggcagcctcttcaaaccccccaaggggtttacacgggctactccgcgttttagcatattgacaatccggaatcctccggatttcctctttgggtttttcatggagacccagcatggcgtat

SEQ ID NO: 419 - DNA, 140 bp, Artificial Sequence
  Synthetic
atacgccatgctgggtctcccagccggacttctgctgggtcatggacccattagaatggttttggcgatactagcctttttgagatttacagcaatcaagccatcactgggcctcatcaacgtacttgggagtcggccat

SEQ ID NO: 420 - DNA, 140 bp, Artificial Sequence
  Synthetic
atggccgactcccaagtacgttgatgaggcccagtgatggcttgattgctgtaaatctcaaaaaggctagtatcgccaaaaccattctaatgggtccatgacccagcagaagtccggctgggagacccagcatggcgtat

SEQ ID NO: 421 - DNA, 140 bp, Artificial Sequence
  Synthetic
atacgccatgctgggtctcctagatggggttcagtggggaaaaaagaggctatggagataataaagaagtttaagaaagatcttgctgccatgttgagaataatcaatgctaggaaggagcgtacttgggagtcggccat

SEQ ID NO: 422 - DNA, 140 bp, Artificial Sequence
  Synthetic
atggccgactcccaagtacgctccttcctagcattgattattctcaacatggcagcaagatctttcttaaacttctttattatctccatagcctcttttttccccactgaaccccatctaggagacccagcatggcgtat

SEQ ID NO: 423 - DNA, 140 bp, Artificial Sequence
  Synthetic
atacgccatgctgggtctccaggaagagacgtggtgcagacaccagtatcggaatcattggcctcctgctgactacagccatggcagcagagattactagacgaggaagtgcatactacacgtacttgggagtcggccat

SEQ ID NO: 424 - DNA, 140 bp, Artificial Sequence
  Synthetic
atggccgactcccaagtacgtgtagtatgcacttcctcgtctagtaatctctgctgccatggctgtagtcagcaggaggccaatgattccgatactggtgtctgcaccacgtctcttcctggagacccagcatggcgtat

SEQ ID NO: 425 - DNA, 140 bp, Artificial Sequence
  Synthetic
atacgccatgctgggtctcctgtacttggacaggagcgatgctgggaaggccatttcctttgctaccacattgggagtgaacaaatgccatgtacagatcatggatctcgggcacatgtgcgtacttgggagtcggccat

SEQ ID NO: 426 - DNA, 140 bp, Artificial Sequence
  Synthetic
atggccgactcccaagtacgcacatgtgcccgagatccatgatctgtacatggcatttgttcactcccaatgtggtagcaaaggaaatggccttcccagcatcgctcctgtccaagtacaggagacccagcatggcgtat

SEQ ID NO: 427 - DNA, 140 bp, Artificial Sequence
  Synthetic
aggccctggctgctgatatgttgggagtgaacaaatgccatgtacagatcatggatctcgggcacatgtgtgacgccaccatgagttatgagtgccctatgctagacgaaggagtggaacgaccttttgggacagcggtg

SEQ ID NO: 428 - DNA, 140 bp, Artificial Sequence
  Synthetic
caccgctgtcccaaaaggtcgttccactccttcgtctagcatagggcactcataactcatggtggcgtcacacatgtgcccgagatccatgatctgtacatggcatttgttcactcccaacatatcagcagccagggcct

SEQ ID NO: 429 - DNA, 140 bp, Artificial Sequence
  Synthetic
aggccctggctgctgatatgcagatgatgtcgattgctggtgcaacacgacatcaacttgggttgtgtacggaacctgtcatcacaaaaaaggtgaagcacggcgatctagaagagctgtgaccttttgggacagcggtg

SEQ ID NO: 430 - DNA, 140 bp, Artificial Sequence
  Synthetic
caccgctgtcccaaaaggtcacagctcttctagatcgccgtgcttcaccttttttgtgatgacaggttccgtacacaacccaagttgatgtcgtgttgcaccagcaatcgacatcatctgcatatcagcagccagggcct

SEQ ID NO: 431 - DNA, 140 bp, Artificial Sequence
  Synthetic
atacgccatgctgggtctccgacgctcccttctcactccacaaggaagttgcaaacgcggtcgcagacctggttagaatcaagagaatacacgaagcacttgatcaaggttgaaaactggcgtacttgggagtcggccat

SEQ ID NO: 432 - DNA, 140 bp, Artificial Sequence
  Synthetic
atggccgactcccaagtacgccagttttcaaccttgatcaagtgcttcgtgtattctcttgattctaaccaggtctgcgaccgcgtttgcaacttccttgtggagtgagaagggagcgtcggagacccagcatggcgtat

SEQ ID NO: 433 - DNA, 140 bp, Artificial Sequence
  Synthetic
aggccctggctgctgatatgggttagaatcaagagaatacacgaagcacttgatcaaggttgaaaactggatattcaggaaccccgggtttgcgctagcggctgttgccattgcttggctgaccttttgggacagcggtg

SEQ ID NO: 434 - DNA, 140 bp, Artificial Sequence
  Synthetic
caccgctgtcccaaaaggtcagccaagcaatggcaacagccgctagcgcaaacccggggttcctgaatatccagttttcaaccttgatcaagtgcttcgtgtattctcttgattctaacccatatcagcagccagggcct

SEQ ID NO: 435 - DNA, 140 bp, Artificial Sequence
  Synthetic
atacgccatgctgggtctcctctgggaagctcgacgagccaaaaagtcatatacttggtcatgatattgttgattgccccggcatacagcatcaggtgcataggagttagcaatagagatcgtacttgggagtcggccat

SEQ ID NO: 436 - DNA, 140 bp, Artificial Sequence
  Synthetic
atggccgactcccaagtacgatctctattgctaactcctatgcacctgatgctgtatgccggggcaatcaacaatatcatgaccaagtatatgactttttggctcgtcgagcttcccagaggagacccagcatggcgtat

SEQ ID NO: 437 - DNA, 140 bp, Artificial Sequence
  Synthetic
aggccctggctgctgatatgtgattgccccggcatacagcatcaggtgcataggagttagcaatagagatttcgtagagggcatgtcaggtgggacctgggttgatgtcgtcttggaacagaccttttgggacagcggtg

SEQ ID NO: 438 - DNA, 140 bp, Artificial Sequence
  Synthetic
caccgctgtcccaaaaggtctgttccaagacgacatcaacccaggtcccacctgacatgccctctacgaaatctctattgctaactcctatgcacctgatgctgtatgccggggcaatcacatatcagcagccagggcct

SEQ ID NO: 439 - DNA, 140 bp, Artificial Sequence
  Synthetic
aggccctggctgctgatatgagttggtcacgacaacggttagcaacatggccgaggtaagatcctactgctatgaggcatcaatatcggacatggcctcggacagccgctgtccaacacagaccttttgggacagcggtg

SEQ ID NO: 440 - DNA, 140 bp, Artificial Sequence
  Synthetic
caccgctgtcccaaaaggtctgtgttggacagcggctgtccgaggccatgtccgatattgatgcctcatagcagtaggatcttacctcggccatgttgctaaccgttgtcgtgaccaactcatatcagcagccagggcct

SEQ ID NO: 441 - DNA, 140 bp, Artificial Sequence
  Synthetic
atacgccatgctgggtctccaggtgaagcctaccttgacaagcaatcagacactcaatatgtctgcaaaagaacattagtggacagaggttggggaaacggttgtggactttttggcaaacgtacttgggagtcggccat

SEQ ID NO: 442 - DNA, 140 bp, Artificial Sequence
  Synthetic
atggccgactcccaagtacgtttgccaaaaagtccacaaccgtttccccaacctctgtccactaatgttcttttgcagacatattgagtgtctgattgcttgtcaaggtaggcttcacctggagacccagcatggcgtat

SEQ ID NO: 443 - DNA, 140 bp, Artificial Sequence
  Synthetic
aggccctggctgctgatatggaacattagtggacagaggttggggaaacggttgtggactttttggcaaagggagcttggtgacatgtgccaagtttacgtgttctaagaagatgaccgggaccttttgggacagcggtg

SEQ ID NO: 444 - DNA, 140 bp, Artificial Sequence
  Synthetic
caccgctgtcccaaaaggtcccggtcatcttcttagaacacgtaaacttggcacatgtcaccaagctccctttgccaaaaagtccacaaccgtttccccaacctctgtccactaatgttccatatcagcagccagggcct

SEQ ID NO: 445 - DNA, 140 bp, Artificial Sequence
  Synthetic
aggccctggctgctgatatggacgaaaacagagcaaaggtcgaggtcacacccaattcaccaagagcagaagcaaccttgggaggttttggaagcttgggacttgactgtgaaccaaggagaccttttgggacagcggtg

SEQ ID NO: 446 - DNA, 140 bp, Artificial Sequence
  Synthetic
caccgctgtcccaaaaggtctccttggttcacagtcaagtcccaagcttccaaaacctcccaaggttgcttctgctcttggtgaattgggtgtgacctcgacctttgctctgttttcgtccatatcagcagccagggcct

SEQ ID NO: 447 - DNA, 140 bp, Artificial Sequence
  Synthetic
atacgccatgctgggtctccagcaaccttgggaggttttggaagcttgggacttgactgtgaaccaaggacaggccttgacttctcagatctgtattatctgaccatgaacaacaagcatcgtacttgggagtcggccat

SEQ ID NO: 448 - DNA, 140 bp, Artificial Sequence
  Synthetic
atggccgactcccaagtacgatgcttgttgttcatggtcagataatacagatctgagaagtcaaggcctgtccttggttcacagtcaagtcccaagcttccaaaacctcccaaggttgctggagacccagcatggcgtat

SEQ ID NO: 449 - DNA, 140 bp, Artificial Sequence
  Synthetic
atacgccatgctgggtctcccggttggtgcgcaaggagtggtttcatgacatcccattaccttggcatgctggtgcagacactggaactccacactggaacaacaaagaggcattggtggcgtacttgggagtcggccat

SEQ ID NO: 450 - DNA, 140 bp, Artificial Sequence
  Synthetic
atggccgactcccaagtacgccaccaatgcctctttgttgttccagtgtggagttccagtgtctgcaccagcatgccaaggtaatgggatgtcatgaaaccactccttgcgcaccaaccgggagacccagcatggcgtat

SEQ ID NO: 451 - DNA, 140 bp, Artificial Sequence
  Synthetic
aggccctggctgctgatatgtggtgcagacactggaactccacactggaacaacaaagaggcattggtggagttcaaggacgctcacgccaagaggcaaactgttgtggttctggggagcgaccttttgggacagcggtg

SEQ ID NO: 452 - DNA, 140 bp, Artificial Sequence
  Synthetic
caccgctgtcccaaaaggtcgctccccagaaccacaacagtttgcctcttggcgtgagcgtccttgaactccaccaatgcctctttgttgttccagtgtggagttccagtgtctgcaccacatatcagcagccagggcct

SEQ ID NO: 453 - DNA, 140 bp, Artificial Sequence
  Synthetic
atacgccatgctgggtctcccaagagggagctgttcacacggccctcgctggagctctggaggctgagatggatggtgcaaagggaaggctattctctggccatttgaaatgccgcctaacgtacttgggagtcggccat

SEQ ID NO: 454 - DNA, 140 bp, Artificial Sequence
  Synthetic
atggccgactcccaagtacgttaggcggcatttcaaatggccagagaatagccttccctttgcaccatccatctcagcctccagagctccagcgagggccgtgtgaacagctccctcttgggagacccagcatggcgtat

SEQ ID NO: 455 - DNA, 140 bp, Artificial Sequence
  Synthetic
aggccctggctgctgatatgggatggtgcaaagggaaggctattctctggccatttgaaatgccgcctaaaaatggacaagcttaggttgaagggtgtgtcatattccctgtgtactgcagaccttttgggacagcggtg

SEQ ID NO: 456 - DNA, 140 bp, Artificial Sequence
  Synthetic
caccgctgtcccaaaaggtctgcagtacacagggaatatgacacacccttcaacctaagcttgtccatttttaggcggcatttcaaatggccagagaatagccttccctttgcaccatcccatatcagcagccagggcct

SEQ ID NO: 457 - DNA, 140 bp, Artificial Sequence
  Synthetic
atacgccatgctgggtctccaaatggacaagcttaggttgaagggtgtgtcatattccctgtgtactgcagcgttcacatttaccaaggtcccagctgaaacattgcatggaacagttaccgtacttgggagtcggccat

SEQ ID NO: 458 - DNA, 140 bp, Artificial Sequence
  Synthetic
atggccgactcccaagtacggtaactgttccatgcaatgtttcagctgggaccttggtaaatgtgaacgctgcagtacacagggaatatgacacacccttcaacctaagcttgtccatttggagacccagcatggcgtat

SEQ ID NO: 459 - DNA, 140 bp, Artificial Sequence
  Synthetic
atacgccatgctgggtctccagtggaggtgcagtatgcagggacagatggaccttgcaaggtcccagcccagatggcggtggacatgcagactctgaccccagttggaaggctgataacccgtacttgggagtcggccat

SEQ ID NO: 460 - DNA, 140 bp, Artificial Sequence
  Synthetic
atggccgactcccaagtacgggttatcagccttccaactggggtcagagtctgcatgtccaccgccatctgggctgggaccttgcaaggtccatctgtccctgcatactgcacctccactggagacccagcatggcgtat

SEQ ID NO: 461 - DNA, 140 bp, Artificial Sequence
  Synthetic
atacgccatgctgggtctccgccaaccctgtgatcactgaaagtactgagaattcaaagatgatgttggaacttgacccaccatttggggattcttacattgtcataggagtcggggacacgtacttgggagtcggccat

SEQ ID NO: 462 - DNA, 140 bp, Artificial Sequence
  Synthetic
atggccgactcccaagtacgtgtccccgactcctatgacaatgtaagaatccccaaatggtgggtcaagttccaacatcatctttgaattctcagtactttcagtgatcacagggttggcggagacccagcatggcgtat

SEQ ID NO: 463 - DNA, 140 bp, Artificial Sequence
  Synthetic
atacgccatgctgggtctccagaaaatcacccatcactggctcaagaaagggagctccatcggaaaggcatttgaagccactgtgagaggtgccaagagaatggcagtcttgggggacaccgtacttgggagtcggccat

SEQ ID NO: 464 - DNA, 140 bp, Artificial Sequence
  Synthetic
atggccgactcccaagtacggtgtcccccaagactgccattctcttggcacctctcacagtggcttcaaatgcctttccgatggagctccctttcttgagccagtgatgggtgattttctggagacccagcatggcgtat

SEQ ID NO: 465 - DNA, 140 bp, Artificial Sequence
  Synthetic
atacgccatgctgggtctccagcctgggactttggatcagttggaggtgtgtttaattcattgggtaagggtgttcatcagatctttggagcagctttcaaatcactgtttggaggaatgcgtacttgggagtcggccat

SEQ ID NO: 466 - DNA, 140 bp, Artificial Sequence
  Synthetic
atggccgactcccaagtacgcattcctccaaacagtgatttgaaagctgctccaaagatctgatgaacacccttacccaatgaattaaacacacctccaactgatccaaagtcccaggctggagacccagcatggcgtat

SEQ ID NO: 467 - DNA, 140 bp, Artificial Sequence
  Synthetic
atacgccatgctgggtctcctcctggttctcacagatcctcataggcacactgttggtgtggttgggtctgaacacaaagaatggatctatctccctcacatgcttagccctggggggagcgtacttgggagtcggccat

SEQ ID NO: 468 - DNA, 140 bp, Artificial Sequence
  Synthetic
atggccgactcccaagtacgctccccccagggctaagcatgtgagggagatagatccattctttgtgttcagacccaaccacaccaacagtgtgcctatgaggatctgtgagaaccaggaggagacccagcatggcgtat

SEQ ID NO: 469 - DNA, 140 bp, Artificial Sequence
  Synthetic
atacgccatgctgggtctcctgatgattttcctttccacggctgtttctgctgatgttgggtgctcggtggacttctcaaaaaaggaaacgagatgtggcacgggggtgttcgtctacaacgtacttgggagtcggccat

SEQ ID NO: 470 - DNA, 140 bp, Artificial Sequence
  Synthetic
atggccgactcccaagtacgttgtagacgaacacccccgtgccacatctcgtttccttttttgagaagtccaccgagcacccaacatcagcagaaacagccgtggaaaggaaaatcatcaggagacccagcatggcgtat

SEQ ID NO: 471 - DNA, 140 bp, Artificial Sequence
  Synthetic
aggccctggctgctgatatggacttctcaaaaaaggaaacgagatgtggcacgggggtgttcgtctacaatgacgttgaagcctggagggaccgttacaagtatcatcctgactccccccgaccttttgggacagcggtg

SEQ ID NO: 472 - DNA, 140 bp, Artificial Sequence
  Synthetic
caccgctgtcccaaaaggtcggggggagtcaggatgatacttgtaacggtccctccaggcttcaacgtcattgtagacgaacacccccgtgccacatctcgtttccttttttgagaagtccatatcagcagccagggcct

SEQ ID NO: 473 - DNA, 140 bp, Artificial Sequence
  Synthetic
atacgccatgctgggtctccgcagattggcagcagctgttaagcaggcttgggaagaggggatttgtgggatctcctccgtttcgagaatggaaaacatcatgtggaaatcagtggaaggcgtacttgggagtcggccat

SEQ ID NO: 474 - DNA, 140 bp, Artificial Sequence
  Synthetic
atggccgactcccaagtacgccttccactgatttccacatgatgttttccattctcgaaacggaggagatcccacaaatcccctcttcccaagcctgcttaacagctgctgccaatctgcggagacccagcatggcgtat

SEQ ID NO: 475 - DNA, 140 bp, Artificial Sequence
  Synthetic
atacgccatgctgggtctcctggggtctgtaaaaaaccccatgtggagaggtccacaaagattgccagtgcccgtgaatgagctgccccatggctggaaagcctgggggaaatcgtacttcgtacttgggagtcggccat

SEQ ID NO: 476 - DNA, 140 bp, Artificial Sequence
  Synthetic
atggccgactcccaagtacgaagtacgatttcccccaggctttccagccatggggcagctcattcacgggcactggcaatctttgtggacctctccacatggggttttttacagaccccaggagacccagcatggcgtat

SEQ ID NO: 477 - DNA, 140 bp, Artificial Sequence
  Synthetic
atacgccatgctgggtctcctgtcagagcggcaaagaccaacaacagttttgttgtcgacggagacacactgaaggagtgtccgctcaaacatagagcatggaatagcttccttgtggagcgtacttgggagtcggccat

SEQ ID NO: 478 - DNA, 140 bp, Artificial Sequence
  Synthetic
atggccgactcccaagtacgctccacaaggaagctattccatgctctatgtttgagcggacactccttcagtgtgtctccgtcgacaacaaaactgttgttggtctttgccgctctgacaggagacccagcatggcgtat

SEQ ID NO: 479 - DNA, 140 bp, Artificial Sequence
  Synthetic
atacgccatgctgggtctccgatcacgggtttgggattttccacaccagtgtttggctgaaggtcagagaggactactcattagagtgtgacccagccgtcataggaacagctgtcaaggcgtacttgggagtcggccat

SEQ ID NO: 480 - DNA, 140 bp, Artificial Sequence
  Synthetic
atggccgactcccaagtacgccttgacagctgttcctatgacggctgggtcacactctaatgagtagtcctctctgaccttcagccaaacactggtgtggaaaatcccaaacccgtgatcggagacccagcatggcgtat

SEQ ID NO: 481 - DNA, 140 bp, Artificial Sequence
  Synthetic
atacgccatgctgggtctccgaaaggaagctgcacacagtgatctatgctattggattgagagtgaaaagaatgacacatggaggctgaggagggcccacctgattgagatgaaaacatgcgtacttgggagtcggccat

SEQ ID NO: 482 - DNA, 140 bp, Artificial Sequence
  Synthetic
atggccgactcccaagtacgcatgttttcatctcaatcaggtgggccctcctcagcctccatgtgtcattcttttcactctcaatccaatagcatagatcactgtgtgcagcttcctttcggagacccagcatggcgtat

SEQ ID NO: 483 - DNA, 140 bp, Artificial Sequence
  Synthetic
atacgccatgctgggtctcctgaatggccaaagtctcacacattgtggacagatggagtagaagaaagtgatcttatcatacccaagtctttagctggtccactcagccaccacaacacccgtacttgggagtcggccat

SEQ ID NO: 484 - DNA, 140 bp, Artificial Sequence
  Synthetic
atggccgactcccaagtacgggtgttgtggtggctgagtggaccagctaaagacttgggtatgataagatcactttcttctactccatctgtccacaatgtgtgagactttggccattcaggagacccagcatggcgtat

SEQ ID NO: 485 - DNA, 140 bp, Artificial Sequence
  Synthetic
atacgccatgctgggtctccagagagggttacagaacccaagtgaaagggccatggcacagtgaagagcttgaaatccggtttgaggaatgtccaggcaccaaggtttacgtggaggagacgtacttgggagtcggccat

SEQ ID NO: 486 - DNA, 140 bp, Artificial Sequence
  Synthetic
atggccgactcccaagtacgtctcctccacgtaaaccttggtgcctggacattcctcaaaccggatttcaagctcttcactgtgccatggccctttcacttgggttctgtaaccctctctggagacccagcatggcgtat

SEQ ID NO: 487 - DNA, 140 bp, Artificial Sequence
  Synthetic
atacgccatgctgggtctcccatgcggaactagaggaccatctctgagatcaactactgcaagtggaagggtcattgaggaatggtgctgtagggaatgcacaatgcccccactatcgttcgtacttgggagtcggccat

SEQ ID NO: 488 - DNA, 140 bp, Artificial Sequence
  Synthetic
atggccgactcccaagtacgaacgatagtgggggcattgtgcattccctacagcaccattcctcaatgacccttccacttgcagtagttgatctcagagatggtcctctagttccgcatgggagacccagcatggcgtat

SEQ ID NO: 489 - DNA, 140 bp, Artificial Sequence
  Synthetic
atacgccatgctgggtctcctcgagcaaaagacggctgctggtatggaatggagataaggcccaggaaagaaccagagagcaacttagtgaggtcaatggtgacagcggggtcaaccgatcgtacttgggagtcggccat

SEQ ID NO: 490 - DNA, 140 bp, Artificial Sequence
  Synthetic
atggccgactcccaagtacgatcggttgaccccgctgtcaccattgacctcactaagttgctctctggttctttcctgggccttatctccattccataccagcagccgtcttttgctcgaggagacccagcatggcgtat

SEQ ID NO: 491 - DNA, 140 bp, Artificial Sequence
  Synthetic
atacgccatgctgggtctcccatatggaccacttctctcttggagtgcttgtgattctactcatggtgcaggaggggttgaagaagagaatgaccacaaagatcatcatgagcacatcaacgtacttgggagtcggccat

SEQ ID NO: 492 - DNA, 140 bp, Artificial Sequence
  Synthetic
atggccgactcccaagtacgttgatgtgctcatgatgatctttgtggtcattctcttcttcaacccctcctgcaccatgagtagaatcacaagcactccaagagagaagtggtccatatgggagacccagcatggcgtat

SEQ ID NO: 493 - DNA, 140 bp, Artificial Sequence
  Synthetic
aggccctggctgctgatatgggaggggttgaagaagagaatgaccacaaagatcatcatgagcacatcaatggcagtgctggtagccatggtcttgggaggattctcaatgagtgatctggaccttttgggacagcggtg

SEQ ID NO: 494 - DNA, 140 bp, Artificial Sequence
  Synthetic
caccgctgtcccaaaaggtccagatcactcattgagaatcctcccaagaccatggctaccagcactgccattgatgtgctcatgatgatctttgtggtcattctcttcttcaacccctcccatatcagcagccagggcct

SEQ ID NO: 495 - DNA, 140 bp, Artificial Sequence
  Synthetic
aggccctggctgctgatatgaggagatgtggctcacttggcattggttgcggcatttaaagtcagaccagccttgttggtttcctttatcttcagagccaactggacaccccgtgagagcgaccttttgggacagcggtg

SEQ ID NO: 496 - DNA, 140 bp, Artificial Sequence
  Synthetic
caccgctgtcccaaaaggtcgctctcacggggtgtccagttggctctgaagataaaggaaaccaacaaggctggtctgactttaaatgccgcaaccaatgccaagtgagccacatctcctcatatcagcagccagggcct

SEQ ID NO: 497 - DNA, 140 bp, Artificial Sequence
  Synthetic
atacgccatgctgggtctcccaatacgagcaatggccgtgccacgcactgacaatatcgctctagcaactctggccgctttaacaccattggccagaggcacactgctcgtggcatggagcgtacttgggagtcggccat

SEQ ID NO: 498 - DNA, 140 bp, Artificial Sequence
  Synthetic
atggccgactcccaagtacgctccatgccacgagcagtgtgcctctggccaatggtgttaaagcggccagagttgctagagcgatattgtcagtgcgtggcacggccattgctcgtattgggagacccagcatggcgtat

SEQ ID NO: 499 - DNA, 140 bp, Artificial Sequence
  Synthetic
atacgccatgctgggtctccagcgggcctcgccacttgtggagggttcatgcttctttccctgaaagggaaaggtagtgtgaagaagaacctgccttttgtcatggccttggggttggcccgtacttgggagtcggccat

SEQ ID NO: 500 - DNA, 140 bp, Artificial Sequence
  Synthetic
atggccgactcccaagtacgggccaaccccaaggccatgacaaaaggcaggttcttcttcacactacctttccctttcagggaaagaagcatgaaccctccacaagtggcgaggcccgctggagacccagcatggcgtat

SEQ ID NO: 501 - DNA, 140 bp, Artificial Sequence
  Synthetic
atacgccatgctgggtctccgctgtgaggatagtggaccccatcaatgtggtaggactactgttactcacaaggagtggaaaacggagctggccccccagtgaagtgcttacagctgttgcgtacttgggagtcggccat

SEQ ID NO: 502 - DNA, 140 bp, Artificial Sequence
  Synthetic
atggccgactcccaagtacgcaacagctgtaagcacttcactggggggccagctccgttttccactccttgtgagtaacagtagtcctaccacattgatggggtccactatcctcacagcggagacccagcatggcgtat

SEQ ID NO: 503 - DNA, 140 bp, Artificial Sequence
  Synthetic
atacgccatgctgggtctccgcctgatatgtgcactggccggagggtttgccaaggcagacatagagatggctgggcccatggctgcagtaggcctgctaattgtcagttatgtggtctccgtacttgggagtcggccat

SEQ ID NO: 504 - DNA, 140 bp, Artificial Sequence
  Synthetic
atggccgactcccaagtacggagaccacataactgacaattagcaggcctactgcagccatgggcccagccatctctatgtctgccttggcaaaccctccggccagtgcacatatcaggcggagacccagcatggcgtat

SEQ ID NO: 505 - DNA, 140 bp, Artificial Sequence
  Synthetic
atacgccatgctgggtctccgggaaagagtgtggacatgtacatcgaaagagcaggtgatatcacatgggaaaaagacgcggaagtcactggaaacagtccccggcttgacgtggcactgcgtacttgggagtcggccat

SEQ ID NO: 506 - DNA, 140 bp, Artificial Sequence
  Synthetic
atggccgactcccaagtacgcagtgccacgtcaagccggggactgtttccagtgacttccgcgtctttttcccatgtgatatcacctgctctttcgatgtacatgtccacactctttcccggagacccagcatggcgtat

SEQ ID NO: 507 - DNA, 140 bp, Artificial Sequence
  Synthetic
aggccctggctgctgatatgagagatcatactcaaggtggtcctgatggccatctgtggcatgaacccaatagccatacccttcgctgcaggagcgtggtatgtgtatgtaaagactggggaccttttgggacagcggtg

SEQ ID NO: 508 - DNA, 140 bp, Artificial Sequence
  Synthetic
caccgctgtcccaaaaggtccccagtctttacatacacataccacgctcctgcagcgaagggtatggctattgggttcatgccacagatggccatcaggaccaccttgagtatgatctctcatatcagcagccagggcct

SEQ ID NO: 509 - DNA, 140 bp, Artificial Sequence
  Synthetic
aggccctggctgctgatatgaggagagactacagatggagtgtacagagtgatgactcgcagactgctgggttcaacacaggttggagtgggggtcatgcaagagggagtcttccacaccgaccttttgggacagcggtg

SEQ ID NO: 510 - DNA, 140 bp, Artificial Sequence
  Synthetic
caccgctgtcccaaaaggtcggtgtggaagactccctcttgcatgacccccactccaacctgtgttgaacccagcagtctgcgagtcatcactctgtacactccatctgtagtctctcctcatatcagcagccagggcct

SEQ ID NO: 511 - DNA, 140 bp, Artificial Sequence
  Synthetic
atacgccatgctgggtctccatgtggcacgtcacaaaaggagctgcattgaggagcggtgaaggaagacttgatccatattggggggacgtcaagcaggacttggtgtcatattgtgggccgtacttgggagtcggccat

SEQ ID NO: 512 - DNA, 140 bp, Artificial Sequence
  Synthetic
atggccgactcccaagtacggcccacaatatgacaccaagtcctgcttgacgtccccccaatatggatcaagtcttccttcaccgctcctcaatgcagctccttttgtgacgtgccacatggagacccagcatggcgtat

SEQ ID NO: 513 - DNA, 140 bp, Artificial Sequence
  Synthetic
atacgccatgctgggtctcccgtggaagttggacgcaacctgggatggactaagtgaagtgcagcttttggccgtaccccccggagagagggctagaaacattcagactctgcctggaatcgtacttgggagtcggccat

SEQ ID NO: 514 - DNA, 140 bp, Artificial Sequence
  Synthetic
atggccgactcccaagtacgattccaggcagagtctgaatgtttctagccctctctccggggggtacggccaaaagctgcacttcacttagtccatcccaggttgcgtccaacttccacgggagacccagcatggcgtat

SEQ ID NO: 515 - DNA, 140 bp, Artificial Sequence
  Synthetic
atacgccatgctgggtctccattcaagacaaaggatggggacatcggagcggttgctctagactaccccgcaggaacctcaggatctccaatcctagacaaatgcggaagagtgataggacgtacttgggagtcggccat

SEQ ID NO: 516 - DNA, 140 bp, Artificial Sequence
  Synthetic
atggccgactcccaagtacgtcctatcactcttccgcatttgtctaggattggagatcctgaggttcctgcggggtagtctagagcaaccgctccgatgtccccatcctttgtcttgaatggagacccagcatggcgtat

SEQ ID NO: 517 - DNA, 140 bp, Artificial Sequence
  Synthetic
atacgccatgctgggtctccctttatggcaatggggttgtgatcaagaatggaagctatgtcagtgcaataacccagggaaaaagggaggaggaggccccagttgagtgctttgaaccctcgtacttgggagtcggccat

SEQ ID NO: 518 - DNA, 140 bp, Artificial Sequence
  Synthetic
atggccgactcccaagtacgagggttcaaagcactcaactggggcctcctcctccctttttccctgggttattgcactgacatagcttccattcttgatcacaaccccattgccataaagggagacccagcatggcgtat

SEQ ID NO: 519 - DNA, 140 bp, Artificial Sequence
  Synthetic
atacgccatgctgggtctcccgatgctgaggaagaagcagctaacagtcttggatctgcatccaggagccggaaaaaccaggagggttcttcctgaaatagtccgtgaagccataaaaaacgtacttgggagtcggccat

SEQ ID NO: 520 - DNA, 140 bp, Artificial Sequence
  Synthetic
atggccgactcccaagtacgttttttatggcttcacggactatttcaggaagaaccctcctggtttttccggctcctggatgcagatccaagactgttagctgcttcttcctcagcatcgggagacccagcatggcgtat

SEQ ID NO: 521 - DNA, 140 bp, Artificial Sequence
  Synthetic
atacgccatgctgggtctcctttgattgggtgacagaccattctgggaaaacaatttggtttgttccaagtgtgagaaacggaaatgaaatcgcagcctgtctgacaaaggctggaaagccgtacttgggagtcggccat

SEQ ID NO: 522 - DNA, 140 bp, Artificial Sequence
  Synthetic
atggccgactcccaagtacggctttccagcctttgtcagacaggctgcgatttcatttccgtttctcacacttggaacaaaccaaattgttttcccagaatggtctgtcacccaatcaaaggagacccagcatggcgtat

SEQ ID NO: 523 - DNA, 140 bp, Artificial Sequence
  Synthetic
atacgccatgctgggtctcctgccaatttcaaggctgaccgggtcatcgattccaggagatgcctaaagccagtcatacttgatggtgagagagtcatcctggctgggcccatgcctgtccgtacttgggagtcggccat

SEQ ID NO: 524 - DNA, 140 bp, Artificial Sequence
  Synthetic
atggccgactcccaagtacggacaggcatgggcccagccaggatgactctctcaccatcaagtatgactggctttaggcatctcctggaatcgatgacccggtcagccttgaaattggcaggagacccagcatggcgtat

SEQ ID NO: 525 - DNA, 140 bp, Artificial Sequence
  Synthetic
atacgccatgctgggtctccacgcatgccagtgctgctcagaggagaggacgtataggcaggaaccccaacaaacccggagatgagtacatgtatggaggtgggtgtgcagagactgatgcgtacttgggagtcggccat

SEQ ID NO: 526 - DNA, 140 bp, Artificial Sequence
  Synthetic
atggccgactcccaagtacgcatcagtctctgcacacccacctccatacatgtactcatctccgggtttgttggggttcctgcctatacgtcctctcctctgagcagcactggcatgcgtggagacccagcatggcgtat

SEQ ID NO: 527 - DNA, 140 bp, Artificial Sequence
  Synthetic
atacgccatgctgggtctccaagaccatgcacactggcttgaagcaagaatgcttcttgacaacatttacctccaagatggcctcatagcctcgctctatcggcctgaggccgacaaggtcgtacttgggagtcggccat

SEQ ID NO: 528 - DNA, 140 bp, Artificial Sequence
  Synthetic
atggccgactcccaagtacgaccttgtcggcctcaggccgatagagcgaggctatgaggccatcttggaggtaaatgttgtcaagaagcattcttgcttcaagccagtgtgcatggtcttggagacccagcatggcgtat

SEQ ID NO: 529 - DNA, 140 bp, Artificial Sequence
  Synthetic
atacgccatgctgggtctccgtctgttcagatcatgcggctctgaagtcgttcaaagaatttgccgctgggaagagaggagcggctttgggagtaatggatgccctgggaacattgccagcgtacttgggagtcggccat

SEQ ID NO: 530 - DNA, 140 bp, Artificial Sequence
  Synthetic
atggccgactcccaagtacgctggcaatgttcccagggcatccattactcccaaagccgctcctctcttcccagcggcaaattctttgaacgacttcagagccgcatgatctgaacagacggagacccagcatggcgtat

SEQ ID NO: 531 - DNA, 140 bp, Artificial Sequence
  Synthetic
atacgccatgctgggtctccgacacatgacagagaggtttcaggaagccattgacaatcttgctgtgctcatgcgagcagagactggaagtaggccctacaaagcagcggcagctcaactcgtacttgggagtcggccat

SEQ ID NO: 532 - DNA, 140 bp, Artificial Sequence
  Synthetic
atggccgactcccaagtacgagttgagctgccgctgctttgtagggcctacttccagtctctgctcgcatgagcacagcaagattgtcaatggcttcctgaaacctctctgtcatgtgtcggagacccagcatggcgtat

SEQ ID NO: 533 - DNA, 140 bp, Artificial Sequence
  Synthetic
aggccctggctgctgatatgcgctaggaatcttctttgtcttgatgcggaacaagggcatcgggaagatgggcttcggaatggtaacccttggggccagcgcatggctcatgtggctctcgaccttttgggacagcggtg

SEQ ID NO: 534 - DNA, 140 bp, Artificial Sequence
  Synthetic
caccgctgtcccaaaaggtcgagagccacatgagccatgcgctggccccaagggttaccattccgaagcccatcttcccgatgcccttgttccgcatcaagacaaagaagattcctagcgcatatcagcagccagggcct

SEQ ID NO: 535 - DNA, 140 bp, Artificial Sequence
  Synthetic
atacgccatgctgggtctccaatcaaatggcaatcatcatcatggtggcagttggccttttgggtttgataactgcaaatgaactcggatggctggaaaggacaaaaagtgatatagcttcgtacttgggagtcggccat

SEQ ID NO: 536 - DNA, 140 bp, Artificial Sequence
  Synthetic
atggccgactcccaagtacgaagctatatcactttttgtcctttccagccatccgagttcatttgcagttatcaaacccaaaaggccaactgccaccatgatgatgattgccatttgattggagacccagcatggcgtat

SEQ ID NO: 537 - DNA, 140 bp, Artificial Sequence
  Synthetic
atacgccatgctgggtctccatctgatgggaaggaaagaagaggggacaaccataggattctcaatggatattgatctgcggccagcctctgcctgggctatttatgccgcattgacaaccgtacttgggagtcggccat

SEQ ID NO: 538 - DNA, 140 bp, Artificial Sequence
  Synthetic
atggccgactcccaagtacggttgtcaatgcggcataaatagcccaggcagaggctggccgcagatcaatatccattgagaatcctatggttgtcccctcttctttccttcccatcagatggagacccagcatggcgtat

SEQ ID NO: 539 - DNA, 140 bp, Artificial Sequence
  Synthetic
atacgccatgctgggtctccaggttgctactcacagttaacacccctgaccctgatagtagccatcattctgcttgtagcacactacatgtacttgatcccaggtttgcaggcagcagcacgtacttgggagtcggccat

SEQ ID NO: 540 - DNA, 140 bp, Artificial Sequence
  Synthetic
atggccgactcccaagtacgtgctgctgcctgcaaacctgggatcaagtacatgtagtgtgctacaagcagaatgatggctactatcagggtcaggggtgttaactgtgagtagcaacctggagacccagcatggcgtat

SEQ ID NO: 541 - DNA, 140 bp, Artificial Sequence
  Synthetic
aggccctggctgctgatatgtgcttgtagcacactacatgtacttgatcccaggtttgcaggcagcagcagcacgtgctgcccagaagaggacagcagctggcatcatgaaaaatcccgtgaccttttgggacagcggtg

SEQ ID NO: 542 - DNA, 140 bp, Artificial Sequence
  Synthetic
caccgctgtcccaaaaggtcacgggatttttcatgatgccagctgctgtcctcttctgggcagcacgtgctgctgctgcctgcaaacctgggatcaagtacatgtagtgtgctacaagcacatatcagcagccagggcct

SEQ ID NO: 543 - DNA, 140 bp, Artificial Sequence
  Synthetic
atacgccatgctgggtctccagtgctgtgctgctgcggaccgctgggggatggggggaggctggggctctgatcacagcagctacctccaccttatgggaaggctctccaaacaaatactcgtacttgggagtcggccat

SEQ ID NO: 544 - DNA, 140 bp, Artificial Sequence
  Synthetic
atggccgactcccaagtacgagtatttgtttggagagccttcccataaggtggaggtagctgctgtgatcagagccccagcctccccccatcccccagcggtccgcagcagcacagcactggagacccagcatggcgtat

SEQ ID NO: 545 - DNA, 140 bp, Artificial Sequence
  Synthetic
aggccctggctgctgatatggatcacagcagctacctccaccttatgggaaggctctccaaacaaatactggaactcctctacagccacctcactatgcaacatctttagaggaagttatgaccttttgggacagcggtg

SEQ ID NO: 546 - DNA, 140 bp, Artificial Sequence
  Synthetic
caccgctgtcccaaaaggtcataacttcctctaaagatgttgcatagtgaggtggctgtagaggagttccagtatttgtttggagagccttcccataaggtggaggtagctgctgtgatccatatcagcagccagggcct

SEQ ID NO: 547 - DNA, 140 bp, Artificial Sequence
  Synthetic
atacgccatgctgggtctcccccgcctgaaccagatgtcggccctggagttttactcttacaaaaagtcaggcatcaccgaagtgtgtagggaggaggcgcgccgcgctctcaaggatggcgtacttgggagtcggccat

SEQ ID NO: 548 - DNA, 140 bp, Artificial Sequence
  Synthetic
atggccgactcccaagtacgccatccttgagagcgcggcgcgcctcctccctacacacttcggtgatgcctgactttttgtaagagtaaaactccagggccgacatctggttcaggcgggggagacccagcatggcgtat

SEQ ID NO: 549 - DNA, 140 bp, Artificial Sequence
  Synthetic
atacgccatgctgggtctccagtggccacaggagggcatgctgtatcccggggaagcgcaaagcttagatggttggtagagagaggatacctgcagccccatggaaaggttgttgaccttcgtacttgggagtcggccat

SEQ ID NO: 550 - DNA, 140 bp, Artificial Sequence
  Synthetic
atggccgactcccaagtacgaaggtcaacaacctttccatggggctgcaggtatcctctctctaccaaccatctaagctttgcgcttccccgggatacagcatgccctcctgtggccactggagacccagcatggcgtat

SEQ ID NO: 551 - DNA, 140 bp, Artificial Sequence
  Synthetic
aggccctggctgctgatatgggttggtagagagaggatacctgcagccccatggaaaggttgttgaccttggatgtggcagaggaggctggagttattacgctgccactatccgtaaagtgaccttttgggacagcggtg

SEQ ID NO: 552 - DNA, 140 bp, Artificial Sequence
  Synthetic
caccgctgtcccaaaaggtcactttacggatagtggcagcgtaataactccagcctcctctgccacatccaaggtcaacaacctttccatggggctgcaggtatcctctctctaccaacccatatcagcagccagggcct

SEQ ID NO: 553 - DNA, 140 bp, Artificial Sequence
  Synthetic
atacgccatgctgggtctccaggcgagtcatcatctagtcctgaagtggaagagacgcgaacactcagagtgctctccatggtagaagactggcttgagaaaagaccaggggccttctgccgtacttgggagtcggccat

SEQ ID NO: 554 - DNA, 140 bp, Artificial Sequence
  Synthetic
atggccgactcccaagtacggcagaaggcccctggtcttttctcaagccagtcttctaccatggagagcactctgagtgttcgcgtctcttccacttcaggactagatgatgactcgcctggagacccagcatggcgtat

SEQ ID NO: 555 - DNA, 140 bp, Artificial Sequence
  Synthetic
atacgccatgctgggtctcccgcaggggtcagcgtcatccctcgtgaatggggttgttagactcttgtcaaagccctgggatgtggtgactggagttacaggaatagctatgactgacaccgtacttgggagtcggccat

SEQ ID NO: 556 - DNA, 140 bp, Artificial Sequence
  Synthetic
atggccgactcccaagtacggtgtcagtcatagctattcctgtaactccagtcaccacatcccagggctttgacaagagtctaacaaccccattcacgagggatgacgctgacccctgcgggagacccagcatggcgtat

SEQ ID NO: 557 - DNA, 140 bp, Artificial Sequence
  Synthetic
atacgccatgctgggtctcccacgccatacggccaacaaagagtcttcaaggaaaaagtggacacaagggtgccagatccccaagaaggcactcgccaagtaatgaacatagtttcgtctcgtacttgggagtcggccat

SEQ ID NO: 558 - DNA, 140 bp, Artificial Sequence
  Synthetic
atggccgactcccaagtacgagacgaaactatgttcattacttggcgagtgccttcttggggatctggcacccttgtgtccactttttccttgaagactctttgttggccgtatggcgtgggagacccagcatggcgtat

SEQ ID NO: 559 - DNA, 140 bp, Artificial Sequence
  Synthetic
atacgccatgctgggtctcctggctatggaaggagctaggaaaacgcaagcgaccacgtgtctgcaccaaagaagagttcatcaataaggtgcgcagcaatgcagcactgggagcaatatcgtacttgggagtcggccat

SEQ ID NO: 560 - DNA, 140 bp, Artificial Sequence
  Synthetic
atggccgactcccaagtacgatattgctcccagtgctgcattgctgcgcaccttattgatgaactcttctttggtgcagacacgtggtcgcttgcgttttcctagctccttccatagccaggagacccagcatggcgtat

SEQ ID NO: 561 - DNA, 140 bp, Artificial Sequence
  Synthetic
aggccctggctgctgatatggagaattcgggaaagcaaaaggcagccgcgcaatctggtacatgtggttgggagccagatttttggagtttgaagctcttggattcttgaacgaggatcagaccttttgggacagcggtg

SEQ ID NO: 562 - DNA, 140 bp, Artificial Sequence
  Synthetic
caccgctgtcccaaaaggtctgatcctcgttcaagaatccaagagcttcaaactccaaaaatctggctcccaaccacatgtaccagattgcgcggctgccttttgctttcccgaattctccatatcagcagccagggcct

SEQ ID NO: 563 - DNA, 140 bp, Artificial Sequence
  Synthetic
aggccctggctgctgatatgctggatgggaagagaaaactcaggaggtggtgttgaagggctaggactgcaaaggcttggatatatcctagaagaaatgaaccgggcaccaggaggaaaggaccttttgggacagcggtg

SEQ ID NO: 564 - DNA, 140 bp, Artificial Sequence
  Synthetic
caccgctgtcccaaaaggtcctttcctcctggtgcccggttcatttcttctaggatatatccaagcctttgcagtcctagcccttcaacaccacctcctgagttttctcttcccatccagcatatcagcagccagggcct

SEQ ID NO: 565 - DNA, 140 bp, Artificial Sequence
  Synthetic
aggccctggctgctgatatgaaaggcttggatatatcctagaagaaatgaaccgggcaccaggaggaaagatgtatgcagatgacaccgctggctgggacacccgtattagtaagtttgagaccttttgggacagcggtg

SEQ ID NO: 566 - DNA, 140 bp, Artificial Sequence
  Synthetic
caccgctgtcccaaaaggtctcaaacttactaatacgggtgtcccagccagcggtgtcatctgcatacatctttcctcctggtgcccggttcatttcttctaggatatatccaagcctttcatatcagcagccagggcct

SEQ ID NO: 567 - DNA, 140 bp, Artificial Sequence
  Synthetic
atacgccatgctgggtctccacaagaccagagagggagtggacaagttgttacttatgccctcaacacattcaccaacctggtggtgcagcttatccggaacatggaggctgaggaagtgcgtacttgggagtcggccat

SEQ ID NO: 568 - DNA, 140 bp, Artificial Sequence
  Synthetic
atggccgactcccaagtacgcacttcctcagcctccatgttccggataagctgcaccaccaggttggtgaatgtgttgagggcataagtaacaacttgtccactccctctctggtcttgtggagacccagcatggcgtat

SEQ ID NO: 569 - DNA, 140 bp, Artificial Sequence
  Synthetic
atacgccatgctgggtctccctagagatgcatgatctgtggttgttgaggaaaccagagaaagtgaccagatggttgcagagtaatggatgggacagactcaaacggatggcagttagtgcgtacttgggagtcggccat

SEQ ID NO: 570 - DNA, 140 bp, Artificial Sequence
  Synthetic
atggccgactcccaagtacgcactaactgccatccgtttgagtctgtcccatccattactctgcaaccatctggtcactttctctggtttcctcaacaaccacagatcatgcatctctagggagacccagcatggcgtat

SEQ ID NO: 571 - DNA, 140 bp, Artificial Sequence
  Synthetic
atacgccatgctgggtctccatggagcatccgtgagactgcttgccttgcaaaatcatatgcacagatgtggcagcttctttatttccacagaagagatctccgactgatggccaatgcccgtacttgggagtcggccat

SEQ ID NO: 572 - DNA, 140 bp, Artificial Sequence
  Synthetic
atggccgactcccaagtacgggcattggccatcagtcggagatctcttctgtggaaataaagaagctgccacatctgtgcatatgattttgcaaggcaagcagtctcacggatgctccatggagacccagcatggcgtat

SEQ ID NO: 573 - DNA, 140 bp, Artificial Sequence
  Synthetic
aggccctggctgctgatatgggcagcttctttatttccacagaagagatctccgactgatggccaatgccatttgttcggctgtgccagttgattgggtaccaactgggagaaccacctggaccttttgggacagcggtg

SEQ ID NO: 574 - DNA, 140 bp, Artificial Sequence
  Synthetic
caccgctgtcccaaaaggtccaggtggttctcccagttggtacccaatcaactggcacagccgaacaaatggcattggccatcagtcggagatctcttctgtggaaataaagaagctgcccatatcagcagccagggcct

SEQ ID NO: 575 - DNA, 140 bp, Artificial Sequence
  Synthetic
aggccctggctgctgatatgcctgttccaaaatggacagaaattccctacttggggaaaagggagtccctatggtgtggatacattatagggcacagacctcgcaccacttgggctgagagaccttttgggacagcggtg

SEQ ID NO: 576 - DNA, 140 bp, Artificial Sequence
  Synthetic
caccgctgtcccaaaaggtctctcagcccaagtggtgcgaggtctgtgccctataatgtatccacaccatagggactcccttttccccaagtagggaatttctgtccattttggaacaggcatatcagcagccagggcct

SEQ ID NO: 577 - DNA, 140 bp, Artificial Sequence
  Synthetic
atacgccatgctgggtctccacatcaaagacacagtcaacatggtgcttaggctcataggtgatgaagaaaagtacatggactacctatccacccaagtacgctacttgggtgaggaaggcgtacttgggagtcggccat

SEQ ID NO: 578 - DNA, 140 bp, Artificial Sequence
  Synthetic
atggccgactcccaagtacgccttcctcacccaagtagcgtacttgggtggataggtagtccatgtacttttcttcatcacctatgagcctaagcaccatgttgactgtgtctttgatgtggagacccagcatggcgtat

SEQ ID NO: 579 - DNA, 140 bp, Artificial Sequence
  Synthetic
aggccctggctgctgatatgggtgcttaggctcataggtgatgaagaaaagtacatggactacctatccacccaagtacgctacttgggtgaggaagggtccacacctggagtgctgtaagaccttttgggacagcggtg

SEQ ID NO: 580 - DNA, 140 bp, Artificial Sequence
  Synthetic
caccgctgtcccaaaaggtcttacagcactccaggtgtggacccttcctcacccaagtagcgtacttgggtggataggtagtccatgtacttttcttcatcacctatgagcctaagcacccatatcagcagccagggcct

SEQ ID NO: 581 - DNA, 140 bp, Artificial Sequence
  Synthetic
atacgccatgctgggtctccgtttacgtgttctaagaagatgaccgggaagagcattcagccggagaacttggagtaccggataatgctatcagtgcatggatcccagcacagtgggatgcgtacttgggagtcggccat

SEQ ID NO: 582 - DNA, 140 bp, Artificial Sequence
  Synthetic
atggccgactcccaagtacgcatcccactgtgctgggatccatgcactgatagcattatccggtactccaagttctccggctgaatgctcttcccggtcatcttcttagaacacgtaaacggagacccagcatggcgtat

SEQ ID NO: 583 - DNA, 140 bp, Artificial Sequence
  Synthetic
aggccctggctgctgatatgggacatgaaactgacgaaaacagagcaaaggtcgaggtcacacccaattcaccaagagcagaagcaaccttgggaggttttggaagcttgggacttgactgaccttttgggacagcggtg

SEQ ID NO: 584 - DNA, 140 bp, Artificial Sequence
  Synthetic
caccgctgtcccaaaaggtcagtcaagtcccaagcttccaaaacctcccaaggttgcttctgctcttggtgaattgggtgtgacctcgacctttgctctgttttcgtcagtttcatgtcccatatcagcagccagggcct

SEQ ID NO: 585 - DNA, 140 bp, Artificial Sequence
  Synthetic
atacgccatgctgggtctccacctgttgatctgtgtgaatcagactgcgacagttcgagtttgaagcgagagctaacaacagtatcaacaggtttaatttggatttggaagcgagagtttcgtacttgggagtcggccat

SEQ ID NO: 586 - DNA, 140 bp, Artificial Sequence
  Synthetic
atggccgactcccaagtacgaaactctcgcttccaaatccaaattaaacctgttgatactgttgttagctctcgcttcaaactcgaactgtcgcagtctgattcacacagatcaacaggtggagacccagcatggcgtat

SEQ ID NO: 587 - DNA, 140 bp, Artificial Sequence
  Synthetic
aggccctggctgctgatatgagctaacaacagtatcaacaggtttaatttggatttggaagcgagagtttctggtcatgaaaaacccaaagaagaaatccggaggattccggattgtcaagaccttttgggacagcggtg

SEQ ID NO: 588 - DNA, 140 bp, Artificial Sequence
  Synthetic
caccgctgtcccaaaaggtcttgacaatccggaatcctccggatttcttctttgggtttttcatgaccagaaactctcgcttccaaatccaaattaaacctgttgatactgttgttagctcatatcagcagccagggcct

SEQ ID NO: 589 - DNA, 140 bp, Artificial Sequence
  Synthetic
atacgccatgctgggtctccctggtcatgaaaaacccaaagaagaaatccggaggattccggattgtcaatatgctaaaacgcggagtagcccgtgtaaaccccttgggaggtttgaagacgtacttgggagtcggccat

SEQ ID NO: 590 - DNA, 140 bp, Artificial Sequence
  Synthetic
atggccgactcccaagtacgtcttcaaacctcccaaggggtttacacgggctactccgcgttttagcatattgacaatccggaatcctccggatttcttctttgggtttttcatgaccagggagacccagcatggcgtat

SEQ ID NO: 591 - DNA, 140 bp, Artificial Sequence
  Synthetic
aggccctggctgctgatatgtatgctaaaacgcggagtagcccgtgtaaaccccttgggaggtttgaagaggctgccagccggacttctgctgggtcatggacccatcagaatggttttggaccttttgggacagcggtg

SEQ ID NO: 592 - DNA, 140 bp, Artificial Sequence
  Synthetic
caccgctgtcccaaaaggtccaaaaccattctgatgggtccatgacccagcagaagtccggctggcagcctcttcaaacctcccaaggggtttacacgggctactccgcgttttagcatacatatcagcagccagggcct

SEQ ID NO: 593 - DNA, 140 bp, Artificial Sequence
  Synthetic
atacgccatgctgggtctccgcaatactagcctttttgagatttacagcaatcaagccatcactgggcctcatcaacagatggggttctgtggggaaaaaagaggctatggaaataataacgtacttgggagtcggccat

SEQ ID NO: 594 - DNA, 140 bp, Artificial Sequence
  Synthetic
atggccgactcccaagtacgttattatttccatagcctcttttttccccacagaaccccatctgttgatgaggcccagtgatggcttgattgctgtaaatctcaaaaaggctagtattgcggagacccagcatggcgtat

SEQ ID NO: 595 - DNA, 140 bp, Artificial Sequence
  Synthetic
atacgccatgctgggtctccagaagtttaagaaagatcttgctgccatgttgagaataatcaatgctaggaaggagaggaagagacgtggtgcagacaccagcatcggaatcattggtctcgtacttgggagtcggccat

SEQ ID NO: 596 - DNA, 140 bp, Artificial Sequence
  Synthetic
atggccgactcccaagtacgagaccaatgattccgatgctggtgtctgcaccacgtctcttcctctccttcctagcattgattattctcaacatggcagcaagatctttcttaaacttctggagacccagcatggcgtat

SEQ ID NO: 597 - DNA, 140 bp, Artificial Sequence
  Synthetic
atacgccatgctgggtctcccctgctgactacagccatggcagcggagattaccagacgtggaagtgcatactacatgtacttggacaggagcgatgctgggaaggccatctcctttgctcgtacttgggagtcggccat

SEQ ID NO: 598 - DNA, 140 bp, Artificial Sequence
  Synthetic
atggccgactcccaagtacgagcaaaggagatggccttcccagcatcgctcctgtccaagtacatgtagtatgcacttccacgtctggtaatctccgctgccatggctgtagtcagcaggggagacccagcatggcgtat

SEQ ID NO: 599 - DNA, 140 bp, Artificial Sequence
  Synthetic
atacgccatgctgggtctccaccaacttgggagttaacaaatgccatgtacagatcatggatctcgggcacatgtgtgacgccaccatgagttatgagtgccctatgttggacgagggagcgtacttgggagtcggccat

SEQ ID NO: 600 - DNA, 140 bp, Artificial Sequence
  Synthetic
atggccgactcccaagtacgctccctcgtccaacatagggcactcataactcatggtggcgtcacacatgtgcccgagatccatgatctgtacatggcatttgttaactcccaagttggtggagacccagcatggcgtat

SEQ ID NO: 601 - DNA, 140 bp, Artificial Sequence
  Synthetic
atacgccatgctgggtctcctggaaccagatgatgtcgattgctggtgcaacacgacatcaacttgggttgtgtacggaacctgtcatcacaaaaaaggtgaagcacggcgatctagaagcgtacttgggagtcggccat

SEQ ID NO: 602 - DNA, 140 bp, Artificial Sequence
  Synthetic
atggccgactcccaagtacgcttctagatcgccgtgcttcaccttttttgtgatgacaggttccgtacacaacccaagttgatgtcgtgttgcaccagcaatcgacatcatctggttccaggagacccagcatggcgtat

SEQ ID NO: 603 - DNA, 140 bp, Artificial Sequence
  Synthetic
aggccctggctgctgatatggtgtacggaacctgtcatcacaaaaaaggtgaagcacggcgatctagaagagctgtgacgctcccttctcactctacaaggaagttgcaaacgcggtcgcgaccttttgggacagcggtg

SEQ ID NO: 604 - DNA, 140 bp, Artificial Sequence
  Synthetic
caccgctgtcccaaaaggtcgcgaccgcgtttgcaacttccttgtagagtgagaagggagcgtcacagctcttctagatcgccgtgcttcaccttttttgtgatgacaggttccgtacaccatatcagcagccagggcct

SEQ ID NO: 605 - DNA, 140 bp, Artificial Sequence
  Synthetic
atacgccatgctgggtctccagacctggttagaatcaagagaatacacgaagcacctgatcaaggttgaaaactggatatttaggaaccccgggtttgcgctcgcagctgttgccattgccgtacttgggagtcggccat

SEQ ID NO: 606 - DNA, 140 bp, Artificial Sequence
  Synthetic
atggccgactcccaagtacggcaatggcaacagctgcgagcgcaaacccggggttcctaaatatccagttttcaaccttgatcaggtgcttcgtgtattctcttgattctaaccaggtctggagacccagcatggcgtat

SEQ ID NO: 607 - DNA, 140 bp, Artificial Sequence
  Synthetic
aggccctggctgctgatatgaactggatatttaggaaccccgggtttgcgctcgcagctgttgccattgcctggcttttgggaagctcgacgagccaaaaagtcatatacttggttatgagaccttttgggacagcggtg

SEQ ID NO: 608 - DNA, 140 bp, Artificial Sequence
  Synthetic
caccgctgtcccaaaaggtctcataaccaagtatatgactttttggctcgtcgagcttcccaaaagccaggcaatggcaacagctgcgagcgcaaacccggggttcctaaatatccagttcatatcagcagccagggcct

SEQ ID NO: 609 - DNA, 140 bp, Artificial Sequence
  Synthetic
atacgccatgctgggtctcctactgctgattgccccggcatacagcatcaggtgcattggagtcagcaatagagacttcgtggaaggcatgtcaggtgggacctgggttgatgtcgtcttcgtacttgggagtcggccat

SEQ ID NO: 610 - DNA, 140 bp, Artificial Sequence
  Synthetic
atggccgactcccaagtacgaagacgacatcaacccaggtcccacctgacatgccttccacgaagtctctattgctgactccaatgcacctgatgctgtatgccggggcaatcagcagtaggagacccagcatggcgtat

SEQ ID NO: 611 - DNA, 140 bp, Artificial Sequence
  Synthetic
atacgccatgctgggtctccggaacatggaggttgcgtcaccgttatggcacaggacaagccaacagttgacatagagttggtcacgacaacggttagtaacatggccgaggtaagatcccgtacttgggagtcggccat

SEQ ID NO: 612 - DNA, 140 bp, Artificial Sequence
  Synthetic
atggccgactcccaagtacgggatcttacctcggccatgttactaaccgttgtcgtgaccaactctatgtcaactgttggcttgtcctgtgccataacggtgacgcaacctccatgttccggagacccagcatggcgtat

SEQ ID NO: 613 - DNA, 140 bp, Artificial Sequence
  Synthetic
atacgccatgctgggtctcctactgttatgaggcatcaatatcagacatggcttcggacagtcgctgcccaacacaaggtgaagcctaccttgataagcaatcagacacccaatatgtgtcgtacttgggagtcggccat

SEQ ID NO: 614 - DNA, 140 bp, Artificial Sequence
  Synthetic
atggccgactcccaagtacgacacatattgggtgtctgattgcttatcaaggtaggcttcaccttgtgttgggcagcgactgtccgaagccatgtctgatattgatgcctcataacagtaggagacccagcatggcgtat

SEQ ID NO: 615 - DNA, 140 bp, Artificial Sequence
  Synthetic
atacgccatgctgggtctccgcaaaagaacattggtggacagaggttggggaaatgggtgtggactttttggcaaagggagcctggtgacatgtgccaagttcacgtgttccaagaagatcgtacttgggagtcggccat

SEQ ID NO: 616 - DNA, 140 bp, Artificial Sequence
  Synthetic
atggccgactcccaagtacgatcttcttggaacacgtgaacttggcacatgtcaccaggctccctttgccaaaaagtccacacccatttccccaacctctgtccaccaatgttcttttgcggagacccagcatggcgtat

SEQ ID NO: 617 - DNA, 140 bp, Artificial Sequence
  Synthetic
atacgccatgctgggtctccgactgggaagagcattcagccggagaatctggagtatcgaataatgctatcagtgcatggctcccagcacagcgggatgattgttaatgacataggacatcgtacttgggagtcggccat

SEQ ID NO: 618 - DNA, 140 bp, Artificial Sequence
  Synthetic
atggccgactcccaagtacgatgtcctatgtcattaacaatcatcccgctgtgctgggagccatgcactgatagcattattcgatactccagattctccggctgaatgctcttcccagtcggagacccagcatggcgtat

SEQ ID NO: 619 - DNA, 140 bp, Artificial Sequence
  Synthetic
aggccctggctgctgatatgcagtgcatggctcccagcacagcgggatgattgttaatgacataggacatgaaactgacgaaaacagagcgaaagtcgaggtcacgcccaattcaccaaggaccttttgggacagcggtg

SEQ ID NO: 620 - DNA, 140 bp, Artificial Sequence
  Synthetic
caccgctgtcccaaaaggtccttggtgaattgggcgtgacctcgactttcgctctgttttcgtcagtttcatgtcctatgtcattaacaatcatcccgctgtgctgggagccatgcactgcatatcagcagccagggcct

SEQ ID NO: 621 - DNA, 140 bp, Artificial Sequence
  Synthetic
aggccctggctgctgatatgagcagaagcaaccttgggaggctttggaagcttaggacttgattgtgaaccaaggacaggcctggacttttcagatttgtactacttgaccatgaacaacgaccttttgggacagcggtg

SEQ ID NO: 622 - DNA, 140 bp, Artificial Sequence
  Synthetic
caccgctgtcccaaaaggtcgttgttcatggtcaagtagtacaaatctgaaaagtccaggcctgtccttggttcacaatcaagtcctaagcttccaaagcctcccaaggttgcttctgctcatatcagcagccagggcct

SEQ ID NO: 623 - DNA, 140 bp, Artificial Sequence
  Synthetic
atacgccatgctgggtctccaagcactggttggtgcacaaagagtggtttcatgacatcccattgccttggcatgctggggcagataccggaactccacactggaacaacaaggaggcatcgtacttgggagtcggccat

SEQ ID NO: 624 - DNA, 140 bp, Artificial Sequence
  Synthetic
atggccgactcccaagtacgatgcctccttgttgttccagtgtggagttccggtatctgccccagcatgccaaggcaatgggatgtcatgaaaccactctttgtgcaccaaccagtgcttggagacccagcatggcgtat

SEQ ID NO: 625 - DNA, 140 bp, Artificial Sequence
  Synthetic
atacgccatgctgggtctcctggtagagttcaaagatgcccacgccaagaggcaaaccgtcgttgttctagggagccaggaaggagccgttcacacggctcttgctggagctctggaggccgtacttgggagtcggccat

SEQ ID NO: 626 - DNA, 140 bp, Artificial Sequence
  Synthetic
atggccgactcccaagtacggcctccagagctccagcaagagccgtgtgaacggctccttcctggctccctagaacaacgacggtttgcctcttggcgtgggcatctttgaactctaccaggagacccagcatggcgtat

SEQ ID NO: 627 - DNA, 140 bp, Artificial Sequence
  Synthetic
atacgccatgctgggtctcctgagatggatggtgcaaaaggaaggctgttctccggccatttgaaatgccgcttaaaaatggacaagcttagattgaagggcgtgtcatattccttgtgccgtacttgggagtcggccat

SEQ ID NO: 628 - DNA, 140 bp, Artificial Sequence
  Synthetic
atggccgactcccaagtacggcacaaggaatatgacacgcccttcaatctaagcttgtccatttttaagcggcatttcaaatggccggagaacagccttccttttgcaccatccatctcaggagacccagcatggcgtat

SEQ ID NO: 629 - DNA, 140 bp, Artificial Sequence
  Synthetic
atacgccatgctgggtctccaccgcagcgttcacatttaccaaggtcccagctgaaacattgcatggaacagttacagtggaggtgcagtatgcagggacagatggaccctgcaaggtcccgtacttgggagtcggccat

SEQ ID NO: 630 - DNA, 140 bp, Artificial Sequence
  Synthetic
atggccgactcccaagtacgggaccttgcagggtccatctgtccctgcatactgcacctccactgtaactgttccatgcaatgtttcagctgggaccttggtaaatgtgaacgctgcggtggagacccagcatggcgtat

SEQ ID NO: 631 - DNA, 140 bp, Artificial Sequence
  Synthetic
atacgccatgctgggtctcccagcccagatggcggtggacatgcagaccctgaccccagtcgggaggctgataaccgccaaccctgtgattactgaaagcactgagaattcaaagatgatcgtacttgggagtcggccat

SEQ ID NO: 632 - DNA, 140 bp, Artificial Sequence
  Synthetic
atggccgactcccaagtacgatcatctttgaattctcagtgctttcagtaatcacagggttggcggttatcagcctcccgactggggtcagggtctgcatgtccaccgccatctgggctgggagacccagcatggcgtat

SEQ ID NO: 633 - DNA, 140 bp, Artificial Sequence
  Synthetic
atacgccatgctgggtctccgttggagctcgacccaccatttggggattcttacattgtcataggagttggggacaagaaaatcacccatcactggcataggagtggtagcaccatcggacgtacttgggagtcggccat

SEQ ID NO: 634 - DNA, 140 bp, Artificial Sequence
  Synthetic
atggccgactcccaagtacgtccgatggtgctaccactcctatgccagtgatgggtgattttcttgtccccaactcctatgacaatgtaagaatccccaaatggtgggtcgagctccaacggagacccagcatggcgtat

SEQ ID NO: 635 - DNA, 140 bp, Artificial Sequence
  Synthetic
atacgccatgctgggtctccaaagcatttgaggccactgtgagaggtgccaagagaatggcagttctgggggatacagcctgggacttcggatcagtcgggggcgtgttcaactcattggcgtacttgggagtcggccat

SEQ ID NO: 636 - DNA, 140 bp, Artificial Sequence
  Synthetic
atggccgactcccaagtacgccaatgagttgaacacgcccccgactgatccgaagtcccaggctgtatcccccagaactgccattctcttggcacctctcacagtggcctcaaatgctttggagacccagcatggcgtat

SEQ ID NO: 637 - DNA, 140 bp, Artificial Sequence
  Synthetic
aggccctggctgctgatatgggatacagcctgggacttcggatcagtcgggggcgtgttcaactcattgggcaagggtgttcaccagatttttggagcagctttcaaatcactgtttggagaccttttgggacagcggtg

SEQ ID NO: 638 - DNA, 140 bp, Artificial Sequence
  Synthetic
caccgctgtcccaaaaggtctccaaacagtgatttgaaagctgctccaaaaatctggtgaacacccttgcccaatgagttgaacacgcccccgactgatccgaagtcccaggctgtatcccatatcagcagccagggcct

SEQ ID NO: 639 - DNA, 140 bp, Artificial Sequence
  Synthetic
atacgccatgctgggtctccggaatgtcctggttctcacagatcctcataggcacgctgctggtgtggttgggtttgaacacaaagaatggatccatctccctcacatgcttggccctggcgtacttgggagtcggccat

SEQ ID NO: 640 - DNA, 140 bp, Artificial Sequence
  Synthetic
atggccgactcccaagtacgccagggccaagcatgtgagggagatggatccattctttgtgttcaaacccaaccacaccagcagcgtgcctatgaggatctgtgagaaccaggacattccggagacccagcatggcgtat

SEQ ID NO: 641 - DNA, 140 bp, Artificial Sequence
  Synthetic
atacgccatgctgggtctccggggagtgatgatcttcctctccacggctgtctctgctgacgtggggtgctcggtggacttctcaaaaagagaaacgagatgtggcacgggggtgttcgtcgtacttgggagtcggccat

SEQ ID NO: 642 - DNA, 140 bp, Artificial Sequence
  Synthetic
atggccgactcccaagtacgacgaacacccccgtgccacatctcgtttctctttttgagaagtccaccgagcaccccacgtcagcagagacagccgtggagaggaagatcatcactccccggagacccagcatggcgtat

SEQ ID NO: 643 - DNA, 140 bp, Artificial Sequence
  Synthetic
atacgccatgctgggtctccccccccgcagattggcagcagcagtcaagcaggcttgggaagaggggatttgtgggatctcctccgtttcaagaatggaaaacatcatgtggaaatcagtcgtacttgggagtcggccat

SEQ ID NO: 644 - DNA, 140 bp, Artificial Sequence
  Synthetic
atggccgactcccaagtacgactgatttccacatgatgttttccattcttgaaacggaggagatcccacaaatcccctcttcccaagcctgcttgactgctgctgccaatctgcggggggggagacccagcatggcgtat

SEQ ID NO: 645 - DNA, 140 bp, Artificial Sequence
  Synthetic
aggccctggctgctgatatgtgtgggatctcctccgtttcaagaatggaaaacatcatgtggaaatcagtggaaggggagctcaatgctatcttagaggagaatggagttcaactgacaggaccttttgggacagcggtg

SEQ ID NO: 646 - DNA, 140 bp, Artificial Sequence
  Synthetic
caccgctgtcccaaaaggtcctgtcagttgaactccattctcctctaagatagcattgagctccccttccactgatttccacatgatgttttccattcttgaaacggaggagatcccacacatatcagcagccagggcct

SEQ ID NO: 647 - DNA, 140 bp, Artificial Sequence
  Synthetic
atacgccatgctgggtctccttgttgtaggatctgtaaaaaaccccatgtggagaggcccacaaagattgccagtgcctgtgaatgagctgccccatggctggaaagcctgggggaaatccgtacttgggagtcggccat

SEQ ID NO: 648 - DNA, 140 bp, Artificial Sequence
  Synthetic
atggccgactcccaagtacggatttcccccaggctttccagccatggggcagctcattcacaggcactggcaatctttgtgggcctctccacatggggttttttacagatcctacaacaaggagacccagcatggcgtat

SEQ ID NO: 649 - DNA, 140 bp, Artificial Sequence
  Synthetic
atacgccatgctgggtctccatattttgtcagagcggcaaagaccaacaacagttttgttgtcgatggtgacacactgaaggaatgtccgctcaaacacagagcatggaatagtttccttcgtacttgggagtcggccat

SEQ ID NO: 650 - DNA, 140 bp, Artificial Sequence
  Synthetic
atggccgactcccaagtacgaaggaaactattccatgctctgtgtttgagcggacattccttcagtgtgtcaccatcgacaacaaaactgttgttggtctttgccgctctgacaaaatatggagacccagcatggcgtat

SEQ ID NO: 651 - DNA, 140 bp, Artificial Sequence
  Synthetic
atacgccatgctgggtctccgtggaggatcatgggtttggggtcttccacaccagtgtttggctcaaggttagagaagactactcactagaatgtgacccagccgtcataggaacagctgcgtacttgggagtcggccat

SEQ ID NO: 652 - DNA, 140 bp, Artificial Sequence
  Synthetic
atggccgactcccaagtacgcagctgttcctatgacggctgggtcacattctagtgagtagtcttctctaaccttgagccaaacactggtgtggaagaccccaaacccatgatcctccacggagacccagcatggcgtat

SEQ ID NO: 653 - DNA, 140 bp, Artificial Sequence
  Synthetic
atacgccatgctgggtctccttaagggaaaggaggccgcccacagtgacctgggctactggattgaaagtgaaaagaatgacacatggaggctgaagagggcccatctgattgagatgaacgtacttgggagtcggccat

SEQ ID NO: 654 - DNA, 140 bp, Artificial Sequence
  Synthetic
atggccgactcccaagtacgttcatctcaatcagatgggccctcttcagcctccatgtgtcattcttttcactttcaatccagtagcccaggtcactgtgggcggcctcctttcccttaaggagacccagcatggcgtat

SEQ ID NO: 655 - DNA, 140 bp, Artificial Sequence
  Synthetic
atacgccatgctgggtctccaacatgtgagtggccaaagtctcacactctgtggacagatggagtagaagaaagtgatctgatcatacctaaatctttagctggtccactcagccaccaccgtacttgggagtcggccat

SEQ ID NO: 656 - DNA, 140 bp, Artificial Sequence
  Synthetic
atggccgactcccaagtacggtggtggctgagtggaccagctaaagatttaggtatgatcagatcactttcttctactccatctgtccacagagtgtgagactttggccactcacatgttggagacccagcatggcgtat

SEQ ID NO: 657 - DNA, 140 bp, Artificial Sequence
  Synthetic
atacgccatgctgggtctccagagcttgaaatccggtttgaggaatgtccaggcaccaaggttcacgtggaggagacatgcggaactagaggaccatctctgagatcaaccactgcaagtcgtacttgggagtcggccat

SEQ ID NO: 658 - DNA, 140 bp, Artificial Sequence
  Synthetic
atggccgactcccaagtacgacttgcagtggttgatctcagagatggtcctctagttccgcatgtctcctccacgtgaaccttggtgcctggacattcctcaaaccggatttcaagctctggagacccagcatggcgtat

SEQ ID NO: 659 - DNA, 140 bp, Artificial Sequence
  Synthetic
aggccctggctgctgatatgaggagacatgcggaactagaggaccatctctgagatcaaccactgcaagtggaagggtcattgaggaatggtgctgtagagaatgcacaatgcccccactgaccttttgggacagcggtg

SEQ ID NO: 660 - DNA, 140 bp, Artificial Sequence
  Synthetic
caccgctgtcccaaaaggtcagtgggggcattgtgcattctctacagcaccattcctcaatgacccttccacttgcagtggttgatctcagagatggtcctctagttccgcatgtctcctcatatcagcagccagggcct

SEQ ID NO: 661 - DNA, 140 bp, Artificial Sequence
  Synthetic
atacgccatgctgggtctccggaagggtcattgaggaatggtgctgtagagaatgcacaatgcccccactatcgtttcgagcaaaagacggctgctggtatggaatggagataaggcccacgtacttgggagtcggccat

SEQ ID NO: 662 - DNA, 140 bp, Artificial Sequence
  Synthetic
atggccgactcccaagtacgtgggccttatctccattccataccagcagccgtcttttgctcgaaacgatagtgggggcattgtgcattctctacagcaccattcctcaatgacccttccggagacccagcatggcgtat

SEQ ID NO: 663 - DNA, 140 bp, Artificial Sequence
  Synthetic
atacgccatgctgggtctccggaaagaaccagagagcaacttagtgaggtcaatggtgacagcgggatcaaccgatcacatggaccacttctctcttggagtgcttgtgattctactcatcgtacttgggagtcggccat

SEQ ID NO: 664 - DNA, 140 bp, Artificial Sequence
  Synthetic
atggccgactcccaagtacgatgagtagaatcacaagcactccaagagagaagtggtccatgtgatcggttgatcccgctgtcaccattgacctcactaagttgctctctggttctttccggagacccagcatggcgtat

SEQ ID NO: 665 - DNA, 140 bp, Artificial Sequence
  Synthetic
aggccctggctgctgatatgcatcaatggcagtgctggtggccatgatcctgggaggatttttaatgagtgacttggctaagcttgtgatcctgatgggtgccaccttcgcagaaatgaagaccttttgggacagcggtg

SEQ ID NO: 666 - DNA, 140 bp, Artificial Sequence
  Synthetic
caccgctgtcccaaaaggtcttcatttctgcgaaggtggcacccatcaggatcacaagcttagccaagtcactcattaaaaatcctcccaggatcatggccaccagcactgccattgatgcatatcagcagccagggcct

SEQ ID NO: 667 - DNA, 140 bp, Artificial Sequence
  Synthetic
atacgccatgctgggtctcccactggaggagatgtggctcacttggcattggttgcggcatttaaagtcagaccagccttgctggtctcctttattttcagagctaattggacacctcgtcgtacttgggagtcggccat

SEQ ID NO: 668 - DNA, 140 bp, Artificial Sequence
  Synthetic
atggccgactcccaagtacgacgaggtgtccaattagctctgaaaataaaggagaccagcaaggctggtctgactttaaatgccgcaaccaatgccaagtgagccacatctcctccagtgggagacccagcatggcgtat

SEQ ID NO: 669 - DNA, 140 bp, Artificial Sequence
  Synthetic
atacgccatgctgggtctccgagagcatgctgctagccctggcttcgtgtcttttgcaaactgcaatctctgctctcgaaggtgacttgatggtcctcgtcaatggatttgctttggcctcgtacttgggagtcggccat

SEQ ID NO: 670 - DNA, 140 bp, Artificial Sequence
  Synthetic
atggccgactcccaagtacgaggccaaagcaaatccattgacgaggaccatcaagtcaccttcgagagcagagattgcagtttgcaaaagacacgaagccagggctagcagcatgctctcggagacccagcatggcgtat

SEQ ID NO: 671 - DNA, 140 bp, Artificial Sequence
  Synthetic
atacgccatgctgggtctccggttggcaatacgagcaatggccgtgccacgcactgacaacattgctctggcaatcctggctgctctgacaccactagcccgaggtacactgctcgtggccgtacttgggagtcggccat

SEQ ID NO: 672 - DNA, 140 bp, Artificial Sequence
  Synthetic
atggccgactcccaagtacggccacgagcagtgtacctcgggctagtggtgtcagagcagccaggattgccagagcaatgttgtcagtgcgtggcacggccattgctcgtattgccaaccggagacccagcatggcgtat

SEQ ID NO: 673 - DNA, 140 bp, Artificial Sequence
  Synthetic
atacgccatgctgggtctccatggagagcgggcctcgctacttgtggagggtttatgctcctctccctgaaagggaaaggtagtgtgaagaagaacctgccatttgtcatggccttgggacgtacttgggagtcggccat

SEQ ID NO: 674 - DNA, 140 bp, Artificial Sequence
  Synthetic
atggccgactcccaagtacgtcccaaggccatgacaaatggcaggttcttcttcacactacctttccctttcagggagaggagcataaaccctccacaagtagcgaggcccgctctccatggagacccagcatggcgtat

SEQ ID NO: 675 - DNA, 140 bp, Artificial Sequence
  Synthetic
atacgccatgctgggtctccttgactgctgtgaggatagtagaccccattaatgtggtgggactactgttactcacaaggagtgggaagcggagctggccccctagtgaagtgcttacagcgtacttgggagtcggccat

SEQ ID NO: 676 - DNA, 140 bp, Artificial Sequence
  Synthetic
atggccgactcccaagtacgctgtaagcacttcactagggggccagctccgcttcccactccttgtgagtaacagtagtcccaccacattaatggggtctactatcctcacagcagtcaaggagacccagcatggcgtat

SEQ ID NO: 677 - DNA, 140 bp, Artificial Sequence
  Synthetic
atacgccatgctgggtctccctgttggcctgatatgtgcactggccggaggctttgccaaggcagacattgagatggctgggcccatggctgcagtaggcttgctgattgtcagttatgtcgtacttgggagtcggccat

SEQ ID NO: 678 - DNA, 140 bp, Artificial Sequence
  Synthetic
atggccgactcccaagtacgacataactgacaatcagcaagcctactgcagccatgggcccagccatctcaatgtctgccttggcaaagcctccggccagtgcacatatcaggccaacagggagacccagcatggcgtat

SEQ ID NO: 679 - DNA, 140 bp, Artificial Sequence
  Synthetic
atacgccatgctgggtctccggtctcaggaaagagtgtggatatgtacattgaaagagcaggtgacatcacatgggaaaaggacgcggaagttactggaaatagtcctcggcttgacgtgcgtacttgggagtcggccat

SEQ ID NO: 680 - DNA, 140 bp, Artificial Sequence
  Synthetic
atggccgactcccaagtacgcacgtcaagccgaggactatttccagtaacttccgcgtccttttcccatgtgatgtcacctgctctttcaatgtacatatccacactctttcctgagaccggagacccagcatggcgtat

SEQ ID NO: 681 - DNA, 140 bp, Artificial Sequence
  Synthetic
atacgccatgctgggtctccgcactagatgagagtggtgatttctctctggtggaggaagatggtccacccatgagagagatcatactcaaggtggtcctgatggccatctgtggcatgacgtacttgggagtcggccat

SEQ ID NO: 682 - DNA, 140 bp, Artificial Sequence
  Synthetic
atggccgactcccaagtacgtcatgccacagatggccatcaggaccaccttgagtatgatctctctcatgggtggaccatcttcctccaccagagagaaatcaccactctcatctagtgcggagacccagcatggcgtat

SEQ ID NO: 683 - DNA, 140 bp, Artificial Sequence
  Synthetic
aggccctggctgctgatatgcatgagagagatcatactcaaggtggtcctgatggccatctgtggcatgaacccaatagccataccctttgctgcaggagcgtggtatgtgtatgtgaaggaccttttgggacagcggtg

SEQ ID NO: 684 - DNA, 140 bp, Artificial Sequence
  Synthetic
caccgctgtcccaaaaggtccttcacatacacataccacgctcctgcagcaaagggtatggctattgggttcatgccacagatggccatcaggaccaccttgagtatgatctctctcatgcatatcagcagccagggcct

SEQ ID NO: 685 - DNA, 140 bp, Artificial Sequence
  Synthetic
atacgccatgctgggtctccacccaatagccataccctttgctgcaggagcgtggtatgtgtatgtgaagactggaaaaaggagtggtgccctctgggatgtgcccgctcccaaagaagtcgtacttgggagtcggccat

SEQ ID NO: 686 - DNA, 140 bp, Artificial Sequence
  Synthetic
atggccgactcccaagtacgacttctttgggagcgggcacatcccagagggcaccactcctttttccagtcttcacatacacataccacgctcctgcagcaaagggtatggctattgggtggagacccagcatggcgtat

SEQ ID NO: 687 - DNA, 140 bp, Artificial Sequence
  Synthetic
atacgccatgctgggtctccgaaaaaaggagagaccacagatggggtatacagagtgatgacccgcagactgctgggttcaacacaggttggagtgggagtcatgcaagagggagtcttccgtacttgggagtcggccat

SEQ ID NO: 688 - DNA, 140 bp, Artificial Sequence
  Synthetic
atggccgactcccaagtacggaagactccctcttgcatgactcccactccaacctgtgttgaacccagcagtctgcgggtcatcactctgtataccccatctgtggtctctccttttttcggagacccagcatggcgtat

SEQ ID NO: 689 - DNA, 140 bp, Artificial Sequence
  Synthetic
aggccctggctgctgatatgtgctgggttcaacacaggttggagtgggagtcatgcaagagggagtcttccacaccatgtggcacgtcacaaaaggagctgcactgaggagcggtgaagggaccttttgggacagcggtg

SEQ ID NO: 690 - DNA, 140 bp, Artificial Sequence
  Synthetic
caccgctgtcccaaaaggtcccttcaccgctcctcagtgcagctccttttgtgacgtgccacatggtgtggaagactccctcttgcatgactcccactccaacctgtgttgaacccagcacatatcagcagccagggcct

SEQ ID NO: 691 - DNA, 140 bp, Artificial Sequence
  Synthetic
atacgccatgctgggtctccgagacttgatccatactggggggatgtcaagcaggacttagtgtcatactgtgggccttggaagttggatgcagcttgggatggacttagtgaggtgcagcgtacttgggagtcggccat

SEQ ID NO: 692 - DNA, 140 bp, Artificial Sequence
  Synthetic
atggccgactcccaagtacgctgcacctcactaagtccatcccaagctgcatccaacttccaaggcccacagtatgacactaagtcctgcttgacatccccccagtatggatcaagtctcggagacccagcatggcgtat

SEQ ID NO: 693 - DNA, 140 bp, Artificial Sequence
  Synthetic
atacgccatgctgggtctccctcttggcagtaccccccggagagagggccagaaacattcagactctgcctggaatattcaagacaaaggatggggacatcggagcagtcgctctggactcgtacttgggagtcggccat

SEQ ID NO: 694 - DNA, 140 bp, Artificial Sequence
  Synthetic
atggccgactcccaagtacgagtccagagcgactgctccgatgtccccatcctttgtcttgaatattccaggcagagtctgaatgtttctggccctctctccggggggtactgccaagagggagacccagcatggcgtat

SEQ ID NO: 695 - DNA, 140 bp, Artificial Sequence
  Synthetic
atacgccatgctgggtctccaccccgcaggaacttcaggatccccgatcctagacaaatgcggaagagtgataggactttatggcaatggggttgtgatcaagaatggaagctatgttagcgtacttgggagtcggccat

SEQ ID NO: 696 - DNA, 140 bp, Artificial Sequence
  Synthetic
atggccgactcccaagtacgctaacatagcttccattcttgatcacaaccccattgccataaagtcctatcactcttccgcatttgtctaggatcggggatcctgaagttcctgcggggtggagacccagcatggcgtat

SEQ ID NO: 697 - DNA, 140 bp, Artificial Sequence
  Synthetic
aggccctggctgctgatatgataggactttatggcaatggggttgtgatcaagaatggaagctatgttagtgccataacccagggaaagagggaggaggagactccggttgaatgtttcggaccttttgggacagcggtg

SEQ ID NO: 698 - DNA, 140 bp, Artificial Sequence
  Synthetic
caccgctgtcccaaaaggtccgaaacattcaaccggagtctcctcctccctctttccctgggttatggcactaacatagcttccattcttgatcacaaccccattgccataaagtcctatcatatcagcagccagggcct

SEQ ID NO: 699 - DNA, 140 bp, Artificial Sequence
  Synthetic
aggccctggctgctgatatgaaccctcgatgctgaagaagaagcagctaactgtcctggatctgcatccaggagccggaaagactaggagagttcttcctgaaatagtccgtgaagccatgaccttttgggacagcggtg

SEQ ID NO: 700 - DNA, 140 bp, Artificial Sequence
  Synthetic
caccgctgtcccaaaaggtcatggcttcacggactatttcaggaagaactctcctagtctttccggctcctggatgcagatccaggacagttagctgcttcttcttcagcatcgagggttcatatcagcagccagggcct

SEQ ID NO: 701 - DNA, 140 bp, Artificial Sequence
  Synthetic
atacgccatgctgggtctccaaaaaagagactccgcacagtgattttggctccaaccagggttgtcgctgctgagatggaggaagccttgagaggacttccggtgcgttacatgacaacacgtacttgggagtcggccat

SEQ ID NO: 702 - DNA, 140 bp, Artificial Sequence
  Synthetic
atggccgactcccaagtacgtgttgtcatgtaacgcaccggaagtcctctcaaggcttcctccatctcagcagcgacaaccctggttggagccaaaatcactgtgcggagtctcttttttggagacccagcatggcgtat

SEQ ID NO: 703 - DNA, 140 bp, Artificial Sequence
  Synthetic
aggccctggctgctgatatgctgagatggaggaagccttgagaggacttccggtgcgttacatgacaacagcagttaacgtcacccactctgggacagaaatcgttgatttgatgtgccagaccttttgggacagcggtg

SEQ ID NO: 704 - DNA, 140 bp, Artificial Sequence
  Synthetic
caccgctgtcccaaaaggtctggcacatcaaatcaacgatttctgtcccagagtgggtgacgttaactgctgttgtcatgtaacgcaccggaagtcctctcaaggcttcctccatctcagcatatcagcagccagggcct

SEQ ID NO: 705 - DNA, 140 bp, Artificial Sequence
  Synthetic
atacgccatgctgggtctccgcagttaacgtcacccactctgggacagaaatcgttgatttgatgtgccatgccaccttcacctcacgcctattacaacccatcagagtccctaattacacgtacttgggagtcggccat

SEQ ID NO: 706 - DNA, 140 bp, Artificial Sequence
  Synthetic
atggccgactcccaagtacgtgtaattagggactctgatgggttgtaataggcgtgaggtgaaggtggcatggcacatcaaatcaacgatttctgtcccagagtgggtgacgttaactgcggagacccagcatggcgtat

SEQ ID NO: 707 - DNA, 140 bp, Artificial Sequence
  Synthetic
atacgccatgctgggtctccatctctacatcatggatgaagcccatttcacagacccctcaagtatagctgcaagaggatacatatcaacaagggttgaaatgggcgaggcggctgccatcgtacttgggagtcggccat

SEQ ID NO: 708 - DNA, 140 bp, Artificial Sequence
  Synthetic
atggccgactcccaagtacgatggcagccgcctcgcccatttcaacccttgttgatatgtatcctcttgcagctatacttgaggggtctgtgaaatgggcttcatccatgatgtagagatggagacccagcatggcgtat

SEQ ID NO: 709 - DNA, 140 bp, Artificial Sequence
  Synthetic
aggccctggctgctgatatggcaagaggatacatatcaacaagggttgaaatgggcgaggcggctgccatcttcatgacagccacgccaccaggaacccgagatgcatttccagactccagaccttttgggacagcggtg

SEQ ID NO: 710 - DNA, 140 bp, Artificial Sequence
  Synthetic
caccgctgtcccaaaaggtctggagtctggaaatgcatctcgggttcctggtggcgtggctgtcatgaagatggcagccgcctcgcccatttcaacccttgttgatatgtatcctcttgccatatcagcagccagggcct

SEQ ID NO: 711 - DNA, 140 bp, Artificial Sequence
  Synthetic
atacgccatgctgggtctcctccaagtgtgagaaatggaaatgaaatcgcagcctgtctgacaaaggctggaaagcgggtcatacaactcagcaggaagacttttgagacagagtttcagcgtacttgggagtcggccat

SEQ ID NO: 712 - DNA, 140 bp, Artificial Sequence
  Synthetic
atggccgactcccaagtacgctgaaactctgtctcaaaagtcttcctgctgagttgtatgacccgctttccagcctttgtcagacaggctgcgatttcatttccatttctcacacttggaggagacccagcatggcgtat

SEQ ID NO: 713 - DNA, 140 bp, Artificial Sequence
  Synthetic
aggccctggctgctgatatggaaagcgggtcatacaactcagcaggaagacttttgagacagagtttcagaaaacaaaaaatcaagagtgggactttgtcataacaactgacatctcagagaccttttgggacagcggtg

SEQ ID NO: 714 - DNA, 140 bp, Artificial Sequence
  Synthetic
caccgctgtcccaaaaggtctctgagatgtcagttgttatgacaaagtcccactcttgattttttgttttctgaaactctgtctcaaaagtcttcctgctgagttgtatgacccgctttccatatcagcagccagggcct

SEQ ID NO: 715 - DNA, 140 bp, Artificial Sequence
  Synthetic
atacgccatgctgggtctccgatgggcgcgaatttcaaagctgaccgggtcatagactctaggagatgcctaaagccagtcatacttgatggtgagagagtcatcttggctgggcccatgcgtacttgggagtcggccat

SEQ ID NO: 716 - DNA, 140 bp, Artificial Sequence
  Synthetic
atggccgactcccaagtacgcatgggcccagccaagatgactctctcaccatcaagtatgactggctttaggcatctcctagagtctatgacccggtcagctttgaaattcgcgcccatcggagacccagcatggcgtat

SEQ ID NO: 717 - DNA, 140 bp, Artificial Sequence
  Synthetic
atacgccatgctgggtctcccctgtcacgcatgctagtgctgctcaaaggagagggcgtataggcaggaaccctaacaaacctggagatgagtacatgtatggaggtggatgtgcagagacgtacttgggagtcggccat

SEQ ID NO: 718 - DNA, 140 bp, Artificial Sequence
  Synthetic
atggccgactcccaagtacgtctctgcacatccacctccatacatgtactcatctccaggtttgttagggttcctgcctatacgccctctcctttgagcagcactagcatgcgtgacaggggagacccagcatggcgtat

SEQ ID NO: 719 - DNA, 140 bp, Artificial Sequence
  Synthetic
atacgccatgctgggtctccatctacctccaggatggcctcatagcctcgctctaccggcctgaggccgataaggtagctgccattgagggagagttcaagctgaggacagagcaaaggacgtacttgggagtcggccat

SEQ ID NO: 720 - DNA, 140 bp, Artificial Sequence
  Synthetic
atggccgactcccaagtacgtcctttgctctgtcctcagcttgaactctccctcaatggcagctaccttatcggcctcaggccggtagagcgaggctatgaggccatcctggaggtagatggagacccagcatggcgtat

SEQ ID NO: 721 - DNA, 140 bp, Artificial Sequence
  Synthetic
aggccctggctgctgatatgtaaggtagctgccattgagggagagttcaagctgaggacagagcaaaggaaaacctttgtggaacttatgaagagaggagaccttcccgtttggctagccgaccttttgggacagcggtg

SEQ ID NO: 722 - DNA, 140 bp, Artificial Sequence
  Synthetic
caccgctgtcccaaaaggtcggctagccaaacgggaaggtctcctctcttcataagttccacaaaggttttcctttgctctgtcctcagcttgaactctccctcaatggcagctaccttacatatcagcagccagggcct

SEQ ID NO: 723 - DNA, 140 bp, Artificial Sequence
  Synthetic
aggccctggctgctgatatgtatcaggttgcatctgccggaataacttacacagacagaagatggtgctttgatggcacaaccaacaacaccataatggaagatagtgtaccagcagaaggaccttttgggacagcggtg

SEQ ID NO: 724 - DNA, 140 bp, Artificial Sequence
  Synthetic
caccgctgtcccaaaaggtccttctgctggtacactatcttccattatggtgttgttggttgtgccatcaaagcaccatcttctgtctgtgtaagttattccggcagatgcaacctgatacatatcagcagccagggcct

SEQ ID NO: 725 - DNA, 140 bp, Artificial Sequence
  Synthetic
atacgccatgctgggtctcctgtggacaaaatatggagagaagagagtgctcaaaccaagatggatggatgcgagggtctgttccgatcatgctgccctgaagtcgttcaaagaatttgccgtacttgggagtcggccat

SEQ ID NO: 726 - DNA, 140 bp, Artificial Sequence
  Synthetic
atggccgactcccaagtacggcaaattctttgaacgacttcagggcagcatgatcggaacagaccctcgcatccatccatcttggtttgagcactctcttctctccatattttgtccacaggagacccagcatggcgtat

SEQ ID NO: 727 - DNA, 140 bp, Artificial Sequence
  Synthetic
atacgccatgctgggtctcctgccgggaaaagaggagtggctttaggagtaatggaggccctgggaacattgccaggacacatgacagagaggtttcaggaggccattgacaatctcgctcgtacttgggagtcggccat

SEQ ID NO: 728 - DNA, 140 bp, Artificial Sequence
  Synthetic
atggccgactcccaagtacgagcgagattgtcaatggcctcctgaaacctctctgtcatgtgtcctggcaatgttcccagggcctccattactcctaaagccactcctcttttcccggcaggagacccagcatggcgtat

SEQ ID NO: 729 - DNA, 140 bp, Artificial Sequence
  Synthetic
atacgccatgctgggtctccgtgctcatgcgagcagagactggaagcaggccttacaaggcagcggcagcccaactgccggagaccctagagaccatcatgctcttaggcttgttgggaacgtacttgggagtcggccat

SEQ ID NO: 730 - DNA, 140 bp, Artificial Sequence
  Synthetic
atggccgactcccaagtacgttcccaacaagcctaagagcatgatggtctctagggtctccggcagttgggctgccgctgccttgtaaggcctgcttccagtctctgctcgcatgagcacggagacccagcatggcgtat

SEQ ID NO: 731 - DNA, 140 bp, Artificial Sequence
  Synthetic
atacgccatgctgggtctcccagtttcgttggggatcttctttgtcttgatgcggaacaagggcatcgggaagatgggttttggaatggtaactcttggggccagtgcatggctcatgtgcgtacttgggagtcggccat

SEQ ID NO: 732 - DNA, 140 bp, Artificial Sequence
  Synthetic
atggccgactcccaagtacgcacatgagccatgcactggccccaagagttaccattccaaaacccatcttcccgatgcccttgttccgcatcaagacaaagaagatccccaacgaaactgggagacccagcatggcgtat

SEQ ID NO: 733 - DNA, 140 bp, Artificial Sequence
  Synthetic
aggccctggctgctgatatgaagatgggttttggaatggtaactcttggggccagtgcatggctcatgtggctttcggaaattgaaccagccagaattgcatgtgtcctcattgttgtgtgaccttttgggacagcggtg

SEQ ID NO: 734 - DNA, 140 bp, Artificial Sequence
  Synthetic
caccgctgtcccaaaaggtcacacaacaatgaggacacatgcaattctggctggttcaatttccgaaagccacatgagccatgcactggccccaagagttaccattccaaaacccatcttcatatcagcagccagggcct

SEQ ID NO: 735 - DNA, 140 bp, Artificial Sequence
  Synthetic
atacgccatgctgggtctcctcttgttactggtggtactcatacccgagccagagaagcaaagatctccccaggacaaccagatggcaatcatcatcatggtggcagtgggccttctgggcgtacttgggagtcggccat

SEQ ID NO: 736 - DNA, 140 bp, Artificial Sequence
  Synthetic
atggccgactcccaagtacgcccagaaggcccactgccaccatgatgatgattgccatctggttgtcctggggagatctttgcttctctggctcgggtatgagtaccaccagtaacaagaggagacccagcatggcgtat

SEQ ID NO: 737 - DNA, 140 bp, Artificial Sequence
  Synthetic
atacgccatgctgggtctcctttgataactgcaaacgaacttggatggctggaaagaacaaaaaatgacatagctcatctaatgggaaggagagaagaaggagtaactatgggattctcacgtacttgggagtcggccat

SEQ ID NO: 738 - DNA, 140 bp, Artificial Sequence
  Synthetic
atggccgactcccaagtacgtgagaatcccatagttactccttcttctctccttcccattagatgagctatgtcattttttgttctttccagccatccaagttcgtttgcagttatcaaaggagacccagcatggcgtat

SEQ ID NO: 739 - DNA, 140 bp, Artificial Sequence
  Synthetic
atacgccatgctgggtctccatggacatcgatttgcggccagcctccgcctgggctatctatgccgcactgacaactctcatcaccccagccgtccaacacgcggtaaccacttcatacacgtacttgggagtcggccat

SEQ ID NO: 740 - DNA, 140 bp, Artificial Sequence
  Synthetic
atggccgactcccaagtacgtgtatgaagtggttaccgcgtgttggacggctggggtgatgagagttgtcagtgcggcatagatagcccaggcggaggctggccgcaaatcgatgtccatggagacccagcatggcgtat

SEQ ID NO: 741 - DNA, 140 bp, Artificial Sequence
  Synthetic
atacgccatgctgggtctccacaactactccctaatggcgatggccacacaagctggagtgctatttggcatgggcaaagggatgccattttatgcatgggactttggagtcccgctgctcgtacttgggagtcggccat

SEQ ID NO: 742 - DNA, 140 bp, Artificial Sequence
  Synthetic
atggccgactcccaagtacgagcagcgggactccaaagtcccatgcataaaatggcatccctttgcccatgccaaatagcactccagcttgtgtggccatcgccattagggagtagttgtggagacccagcatggcgtat

SEQ ID NO: 743 - DNA, 140 bp, Artificial Sequence
  Synthetic
atacgccatgctgggtctccaatgatgggttgctactcacaattaacacccctaaccttgatagtggctatcattctgcttgtggcacactatatgtacttgatcccaggcctacaggcacgtacttgggagtcggccat

SEQ ID NO: 744 - DNA, 140 bp, Artificial Sequence
  Synthetic
atggccgactcccaagtacgtgcctgtaggcctgggatcaagtacatatagtgtgccacaagcagaatgatagccactatcaaggttaggggtgttaattgtgagtagcaacccatcattggagacccagcatggcgtat

SEQ ID NO: 745 - DNA, 140 bp, Artificial Sequence
  Synthetic
aggccctggctgctgatatggcagcagcgcgtgctgcccagaagagaacagcagctggcatcatgaagaatcccgttgtggatggaatagtggtaactgacattgacacaatgacaattggaccttttgggacagcggtg

SEQ ID NO: 746 - DNA, 140 bp, Artificial Sequence
  Synthetic
caccgctgtcccaaaaggtccaattgtcattgtgtcaatgtcagttaccactattccatccacaacgggattcttcatgatgccagctgctgttctcttctgggcagcacgcgctgctgccatatcagcagccagggcct

SEQ ID NO: 747 - DNA, 140 bp, Artificial Sequence
  Synthetic
atacgccatgctgggtctccacccccaagtggagaagaagatgggacaagtgttacttatagcagtagccatctccagtgctgtgctgctgcggactgcttggggatggggggaggctggcgtacttgggagtcggccat

SEQ ID NO: 748 - DNA, 140 bp, Artificial Sequence
  Synthetic
atggccgactcccaagtacgccagcctccccccatccccaagcagtccgcagcagcacagcactggagatggctactgctataagtaacacttgtcccatcttcttctccacttgggggtggagacccagcatggcgtat

SEQ ID NO: 749 - DNA, 140 bp, Artificial Sequence
  Synthetic
atacgccatgctgggtctccagctctgattactgcagcaacctccaccttgtgggaaggttctccaaacaaatactggaactcctctacagccacctcactgtgcaacatcttcagaggacgtacttgggagtcggccat

SEQ ID NO: 750 - DNA, 140 bp, Artificial Sequence
  Synthetic
atggccgactcccaagtacgtcctctgaagatgttgcacagtgaggtggctgtagaggagttccagtatttgtttggagaaccttcccacaaggtggaggttgctgcagtaatcagagctggagacccagcatggcgtat

SEQ ID NO: 751 - DNA, 140 bp, Artificial Sequence
  Synthetic
aggccctggctgctgatatgaatactggaactcctctacagccacctcactgtgcaacatcttcagaggaagttacctggcaggcgcttctcttatttatacagtgacaagaaatgctgggaccttttgggacagcggtg

SEQ ID NO: 752 - DNA, 140 bp, Artificial Sequence
  Synthetic
caccgctgtcccaaaaggtcccagcatttcttgtcactgtataaataagagaagcgcctgccaggtaacttcctctgaagatgttgcacagtgaggtggctgtagaggagttccagtattcatatcagcagccagggcct

SEQ ID NO: 753 - DNA, 140 bp, Artificial Sequence
  Synthetic
atacgccatgctgggtctcccctagtcaagagacgtggaggtggaacgggagagactctaggagagaagtggaaagctcgcctgaatcagatgtcggccctggagttctactcttacaaacgtacttgggagtcggccat

SEQ ID NO: 754 - DNA, 140 bp, Artificial Sequence
  Synthetic
atggccgactcccaagtacgtttgtaagagtagaactccagggccgacatctgattcaggcgagctttccacttctctcctagagtctctcccgttccacctccacgtctcttgactaggggagacccagcatggcgtat

SEQ ID NO: 755 - DNA, 140 bp, Artificial Sequence
  Synthetic
aggccctggctgctgatatgggaaagctcgcctgaatcagatgtcggccctggagttctactcttacaaaaagtcaggcatcactgaagtgtgtagagaggaggctcgccgcgccctcaagaccttttgggacagcggtg

SEQ ID NO: 756 - DNA, 140 bp, Artificial Sequence
  Synthetic
caccgctgtcccaaaaggtcttgagggcgcggcgagcctcctctctacacacttcagtgatgcctgactttttgtaagagtagaactccagggccgacatctgattcaggcgagctttcccatatcagcagccagggcct

SEQ ID NO: 757 - DNA, 140 bp, Artificial Sequence
  Synthetic
aggccctggctgctgatatgtcagatggctggtggagagaggatacctgcaaccccatggaaaggttgttgacctcggatgtggcagagggggttggagctattatgccgccaccatccggaccttttgggacagcggtg

SEQ ID NO: 758 - DNA, 140 bp, Artificial Sequence
  Synthetic
caccgctgtcccaaaaggtccggatggtggcggcataatagctccaaccccctctgccacatccgaggtcaacaacctttccatggggttgcaggtatcctctctccaccagccatctgacatatcagcagccagggcct

SEQ ID NO: 759 - DNA, 140 bp, Artificial Sequence
  Synthetic
aggccctggctgctgatatggaaagtgcaggaggtgaaaggatacacaaagggaggtcccggtcatgaagaacccatgctggtgcaaagctatgggtggaacatcgttcgtctcaagagtgaccttttgggacagcggtg

SEQ ID NO: 760 - DNA, 140 bp, Artificial Sequence
  Synthetic
caccgctgtcccaaaaggtcactcttgagacgaacgatgttccacccatagctttgcaccagcatgggttcttcatgaccgggacctccctttgtgtatcctttcacctcctgcactttccatatcagcagccagggcct

SEQ ID NO: 761 - DNA, 140 bp, Artificial Sequence
  Synthetic
atacgccatgctgggtctccggagtggacgtcttccacatggcggccgagccgtgtgataccttgctgtgtgacataggtgagtcatcatctagtcctgaagtggaagagacgcgaacaccgtacttgggagtcggccat

SEQ ID NO: 762 - DNA, 140 bp, Artificial Sequence
  Synthetic
atggccgactcccaagtacggtgttcgcgtctcttccacttcaggactagatgatgactcacctatgtcacacagcaaggtatcacacggctcggccgccatgtggaagacgtccactccggagacccagcatggcgtat

SEQ ID NO: 763 - DNA, 140 bp, Artificial Sequence
  Synthetic
atacgccatgctgggtctcctccgagtgctctctatggtgggggactggcttgagaaaagaccgggggccttctgtataaaggtgctgtgtccatacaccagcactatgatggagaccatcgtacttgggagtcggccat

SEQ ID NO: 764 - DNA, 140 bp, Artificial Sequence
  Synthetic
atggccgactcccaagtacgatggtctccatcatagtgctggtgtatggacacagcacctttatacagaaggcccccggtcttttctcaagccagtcccccaccatagagagcactcggaggagacccagcatggcgtat

SEQ ID NO: 765 - DNA, 140 bp, Artificial Sequence
  Synthetic
atacgccatgctgggtctccggagcgcctgcaacgtaggtatgggggaggattagtcagagtgccattgtctcgcaactccacacatgagatgtattgggtctctggagcaaaaagtaaccgtacttgggagtcggccat

SEQ ID NO: 766 - DNA, 140 bp, Artificial Sequence
  Synthetic
atggccgactcccaagtacggttactttttgctccagagacccaatacatctcatgtgtggagttgcgagacaatggcactctgactaatcctcccccatacctacgttgcaggcgctccggagacccagcatggcgtat

SEQ ID NO: 767 - DNA, 140 bp, Artificial Sequence
  Synthetic
atacgccatgctgggtctccgtcataaaaagtgtgtccaccacaagtcagctcctcctgggacgcatggatggtcccaggaggccagtgaaatatgaggaagatgtgaacctcggctcggcgtacttgggagtcggccat

SEQ ID NO: 768 - DNA, 140 bp, Artificial Sequence
  Synthetic
atggccgactcccaagtacgccgagccgaggttcacatcttcctcatatttcactggcctcctgggaccatccatgcgtcccaggaggagctgacttgtggtggacacactttttatgacggagacccagcatggcgtat

SEQ ID NO: 769 - DNA, 140 bp, Artificial Sequence
  Synthetic
atacgccatgctgggtctccgcacacgagctgtggcaagctgtgctgaagctcccaacatgaaggtcattggcaagcgcattgagagaatccgcagtgaacatgcagaaacatggttcttcgtacttgggagtcggccat

SEQ ID NO: 770 - DNA, 140 bp, Artificial Sequence
  Synthetic
atggccgactcccaagtacgaagaaccatgtttctgcatgttcactgcggattctctcaatgcgcttgccaatgaccttcatgttgggagcttcagcacagcttgccacagctcgtgtgcggagacccagcatggcgtat

SEQ ID NO: 771 - DNA, 140 bp, Artificial Sequence
  Synthetic
atacgccatgctgggtctcctgatgaaaaccatccatacaggacatgggcctaccatgggagctacgaagcccccacacaagggtcagcatcttccctcgtgaatggggttgttagactccgtacttgggagtcggccat

SEQ ID NO: 772 - DNA, 140 bp, Artificial Sequence
  Synthetic
atggccgactcccaagtacggagtctaacaaccccattcacgagggaagatgctgacccttgtgtgggggcttcgtagctcccatggtaggcccatgtcctgtatggatggttttcatcaggagacccagcatggcgtat

SEQ ID NO: 773 - DNA, 140 bp, Artificial Sequence
  Synthetic
atacgccatgctgggtctccctgtcaaagccctgggatgtagtgactggagttacaggaatagctatgactgatacaacaccatacggccaacaaagagtcttcaaagaaaaagtggacacgtacttgggagtcggccat

SEQ ID NO: 774 - DNA, 140 bp, Artificial Sequence
  Synthetic
atggccgactcccaagtacgtgtccactttttctttgaagactctttgttggccgtatggtgttgtatcagtcatagctattcctgtaactccagtcactacatcccagggctttgacagggagacccagcatggcgtat

SEQ ID NO: 775 - DNA, 140 bp, Artificial Sequence
  Synthetic
atacgccatgctgggtctccccagggtgccagatccccaagaaggcactcgccaggcaatgaacatggtctcttcctggctgtggaaggagttggggaaacgcaagcggccacgtgtctgcgtacttgggagtcggccat

SEQ ID NO: 776 - DNA, 140 bp, Artificial Sequence
  Synthetic
atggccgactcccaagtacgcagacacgtggccgcttgcgtttccccaactccttccacagccaggaagagaccatgttcattgcctggcgagtgccttcttggggatctggcaccctggggagacccagcatggcgtat

SEQ ID NO: 777 - DNA, 140 bp, Artificial Sequence
  Synthetic
atacgccatgctgggtctcccaccaaagaagagttcatcaacaaggtgcgcagcaatgcagcactgggagcaatatttgaagaggaaaaagaatggaagacggccgtggaggctgtgaatcgtacttgggagtcggccat

SEQ ID NO: 778 - DNA, 140 bp, Artificial Sequence
  Synthetic
atggccgactcccaagtacgattcacagcctccacggccgtcttccattctttttcctcttcaaatattgctcccagtgctgcattgctgcgcaccttgttgatgaactcttctttggtgggagacccagcatggcgtat

SEQ ID NO: 779 - DNA, 140 bp, Artificial Sequence
  Synthetic
aggccctggctgctgatatgcaatatttgaagaggaaaaagaatggaagacggccgtggaggctgtgaatgatccaaggttttgggctctagtggacaaggaaagagaacatcacctgaggaccttttgggacagcggtg

SEQ ID NO: 780 - DNA, 140 bp, Artificial Sequence
  Synthetic
caccgctgtcccaaaaggtcctcaggtgatgttctctttccttgtccactagagcccaaaaccttggatcattcacagcctccacggccgtcttccattctttttcctcttcaaatattgcatatcagcagccagggcct

SEQ ID NO: 781 - DNA, 140 bp, Artificial Sequence
  Synthetic
atacgccatgctgggtctccaggagagtgccatagctgtgtgtacaatatgatgggaaaaagagagaagaagcaaggagaattcggaaaagcaaaaggcagccgcgccatctggtacatgcgtacttgggagtcggccat

SEQ ID NO: 782 - DNA, 140 bp, Artificial Sequence
  Synthetic
atggccgactcccaagtacgcatgtaccagatggcgcggctgccttttgcttttccgaattctccttgcttcttctctctttttcccatcatattgtacacacagctatggcactctcctggagacccagcatggcgtat

SEQ ID NO: 783 - DNA, 140 bp, Artificial Sequence
  Synthetic
aggccctggctgctgatatgagcaaggagaattcggaaaagcaaaaggcagccgcgccatctggtacatgtggttgggagccagattcttggagtttgaagcccttggattcttgaatgagaccttttgggacagcggtg

SEQ ID NO: 784 - DNA, 140 bp, Artificial Sequence
  Synthetic
caccgctgtcccaaaaggtctcattcaagaatccaagggcttcaaactccaagaatctggctcccaaccacatgtaccagatggcgcggctgccttttgcttttccgaattctccttgctcatatcagcagccagggcct

SEQ ID NO: 785 - DNA, 140 bp, Artificial Sequence
  Synthetic
aggccctggctgctgatatgggaccattggatgggaagagaaaactcaggaggtggtgtcgaagggctaggactgcaaagacttggatacattctagaagaaatgaatcgggcaccaggagaccttttgggacagcggtg

SEQ ID NO: 786 - DNA, 140 bp, Artificial Sequence
  Synthetic
caccgctgtcccaaaaggtctcctggtgcccgattcatttcttctagaatgtatccaagtctttgcagtcctagcccttcgacaccacctcctgagttttctcttcccatccaatggtcccatatcagcagccagggcct

SEQ ID NO: 787 - DNA, 140 bp, Artificial Sequence
  Synthetic
atacgccatgctgggtctccggaaagatgtatgcagatgacaccgctggctgggacacccgcattagtaagtttgatctggagaatgaagccttaattaccaaccaaatggaggaagggccgtacttgggagtcggccat

SEQ ID NO: 788 - DNA, 140 bp, Artificial Sequence
  Synthetic
atggccgactcccaagtacggcccttcctccatttggttggtaattaaggcttcattctccagatcaaacttactaatgcgggtgtcccagccagcggtgtcatctgcatacatctttccggagacccagcatggcgtat

SEQ ID NO: 789 - DNA, 140 bp, Artificial Sequence
  Synthetic
atacgccatgctgggtctccacagagctctggcgttggctgtgattaagtacacaaaaaacaaagtggtgaaggtcctcagaccagctgaaggagggaaaacagttatggacatcatttccgtacttgggagtcggccat

SEQ ID NO: 790 - DNA, 140 bp, Artificial Sequence
  Synthetic
atggccgactcccaagtacggaaatgatgtccataactgttttccctccttcagctggtctgaggaccttcaccactttgttttttgtgtacttaatcacagccaacgccagagctctgtggagacccagcatggcgtat

SEQ ID NO: 791 - DNA, 140 bp, Artificial Sequence
  Synthetic
atacgccatgctgggtctccaagacaggaccagagagggagtggacaagttgtcacctatgctctcaacacatttaccaacttagtggtgcagcttatccggaatatggaggctgaggaacgtacttgggagtcggccat

SEQ ID NO: 792 - DNA, 140 bp, Artificial Sequence
  Synthetic
atggccgactcccaagtacgttcctcagcctccatattccggataagctgcaccactaagttggtaaatgtgttgagagcataggtgacaacttgtccactccctctctggtcctgtcttggagacccagcatggcgtat

SEQ ID NO: 793 - DNA, 140 bp, Artificial Sequence
  Synthetic
atacgccatgctgggtctccgtgttagagatgcaagacttatggctgttgaggaagccagagaaagtgaccagatggttgcagtgcaatggatgggacagactcaaacgaatggcagtcacgtacttgggagtcggccat

SEQ ID NO: 794 - DNA, 140 bp, Artificial Sequence
  Synthetic
atggccgactcccaagtacgtgactgccattcgtttgagtctgtcccatccattgcactgcaaccatctggtcactttctctggcttcctcaacagccataagtcttgcatctctaacacggagacccagcatggcgtat

SEQ ID NO: 795 - DNA, 140 bp, Artificial Sequence
  Synthetic
atacgccatgctgggtctccgtggagatgactgcgttgtgaagccaattgatgataggtttgcgcatgccctcaggttcttaaatgacatgggaaaagttaggaaagacacacaggaatgcgtacttgggagtcggccat

SEQ ID NO: 796 - DNA, 140 bp, Artificial Sequence
  Synthetic
atggccgactcccaagtacgcattcctgtgtgtctttcctaacttttcccatgtcatttaagaacctgagggcatgcgcaaacctatcatcaattggcttcacaacgcagtcatctccacggagacccagcatggcgtat

SEQ ID NO: 797 - DNA, 140 bp, Artificial Sequence
  Synthetic
atacgccatgctgggtctccgaaaccctcgactggatggagcaattgggaagaagtcccgttctgctcccaccatttcaacaagctgcacctcaaggatggtagatccattgtggtccctcgtacttgggagtcggccat

SEQ ID NO: 798 - DNA, 140 bp, Artificial Sequence
  Synthetic
atggccgactcccaagtacgagggaccacaatggatctaccatccttgaggtgcagcttgttgaaatggtgggagcagaacgggacttcttcccaattgctccatccagtcgagggtttcggagacccagcatggcgtat

SEQ ID NO: 799 - DNA, 140 bp, Artificial Sequence
  Synthetic
aggccctggctgctgatatgaccatttcaacaagctgcacctcaaggatggtagatccattgtggtcccttgccgccaccaagatgaattgattggccgagcccgtgtatcaccaggggcgaccttttgggacagcggtg

SEQ ID NO: 800 - DNA, 140 bp, Artificial Sequence
  Synthetic
caccgctgtcccaaaaggtcgcccctggtgatacacgggctcggccaatcaattcatcttggtggcggcaagggaccacaatggatctaccatccttgaggtgcagcttgttgaaatggtcatatcagcagccagggcct

SEQ ID NO: 801 - DNA, 140 bp, Artificial Sequence
  Synthetic
atacgccatgctgggtctcctgccgccaccaagatgaattgattggccgagcccgtgtatcaccaggggcaggatggagcattcgggagactgcctgtctagcaaaatcatatgcacagacgtacttgggagtcggccat

SEQ ID NO: 802 - DNA, 140 bp, Artificial Sequence
  Synthetic
atggccgactcccaagtacgtctgtgcatatgattttgctagacaggcagtctcccgaatgctccatcctgcccctggtgatacacgggctcggccaatcaattcatcttggtggcggcaggagacccagcatggcgtat

SEQ ID NO: 803 - DNA, 140 bp, Artificial Sequence
  Synthetic
atacgccatgctgggtctcctgtggcagcttctttacttccacagaagagaccttcgactgatggccaatgctatttgttcggctgtgccagttgactgggtaccaaccgggagaaccaccgtacttgggagtcggccat

SEQ ID NO: 804 - DNA, 140 bp, Artificial Sequence
  Synthetic
atggccgactcccaagtacggtggttctcccggttggtacccagtcaactggcacagccgaacaaatagcattggccatcagtcgaaggtctcttctgtggaagtaaagaagctgccacaggagacccagcatggcgtat

SEQ ID NO: 805 - DNA, 140 bp, Artificial Sequence
  Synthetic
atacgccatgctgggtctccctggtcaatccacggaaagggagaatggatgactactgaggacatgctcatggtgtggaatagagtgtggattgaggagaacgaccatatggaggacaagcgtacttgggagtcggccat

SEQ ID NO: 806 - DNA, 140 bp, Artificial Sequence
  Synthetic
atggccgactcccaagtacgcttgtcctccatatggtcgttctcctcaatccacactctattccacaccatgagcatgtcctcagtagtcatccattctccctttccgtggattgaccagggagacccagcatggcgtat

SEQ ID NO: 807 - DNA, 140 bp, Artificial Sequence
  Synthetic
atacgccatgctgggtctccactcctgtgacaaagtggacagacatcccctatctgggaaaaagggaggacttatggtgtggatcccttatagggcacaggccccgcaccacttgggctgcgtacttgggagtcggccat

SEQ ID NO: 808 - DNA, 140 bp, Artificial Sequence
  Synthetic
atggccgactcccaagtacgcagcccaagtggtgcggggcctgtgccctataagggatccacaccataagtcctccctttttcccagataggggatgtctgtccactttgtcacaggagtggagacccagcatggcgtat

SEQ ID NO: 809 - DNA, 140 bp, Artificial Sequence
  Synthetic
atacgccatgctgggtctccagaacatcaaagacacagtcaacatggtgcgcaggatcataggtgatgaagaaaaatacatggactacttatccacccaggtccgctacttgggtgaggacgtacttgggagtcggccat

SEQ ID NO: 810 - DNA, 140 bp, Artificial Sequence
  Synthetic
atggccgactcccaagtacgtcctcacccaagtagcggacctgggtggataagtagtccatgtatttttcttcatcacctatgatcctgcgcaccatgttgactgtgtctttgatgttctggagacccagcatggcgtat

SEQ ID NO: 811 - DNA, 140 bp, Artificial Sequence
  Synthetic
atacgccatgctgggtctccagggtccacacctggagtgttgtaagcaccaatttcagtgttgtcaggcctgctagccagccacagtttggggaaagctgtgcagcctgtagcccccccacgtacttgggagtcggccat

SEQ ID NO: 812 - DNA, 140 bp, Artificial Sequence
  Synthetic
atggccgactcccaagtacgtgggggggctacaggctgcacagctttccccaaactgtggctggctagcaggcctgacaacactgaaattggtgcttacaacactccaggtgtggaccctggagacccagcatggcgtat

SEQ ID NO: 813 - DNA, 140 bp, Artificial Sequence
  Synthetic
atacgccatgctgggtctccggagaagctgggaaaccaagctcatagtcaggccgagaacgccatggcacggaagaagccatgctgcctgtgagcccctcagaggacactgagttaaaaacgtacttgggagtcggccat

SEQ ID NO: 814 - DNA, 140 bp, Artificial Sequence
  Synthetic
atggccgactcccaagtacgtttttaactcagtgtcctctgaggggctcacaggcagcatggcttcttccgtgccatggcgttctcggcctgactatgagcttggtttcccagcttctccggagacccagcatggcgtat

SEQ ID NO: 815 - DNA, 140 bp, Artificial Sequence
  Synthetic
atacgccatgctgggtctccaccccacgcgcttggaagcgcaggatgggaaaagaaggtggcgaccttccccaccctttaatctggggcctgaactggagactagctgtgaatctccagccgtacttgggagtcggccat

SEQ ID NO: 816 - DNA, 140 bp, Artificial Sequence
  Synthetic
atggccgactcccaagtacggctggagattcacagctagtctccagttcaggccccagattaaagggtggggaaggtcgccaccttcttttcccatcctgcgcttccaagcgcgtggggtggagacccagcatggcgtat

SEQ ID NO: 817 - DNA, 140 bp, Artificial Sequence
  Synthetic
aggccctggctgctgatatgccaccctttaatctggggcctgaactggagactagctgtgaatctccagcagagggactagtggttagaggagaccccccggaaaacgcaaaacagcatagaccttttgggacagcggtg

SEQ ID NO: 818 - DNA, 140 bp, Artificial Sequence
  Synthetic
caccgctgtcccaaaaggtctatgctgttttgcgttttccggggggtctcctctaaccactagtccctctgctggagattcacagctagtctccagttcaggccccagattaaagggtggcatatcagcagccagggcct

SEQ ID NO: 819 - DNA, 140 bp, Artificial Sequence
  Synthetic
atacgccatgctgggtctccgactagtggttagaggagaccccccggaaaacgcaaaacagcatattgacgctgggaaagaccagagactccatgagtttccaccacgctggccgccaggcgtacttgggagtcggccat

SEQ ID NO: 820 - DNA, 140 bp, Artificial Sequence
  Synthetic
atggccgactcccaagtacgcctggcggccagcgtggtggaaactcatggagtctctggtctttcccagcgtcaatatgctgttttgcgttttccggggggtctcctctaaccactagtcggagacccagcatggcgtat

SEQ ID NO: 821 - DNA, 140 bp, Artificial Sequence
  Synthetic
aggccctggctgctgatatggaaccagagagcaacttagtgaggtcaatggtgacagcgggatcaaccgatcacatggaccacttctctcttggagtgcttgtgattctactcatggtgcgaccttttgggacagcggtg

SEQ ID NO: 822 - DNA, 140 bp, Artificial Sequence
  Synthetic
caccgctgtcccaaaaggtcgcaccatgagtagaatcacaagcactccaagagagaagtggtccatgtgatcggttgatcccgctgtcaccattgacctcactaagttgctctctggttccatatcagcagccagggcct

SEQ ID NO: 823 - DNA, 140 bp, Artificial Sequence
  Synthetic
atacgccatgctgggtctccgaagggctgaagaagagaatgaccacaaagatcattatgagcacatcaatggcagtgctggtggccatgatcctgggaggatttttaatgagtgacttggcgtacttgggagtcggccat

SEQ ID NO: 824 - DNA, 140 bp, Artificial Sequence
  Synthetic
atggccgactcccaagtacgccaagtcactcattaaaaatcctcccaggatcatggccaccagcactgccattgatgtgctcataatgatctttgtggtcattctcttcttcagcccttcggagacccagcatggcgtat

SEQ ID NO: 825 - DNA, 140 bp, Artificial Sequence
  Synthetic
atacgccatgctgggtctccagttgttgatctgtgtgaatcagactgcgacagttcgagtttgaagcgagagctaacaacagtatcaacaggtttaatttggatttggaagcgagagtttcgtacttgggagtcggccat

SEQ ID NO: 826 - DNA, 140 bp, Artificial Sequence
  Synthetic
atggccgactcccaagtacgaaactctcgcttccaaatccaaattaaacctgttgatactgttgttagctctcgcttcaaactcgaactgtcgcagtctgattcacacagatcaacaactggagacccagcatggcgtat

SEQ ID NO: 827 - DNA, 140 bp, Artificial Sequence
  Synthetic
aggccctggctgctgatatgaccgatcacatggaccacttctctcttggagtgcttgtgattctactcatggtgcaggaagggctgaagaagagaatgaccacaaagatcattatgagcagaccttttgggacagcggtg

SEQ ID NO: 828 - DNA, 140 bp, Artificial Sequence
  Synthetic
caccgctgtcccaaaaggtctgctcataatgatctttgtggtcattctcttcttcagcccttcctgcaccatgagtagaatcacaagcactccaagagagaagtggtccatgtgatcggtcatatcagcagccagggcct

SEQ ID NO: 829 - DNA, 140 bp, Artificial Sequence
  Synthetic
atacgccatgctgggtctccgatccaaggttttgggctctagtggacaaggaaagagaacatcacctgagaggagagtgtcatagctgtgtgtacaacatgatgggaaaaagagagaagacgtacttgggagtcggccat

SEQ ID NO: 830 - DNA, 140 bp, Artificial Sequence
  Synthetic
atggccgactcccaagtacgtcttctctctttttcccatcatgttgtacacacagctatgacactctcctctcaggtgatgttctctttccttgtccactagagcccaaaaccttggatcggagacccagcatggcgtat

SEQ ID NO: 831 - DNA, 140 bp, Artificial Sequence
  Synthetic
aggccctggctgctgatatgcaaaacagcatattgacgctgggaaagaccagagactccatgagtttccaccacgctggccgccaggcacagatcgccgaacagcggcggccagtgtggggaccttttgggacagcggtg

SEQ ID NO: 832 - DNA, 140 bp, Artificial Sequence
  Synthetic
caccgctgtcccaaaaggtccccacactggccgccgctgttcggcgatctgtgcctggcggccagcgtggtggaaactcatggagtctctggtctttcccagcgtcaatatgctgttttgcatatcagcagccagggcct

SEQ ID NO: 833 - DNA, 140 bp, Artificial Sequence
  Synthetic
atacgccatgctgggtctccatgaaaaacccaaagaagaaatccggaggattccggattgtcaatatgctaaaacgcggagtagcccgtgtaaaccccttgggaggtttgaagaggctgccgtacttgggagtcggccat

SEQ ID NO: 834 - DNA, 140 bp, Artificial Sequence
  Synthetic
atggccgactcccaagtacggcagcctcttcaaacctcccaaggggtttacacgggctactccgcgttttagcatattgacaatccggaatcctccggatttcttctttgggtttttcatggagacccagcatggcgtat

SEQ ID NO: 835 - DNA, 140 bp, Artificial Sequence
  Synthetic
atacgccatgctgggtctcctctgggaagttcgacgagccaaaaagtcatatacttgatcatgatactgctgattgccccggcatacagcatcaggtgcattggagtcagcaacagagaccgtacttgggagtcggccat

SEQ ID NO: 836 - DNA, 140 bp, Artificial Sequence
  Synthetic
atggccgactcccaagtacggtctctgttgctgactccaatgcacctgatgctgtatgccggggcaatcagcagtatcatgatcaagtatatgactttttggctcgtcgaacttcccagaggagacccagcatggcgtat

SEQ ID NO: 837 - DNA, 140 bp, Artificial Sequence
  Synthetic
aggccctggctgctgatatgttcgtggaaggcatgtcaggtgggacctgggttgatgtcgtcttggaacatggaggttgcgtcaccgtaatggcacaggacaagccaacagttgacataggaccttttgggacagcggtg

SEQ ID NO: 838 - DNA, 140 bp, Artificial Sequence
  Synthetic
caccgctgtcccaaaaggtcctatgtcaactgttggcttgtcctgtgccattacggtgacgcaacctccatgttccaagacgacatcaacccaggtcccacctgacatgccttccacgaacatatcagcagccagggcct

SEQ ID NO: 839 - DNA, 140 bp, Artificial Sequence
  Synthetic
atacgccatgctgggtctccagttggtcacgacaacggttagcaacatggctgaggtaagatcctactgctacgaggcatcaatatcggacatggcttcggatagtcgctgcccaacacacgtacttgggagtcggccat

SEQ ID NO: 840 - DNA, 140 bp, Artificial Sequence
  Synthetic
atggccgactcccaagtacgtgtgttgggcagcgactatccgaagccatgtccgatattgatgcctcgtagcagtaggatcttacctcagccatgttgctaaccgttgtcgtgaccaactggagacccagcatggcgtat

SEQ ID NO: 841 - DNA, 140 bp, Artificial Sequence
  Synthetic
aggccctggctgctgatatgtacgaggcatcaatatcggacatggcttcggatagtcgctgcccaacacaaggtgaagcctaccttgacaagcaatcagacactcaatatgtttgcaaaagaccttttgggacagcggtg

SEQ ID NO: 842 - DNA, 140 bp, Artificial Sequence
  Synthetic
caccgctgtcccaaaaggtcttttgcaaacatattgagtgtctgattgcttgtcaaggtaggcttcaccttgtgttgggcagcgactatccgaagccatgtccgatattgatgcctcgtacatatcagcagccagggcct

SEQ ID NO: 843 - DNA, 140 bp, Artificial Sequence
  Synthetic
aggccctggctgctgatatggaacattggtggacagaggttggggaaatgggtgtggactttttggcaaagggagcctggtgacatgtgccaagttcacgtgttccaagaagatgaccgggaccttttgggacagcggtg

SEQ ID NO: 844 - DNA, 140 bp, Artificial Sequence
  Synthetic
caccgctgtcccaaaaggtcccggtcatcttcttggaacacgtgaacttggcacatgtcaccaggctccctttgccaaaaagtccacacccatttccccaacctctgtccaccaatgttccatatcagcagccagggcct

SEQ ID NO: 845 - DNA, 140 bp, Artificial Sequence
  Synthetic
aggccctggctgctgatatgagcaaccttgggaggctttggaagtttaggacttgattgtgaaccaaggacaggccttgacttttcagatttgtattacctgaccatgaacaataagcacgaccttttgggacagcggtg

SEQ ID NO: 846 - DNA, 140 bp, Artificial Sequence
  Synthetic
caccgctgtcccaaaaggtcgtgcttattgttcatggtcaggtaatacaaatctgaaaagtcaaggcctgtccttggttcacaatcaagtcctaaacttccaaagcctcccaaggttgctcatatcagcagccagggcct

SEQ ID NO: 847 - DNA, 140 bp, Artificial Sequence
  Synthetic
atacgccatgctgggtctcctggttagtccacaaagagtggtttcatgacatcccattgccttggcatgctggggcagacaccggaactccacactggaacaacaaagaggcattggtagcgtacttgggagtcggccat

SEQ ID NO: 848 - DNA, 140 bp, Artificial Sequence
  Synthetic
atggccgactcccaagtacgctaccaatgcctctttgttgttccagtgtggagttccggtgtctgccccagcatgccaaggcaatgggatgtcatgaaaccactctttgtggactaaccaggagacccagcatggcgtat

SEQ ID NO: 849 - DNA, 140 bp, Artificial Sequence
  Synthetic
atacgccatgctgggtctccagttcaaggatgcccacgccaagaggcaaaccgtcgtcgttctggggagccaggaaggagctgttcacacggctcttgctggagctttggaggctgagatcgtacttgggagtcggccat

SEQ ID NO: 850 - DNA, 140 bp, Artificial Sequence
  Synthetic
atggccgactcccaagtacgatctcagcctccaaagctccagcaagagccgtgtgaacagctccttcctggctccccagaacgacgacggtttgcctcttggcgtgggcatccttgaactggagacccagcatggcgtat

SEQ ID NO: 851 - DNA, 140 bp, Artificial Sequence
  Synthetic
atacgccatgctgggtctccggatggtgcaaaaggaaggctgttctctggccatttgaaatgccgcctaaaaatggacaagcttagattgaagggcgtgtcatattccttgtgcaccgcacgtacttgggagtcggccat

SEQ ID NO: 852 - DNA, 140 bp, Artificial Sequence
  Synthetic
atggccgactcccaagtacgtgcggtgcacaaggaatatgacacgcccttcaatctaagcttgtccatttttaggcggcatttcaaatggccagagaacagccttccttttgcaccatccggagacccagcatggcgtat

SEQ ID NO: 853 - DNA, 140 bp, Artificial Sequence
  Synthetic
aggccctggctgctgatatgaaatggacaagcttagattgaagggcgtgtcatattccttgtgcaccgcagcgttcacattcaccaaggtcccagctgaaacactgcatggaacagtcacgaccttttgggacagcggtg

SEQ ID NO: 854 - DNA, 140 bp, Artificial Sequence
  Synthetic
caccgctgtcccaaaaggtcgtgactgttccatgcagtgtttcagctgggaccttggtgaatgtgaacgctgcggtgcacaaggaatatgacacgcccttcaatctaagcttgtccatttcatatcagcagccagggcct

SEQ ID NO: 855 - DNA, 140 bp, Artificial Sequence
  Synthetic
aggccctggctgctgatatgagtggaggtgcagtatgcagggacagatggaccctgcaaggtcccagcccagatggcggtggacatgcagactttgaccccagtcggaaggctgataactgaccttttgggacagcggtg

SEQ ID NO: 856 - DNA, 140 bp, Artificial Sequence
  Synthetic
caccgctgtcccaaaaggtcagttatcagccttccgactggggtcaaagtctgcatgtccaccgccatctgggctgggaccttgcagggtccatctgtccctgcatactgcacctccactcatatcagcagccagggcct

SEQ ID NO: 857 - DNA, 140 bp, Artificial Sequence
  Synthetic
atacgccatgctgggtctccgccaaccccgtgattactgaaagcactgaaaattcaaagatgatgttggagctcgacccaccatttggggattcttacattgtcataggagttggagatacgtacttgggagtcggccat

SEQ ID NO: 858 - DNA, 140 bp, Artificial Sequence
  Synthetic
atggccgactcccaagtacgtatctccaactcctatgacaatgtaagaatccccaaatggtgggtcgagctccaacatcatctttgaattttcagtgctttcagtaatcacggggttggcggagacccagcatggcgtat

SEQ ID NO: 859 - DNA, 140 bp, Artificial Sequence
  Synthetic
atacgccatgctgggtctccagaaaatcacccaccactggcataggagtggtagcaccatcggaaaagcatttgaggccactgtgagaggtgccaagagaatggcagttttgggggacaccgtacttgggagtcggccat

SEQ ID NO: 860 - DNA, 140 bp, Artificial Sequence
  Synthetic
atggccgactcccaagtacggtgtcccccaaaactgccattctcttggcacctctcacagtggcctcaaatgcttttccgatggtgctaccactcctatgccagtggtgggtgattttctggagacccagcatggcgtat

SEQ ID NO: 861 - DNA, 140 bp, Artificial Sequence
  Synthetic
atacgccatgctgggtctccagcttgggactttggatccgtcgggggtgtgttcaactcattgggcaagggcatccaccagatctttggagcagccttcaaatcactgtttggaggaatgcgtacttgggagtcggccat

SEQ ID NO: 862 - DNA, 140 bp, Artificial Sequence
  Synthetic
atggccgactcccaagtacgcattcctccaaacagtgatttgaaggctgctccaaagatctggtggatgcccttgcccaatgagttgaacacacccccgacggatccaaagtcccaagctggagacccagcatggcgtat

SEQ ID NO: 863 - DNA, 140 bp, Artificial Sequence
  Synthetic
atacgccatgctgggtctcctcctggttctcacagatcctcataggcacgctgctagtgtggttgggcttgaacacaaagaatggatccatctccctcacatgcttggccctggggggagcgtacttgggagtcggccat

SEQ ID NO: 864 - DNA, 140 bp, Artificial Sequence
  Synthetic
atggccgactcccaagtacgctccccccagggccaagcatgtgagggagatggatccattctttgtgttcaagcccaaccacactagcagcgtgcctatgaggatctgtgagaaccaggaggagacccagcatggcgtat

SEQ ID NO: 865 - DNA, 140 bp, Artificial Sequence
  Synthetic
atacgccatgctgggtctcctgatgatcttcctctccacggctgtttctgctgatgtggggtgctcggtggacttctcaaaaagagaaacgagatgtggcacgggggtgttcgtctacaacgtacttgggagtcggccat

SEQ ID NO: 866 - DNA, 140 bp, Artificial Sequence
  Synthetic
atggccgactcccaagtacgttgtagacgaacacccccgtgccacatctcgtttctctttttgagaagtccaccgagcaccccacatcagcagaaacagccgtggagaggaagatcatcaggagacccagcatggcgtat

SEQ ID NO: 867 - DNA, 140 bp, Artificial Sequence
  Synthetic
aggccctggctgctgatatggacttctcaaaaagagaaacgagatgtggcacgggggtgttcgtctacaatgacgttgaagcctggagggataggtacaagtaccatcctgactccccccgaccttttgggacagcggtg

SEQ ID NO: 868 - DNA, 140 bp, Artificial Sequence
  Synthetic
caccgctgtcccaaaaggtcggggggagtcaggatggtacttgtacctatccctccaggcttcaacgtcattgtagacgaacacccccgtgccacatctcgtttctctttttgagaagtccatatcagcagccagggcct

SEQ ID NO: 869 - DNA, 140 bp, Artificial Sequence
  Synthetic
aggccctggctgctgatatgatctcctccgtttcaagaatggaaaacatcatgtggaaatcagtggaaggggagctcaatgctatcttagaggagaatggagttcaactgacagttgttggaccttttgggacagcggtg

SEQ ID NO: 870 - DNA, 140 bp, Artificial Sequence
  Synthetic
caccgctgtcccaaaaggtccaacaactgtcagttgaactccattctcctctaagatagcattgagctccccttccactgatttccacatgatgttttccattcttgaaacggaggagatcatatcagcagccagggcct

SEQ ID NO: 871 - DNA, 140 bp, Artificial Sequence
  Synthetic
atacgccatgctgggtctcctgggatctgtaaaaaaccccatgtggagaggtccacaaagattgccagtgcctgtaaatgagctgccccatggctggaaagcctgggggaaatcatatttcgtacttgggagtcggccat

SEQ ID NO: 872 - DNA, 140 bp, Artificial Sequence
  Synthetic
atggccgactcccaagtacgaaatatgatttcccccaggctttccagccatggggcagctcatttacaggcactggcaatctttgtggacctctccacatggggttttttacagatcccaggagacccagcatggcgtat

SEQ ID NO: 873 - DNA, 140 bp, Artificial Sequence
  Synthetic
atacgccatgctgggtctcctgtcagagcggcaaagaccaacaacagttttgttgtcgacggtgacacactgaaggaatgtccgctcaaacacagagcatggaacagtttccttgtggagcgtacttgggagtcggccat

SEQ ID NO: 874 - DNA, 140 bp, Artificial Sequence
  Synthetic
atggccgactcccaagtacgctccacaaggaaactgttccatgctctgtgtttgagcggacattccttcagtgtgtcaccgtcgacaacaaaactgttgttggtctttgccgctctgacaggagacccagcatggcgtat

SEQ ID NO: 875 - DNA, 140 bp, Artificial Sequence
  Synthetic
atacgccatgctgggtctccgatcacgggtttggggtcttccacactagtgtttggcttaaggttagagaagattactcactagagtgtgacccagccgtcataggaacagctgttaaggcgtacttgggagtcggccat

SEQ ID NO: 876 - DNA, 140 bp, Artificial Sequence
  Synthetic
atggccgactcccaagtacgccttaacagctgttcctatgacggctgggtcacactctagtgagtaatcttctctaaccttaagccaaacactagtgtggaagaccccaaacccgtgatcggagacccagcatggcgtat

SEQ ID NO: 877 - DNA, 140 bp, Artificial Sequence
  Synthetic
atacgccatgctgggtctccgaaaggaggccgcgcacagtgatctaggctactggattgaaagtgaaaagaatgacacatggaggttgaagagggcccacctgattgagatgaaaacatgcgtacttgggagtcggccat

SEQ ID NO: 878 - DNA, 140 bp, Artificial Sequence
  Synthetic
atggccgactcccaagtacgcatgttttcatctcaatcaggtgggccctcttcaacctccatgtgtcattcttttcactttcaatccagtagcctagatcactgtgcgcggcctcctttcggagacccagcatggcgtat

SEQ ID NO: 879 - DNA, 140 bp, Artificial Sequence
  Synthetic
atacgccatgctgggtctcctgagtggccaaagtctcacacactgtggacagatggagtagaagaaagtgatctgatcatacccaagtctttagctggtccactcagccaccacaacacccgtacttgggagtcggccat

SEQ ID NO: 880 - DNA, 140 bp, Artificial Sequence
  Synthetic
atggccgactcccaagtacgggtgttgtggtggctgagtggaccagctaaagacttgggtatgatcagatcactttcttctactccatctgtccacagtgtgtgagactttggccactcaggagacccagcatggcgtat

SEQ ID NO: 881 - DNA, 140 bp, Artificial Sequence
  Synthetic
aggccctggctgctgatatgatctgatcatacccaagtctttagctggtccactcagccaccacaacaccagagagggttacagaactcaggcaaaagggccatggcatagtgaagagctgaccttttgggacagcggtg

SEQ ID NO: 882 - DNA, 140 bp, Artificial Sequence
  Synthetic
caccgctgtcccaaaaggtcagctcttcactatgccatggcccttttgcctgagttctgtaaccctctctggtgttgtggtggctgagtggaccagctaaagacttgggtatgatcagatcatatcagcagccagggcct

SEQ ID NO: 883 - DNA, 140 bp, Artificial Sequence
  Synthetic
aggccctggctgctgatatgcatgcggaactagaggaccatctctgagatcaaccactgcaagtggaagggtcattgaggaatggtgctgtagagaatgcacaatgcccccactatcattgaccttttgggacagcggtg

SEQ ID NO: 884 - DNA, 140 bp, Artificial Sequence
  Synthetic
caccgctgtcccaaaaggtcaatgatagtgggggcattgtgcattctctacagcaccattcctcaatgacccttccacttgcagtggttgatctcagagatggtcctctagttccgcatgcatatcagcagccagggcct

SEQ ID NO: 885 - DNA, 140 bp, Artificial Sequence
  Synthetic
atacgccatgctgggtctcctcgagcgaaagacggctgctggtatggaatggagataaggcccaggaaagaaccagagagcaatttagtgaggtcaatggtgacagcgggatcaaccgatcgtacttgggagtcggccat

SEQ ID NO: 886 - DNA, 140 bp, Artificial Sequence
  Synthetic
atggccgactcccaagtacgatcggttgatcccgctgtcaccattgacctcactaaattgctctctggttctttcctgggccttatctccattccataccagcagccgtctttcgctcgaggagacccagcatggcgtat

SEQ ID NO: 887 - DNA, 140 bp, Artificial Sequence
  Synthetic
atacgccatgctgggtctcccacatggaccacttctctcttggagtgcttgtgattctactcatggtgcaggaagggctgaagaagagaatgaccacgaagatcattgtgagcacatcaacgtacttgggagtcggccat

SEQ ID NO: 888 - DNA, 140 bp, Artificial Sequence
  Synthetic
atggccgactcccaagtacgttgatgtgctcacaatgatcttcgtggtcattctcttcttcagcccttcctgcaccatgagtagaatcacaagcactccaagagagaagtggtccatgtgggagacccagcatggcgtat

SEQ ID NO: 889 - DNA, 140 bp, Artificial Sequence
  Synthetic
atacgccatgctgggtctcctggcagtgctggtagccatgatcttgggaggattctcaatgagtgacctggctaagcttgtgatcctgatgggtgctactttcgcagaaatgaatactggcgtacttgggagtcggccat

SEQ ID NO: 890 - DNA, 140 bp, Artificial Sequence
  Synthetic
atggccgactcccaagtacgccagtattcatttctgcgaaagtagcacccatcaggatcacaagcttagccaggtcactcattgagaatcctcccaagatcatggctaccagcactgccaggagacccagcatggcgtat

SEQ ID NO: 891 - DNA, 140 bp, Artificial Sequence
  Synthetic
atacgccatgctgggtctccaggagatgtggctcacttggcattggtcgcggcattcaaagtcagaccagccttgctggtctccttcattttcagagccaattggacaccccgtgagagccgtacttgggagtcggccat

SEQ ID NO: 892 - DNA, 140 bp, Artificial Sequence
  Synthetic
atggccgactcccaagtacggctctcacggggtgtccaattggctctgaaaatgaaggagaccagcaaggctggtctgactttgaatgccgcgaccaatgccaagtgagccacatctcctggagacccagcatggcgtat

SEQ ID NO: 893 - DNA, 140 bp, Artificial Sequence
  Synthetic
atacgccatgctgggtctccatgctgctagccctggcttcgtgtcttttgcaaactgcaatttcagctcttgaaggtgacttgatggtcctcgttaatggatttgctttggcctggttggcgtacttgggagtcggccat

SEQ ID NO: 894 - DNA, 140 bp, Artificial Sequence
  Synthetic
atggccgactcccaagtacgccaaccaggccaaagcaaatccattaacgaggaccatcaagtcaccttcaagagctgaaattgcagtttgcaaaagacacgaagccagggctagcagcatggagacccagcatggcgtat

SEQ ID NO: 895 - DNA, 140 bp, Artificial Sequence
  Synthetic
atacgccatgctgggtctcccaatacgagcaatggccgtgccacgcactgacaacattgctctagcaatcctggctgctctgacaccactagcccgaggcacactgctcgtggcatggagcgtacttgggagtcggccat

SEQ ID NO: 896 - DNA, 140 bp, Artificial Sequence
  Synthetic
atggccgactcccaagtacgctccatgccacgagcagtgtgcctcgggctagtggtgtcagagcagccaggattgctagagcaatgttgtcagtgcgtggcacggccattgctcgtattgggagacccagcatggcgtat

SEQ ID NO: 897 - DNA, 140 bp, Artificial Sequence
  Synthetic
atacgccatgctgggtctccagcgggcctcgccacttgtggagggttcatgctcctctccttgaaaggaaaaggtagtgtgaagaagaacctgccatttgtcatggccttgggaatgacccgtacttgggagtcggccat

SEQ ID NO: 898 - DNA, 140 bp, Artificial Sequence
  Synthetic
atggccgactcccaagtacgggtcattcccaaggccatgacaaatggcaggttcttcttcacactaccttttcctttcaaggagaggagcatgaaccctccacaagtggcgaggcccgctggagacccagcatggcgtat

SEQ ID NO: 899 - DNA, 140 bp, Artificial Sequence
  Synthetic
atacgccatgctgggtctccgctgtgaggatagtggaccccattaacgtggtgggactactactactcacaaggagtgggaagcggagctggccccccagtgaagtgcttacagctgttgcgtacttgggagtcggccat

SEQ ID NO: 900 - DNA, 140 bp, Artificial Sequence
  Synthetic
atggccgactcccaagtacgcaacagctgtaagcacttcactggggggccagctccgcttcccactccttgtgagtagtagtagtcccaccacgttaatggggtccactatcctcacagcggagacccagcatggcgtat

SEQ ID NO: 901 - DNA, 140 bp, Artificial Sequence
  Synthetic
aggccctggctgctgatatggcctgatatgtgcactggccggagggtttgccaaggcagacattgagatggctgggcccatggctgcagtaggcttgctaattgtcagttatgtggtctcgaccttttgggacagcggtg

SEQ ID NO: 902 - DNA, 140 bp, Artificial Sequence
  Synthetic
caccgctgtcccaaaaggtcgagaccacataactgacaattagcaagcctactgcagccatgggcccagccatctcaatgtctgccttggcaaaccctccggccagtgcacatatcaggccatatcagcagccagggcct

SEQ ID NO: 903 - DNA, 140 bp, Artificial Sequence
  Synthetic
atacgccatgctgggtctccaggaaagagtgtggatatgtacattgaaagagcaggtgacatcacatgggaaaaagacgcggaagttactggaaatagtcctcggcttgacgtggcactacgtacttgggagtcggccat

SEQ ID NO: 904 - DNA, 140 bp, Artificial Sequence
  Synthetic
atggccgactcccaagtacgtagtgccacgtcaagccgaggactatttccagtaacttccgcgtctttttcccatgtgatgtcacctgctctttcaatgtacatatccacactctttcctggagacccagcatggcgtat

SEQ ID NO: 905 - DNA, 140 bp, Artificial Sequence
  Synthetic
atacgccatgctgggtctccgatgagagtggtgatttctctctggtagaggaagatggtccacccatgagagagatcatactcaaggtggtcctgatggccatctgtggcatgaacccaacgtacttgggagtcggccat

SEQ ID NO: 906 - DNA, 140 bp, Artificial Sequence
  Synthetic
atggccgactcccaagtacgttgggttcatgccacagatggccatcaggaccaccttgagtatgatctctctcatgggtggaccatcttcctctaccagagagaaatcaccactctcatcggagacccagcatggcgtat

SEQ ID NO: 907 - DNA, 140 bp, Artificial Sequence
  Synthetic
atacgccatgctgggtctcctagccataccttttgctgcaggagcgtggtatgtgtatgtgaagactgggaaaaggagtggtgccctctgggatgtgccagctcctaaagaagtgaaaaacgtacttgggagtcggccat

SEQ ID NO: 908 - DNA, 140 bp, Artificial Sequence
  Synthetic
atggccgactcccaagtacgtttttcacttctttaggagctggcacatcccagagggcaccactccttttcccagtcttcacatacacataccacgctcctgcagcaaaaggtatggctaggagacccagcatggcgtat

SEQ ID NO: 909 - DNA, 140 bp, Artificial Sequence
  Synthetic
atacgccatgctgggtctccaggagagaccacagatggagtatacagagtgatgacccgcagattgctgggttcaacacaggttggagtgggagtcatgcaggagggagtcttccacacccgtacttgggagtcggccat

SEQ ID NO: 910 - DNA, 140 bp, Artificial Sequence
  Synthetic
atggccgactcccaagtacgggtgtggaagactccctcctgcatgactcccactccaacctgtgttgaacccagcaatctgcgggtcatcactctgtatactccatctgtggtctctcctggagacccagcatggcgtat

SEQ ID NO: 911 - DNA, 140 bp, Artificial Sequence
  Synthetic
atacgccatgctgggtctccatgtggcacgtcacaaaaggagccgcactgaggagcggtgaagggagacttgatccatactggggtgatgtcaagcaggacttggtgtcatactgtgggccgtacttgggagtcggccat

SEQ ID NO: 912 - DNA, 140 bp, Artificial Sequence
  Synthetic
atggccgactcccaagtacggcccacagtatgacaccaagtcctgcttgacatcaccccagtatggatcaagtctcccttcaccgctcctcagtgcggctccttttgtgacgtgccacatggagacccagcatggcgtat

SEQ ID NO: 913 - DNA, 140 bp, Artificial Sequence
  Synthetic
atacgccatgctgggtctcccttggaagctggatgcagcttgggatggacttagtgaggtgcagctcttggcagtacctcccggagagagggccagaaacatccagactctgcctggaatcgtacttgggagtcggccat

SEQ ID NO: 914 - DNA, 140 bp, Artificial Sequence
  Synthetic
atggccgactcccaagtacgattccaggcagagtctggatgtttctggccctctctccgggaggtactgccaagagctgcacctcactaagtccatcccaagctgcatccagcttccaagggagacccagcatggcgtat

SEQ ID NO: 915 - DNA, 140 bp, Artificial Sequence
  Synthetic
aggccctggctgctgatatggcagtacctcccggagagagggccagaaacatccagactctgcctggaatattcaagacaaaggatggggacatcggagcagttgctctggactaccccggaccttttgggacagcggtg

SEQ ID NO: 916 - DNA, 140 bp, Artificial Sequence
  Synthetic
caccgctgtcccaaaaggtccggggtagtccagagcaactgctccgatgtccccatcctttgtcttgaatattccaggcagagtctggatgtttctggccctctctccgggaggtactgccatatcagcagccagggcct

SEQ ID NO: 917 - DNA, 140 bp, Artificial Sequence
  Synthetic
aggccctggctgctgatatgcaggaacctcaggatctccgatcctagacaaatgcggaagagtgataggactttatggcaatggggttgtgatcaagaatggaagctatgttagtgccatgaccttttgggacagcggtg

SEQ ID NO: 918 - DNA, 140 bp, Artificial Sequence
  Synthetic
caccgctgtcccaaaaggtcatggcactaacatagcttccattcttgatcacaaccccattgccataaagtcctatcactcttccgcatttgtctaggatcggagatcctgaggttcctgcatatcagcagccagggcct

SEQ ID NO: 919 - DNA, 140 bp, Artificial Sequence
  Synthetic
atacgccatgctgggtctccaacccagggaaagagggaggaggagactccggttgaatgtttcgaaccctcgatgctgaagaagaagcagctaactgtcctggacctgcatccaggagcccgtacttgggagtcggccat

SEQ ID NO: 920 - DNA, 140 bp, Artificial Sequence
  Synthetic
atggccgactcccaagtacgggctcctggatgcaggtccaggacagttagctgcttcttcttcagcatcgagggttcgaaacattcaaccggagtctcctcctccctctttccctgggttggagacccagcatggcgtat

SEQ ID NO: 921 - DNA, 140 bp, Artificial Sequence
  Synthetic
atacgccatgctgggtctccggaaagactaggagagttcttcctgaaatagtccgtgaagccataaaaaagagactccgcacagtgatcttggctccaaccagggttgtcgctgctgagacgtacttgggagtcggccat

SEQ ID NO: 922 - DNA, 140 bp, Artificial Sequence
  Synthetic
atggccgactcccaagtacgtctcagcagcgacaaccctggttggagccaagatcactgtgcggagtctcttttttatggcttcacggactatttcaggaagaactctcctagtctttccggagacccagcatggcgtat

SEQ ID NO: 923 - DNA, 140 bp, Artificial Sequence
  Synthetic
aggccctggctgctgatatgcaatcatggacacagaagtggaagtcccagagagagcctggagctcaggctttgattgggtgacagaccattctgggaaaacagtttggttcgttccaaggaccttttgggacagcggtg

SEQ ID NO: 924 - DNA, 140 bp, Artificial Sequence
  Synthetic
caccgctgtcccaaaaggtccttggaacgaaccaaactgttttcccagaatggtctgtcacccaatcaaagcctgagctccaggctctctctgggacttccacttctgtgtccatgattgcatatcagcagccagggcct

SEQ ID NO: 925 - DNA, 140 bp, Artificial Sequence
  Synthetic
atacgccatgctgggtctcctgtgagaaatggaaatgaaatcacagcctgcctgacaaaggctggaaagcgggtcatacagctcagcaggaagacttttgagacagagttccagaaaacacgtacttgggagtcggccat

SEQ ID NO: 926 - DNA, 140 bp, Artificial Sequence
  Synthetic
atggccgactcccaagtacgtgttttctggaactctgtctcaaaagtcttcctgctgagctgtatgacccgctttccagcctttgtcaggcaggctgtgatttcatttccatttctcacaggagacccagcatggcgtat

SEQ ID NO: 927 - DNA, 140 bp, Artificial Sequence
  Synthetic
atacgccatgctgggtctccaaaaaccaagagtgggactttgtcataacaactgacatctcagagatgggcgccaatttcaaggctgaccgggtcatagactctaggagatgcctaaagccgtacttgggagtcggccat

SEQ ID NO: 928 - DNA, 140 bp, Artificial Sequence
  Synthetic
atggccgactcccaagtacggctttaggcatctcctagagtctatgacccggtcagccttgaaattggcgcccatctctgagatgtcagttgttatgacaaagtcccactcttggtttttggagacccagcatggcgtat

SEQ ID NO: 929 - DNA, 140 bp, Artificial Sequence
  Synthetic
atacgccatgctgggtctcccagtcatacttgatggtgagagagtcatcttggctgggcccatgcctgtcacgcatgctagtgctgctcagaggagaggacgtataggcaggaaccctaacgtacttgggagtcggccat

SEQ ID NO: 930 - DNA, 140 bp, Artificial Sequence
  Synthetic
atggccgactcccaagtacgttagggttcctgcctatacgtcctctcctctgagcagcactagcatgcgtgacaggcatgggcccagccaagatgactctctcaccatcaagtatgactgggagacccagcatggcgtat

SEQ ID NO: 931 - DNA, 140 bp, Artificial Sequence
  Synthetic
aggccctggctgctgatatgacgcatgctagtgctgctcagaggagaggacgtataggcaggaaccctaacaaacctggagatgagtacatgtatggaggtgggtgtgcagagactgatggaccttttgggacagcggtg

SEQ ID NO: 932 - DNA, 140 bp, Artificial Sequence
  Synthetic
caccgctgtcccaaaaggtccatcagtctctgcacacccacctccatacatgtactcatctccaggtttgttagggttcctgcctatacgtcctctcctctgagcagcactagcatgcgtcatatcagcagccagggcct

SEQ ID NO: 933 - DNA, 140 bp, Artificial Sequence
  Synthetic
atacgccatgctgggtctccaagaccacgcacactggcttgaagcaagaatgcttcttgacaacatctacctccaggatggcctcatagcctcgctctatcggcctgaggccgataaggtcgtacttgggagtcggccat

SEQ ID NO: 934 - DNA, 140 bp, Artificial Sequence
  Synthetic
atggccgactcccaagtacgaccttatcggcctcaggccgatagagcgaggctatgaggccatcctggaggtagatgttgtcaagaagcattcttgcttcaagccagtgtgcgtggtcttggagacccagcatggcgtat

SEQ ID NO: 935 - DNA, 140 bp, Artificial Sequence
  Synthetic
aggccctggctgctgatatgctccaggatggcctcatagcctcgctctatcggcctgaggccgataaggtggccgccattgagggagagtttaagctgaggacagagcaaaggaagacctgaccttttgggacagcggtg

SEQ ID NO: 936 - DNA, 140 bp, Artificial Sequence
  Synthetic
caccgctgtcccaaaaggtcaggtcttcctttgctctgtcctcagcttaaactctccctcaatggcggccaccttatcggcctcaggccgatagagcgaggctatgaggccatcctggagcatatcagcagccagggcct

SEQ ID NO: 937 - DNA, 140 bp, Artificial Sequence
  Synthetic
atacgccatgctgggtctccttgtggaacttatgaagagaggagaccttcccgtttggctagcctatcaggttgcatctgccggaataacttacacagacagaagatggtgctttgatggcgtacttgggagtcggccat

SEQ ID NO: 938 - DNA, 140 bp, Artificial Sequence
  Synthetic
atggccgactcccaagtacgccatcaaagcaccatcttctgtctgtgtaagttattccggcagatgcaacctgataggctagccaaacgggaaggtctcctctcttcataagttccacaaggagacccagcatggcgtat

SEQ ID NO: 939 - DNA, 140 bp, Artificial Sequence
  Synthetic
atacgccatgctgggtctcccacaactaacaacaccataatggaagacagtgtaccagcagaggtgtggacaaaatatggagagaagagagtgctcaaaccaagatggatggatgctagacgtacttgggagtcggccat

SEQ ID NO: 940 - DNA, 140 bp, Artificial Sequence
  Synthetic
atggccgactcccaagtacgtctagcatccatccatcttggtttgagcactctcttctctccatattttgtccacacctctgctggtacactgtcttccattatggtgttgttagttgtgggagacccagcatggcgtat

SEQ ID NO: 941 - DNA, 140 bp, Artificial Sequence
  Synthetic
atacgccatgctgggtctccgtctgttcagatcatgccgccctgaagtcgttcaaagagtttgctgccgggaaaagaggagcggctttgggagtaatggaggccctgggaacattgccagcgtacttgggagtcggccat

SEQ ID NO: 942 - DNA, 140 bp, Artificial Sequence
  Synthetic
atggccgactcccaagtacgctggcaatgttcccagggcctccattactcccaaagccgctcctcttttcccggcagcaaactctttgaacgacttcagggcggcatgatctgaacagacggagacccagcatggcgtat

SEQ ID NO: 943 - DNA, 140 bp, Artificial Sequence
  Synthetic
atacgccatgctgggtctccgacacatgacagagaggtttcaggaagccattgacaatctcgctgtgcttatgcgagcagaaactggaagcaggccttacaaggcagcggcagccccactcgtacttgggagtcggccat

SEQ ID NO: 944 - DNA, 140 bp, Artificial Sequence
  Synthetic
atggccgactcccaagtacgagtggggctgccgctgccttgtaaggcctgcttccagtttctgctcgcataagcacagcgagattgtcaatggcttcctgaaacctctctgtcatgtgtcggagacccagcatggcgtat

SEQ ID NO: 945 - DNA, 140 bp, Artificial Sequence
  Synthetic
atacgccatgctgggtctccgccggagaccctagagaccatcatgctcttaggtttgctgggaacagtttcgttggggatattctttgtcttgatgcggaacaagggcatcgggaagatgcgtacttgggagtcggccat

SEQ ID NO: 946 - DNA, 140 bp, Artificial Sequence
  Synthetic
atggccgactcccaagtacgcatcttcccgatgcccttgttccgcatcaagacaaagaatatccccaacgaaactgttcccagcaaacctaagagcatgatggtctctagggtctccggcggagacccagcatggcgtat

SEQ ID NO: 947 - DNA, 140 bp, Artificial Sequence
  Synthetic
atacgccatgctgggtctccgggtttggaatggtaactcttggggccagtgcatggctcatgtggctttcggaaattgaaccagccagaattgcatgtgtcctcattgttgtgtttttgtcgtacttgggagtcggccat

SEQ ID NO: 948 - DNA, 140 bp, Artificial Sequence
  Synthetic
atggccgactcccaagtacgacaaaaacacaacaatgaggacacatgcaattctggctggttcaatttccgaaagccacatgagccatgcactggccccaagagttaccattccaaacccggagacccagcatggcgtat

SEQ ID NO: 949 - DNA, 140 bp, Artificial Sequence
  Synthetic
atacgccatgctgggtctcctactggtggtactcatacctgagccagagaagcaaagatctccccaggataaccagatggcaatcatcatcatggtggcagtgggccttctggggttgatcgtacttgggagtcggccat

SEQ ID NO: 950 - DNA, 140 bp, Artificial Sequence
  Synthetic
atggccgactcccaagtacgatcaaccccagaaggcccactgccaccatgatgatgattgccatctggttatcctggggagatctttgcttctctggctcaggtatgagtaccaccagtaggagacccagcatggcgtat

SEQ ID NO: 951 - DNA, 140 bp, Artificial Sequence
  Synthetic
atacgccatgctgggtctccaactgcaaatgaacttggatggctggaaagaacaaaaaatgacatagctcatctaatgggaaggagagaagaaggagtaactatgggattctcaatggaccgtacttgggagtcggccat

SEQ ID NO: 952 - DNA, 140 bp, Artificial Sequence
  Synthetic
atggccgactcccaagtacggtccattgagaatcccatagttactccttcttctctccttcccattagatgagctatgtcattttttgttctttccagccatccaagttcatttgcagttggagacccagcatggcgtat

SEQ ID NO: 953 - DNA, 140 bp, Artificial Sequence
  Synthetic
atacgccatgctgggtctccatcgatttgaggccggcctccgcctgggctatctatgctgcattgacaactctcatcaccccagccgtccaacatgcggtaaccacttcatataacaactcgtacttgggagtcggccat

SEQ ID NO: 954 - DNA, 140 bp, Artificial Sequence
  Synthetic
atggccgactcccaagtacgagttgttatatgaagtggttaccgcatgttggacggctggggtgatgagagttgtcaatgcagcatagatagcccaggcggaggccggcctcaaatcgatggagacccagcatggcgtat

SEQ ID NO: 955 - DNA, 140 bp, Artificial Sequence
  Synthetic
atacgccatgctgggtctccactccttaatggcgatggccacacaagctggagtgctgtttggcatgggcaaagggatgccattttatgcatgggactttggagtcccgctgctaatgatcgtacttgggagtcggccat

SEQ ID NO: 956 - DNA, 140 bp, Artificial Sequence
  Synthetic
atggccgactcccaagtacgatcattagcagcgggactccaaagtcccatgcataaaatggcatccctttgcccatgccaaacagcactccagcttgtgtggccatcgccattaaggagtggagacccagcatggcgtat

SEQ ID NO: 957 - DNA, 140 bp, Artificial Sequence
  Synthetic
atacgccatgctgggtctccgggttgctactcacaattaacacccctgaccctgatagtggctatcattctgcttgtggcacactacatgtacttgatcccaggcctacaggcagcagcacgtacttgggagtcggccat

SEQ ID NO: 958 - DNA, 140 bp, Artificial Sequence
  Synthetic
atggccgactcccaagtacgtgctgctgcctgtaggcctgggatcaagtacatgtagtgtgccacaagcagaatgatagccactatcagggtcaggggtgttaattgtgagtagcaacccggagacccagcatggcgtat

SEQ ID NO: 959 - DNA, 140 bp, Artificial Sequence
  Synthetic
aggccctggctgctgatatgaagtggagaagaagatgggacaagtgttactcatagcagtagccatctccagtgctgtgctgctgcggactgcttggggatggggggaagctggagctctgaccttttgggacagcggtg

SEQ ID NO: 960 - DNA, 140 bp, Artificial Sequence
  Synthetic
caccgctgtcccaaaaggtcagagctccagcttccccccatccccaagcagtccgcagcagcacagcactggagatggctactgctatgagtaacacttgtcccatcttcttctccacttcatatcagcagccagggcct

SEQ ID NO: 961 - DNA, 140 bp, Artificial Sequence
  Synthetic
atacgccatgctgggtctccgatcacagcagcaacctccactttgtgggaaggttctccaaacaaatactggaactcctctacagccacctcactgtgcaacatctttagaggaagttaccgtacttgggagtcggccat

SEQ ID NO: 962 - DNA, 140 bp, Artificial Sequence
  Synthetic
atggccgactcccaagtacggtaacttcctctaaagatgttgcacagtgaggtggctgtagaggagttccagtatttgtttggagaaccttcccacaaagtggaggttgctgctgtgatcggagacccagcatggcgtat

SEQ ID NO: 963 - DNA, 140 bp, Artificial Sequence
  Synthetic
atacgccatgctgggtctccctggcaggcgcttctcttatttacacagtgacaagaaatgctggcctggtcaagagacgtggaggtggaacgggagagactctaggagagaagtggaaagcgtacttgggagtcggccat

SEQ ID NO: 964 - DNA, 140 bp, Artificial Sequence
  Synthetic
atggccgactcccaagtacgctttccacttctctcctagagtctctcccgttccacctccacgtctcttgaccaggccagcatttcttgtcactgtgtaaataagagaagcgcctgccagggagacccagcatggcgtat

SEQ ID NO: 965 - DNA, 140 bp, Artificial Sequence
  Synthetic
aggccctggctgctgatatgcaagagacgtggaggtggaacgggagagactctaggagagaagtggaaagctcgcctgaatcagatgtcggccctggagttctactcttacaaaaagtcggaccttttgggacagcggtg

SEQ ID NO: 966 - DNA, 140 bp, Artificial Sequence
  Synthetic
caccgctgtcccaaaaggtccgactttttgtaagagtagaactccagggccgacatctgattcaggcgagctttccacttctctcctagagtctctcccgttccacctccacgtctcttgcatatcagcagccagggcct

SEQ ID NO: 967 - DNA, 140 bp, Artificial Sequence
  Synthetic
atacgccatgctgggtctccggcatcactgaagtgtgtagagaggaggctcgccgcgccctcaaggatggagtggccacaggaggacatgctgtatcccggggaagcgcaaagctcagatcgtacttgggagtcggccat

SEQ ID NO: 968 - DNA, 140 bp, Artificial Sequence
  Synthetic
atggccgactcccaagtacgatctgagctttgcgcttccccgggatacagcatgtcctcctgtggccactccatccttgagggcgcggcgagcctcctctctacacacttcagtgatgccggagacccagcatggcgtat

SEQ ID NO: 969 - DNA, 140 bp, Artificial Sequence
  Synthetic
atacgccatgctgggtctccggctggtggagagaggatacctgcagccccatggaaaggttgttgacctcggatgtggcagagggggttggagctattatgccgctaccatccggaaagtcgtacttgggagtcggccat

SEQ ID NO: 970 - DNA, 140 bp, Artificial Sequence
  Synthetic
atggccgactcccaagtacgactttccggatggtagcggcataatagctccaaccccctctgccacatccgaggtcaacaacctttccatggggctgcaggtatcctctctccaccagccggagacccagcatggcgtat

SEQ ID NO: 971 - DNA, 140 bp, Artificial Sequence
  Synthetic
atacgccatgctgggtctccgcaggaggtgaaaggatacacaaagggaggtcccggtcatgaagaacccatgctggtgcaaagctatggatggaacatagttcgtctcaagagtggagtgcgtacttgggagtcggccat

SEQ ID NO: 972 - DNA, 140 bp, Artificial Sequence
  Synthetic
atggccgactcccaagtacgcactccactcttgagacgaactatgttccatccatagctttgcaccagcatgggttcttcatgaccgggacctccctttgtgtatcctttcacctcctgcggagacccagcatggcgtat

SEQ ID NO: 973 - DNA, 140 bp, Artificial Sequence
  Synthetic
atacgccatgctgggtctccgacgtcttccacatggcggctgagccgtgtgatactctgctgtgtgacataggtgagtcatcatccagtcctgaagtagaagagacgcgaacactcagagcgtacttgggagtcggccat

SEQ ID NO: 974 - DNA, 140 bp, Artificial Sequence
  Synthetic
atggccgactcccaagtacgctctgagtgttcgcgtctcttctacttcaggactggatgatgactcacctatgtcacacagcagagtatcacacggctcagccgccatgtggaagacgtcggagacccagcatggcgtat

SEQ ID NO: 975 - DNA, 140 bp, Artificial Sequence
  Synthetic
atacgccatgctgggtctcctgctctctatggtgggggactggcttgaaaaaagaccaggggccttctgcataaaggtgctgtgcccatacaccagcactatgatggagaccatggagcgcgtacttgggagtcggccat

SEQ ID NO: 976 - DNA, 140 bp, Artificial Sequence
  Synthetic
atggccgactcccaagtacgcgctccatggtctccatcatagtgctggtgtatgggcacagcacctttatgcagaaggcccctggtcttttttcaagccagtcccccaccatagagagcaggagacccagcatggcgtat

SEQ ID NO: 977 - DNA, 140 bp, Artificial Sequence
  Synthetic
atacgccatgctgggtctccactgcaacgtaggtatgggggaggattagtcagagtgccattgtctcgcaactccacacatgagatgtattgggtctctggagcaaaaagcaacatcatacgtacttgggagtcggccat

SEQ ID NO: 978 - DNA, 140 bp, Artificial Sequence
  Synthetic
atggccgactcccaagtacgtatgatgttgctttttgctccagagacccaatacatctcatgtgtggagttgcgagacaatggcactctgactaatcctcccccatacctacgttgcagtggagacccagcatggcgtat

SEQ ID NO: 979 - DNA, 140 bp, Artificial Sequence
  Synthetic
atacgccatgctgggtctccaaaagtgtgtccaccacaagccagctcctcctgggacgcatggatgggcccaggaggccagtgaaatatgaggaggatgtgaacctcggctcgggcacaccgtacttgggagtcggccat

SEQ ID NO: 980 - DNA, 140 bp, Artificial Sequence
  Synthetic
atggccgactcccaagtacggtgtgcccgagccgaggttcacatcctcctcatatttcactggcctcctgggcccatccatgcgtcccaggaggagctggcttgtggtggacacacttttggagacccagcatggcgtat

SEQ ID NO: 981 - DNA, 140 bp, Artificial Sequence
  Synthetic
atacgccatgctgggtctccgagctgtggcaagctgtgctgaggctcccaacatgaagatcattggtaagcgcattgagagaatccgcagtgaacatgcagaaacatggttctttgatgacgtacttgggagtcggccat

SEQ ID NO: 982 - DNA, 140 bp, Artificial Sequence
  Synthetic
atggccgactcccaagtacgtcatcaaagaaccatgtttctgcatgttcactgcggattctctcaatgcgcttaccaatgatcttcatgttgggagcctcagcacagcttgccacagctcggagacccagcatggcgtat

SEQ ID NO: 983 - DNA, 140 bp, Artificial Sequence
  Synthetic
atacgccatgctgggtctccaaaccacccatacaggacatgggcttaccatgggagctacgaagcccccacgcaagggtcagcgtcttccctcgtgaatggggttgttaggctcctgtcacgtacttgggagtcggccat

SEQ ID NO: 984 - DNA, 140 bp, Artificial Sequence
  Synthetic
atggccgactcccaagtacgtgacaggagcctaacaaccccattcacgagggaagacgctgacccttgcgtgggggcttcgtagctcccatggtaagcccatgtcctgtatgggtggtttggagacccagcatggcgtat

SEQ ID NO: 985 - DNA, 140 bp, Artificial Sequence
  Synthetic
atacgccatgctgggtctccaagccctgggatgtagtgactggagttacaggaatagctatgactgacaccacaccatatggccaacaaagagtcttcaaagaaaaagtggacaccagggcgtacttgggagtcggccat

SEQ ID NO: 986 - DNA, 140 bp, Artificial Sequence
  Synthetic
atggccgactcccaagtacgccctggtgtccactttttctttgaagactctttgttggccatatggtgtggtgtcagtcatagctattcctgtaactccagtcactacatcccagggcttggagacccagcatggcgtat

SEQ ID NO: 987 - DNA, 140 bp, Artificial Sequence
  Synthetic
atacgccatgctgggtctcctgccagatccccaagaaggcactcgccagacaatgaacatggtctcgtcctggctgtggaaggagctgggaaaacgcaagcggccacgcgtctgcaccaacgtacttgggagtcggccat

SEQ ID NO: 988 - DNA, 140 bp, Artificial Sequence
  Synthetic
atggccgactcccaagtacgttggtgcagacgcgtggccgcttgcgttttcccagctccttccacagccaggacgagaccatgttcattgtctggcgagtgccttcttggggatctggcaggagacccagcatggcgtat

SEQ ID NO: 989 - DNA, 140 bp, Artificial Sequence
  Synthetic
atacgccatgctgggtctccagaagagttcatcaacaaggtgcgcagcaatgcagcgctgggagcaatatttgaagaggaaaaagaatggaagacggccgtggaagctgtgaatgatccacgtacttgggagtcggccat

SEQ ID NO: 990 - DNA, 140 bp, Artificial Sequence
  Synthetic
atggccgactcccaagtacgtggatcattcacagcttccacggccgtcttccattctttttcctcttcaaatattgctcccagcgctgcattgctgcgcaccttgttgatgaactcttctggagacccagcatggcgtat

SEQ ID NO: 991 - DNA, 140 bp, Artificial Sequence
  Synthetic
atacgccatgctgggtctccaggttttgggccctagtggataaggagagagagcatcacctaagaggagagtgtcatagctgtgtgtacaacatgatgggaaaaagagagaagaagaaagcgtacttgggagtcggccat

SEQ ID NO: 992 - DNA, 140 bp, Artificial Sequence
  Synthetic
atggccgactcccaagtacgctttcttcttctctctttttcccatcatgttgtacacacagctatgacactctcctcttaggtgatgctctctctccttatccactagggcccaaaacctggagacccagcatggcgtat

SEQ ID NO: 993 - DNA, 140 bp, Artificial Sequence
  Synthetic
atacgccatgctgggtctccaggttttgggccctagtggataaggagagagagcatcacctaagaggagagtgtcatagctgtgtgtacaacatgatgggaaaaagagagaagaagtaagcgtacttgggagtcggccat

SEQ ID NO: 994 - DNA, 140 bp, Artificial Sequence
  Synthetic
atggccgactcccaagtacgcttacttcttctctctttttcccatcatgttgtacacacagctatgacactctcctcttaggtgatgctctctctccttatccactagggcccaaaacctggagacccagcatggcgtat

SEQ ID NO: 995 - DNA, 140 bp, Artificial Sequence
  Synthetic
atacgccatgctgggtctccaggttttgggccctagtggataaggagagagagcatcacctaagaggagagtgtcatagctgtgtgtacaacatgatgggaaaaagagagaagaagcaagcgtacttgggagtcggccat

SEQ ID NO: 996 - DNA, 140 bp, Artificial Sequence
  Synthetic
atggccgactcccaagtacgcttgcttcttctctctttttcccatcatgttgtacacacagctatgacactctcctcttaggtgatgctctctctccttatccactagggcccaaaacctggagacccagcatggcgtat

SEQ ID NO: 997 - DNA, 140 bp, Artificial Sequence
  Synthetic
atacgccatgctgggtctccaggttttgggccctagtggataaggagagagagcatcacctaagaggagagtgtcatagctgtgtgtacaacatgatgggaaaaagagagaagaaggaagcgtacttgggagtcggccat

SEQ ID NO: 998 - DNA, 140 bp, Artificial Sequence
  Synthetic
atggccgactcccaagtacgcttccttcttctctctttttcccatcatgttgtacacacagctatgacactctcctcttaggtgatgctctctctccttatccactagggcccaaaacctggagacccagcatggcgtat

SEQ ID NO: 999 - DNA, 140 bp, Artificial Sequence
  Synthetic
atacgccatgctgggtctccgagaattcgggaaagcaaaaggcagccgcgccatctggtacatgtggttgggagccaggtttctggagtttgaatcactggggtttctgaatgaagatcacgtacttgggagtcggccat

SEQ ID NO: 1000 - DNA, 140 bp, Artificial Sequence
  Synthetic
atggccgactcccaagtacgtgatcttcattcagaaaccccagtgattcaaactccagaaacctggctcccaaccacatgtaccagatggcgcggctgccttttgctttcccgaattctcggagacccagcatggcgtat

SEQ ID NO: 1001 - DNA, 140 bp, Artificial Sequence
  Synthetic
atacgccatgctgggtctccctggatgggaagagagaactcaggaggtggtgtcgaagggctaggactgcaaagacttggatatattctagaagaaatgaatcgggcaccaggaggaaagcgtacttgggagtcggccat

SEQ ID NO: 1002 - DNA, 140 bp, Artificial Sequence
  Synthetic
atggccgactcccaagtacgctttcctcctggtgcccgattcatttcttctagaatatatccaagtctttgcagtcctagcccttcgacaccacctcctgagttctctcttcccatccagggagacccagcatggcgtat

SEQ ID NO: 1003 - DNA, 140 bp, Artificial Sequence
  Synthetic
atacgccatgctgggtctccatgtatgcagatgacaccgctggttgggatacccgcattagtaagtttgatctggagaatgaagccttgattaccaaccaaatggaggaagggcacagagcgtacttgggagtcggccat

SEQ ID NO: 1004 - DNA, 140 bp, Artificial Sequence
  Synthetic
atggccgactcccaagtacgctctgtgcccttcctccatttggttggtaatcaaggcttcattctccagatcaaacttactaatgcgggtatcccaaccagcggtgtcatctgcatacatggagacccagcatggcgtat

SEQ ID NO: 1005 - DNA, 140 bp, Artificial Sequence
  Synthetic
atacgccatgctgggtctccctctggcgttggctgtgattaaatacacataccaaaacaaagtggtgaaggtccttagaccagctgaaggaggaaaaacagttatggacatcatttcaagcgtacttgggagtcggccat

SEQ ID NO: 1006 - DNA, 140 bp, Artificial Sequence
  Synthetic
atggccgactcccaagtacgcttgaaatgatgtccataactgtttttcctccttcagctggtctaaggaccttcaccactttgttttggtatgtgtatttaatcacagccaacgccagagggagacccagcatggcgtat

SEQ ID NO: 1007 - DNA, 140 bp, Artificial Sequence
  Synthetic
atacgccatgctgggtctccacaagaccagagagggagtgggcaagttgtcacttatgctctcaacacgtttaccaacttagtggtgcagcttattcggaacatggaggctgaggaagtgcgtacttgggagtcggccat

SEQ ID NO: 1008 - DNA, 140 bp, Artificial Sequence
  Synthetic
atggccgactcccaagtacgcacttcctcagcctccatgttccgaataagctgcaccactaagttggtaaacgtgttgagagcataagtgacaacttgcccactccctctctggtcttgtggagacccagcatggcgtat

SEQ ID NO: 1009 - DNA, 140 bp, Artificial Sequence
  Synthetic
atacgccatgctgggtctccttagagatgcaagacttatggctgttgaggaagccagagaaagtgactagatggttgcagagtaatggatgggacagactcaaacgaatggcagtcagtgcgtacttgggagtcggccat

SEQ ID NO: 1010 - DNA, 140 bp, Artificial Sequence
  Synthetic
atggccgactcccaagtacgcactgactgccattcgtttgagtctgtcccatccattactctgcaaccatctagtcactttctctggcttcctcaacagccataagtcttgcatctctaaggagacccagcatggcgtat

SEQ ID NO: 1011 - DNA, 140 bp, Artificial Sequence
  Synthetic
atacgccatgctgggtctccgagatgactgtgttgtgaagccaattgatgataggtttgcatgctgcctcaggttcctaaacgacatggggaaagttaggaaagacacacaggaatggaacgtacttgggagtcggccat

SEQ ID NO: 1012 - DNA, 140 bp, Artificial Sequence
  Synthetic
atggccgactcccaagtacgttccattcctgtgtgtctttcctaactttccccatgtcgtttaggaacctgaggcagcatgcaaacctatcatcaattggcttcacaacacagtcatctcggagacccagcatggcgtat

SEQ ID NO: 1013 - DNA, 140 bp, Artificial Sequence
  Synthetic
atacgccatgctgggtctccaccctcgactggatggagcaattgggaagaagtccctttctgctcccaccacttcaacaagctgcacctcaaggatggtagatccattgtggtcccttgccgtacttgggagtcggccat

SEQ ID NO: 1014 - DNA, 140 bp, Artificial Sequence
  Synthetic
atggccgactcccaagtacggcaagggaccacaatggatctaccatccttgaggtgcagcttgttgaagtggtgggagcagaaagggacttcttcccaattgctccatccagtcgagggtggagacccagcatggcgtat

SEQ ID NO: 1015 - DNA, 140 bp, Artificial Sequence
  Synthetic
atacgccatgctgggtctcccgccaccaagatgaactgattggccgagcccgtgtatcaccaggggcaggatggagcatccgggagactgcctgtcttgcaaaatcatatgcacagatgtcgtacttgggagtcggccat

SEQ ID NO: 1016 - DNA, 140 bp, Artificial Sequence
  Synthetic
atggccgactcccaagtacgacatctgtgcatatgattttgcaagacaggcagtctcccggatgctccatcctgcccctggtgatacacgggctcggccaatcagttcatcttggtggcgggagacccagcatggcgtat

SEQ ID NO: 1017 - DNA, 140 bp, Artificial Sequence
  Synthetic
atacgccatgctgggtctccggcagcttctttacttccacagaagagaccttcgactgatggccaacgccatttgttcggctgtgccagtcgactgggtaccaaccgggagaaccacctgcgtacttgggagtcggccat

SEQ ID NO: 1018 - DNA, 140 bp, Artificial Sequence
  Synthetic
atggccgactcccaagtacgcaggtggttctcccggttggtacccagtcgactggcacagccgaacaaatggcgttggccatcagtcgaaggtctcttctgtggaagtaaagaagctgccggagacccagcatggcgtat

SEQ ID NO: 1019 - DNA, 140 bp, Artificial Sequence
  Synthetic
aggccctggctgctgatatgatttgttcggctgtgccagtcgactgggtaccaaccgggagaaccacctggtcaatccacgggaagggagaatggatgaccactgaggacatgctcatgggaccttttgggacagcggtg

SEQ ID NO: 1020 - DNA, 140 bp, Artificial Sequence
  Synthetic
caccgctgtcccaaaaggtcccatgagcatgtcctcagtggtcatccattctcccttcccgtggattgaccaggtggttctcccggttggtacccagtcgactggcacagccgaacaaatcatatcagcagccagggcct

SEQ ID NO: 1021 - DNA, 140 bp, Artificial Sequence
  Synthetic
aggccctggctgctgatatgtgtggaatagagtgtggattgaggagaacgaccatatggaggacaagactcctgtaacaaagtggactgacattccctacctgggaaaaagggaggacttgaccttttgggacagcggtg

SEQ ID NO: 1022 - DNA, 140 bp, Artificial Sequence
  Synthetic
caccgctgtcccaaaaggtcaagtcctccctttttcccaggtagggaatgtcagtccactttgttacaggagtcttgtcctccatatggtcgttctcctcaatccacactctattccacacatatcagcagccagggcct

SEQ ID NO: 1023 - DNA, 140 bp, Artificial Sequence
  Synthetic
atacgccatgctgggtctccatggtgtggatcccttatagggcacagaccccgcaccacttgggctgagaacatcaaagacacagtcaacatggtgcgcaggatcataggtgatgaagaacgtacttgggagtcggccat

SEQ ID NO: 1024 - DNA, 140 bp, Artificial Sequence
  Synthetic
atggccgactcccaagtacgttcttcatcacctatgatcctgcgcaccatgttgactgtgtctttgatgttctcagcccaagtggtgcggggtctgtgccctataagggatccacaccatggagacccagcatggcgtat

SEQ ID NO: 1025 - DNA, 140 bp, Artificial Sequence
  Synthetic
aggccctggctgctgatatgggtgcgcaggatcataggtgatgaagaaaaatacatggactacctatccacccaagtccgctacttgggtgaggaagggtccacacctggagtgttgtaagaccttttgggacagcggtg

SEQ ID NO: 1026 - DNA, 140 bp, Artificial Sequence
  Synthetic
caccgctgtcccaaaaggtcttacaacactccaggtgtggacccttcctcacccaagtagcggacttgggtggataggtagtccatgtatttttcttcatcacctatgatcctgcgcacccatatcagcagccagggcct

SEQ ID NO: 1027 - DNA, 140 bp, Artificial Sequence
  Synthetic
aggccctggctgctgatatgcaagaagatgaccgggaagagcatccagccggagaatctggagtatcgaataatgctatcggtgcatggctcccagcacagcgggatgattgttaatgacgaccttttgggacagcggtg

SEQ ID NO: 1028 - DNA, 140 bp, Artificial Sequence
  Synthetic
caccgctgtcccaaaaggtcgtcattaacaatcatcccgctgtgctgggagccatgcaccgatagcattattcgatactccagattctccggctggatgctcttcccggtcatcttcttgcatatcagcagccagggcct

SEQ ID NO: 1029 - DNA, 140 bp, Artificial Sequence
  Synthetic
atacgccatgctgggtctccaacagagcggaagtcgaggtcacgcctaattcaccaagagcagaagcaaccttgggaggctttggaagtttaggacttgattgtgaaccaaggacaggcccgtacttgggagtcggccat

SEQ ID NO: 1030 - DNA, 140 bp, Artificial Sequence
  Synthetic
atggccgactcccaagtacgggcctgtccttggttcacaatcaagtcctaaacttccaaagcctcccaaggttgcttctgctcttggtgaattaggcgtgacctcgacttccgctctgttggagacccagcatggcgtat

SEQ ID NO: 1031 - DNA, 140 bp, Artificial Sequence
  Synthetic
aggccctggctgctgatatggaaatagtccgtgaagccataaaaaagagactccgcacagtgatcttggctccaaccagggttgtcgctgctgagatggaggaagccttgagaggacttcgaccttttgggacagcggtg

SEQ ID NO: 1032 - DNA, 140 bp, Artificial Sequence
  Synthetic
caccgctgtcccaaaaggtcgaagtcctctcaaggcttcctccatctcagcagcgacaaccctggttggagccaagatcactgtgcggagtctcttttttatggcttcacggactatttccatatcagcagccagggcct

SEQ ID NO: 1033 - DNA, 140 bp, Artificial Sequence
  Synthetic
atacgccatgctgggtctccgtacgttacatgacaacagcagtcaacgtcacccattctgggacagaaatcgttgatttgatgtgccatgccactttcacttcacgcttactacaacccacgtacttgggagtcggccat

SEQ ID NO: 1034 - DNA, 140 bp, Artificial Sequence
  Synthetic
atggccgactcccaagtacgtgggttgtagtaagcgtgaagtgaaagtggcatggcacatcaaatcaacgatttctgtcccagaatgggtgacgttgactgctgttgtcatgtaacgtacggagacccagcatggcgtat

SEQ ID NO: 1035 - DNA, 140 bp, Artificial Sequence
  Synthetic
atacgccatgctgggtctccgttcgttacatgacaacagcagtcaacgtcacccattctgggacagaaatcgttgatttgatgtgccatgccactttcacttcacgcttactacaacccacgtacttgggagtcggccat

SEQ ID NO: 1036 - DNA, 140 bp, Artificial Sequence
  Synthetic
atggccgactcccaagtacgtgggttgtagtaagcgtgaagtgaaagtggcatggcacatcaaatcaacgatttctgtcccagaatgggtgacgttgactgctgttgtcatgtaacgaacggagacccagcatggcgtat

SEQ ID NO: 1037 - DNA, 140 bp, Artificial Sequence
  Synthetic
atacgccatgctgggtctccgtccgttacatgacaacagcagtcaacgtcacccattctgggacagaaatcgttgatttgatgtgccatgccactttcacttcacgcttactacaacccacgtacttgggagtcggccat

SEQ ID NO: 1038 - DNA, 140 bp, Artificial Sequence
  Synthetic
atggccgactcccaagtacgtgggttgtagtaagcgtgaagtgaaagtggcatggcacatcaaatcaacgatttctgtcccagaatgggtgacgttgactgctgttgtcatgtaacggacggagacccagcatggcgtat

SEQ ID NO: 1039 - DNA, 140 bp, Artificial Sequence; identical to SEQ ID NO: 251
  Synthetic

SEQ ID NO: 1040 - DNA, 140 bp, Artificial Sequence; identical to SEQ ID NO: 252
  Synthetic

SEQ ID NO: 1041 - DNA, 140 bp, Artificial Sequence
  Synthetic
aggccctggctgctgatatgacaggttttattttggatttggaaacgagagtttctggtcatgaaaaacccaaaaaagaaatccggaggattccggattgtcaatatgctaaaacgcggagaccttttgggacagcggtg

SEQ ID NO: 1042 - DNA, 140 bp, Artificial Sequence
  Synthetic
caccgctgtcccaaaaggtctccgcgttttagcatattgacaatccggaatcctccggatttcttttttgggtttttcatgaccagaaactctcgtttccaaatccaaaataaaacctgtcatatcagcagccagggcct

SEQ ID NO: 1043 - DNA, 140 bp, Artificial Sequence
  Synthetic
aggccctggctgctgatatgtcagtggggaaaaaagaggctatggaaataataaagaagttcaagaaagatctggctgccatgctgagaataatcaatgctaggaaggagaagaagagacgaccttttgggacagcggtg

SEQ ID NO: 1044 - DNA, 140 bp, Artificial Sequence
  Synthetic
caccgctgtcccaaaaggtcgtctcttcttctccttcctagcattgattattctcagcatggcagccagatctttcttgaacttctttattatttccatagcctcttttttccccactgacatatcagcagccagggcct

SEQ ID NO: 1045 - DNA, 140 bp, Artificial Sequence
  Synthetic
atacgccatgctgggtctcctctggctgccatgctgagaataatcaatgctaggaaggagaagaagagacgaggcgcagatactagtgtcggaattgttggcctcctgctgaccacagctcgtacttgggagtcggccat

SEQ ID NO: 1046 - DNA, 140 bp, Artificial Sequence
  Synthetic
atggccgactcccaagtacgagctgtggtcagcaggaggccaacaattccgacactagtatctgcgcctcgtctcttcttctccttcctagcattgattattctcagcatggcagccagaggagacccagcatggcgtat

SEQ ID NO: 1047 - DNA, 140 bp, Artificial Sequence
  Synthetic
aggccctggctgctgatatgataagtgttatatacagatcatggatcttggacacacgtgtgatgccaccatgagctatgaatgccctatgctggatgagggggtggaaccagatgacgtgaccttttgggacagcggtg

SEQ ID NO: 1048 - DNA, 140 bp, Artificial Sequence
  Synthetic
caccgctgtcccaaaaggtcacgtcatctggttccaccccctcatccagcatagggcattcatagctcatggtggcatcacacgtgtgtccaagatccatgatctgtatataacacttatcatatcagcagccagggcct

SEQ ID NO: 1049 - DNA, 140 bp, Artificial Sequence
  Synthetic
aggccctggctgctgatatgcgattgttggtgcaacacgacgtcaacttgggttgtgtacggaacctgccatcacaaaaaaggtgaagcacggagatctagaagagctgtgacgctccccgaccttttgggacagcggtg

SEQ ID NO: 1050 - DNA, 140 bp, Artificial Sequence
  Synthetic
caccgctgtcccaaaaggtcggggagcgtcacagctcttctagatctccgtgcttcaccttttttgtgatggcaggttccgtacacaacccaagttgacgtcgtgttgcaccaacaatcgcatatcagcagccagggcct

SEQ ID NO: 1051 - DNA, 140 bp, Artificial Sequence
  Synthetic
aggccctggctgctgatatggtatgtcaggtgggacttgggttgatgttgtcttggaacatggaggttgtgtcactgtaatggcacaggacaaaccgactgtcgacatagagctggttacgaccttttgggacagcggtg

SEQ ID NO: 1052 - DNA, 140 bp, Artificial Sequence
  Synthetic
caccgctgtcccaaaaggtcgtaaccagctctatgtcgacagtcggtttgtcctgtgccattacagtgacacaacctccatgttccaagacaacatcaacccaagtcccacctgacataccatatcagcagccagggcct

SEQ ID NO: 1053 - DNA, 140 bp, Artificial Sequence
  Synthetic
atacgccatgctgggtctcctgacatgcgctaagtttgcatgctccaagaaaatgaccgggaagagcatccagccagagaatctggagtaccggataatgctgtcagttcatggctcccacgtacttgggagtcggccat

SEQ ID NO: 1054 - DNA, 140 bp, Artificial Sequence
  Synthetic
atggccgactcccaagtacgtgggagccatgaactgacagcattatccggtactccagattctctggctggatgctcttcccggtcattttcttggagcatgcaaacttagcgcatgtcaggagacccagcatggcgtat

SEQ ID NO: 1055 - DNA, 140 bp, Artificial Sequence
  Synthetic
atacgccatgctgggtctccgcacagtgggatgatcgttaatgacacaggacatgaaactgatgagaatagagcgaaagttgagataacgcccaattcaccaagagccgaagccaccctgcgtacttgggagtcggccat

SEQ ID NO: 1056 - DNA, 140 bp, Artificial Sequence
  Synthetic
atggccgactcccaagtacgcagggtggcttcggctcttggtgaattgggcgttatctcaactttcgctctattctcatcagtttcatgtcctgtgtcattaacgatcatcccactgtgcggagacccagcatggcgtat

SEQ ID NO: 1057 - DNA, 140 bp, Artificial Sequence
  Synthetic
atacgccatgctgggtctccggggggtttggaagcctaggacttgattgtgaaccgaggacaggccttgacttttcagatttgtattacttgactatgaataacaagcactggctggttccgtacttgggagtcggccat

SEQ ID NO: 1058 - DNA, 140 bp, Artificial Sequence
  Synthetic
atggccgactcccaagtacggaaccagccagtgcttgttattcatagtcaagtaatacaaatctgaaaagtcaaggcctgtcctcggttcacaatcaagtcctaggcttccaaaccccccggagacccagcatggcgtat

SEQ ID NO: 1059 - DNA, 140 bp, Artificial Sequence
  Synthetic
aggccctggctgctgatatgacaaggagtggttccacgacattccattaccttggcacgctggggcagacaccggaactccacactggaacaacaaagaagcactggtagagttcaaggagaccttttgggacagcggtg

SEQ ID NO: 1060 - DNA, 140 bp, Artificial Sequence
  Synthetic
caccgctgtcccaaaaggtctccttgaactctaccagtgcttctttgttgttccagtgtggagttccggtgtctgccccagcgtgccaaggtaatggaatgtcgtggaaccactccttgtcatatcagcagccagggcct

SEQ ID NO: 1061 - DNA, 140 bp, Artificial Sequence
  Synthetic
aggccctggctgctgatatgtcaccaagatcccggctgaaacactgcacgggacagtcacagtggaggtacagtacgcagggacagatggaccttgcaaggttccagctcagatggcggtgaccttttgggacagcggtg

SEQ ID NO: 1062 - DNA, 140 bp, Artificial Sequence
  Synthetic
caccgctgtcccaaaaggtcaccgccatctgagctggaaccttgcaaggtccatctgtccctgcgtactgtacctccactgtgactgtcccgtgcagtgtttcagccgggatcttggtgacatatcagcagccagggcct

SEQ ID NO: 1063 - DNA, 140 bp, Artificial Sequence
  Synthetic
aggccctggctgctgatatgtaatcactgaaagcactgagaactctaagatgatgctggaacttgatccaccatttggggactcttacattgtcataggagtcggggagaagaagatcacgaccttttgggacagcggtg

SEQ ID NO: 1064 - DNA, 140 bp, Artificial Sequence
  Synthetic
caccgctgtcccaaaaggtcgtgatcttcttctccccgactcctatgacaatgtaagagtccccaaatggtggatcaagttccagcatcatcttagagttctcagtgctttcagtgattacatatcagcagccagggcct

SEQ ID NO: 1065 - DNA, 140 bp, Artificial Sequence
  Synthetic
atacgccatgctgggtctccaatctttggagcagctttcaaatcattgtttggaggaatgtcctggttctcacaaattctcattggaacgttgctgatgtggttgggtctgaacgcaaagcgtacttgggagtcggccat

SEQ ID NO: 1066 - DNA, 140 bp, Artificial Sequence
  Synthetic
atggccgactcccaagtacgctttgcgttcagacccaaccacatcagcaacgttccaatgagaatttgtgagaaccaggacattcctccaaacaatgatttgaaagctgctccaaagattggagacccagcatggcgtat

SEQ ID NO: 1067 - DNA, 140 bp, Artificial Sequence
  Synthetic
aggccctggctgctgatatgcacaaattctcattggaacgttgctgatgtggttgggtctgaacgcaaagaatggatctatttcccttatgtgcttggccttagggggagtgttgatcttgaccttttgggacagcggtg

SEQ ID NO: 1068 - DNA, 140 bp, Artificial Sequence
  Synthetic
caccgctgtcccaaaaggtcaagatcaacactccccctaaggccaagcacataagggaaatagatccattctttgcgttcagacccaaccacatcagcaacgttccaatgagaatttgtgcatatcagcagccagggcct

SEQ ID NO: 1069 - DNA, 140 bp, Artificial Sequence
  Synthetic
aggccctggctgctgatatgaatggatctatttcccttatgtgcttggccttagggggagtgttgatcttcttatccacagccgtctctgctgatgtggggtgctcggtggacttctcaagaccttttgggacagcggtg

SEQ ID NO: 1070 - DNA, 140 bp, Artificial Sequence
  Synthetic
caccgctgtcccaaaaggtcttgagaagtccaccgagcaccccacatcagcagagacggctgtggataagaagatcaacactccccctaaggccaagcacataagggaaatagatccattcatatcagcagccagggcct

SEQ ID NO: 1071 - DNA, 140 bp, Artificial Sequence
  Synthetic
aggccctggctgctgatatgagctgccccacggctggaaggcttgggggaaatcgtacttcgtcagagcagcaaagacaaataacagctttgtcgtggatggtgacacactgaaggaatggaccttttgggacagcggtg

SEQ ID NO: 1072 - DNA, 140 bp, Artificial Sequence
  Synthetic
caccgctgtcccaaaaggtccattccttcagtgtgtcaccatccacgacaaagctgttatttgtctttgctgctctgacgaagtacgatttcccccaagccttccagccgtggggcagctcatatcagcagccagggcct

SEQ ID NO: 1073 - DNA, 140 bp, Artificial Sequence
  Synthetic
aggccctggctgctgatatgtgtacacagtgatctaggctactggattgagagtgagaagaatgacacatggaggctgaagagggcccatctgatcgagatgaaaacatgtgaatggccagaccttttgggacagcggtg

SEQ ID NO: 1074 - DNA, 140 bp, Artificial Sequence
  Synthetic
caccgctgtcccaaaaggtctggccattcacatgttttcatctcgatcagatgggccctcttcagcctccatgtgtcattcttctcactctcaatccagtagcctagatcactgtgtacacatatcagcagccagggcct

SEQ ID NO: 1075 - DNA, 140 bp, Artificial Sequence
  Synthetic
atacgccatgctgggtctccacaggacccaaatgaaagggccatggcacagtgaagagcttgaaattcggtttgaggaatgcccaggcactaaggtccacgtggaggaaacatgtggaaccgtacttgggagtcggccat

SEQ ID NO: 1076 - DNA, 140 bp, Artificial Sequence
  Synthetic
atggccgactcccaagtacggttccacatgtttcctccacgtggaccttagtgcctgggcattcctcaaaccgaatttcaagctcttcactgtgccatggccctttcatttgggtcctgtggagacccagcatggcgtat

SEQ ID NO: 1077 - DNA, 140 bp, Artificial Sequence
  Synthetic
aggccctggctgctgatatgtttgaggaatgcccaggcactaaggtccacgtggaggaaacatgtggaacgagaggaccatctctgagatcaaccactgcaagcggaagggtgatcgagggaccttttgggacagcggtg

SEQ ID NO: 1078 - DNA, 140 bp, Artificial Sequence
  Synthetic
caccgctgtcccaaaaggtccctcgatcacccttccgcttgcagtggttgatctcagagatggtcctctcgttccacatgtttcctccacgtggaccttagtgcctgggcattcctcaaacatatcagcagccagggcct

SEQ ID NO: 1079 - DNA, 140 bp, Artificial Sequence
  Synthetic
aggccctggctgctgatatgcaacttagtaaggtcaatggtgactgcaggatcaactgatcacatggaccacttctcccttggagtgcttgtgattctgctcatggtgcaggaagggttggaccttttgggacagcggtg

SEQ ID NO: 1080 - DNA, 140 bp, Artificial Sequence
  Synthetic
caccgctgtcccaaaaggtccaacccttcctgcaccatgagcagaatcacaagcactccaagggagaagtggtccatgtgatcagttgatcctgcagtcaccattgaccttactaagttgcatatcagcagccagggcct

SEQ ID NO: 1081 - DNA, 140 bp, Artificial Sequence
  Synthetic
aggccctggctgctgatatgaagaagagaatgaccacaaagatcatcataagcacatcaatggcagtgctggtagctatgatcctgggaggattttcaatgagtgacctggctaagcttggaccttttgggacagcggtg

SEQ ID NO: 1082 - DNA, 140 bp, Artificial Sequence
  Synthetic
caccgctgtcccaaaaggtccaagcttagccaggtcactcattgaaaatcctcccaggatcatagctaccagcactgccattgatgtgcttatgatgatctttgtggtcattctcttcttcatatcagcagccagggcct

SEQ ID NO: 1083 - DNA, 140 bp, Artificial Sequence
  Synthetic
aggccctggctgctgatatgccttggcctcgtgtcttttgcaaactgcgatctccgccttggaaggcgacctgatggttctcatcaatggttttgctttggcctggttggcaatacgagcgaccttttgggacagcggtg

SEQ ID NO: 1084 - DNA, 140 bp, Artificial Sequence
  Synthetic
caccgctgtcccaaaaggtcgctcgtattgccaaccaggccaaagcaaaaccattgatgagaaccatcaggtcgccttccaaggcggagatcgcagtttgcaaaagacacgaggccaaggcatatcagcagccagggcct

SEQ ID NO: 1085 - DNA, 140 bp, Artificial Sequence
  Synthetic
aggccctggctgctgatatggaagaagaacttaccatttgtcatggccctgggactaaccgctgtgaggctggtcgaccccatcaacgtggtgggactgctgttgctcacaaggagtggggaccttttgggacagcggtg

SEQ ID NO: 1086 - DNA, 140 bp, Artificial Sequence
  Synthetic
caccgctgtcccaaaaggtccccactccttgtgagcaacagcagtcccaccacgttgatggggtcgaccagcctcacagcggttagtcccagggccatgacaaatggtaagttcttcttccatatcagcagccagggcct

SEQ ID NO: 1087 - DNA, 140 bp, Artificial Sequence
  Synthetic
aggccctggctgctgatatgtggccgcggtcggtctgctaattgtcagttacgtggtctcaggaaagagtgtggacatgtacattgaaagagcaggtgacatcacatgggaaaaagatgcgaccttttgggacagcggtg

SEQ ID NO: 1088 - DNA, 140 bp, Artificial Sequence
  Synthetic
caccgctgtcccaaaaggtcgcatctttttcccatgtgatgtcacctgctctttcaatgtacatgtccacactctttcctgagaccacgtaactgacaattagcagaccgaccgcggccacatatcagcagccagggcct

SEQ ID NO: 1089 - DNA, 140 bp, Artificial Sequence
  Synthetic
aggccctggctgctgatatggtgctctatgggatgtgcctgctcccaaggaagtaaaaaagggggagaccacagatggagtgtacagagtaatgactcgtagactgctaggttcaacacagaccttttgggacagcggtg

SEQ ID NO: 1090 - DNA, 140 bp, Artificial Sequence
  Synthetic
caccgctgtcccaaaaggtctgtgttgaacctagcagtctacgagtcattactctgtacactccatctgtggtctcccccttttttacttccttgggagcaggcacatcccatagagcaccatatcagcagccagggcct

SEQ ID NO: 1091 - DNA, 140 bp, Artificial Sequence
  Synthetic
aggccctggctgctgatatgagatgccgcctgggacgggcacagcgaggtgcagctcttggccgtgccccccggagagagagcgaggaacatccagactctgcccggaatatttaagacagaccttttgggacagcggtg

SEQ ID NO: 1092 - DNA, 140 bp, Artificial Sequence
  Synthetic
caccgctgtcccaaaaggtctgtcttaaatattccgggcagagtctggatgttcctcgctctctctccggggggcacggccaagagctgcacctcgctgtgcccgtcccaggcggcatctcatatcagcagccagggcct

SEQ ID NO: 1093 - DNA, 140 bp, Artificial Sequence
  Synthetic
atacgccatgctgggtctccaaggatggggacattggagcggttgcgctggattacccagcaggaacttcaggatctcctatcctagacaagtgtgggagagtgataggactttatggcacgtacttgggagtcggccat

SEQ ID NO: 1094 - DNA, 140 bp, Artificial Sequence
  Synthetic
atggccgactcccaagtacgtgccataaagtcctatcactctcccacacttgtctaggataggagatcctgaagttcctgctgggtaatccagcgcaaccgctccaatgtccccatccttggagacccagcatggcgtat

SEQ ID NO: 1095 - DNA, 140 bp, Artificial Sequence
  Synthetic
atacgccatgctgggtctccccttagagggcttccagtgcgttatatgacaacagcagtcaatgtcacccactctggaacagaaatcgtcgacttaatgtgccatgccaccttcacttcgcgtacttgggagtcggccat

SEQ ID NO: 1096 - DNA, 140 bp, Artificial Sequence
  Synthetic
atggccgactcccaagtacgcgaagtgaaggtggcatggcacattaagtcgacgatttctgttccagagtgggtgacattgactgctgttgtcatataacgcactggaagccctctaaggggagacccagcatggcgtat

SEQ ID NO: 1097 - DNA, 140 bp, Artificial Sequence
  Synthetic
aggccctggctgctgatatgcgtctactacagccaatcagagtccccaactataatctgtatattatggatgaggcccacttcacagatccctcaagtatagcagcaagaggatacatttgaccttttgggacagcggtg

SEQ ID NO: 1098 - DNA, 140 bp, Artificial Sequence
  Synthetic
caccgctgtcccaaaaggtcaaatgtatcctcttgctgctatacttgagggatctgtgaagtgggcctcatccataatatacagattatagttggggactctgattggctgtagtagacgcatatcagcagccagggcct

SEQ ID NO: 1099 - DNA, 140 bp, Artificial Sequence
  Synthetic
aggccctggctgctgatatgcaccgaagtggaagtcccagagagagcctggagctcaggctttgattgggtgacggatcattctggaaaaacagtttggtttgttccaagcgtgaggaacgaccttttgggacagcggtg

SEQ ID NO: 1100 - DNA, 140 bp, Artificial Sequence
  Synthetic
caccgctgtcccaaaaggtcgttcctcacgcttggaacaaaccaaactgtttttccagaatgatccgtcacccaatcaaagcctgagctccaggctctctctgggacttccacttcggtgcatatcagcagccagggcct

SEQ ID NO: 1101 - DNA, 140 bp, Artificial Sequence
  Synthetic
aggccctggctgctgatatgaaagctgaccgtgtcatagattccaggagatgcctaaagccggtcatacttgatggcgagagagtcattctggctggacccatgcctgtcacacatgccagaccttttgggacagcggtg

SEQ ID NO: 1102 - DNA, 140 bp, Artificial Sequence
  Synthetic
caccgctgtcccaaaaggtctggcatgtgtgacaggcatgggtccagccagaatgactctctcgccatcaagtatgaccggctttaggcatctcctggaatctatgacacggtcagctttcatatcagcagccagggcct

SEQ ID NO: 1103 - DNA, 140 bp, Artificial Sequence
  Synthetic
atacgccatgctgggtctccacactggcttgaagcaagaatgctccttgacaatatttacctccaagatggcctcatagcctcgctctatcgacctgaggccgacaaagtagcagccattcgtacttgggagtcggccat

SEQ ID NO: 1104 - DNA, 140 bp, Artificial Sequence
  Synthetic
atggccgactcccaagtacgaatggctgctactttgtcggcctcaggtcgatagagcgaggctatgaggccatcttggaggtaaatattgtcaaggagcattcttgcttcaagccagtgtggagacccagcatggcgtat

SEQ ID NO: 1105 - DNA, 140 bp, Artificial Sequence
  Synthetic
atacgccatgctgggtctccgagggagagttcaagcttaggacggagcaaaggaagacctttgtggaactcatgaaaagaggagatcttcctgtttggctggcctatcaggttgcatctgcgtacttgggagtcggccat

SEQ ID NO: 1106 - DNA, 140 bp, Artificial Sequence
  Synthetic
atggccgactcccaagtacgcagatgcaacctgataggccagccaaacaggaagatctcctcttttcatgagttccacaaaggtcttcctttgctccgtcctaagcttgaactctccctcggagacccagcatggcgtat

SEQ ID NO: 1107 - DNA, 140 bp, Artificial Sequence
  Synthetic
aggccctggctgctgatatgcatgaaaagaggagatcttcctgtttggctggcctatcaggttgcatctgccggaataacctacacagatagaagatggtgctttgatggcacgaccaacgaccttttgggacagcggtg

SEQ ID NO: 1108 - DNA, 140 bp, Artificial Sequence
  Synthetic
caccgctgtcccaaaaggtcgttggtcgtgccatcaaagcaccatcttctatctgtgtaggttattccggcagatgcaacctgataggccagccaaacaggaagatctcctcttttcatgcatatcagcagccagggcct

SEQ ID NO: 1109 - DNA, 140 bp, Artificial Sequence
  Synthetic
atacgccatgctgggtctccccggaataacctacacagatagaagatggtgctttgatggcacgaccaacaacaccataatggaagacagtgtgccggcagaagtgtggaccagacacggcgtacttgggagtcggccat

SEQ ID NO: 1110 - DNA, 140 bp, Artificial Sequence
  Synthetic
atggccgactcccaagtacgccgtgtctggtccacacttctgccggcacactgtcttccattatggtgttgttggtcgtgccatcaaagcaccatcttctatctgtgtaggttattccggggagacccagcatggcgtat

SEQ ID NO: 1111 - DNA, 140 bp, Artificial Sequence
  Synthetic
aggccctggctgctgatatgagagaaaagagtgctcaaaccgaggtggatggacgccagagtttgttcagatcatgcggccctgaagtcattcaaggagtttgccgctgggaaaagaggagaccttttgggacagcggtg

SEQ ID NO: 1112 - DNA, 140 bp, Artificial Sequence
  Synthetic
caccgctgtcccaaaaggtctcctcttttcccagcggcaaactccttgaatgacttcagggccgcatgatctgaacaaactctggcgtccatccacctcggtttgagcactcttttctctcatatcagcagccagggcct

SEQ ID NO: 1113 - DNA, 140 bp, Artificial Sequence
  Synthetic
aggccctggctgctgatatgatcatgcggccctgaagtcattcaaggagtttgccgctgggaaaagaggagcggcttttggagtgatggaagccctgggaacactgccaggacacatgacgaccttttgggacagcggtg

SEQ ID NO: 1114 - DNA, 140 bp, Artificial Sequence
  Synthetic
caccgctgtcccaaaaggtcgtcatgtgtcctggcagtgttcccagggcttccatcactccaaaagccgctcctcttttcccagcggcaaactccttgaatgacttcagggccgcatgatcatatcagcagccagggcct

SEQ ID NO: 1115 - DNA, 140 bp, Artificial Sequence
  Synthetic
aggccctggctgctgatatgccagccagaattgcatgtgtcctcattgttgtgttcctattgctggtggtgctcatacctgagccagaaaagcaaagatctccccaggacaaccaaatgggaccttttgggacagcggtg

SEQ ID NO: 1116 - DNA, 140 bp, Artificial Sequence
  Synthetic
caccgctgtcccaaaaggtcccatttggttgtcctggggagatctttgcttttctggctcaggtatgagcaccaccagcaataggaacacaacaatgaggacacatgcaattctggctggcatatcagcagccagggcct

SEQ ID NO: 1117 - DNA, 140 bp, Artificial Sequence
  Synthetic
atacgccatgctgggtctccggccagcctcagcttgggccatctatgctgccttgacaactttcattaccccagccgtccaacatgcagtgaccacctcatacaacaactactccttaatcgtacttgggagtcggccat

SEQ ID NO: 1118 - DNA, 140 bp, Artificial Sequence
  Synthetic
atggccgactcccaagtacgattaaggagtagttgttgtatgaggtggtcactgcatgttggacggctggggtaatgaaagttgtcaaggcagcatagatggcccaagctgaggctggccggagacccagcatggcgtat

SEQ ID NO: 1119 - DNA, 140 bp, Artificial Sequence
  Synthetic
aggccctggctgctgatatggcactacatgtacttgatcccagggctgcaggcagcagctgcgcgtgctgcccagaagagaacggcagctggcatcatgaagaaccctgttgtggatggagaccttttgggacagcggtg

SEQ ID NO: 1120 - DNA, 140 bp, Artificial Sequence
  Synthetic
caccgctgtcccaaaaggtctccatccacaacagggttcttcatgatgccagctgccgttctcttctgggcagcacgcgcagctgctgcctgcagccctgggatcaagtacatgtagtgccatatcagcagccagggcct

SEQ ID NO: 1121 - DNA, 140 bp, Artificial Sequence
  Synthetic
atacgccatgctgggtctccatagtggtgactgacattgacacaatgacaattgacccccaagtggagaaaaagatgggacaggtgctactcatagcagtagccgtctccagcgccataccgtacttgggagtcggccat

SEQ ID NO: 1122 - DNA, 140 bp, Artificial Sequence
  Synthetic
atggccgactcccaagtacggtatggcgctggagacggctactgctatgagtagcacctgtcccatctttttctccacttgggggtcaattgtcattgtgtcaatgtcagtcaccactatggagacccagcatggcgtat

SEQ ID NO: 1123 - DNA, 140 bp, Artificial Sequence
  Synthetic
aggccctggctgctgatatggcaacttccactttgtgggaaggctctccgaacaagtactggaactcctctacagccacttcactgtgtaacatttttaggggaagttacttggctggaggaccttttgggacagcggtg

SEQ ID NO: 1124 - DNA, 140 bp, Artificial Sequence
  Synthetic
caccgctgtcccaaaaggtcctccagccaagtaacttcccctaaaaatgttacacagtgaagtggctgtagaggagttccagtacttgttcggagagccttcccacaaagtggaagttgccatatcagcagccagggcct

SEQ ID NO: 1125 - DNA, 140 bp, Artificial Sequence
  Synthetic
atacgccatgctgggtctccaggtgtgcagagaagaggcccgccgcgccctcaaggacggtgtggcaacgggaggccatgctgtgtcccgaggaagtgcaaagctgagatggttggtggacgtacttgggagtcggccat

SEQ ID NO: 1126 - DNA, 140 bp, Artificial Sequence
  Synthetic
atggccgactcccaagtacgtccaccaaccatctcagctttgcacttcctcgggacacagcatggcctcccgttgccacaccgtccttgagggcgcggcgggcctcttctctgcacacctggagacccagcatggcgtat

SEQ ID NO: 1127 - DNA, 140 bp, Artificial Sequence
  Synthetic
aggccctggctgctgatatgggaggccatgctgtgtcccgaggaagtgcaaagctgagatggttggtggagcggggatacctgcagccctatggaaaggtcattgatcttggatgtggcagaccttttgggacagcggtg

SEQ ID NO: 1128 - DNA, 140 bp, Artificial Sequence
  Synthetic
caccgctgtcccaaaaggtctgccacatccaagatcaatgacctttccatagggctgcaggtatccccgctccaccaaccatctcagctttgcacttcctcgggacacagcatggcctcccatatcagcagccagggcct

SEQ ID NO: 1129 - DNA, 140 bp, Artificial Sequence
  Synthetic
aggccctggctgctgatatgggtgggggattggcttgaaaaaagaccaggagccttttgtataaaagtgttgtgcccatacaccagcactatgatggaaaccctggagcgactgcagcgtgaccttttgggacagcggtg

SEQ ID NO: 1130 - DNA, 140 bp, Artificial Sequence
  Synthetic
caccgctgtcccaaaaggtcacgctgcagtcgctccagggtttccatcatagtgctggtgtatgggcacaacacttttatacaaaaggctcctggtcttttttcaagccaatcccccacccatatcagcagccagggcct

SEQ ID NO: 1131 - DNA, 140 bp, Artificial Sequence
  Synthetic
aggccctggctgctgatatgtgtgcccatacaccagcactatgatggaaaccctggagcgactgcagcgtaggtatgggggaggactggtcagagtgccactctcccgcaactctacacagaccttttgggacagcggtg

SEQ ID NO: 1132 - DNA, 140 bp, Artificial Sequence
  Synthetic
caccgctgtcccaaaaggtctgtgtagagttgcgggagagtggcactctgaccagtcctcccccatacctacgctgcagtcgctccagggtttccatcatagtgctggtgtatgggcacacatatcagcagccagggcct

SEQ ID NO: 1133 - DNA, 140 bp, Artificial Sequence
  Synthetic
aggccctggctgctgatatgaggtatgggggaggactggtcagagtgccactctcccgcaactctacacatgagatgtactgggtctctggagcgaaaagcaacaccataaaaagtgtgtgaccttttgggacagcggtg

SEQ ID NO: 1134 - DNA, 140 bp, Artificial Sequence
  Synthetic
caccgctgtcccaaaaggtcacacactttttatggtgttgcttttcgctccagagacccagtacatctcatgtgtagagttgcgggagagtggcactctgaccagtcctcccccatacctcatatcagcagccagggcct

SEQ ID NO: 1135 - DNA, 140 bp, Artificial Sequence
  Synthetic
aggccctggctgctgatatgaagagctaggcaaacacaaacggccacgagtctgtaccaaagaagagttcatcaacaaggttcgtagcaatgcagcattaggggcaatatttgaagaggagaccttttgggacagcggtg

SEQ ID NO: 1136 - DNA, 140 bp, Artificial Sequence
  Synthetic
caccgctgtcccaaaaggtctcctcttcaaatattgcccctaatgctgcattgctacgaaccttgttgatgaactcttctttggtacagactcgtggccgtttgtgtttgcctagctcttcatatcagcagccagggcct

SEQ ID NO: 1137 - DNA, 140 bp, Artificial Sequence
  Synthetic
aggccctggctgctgatatgaaaagagtggaagactgcagtggaagctgtgaacgatccaaggttctgggctctagtggacaaggaaagagagcaccacctgagaggagagtgccagagtgaccttttgggacagcggtg

SEQ ID NO: 1138 - DNA, 140 bp, Artificial Sequence
  Synthetic
caccgctgtcccaaaaggtcactctggcactctcctctcaggtggtgctctctttccttgtccactagagcccagaaccttggatcgttcacagcttccactgcagtcttccactcttttcatatcagcagccagggcct

SEQ ID NO: 1139 - DNA, 140 bp, Artificial Sequence
  Synthetic
aggccctggctgctgatatgtgtgtgtacaacatgatgggaaaaagagaaaagaaacaaggggaatttggaaaggccaagggcagccgcgccatctggtatatgtggctaggggctagatgaccttttgggacagcggtg

SEQ ID NO: 1140 - DNA, 140 bp, Artificial Sequence
  Synthetic
caccgctgtcccaaaaggtcatctagcccctagccacatataccagatggcgcggctgcccttggcctttccaaattccccttgtttcttttctctttttcccatcatgttgtacacacacatatcagcagccagggcct

SEQ ID NO: 1141 - DNA, 140 bp, Artificial Sequence
  Synthetic
aggccctggctgctgatatgagagagaactcaggaggtggtgttgaagggctgggattacaaagactcggatatgtcctagaagagatgagtcgtataccaggaggaaggatgtatgcaggaccttttgggacagcggtg

SEQ ID NO: 1142 - DNA, 140 bp, Artificial Sequence
  Synthetic
caccgctgtcccaaaaggtcctgcatacatccttcctcctggtatacgactcatctcttctaggacatatccgagtctttgtaatcccagcccttcaacaccacctcctgagttctctctcatatcagcagccagggcct

SEQ ID NO: 1143 - DNA, 140 bp, Artificial Sequence
  Synthetic
aggccctggctgctgatatgatatgtcctagaagagatgagtcgtataccaggaggaaggatgtatgcagatgacactgctggctgggacacccgcattagcaggtttgatctggagaatgaccttttgggacagcggtg

SEQ ID NO: 1144 - DNA, 140 bp, Artificial Sequence
  Synthetic
caccgctgtcccaaaaggtcattctccagatcaaacctgctaatgcgggtgtcccagccagcagtgtcatctgcatacatccttcctcctggtatacgactcatctcttctaggacatatcatatcagcagccagggcct

SEQ ID NO: 1145 - DNA, 140 bp, Artificial Sequence
  Synthetic
aggccctggctgctgatatgagtggtgcaactcattcggaatatggaggctgaggaagttctagagatgcaagacttgtggctgctgcggaggtcagagaaagtgactaactggttgcaggaccttttgggacagcggtg

SEQ ID NO: 1146 - DNA, 140 bp, Artificial Sequence
  Synthetic
caccgctgtcccaaaaggtcctgcaaccagttagtcactttctctgacctccgcagcagccacaagtcttgcatctctagaacttcctcagcctccatattccgaatgagttgcaccactcatatcagcagccagggcct

SEQ ID NO: 1147 - DNA, 140 bp, Artificial Sequence
  Synthetic
aggccctggctgctgatatgagcaacggatgggataggctcaaacgaatggcagtcagtggagatgattgcgttgtgaagccaattgatgataggtttgcacatgccctcaggttcttgagaccttttgggacagcggtg

SEQ ID NO: 1148 - DNA, 140 bp, Artificial Sequence
  Synthetic
caccgctgtcccaaaaggtctcaagaacctgagggcatgtgcaaacctatcatcaattggcttcacaacgcaatcatctccactgactgccattcgtttgagcctatcccatccgttgctcatatcagcagccagggcct

SEQ ID NO: 1149 - DNA, 140 bp, Artificial Sequence
  Synthetic
atacgccatgctgggtctccctgtgccagttgactgggttccaactgggagaactacctggtcaatccatggaaagggagaatggatgaccactgaagacatgcttgtggtgtggaacagcgtacttgggagtcggccat

SEQ ID NO: 1150 - DNA, 140 bp, Artificial Sequence
  Synthetic
atggccgactcccaagtacgctgttccacaccacaagcatgtcttcagtggtcatccattctccctttccatggattgaccaggtagttctcccagttggaacccagtcaactggcacagggagacccagcatggcgtat

SEQ ID NO: 1151 - DNA, 140 bp, Artificial Sequence
  Synthetic
aggccctggctgctgatatgacttgggtgaagaagggtctacacctggagtgctgtaagcaccaatcttaatgttgtcaggcctgctagtcagccacagcttggggaaagctgtgcagccgaccttttgggacagcggtg

SEQ ID NO: 1152 - DNA, 140 bp, Artificial Sequence
  Synthetic
caccgctgtcccaaaaggtcggctgcacagctttccccaagctgtggctgactagcaggcctgacaacattaagattggtgcttacagcactccaggtgtagacccttcttcacccaagtcatatcagcagccagggcct

SEQ ID NO: 1153 - DNA, 140 bp, Artificial Sequence
  Synthetic
aggccctggctgctgatatgtgtgaatcagactgcgacagttcgagtttgaagcgaaagctagcaacagtatcaacaggttttattttggatttggaaacgagagtttctggtcatgaaagaccttttgggacagcggtg

SEQ ID NO: 1154 - DNA, 140 bp, Artificial Sequence
  Synthetic
caccgctgtcccaaaaggtctttcatgaccagaaactctcgtttccaaatccaaaataaaacctgttgatactgttgctagctttcgcttcaaactcgaactgtcgcagtctgattcacacatatcagcagccagggcct

SEQ ID NO: 1155 - DNA, 140 bp, Artificial Sequence
  Synthetic
atacgccatgctgggtctcctttttgagattcacggcaatcaagccatcactgggtctcatcaatagatggggttcagttgggaaaaaagaggctatggaaataataaagaagttcaagacgtacttgggagtcggccat

SEQ ID NO: 1156 - DNA, 140 bp, Artificial Sequence
  Synthetic
atggccgactcccaagtacgtcttgaacttctttattatttccatagcctcttttttcccaactgaaccccatctattgatgagacccagtgatggcttgattgccgtgaatctcaaaaaggagacccagcatggcgtat

SEQ ID NO: 1157 - DNA, 140 bp, Artificial Sequence
  Synthetic
atacgccatgctgggtctccaggaaccctggcttcgcgttagcagcagctgccatcgcttggcttttgggaagctcaacgagccaaaaagtcatatacttggtcatgatactgctgattgcgtacttgggagtcggccat

SEQ ID NO: 1158 - DNA, 140 bp, Artificial Sequence
  Synthetic
atggccgactcccaagtacgcaatcagcagtatcatgaccaagtatatgactttttggctcgttgagcttcccaaaagccaagcgatggcagctgctgctaacgcgaagccagggttcctggagacccagcatggcgtat

SEQ ID NO: 1159 - DNA, 140 bp, Artificial Sequence
  Synthetic
atacgccatgctgggtctccggagcagttcacacggcccttgctggagctctggaggctgagatggatggtgcaaagggaaggctgtcctctggccacttgaaatgtcgcctgaaaatggcgtacttgggagtcggccat

SEQ ID NO: 1160 - DNA, 140 bp, Artificial Sequence
  Synthetic
atggccgactcccaagtacgccattttcaggcgacatttcaagtggccagaggacagccttccctttgcaccatccatctcagcctccagagctccagcaagggccgtgtgaactgctccggagacccagcatggcgtat

SEQ ID NO: 1161 - DNA, 140 bp, Artificial Sequence
  Synthetic
atacgccatgctgggtctccataaacttagattgaagggcgtgtcatactccttgtgtactgcagcgttcacattcaccaagatcccggctgaaacactgcacgggacagtcacagtggacgtacttgggagtcggccat

SEQ ID NO: 1162 - DNA, 140 bp, Artificial Sequence
  Synthetic
atggccgactcccaagtacgtccactgtgactgtcccgtgcagtgtttcagccgggatcttggtgaatgtgaacgctgcagtacacaaggagtatgacacgcccttcaatctaagtttatggagacccagcatggcgtat

SEQ ID NO: 1163 - DNA, 140 bp, Artificial Sequence
  Synthetic
aggccctggctgctgatatgggtacagtacgcagggacagatggaccttgcaaggttccagctcagatggcggtggacatgcaaactctgaccccagttgggaggttgataaccgctaacgaccttttgggacagcggtg

SEQ ID NO: 1164 - DNA, 140 bp, Artificial Sequence
  Synthetic
caccgctgtcccaaaaggtcgttagcggttatcaacctcccaactggggtcagagtttgcatgtccaccgccatctgagctggaaccttgcaaggtccatctgtccctgcgtactgtacccatatcagcagccagggcct

SEQ ID NO: 1165 - DNA, 140 bp, Artificial Sequence
  Synthetic
atacgccatgctgggtctccaaagaatggatctatttcccttatgtgcttggccttagggggggtgttgatcttcttatccacagccgtctctgctgatgtggggtgctcggtggacttccgtacttgggagtcggccat

SEQ ID NO: 1166 - DNA, 140 bp, Artificial Sequence
  Synthetic
atggccgactcccaagtacggaagtccaccgagcaccccacatcagcagagacggctgtggataagaagatcaacaccccccctaaggccaagcacataagggaaatagatccattctttggagacccagcatggcgtat

SEQ ID NO: 1167 - DNA, 140 bp, Artificial Sequence
  Synthetic
atacgccatgctgggtctccgaccacttctcccttggagtgcttgtgatcctgctcatggtgcaggaagggctgaagaagagaatgaccacaaagatcatcataagcacatcaatggcagcgtacttgggagtcggccat

SEQ ID NO: 1168 - DNA, 140 bp, Artificial Sequence
  Synthetic
atggccgactcccaagtacgctgccattgatgtgcttatgatgatctttgtggtcattctcttcttcagcccttcctgcaccatgagcaggatcacaagcactccaagggagaagtggtcggagacccagcatggcgtat

SEQ ID NO: 1169 - DNA, 140 bp, Artificial Sequence
  Synthetic
atacgccatgctgggtctccgtgtgaagaagaacttaccatttgtcatggccctgggactaaccgctgtgaggctggtcgaccccatcaacgtggtgggactgctgttactcacaaggagcgtacttgggagtcggccat

SEQ ID NO: 1170 - DNA, 140 bp, Artificial Sequence
  Synthetic
atggccgactcccaagtacgctccttgtgagtaacagcagtcccaccacgttgatggggtcgaccagcctcacagcggttagtcccagggccatgacaaatggtaagttcttcttcacacggagacccagcatggcgtat

SEQ ID NO: 1171 - DNA, 140 bp, Artificial Sequence
  Synthetic
aggccctggctgctgatatgcatactcaaggtggtcctgatgaccatctgtggcatgaatccaatagccataccctttgcagctggagcgtggtacgtatacgtgaagactggaaaaagggaccttttgggacagcggtg

SEQ ID NO: 1172 - DNA, 140 bp, Artificial Sequence
  Synthetic
caccgctgtcccaaaaggtccctttttccagtcttcacgtatacgtaccacgctccagctgcaaagggtatggctattggattcatgccacagatggtcatcaggaccaccttgagtatgcatatcagcagccagggcct

SEQ ID NO: 1173 - DNA, 140 bp, Artificial Sequence
  Synthetic
atacgccatgctgggtctccggcaatggggtcgtgatcaaaaatgggagttatgttagtgccatcacccaagggaggagggaagaagagactcctgttgagtgcttcgagccctcgatgccgtacttgggagtcggccat

SEQ ID NO: 1174 - DNA, 140 bp, Artificial Sequence
  Synthetic
atggccgactcccaagtacggcatcgagggctcgaagcactcaacaggagtctcttcttccctcctcccttgggtgatggcactaacataactcccatttttgatcacgaccccattgccggagacccagcatggcgtat

SEQ ID NO: 1175 - DNA, 140 bp, Artificial Sequence
  Synthetic
atacgccatgctgggtctcccaacaacaccataatggaagatagtgtgccggcagaggtgtggaccagacacggagagaaaagagtgctcaaaccgaggtggatggacgccagagtttgtcgtacttgggagtcggccat

SEQ ID NO: 1176 - DNA, 140 bp, Artificial Sequence
  Synthetic
atggccgactcccaagtacgacaaactctggcgtccatccacctcggtttgagcactcttttctctccgtgtctggtccacacctctgccggcacactatcttccattatggtgttgttgggagacccagcatggcgtat

SEQ ID NO: 1177 - DNA, 140 bp, Artificial Sequence
  Synthetic
aggccctggctgctgatatggcagagactggaagcaggccttacaaagccgcggcggcccaattgccggagaccctagagaccataatgcttttggggttgctgggaacagtctcgctgggaccttttgggacagcggtg

SEQ ID NO: 1178 - DNA, 140 bp, Artificial Sequence
  Synthetic
caccgctgtcccaaaaggtcccagcgagactgttcccagcaaccccaaaagcattatggtctctagggtctccggcaattgggccgccgcggctttgtaaggcctgcttccagtctctgccatatcagcagccagggcct

SEQ ID NO: 1179 - DNA, 140 bp, Artificial Sequence
  Synthetic
atacgccatgctgggtctcctgcaaagctatgggtggaacatagtccgtcttaagagtggggtggacgtctttcatatggcggctgagccgtgtgacacgctgctgtgtgacataggtgacgtacttgggagtcggccat

SEQ ID NO: 1180 - DNA, 140 bp, Artificial Sequence
  Synthetic
atggccgactcccaagtacgtcacctatgtcacacagcagcgtgtcacacggctcagccgccatatgaaagacgtccaccccactcttaagacggactatgttccacccatagctttgcaggagacccagcatggcgtat

SEQ ID NO: 1181 - DNA, 140 bp, Artificial Sequence
  Synthetic
aggccctggctgctgatatggccagtgaaatatgaggaggatgtgaatctcggctctggcacgcgggctgtggtaagctgcgctgaagctcccaacatgaagatcattggtaaccgcattgaccttttgggacagcggtg

SEQ ID NO: 1182 - DNA, 140 bp, Artificial Sequence
  Synthetic
caccgctgtcccaaaaggtcaatgcggttaccaatgatcttcatgttgggagcttcagcgcagcttaccacagcccgcgtgccagagccgagattcacatcctcctcatatttcactggccatatcagcagccagggcct

SEQ ID NO: 1183 - DNA, 140 bp, Artificial Sequence
  Synthetic
atacgccatgctgggtctccacccccaagaaggcactcgtcaggttatgagcatggtctcttcctggttgtggaaagagctaggcaaacacaaacggccacgagtctgtaccaaagaagacgtacttgggagtcggccat

SEQ ID NO: 1184 - DNA, 140 bp, Artificial Sequence
  Synthetic
atggccgactcccaagtacgtcttctttggtacagactcgtggccgtttgtgtttgcctagctctttccacaaccaggaagagaccatgctcataacctgacgagtgccttcttgggggtggagacccagcatggcgtat

SEQ ID NO: 1185 - DNA, 140 bp, Artificial Sequence
  Synthetic
atacgccatgctgggtctccgagttgtgtgtataacatgatgggaaaaagagaaaagaaacaaggggaatttggaaaggccaagggcagccgcgccatctggtatatgtggctaggggctcgtacttgggagtcggccat

SEQ ID NO: 1186 - DNA, 140 bp, Artificial Sequence
  Synthetic
atggccgactcccaagtacgagcccctagccacatataccagatggcgcggctgcccttggcctttccaaattccccttgtttcttttctctttttcccatcatgttatacacacaactcggagacccagcatggcgtat

SEQ ID NO: 1187 - DNA, 140 bp, Artificial Sequence
  Synthetic
aggccctggctgctgatatgccaaagggggagcggacaagttgtcacttacgctcttaacacatttaccaacctagtggtgcaactcattcggaatatggaggctgaggaagttctagaggaccttttgggacagcggtg

SEQ ID NO: 1188 - DNA, 140 bp, Artificial Sequence
  Synthetic
caccgctgtcccaaaaggtcctctagaacttcctcagcctccatattccgaatgagttgcaccactaggttggtaaatgtgttaagagcgtaagtgacaacttgtccgctccccctttggcatatcagcagccagggcct

SEQ ID NO: 1189 - DNA, 140 bp, Artificial Sequence
  Synthetic
atacgccatgctgggtctccatgcaagacttgtggctgctgcggaggtcagagaaagtgaccaactggttgcagagcaacggatgggataggctcaaacgaatggcagtcagtggagatgcgtacttgggagtcggccat

SEQ ID NO: 1190 - DNA, 140 bp, Artificial Sequence
  Synthetic
atggccgactcccaagtacgcatctccactgactgccattcgtttgagcctatcccatccgttgctctgcaaccagttggtcactttctctgacctccgcagcagccacaagtcttgcatggagacccagcatggcgtat

SEQ ID NO: 1191 - DNA, 140 bp, Artificial Sequence
  Synthetic
atacgccatgctgggtctccattgcgttgtgaagccaattgatgataggtttgcacatgccctcaggttcttgaatgatatgggaaaagttagaaaggacacacaagagtggaaaccctccgtacttgggagtcggccat

SEQ ID NO: 1192 - DNA, 140 bp, Artificial Sequence
  Synthetic
atggccgactcccaagtacggagggtttccactcttgtgtgtcctttctaacttttcccatatcattcaagaacctgagggcatgtgcaaacctatcatcaattggcttcacaacgcaatggagacccagcatggcgtat

SEQ ID NO: 1193 - DNA, 140 bp, Artificial Sequence
  Synthetic
aggccctggctgctgatatgcaagatgaactgattggccgggcccgcgtctctccaggggcgggatggagcatccgggagactgcttgcctagcaaaatcatatgcgcagatgtggcagcgaccttttgggacagcggtg

SEQ ID NO: 1194 - DNA, 140 bp, Artificial Sequence
  Synthetic
caccgctgtcccaaaaggtcgctgccacatctgcgcatatgattttgctaggcaagcagtctcccggatgctccatcccgcccctggagagacgcgggcccggccaatcagttcatcttgcatatcagcagccagggcct

SEQ ID NO: 1195 - DNA, 140 bp, Artificial Sequence
  Synthetic
aggccctggctgctgatatgccatggaaagggagaatggatgaccactgaagacatgcttgtggtgtggaacagagtgtggattgaggagaacgaccacatggaagacaagaccccagttgaccttttgggacagcggtg

SEQ ID NO: 1196 - DNA, 140 bp, Artificial Sequence
  Synthetic
caccgctgtcccaaaaggtcaactggggtcttgtcttccatgtggtcgttctcctcaatccacactctgttccacaccacaagcatgtcttcagtggtcatccattctccctttccatggcatatcagcagccagggcct

SEQ ID NO: 1197 - DNA, 140 bp, Artificial Sequence
  Synthetic
aggccctggctgctgatatgggaaaccaagcctatagtcaggccgagaacgccatggcacggaagaagccatgctgcctgtgagcccctcagaggatactgagtcaaaaaaccccacgcggaccttttgggacagcggtg

SEQ ID NO: 1198 - DNA, 140 bp, Artificial Sequence
  Synthetic
caccgctgtcccaaaaggtccgcgtggggttttttgactcagtatcctctgaggggctcacaggcagcatggcttcttccgtgccatggcgttctcggcctgactataggcttggtttcccatatcagcagccagggcct

SEQ ID NO: 1199 - DNA, 140 bp, Artificial Sequence
  Synthetic
atacgccatgctgggtctcccttggaggcgcaggatgggaaaagaaggtggcgaccttccccacccttcaatctggggcctgaactggagatcagctgtggatccccagaagagggactacgtacttgggagtcggccat

SEQ ID NO: 1200 - DNA, 140 bp, Artificial Sequence
  Synthetic
atggccgactcccaagtacgtagtccctcttctggggatccacagctgatctccagttcaggccccagattgaagggtggggaaggtcgccaccttcttttcccatcctgcgcctccaagggagacccagcatggcgtat

SEQ ID NO: 1201 - DNA, 140 bp, Artificial Sequence
  Synthetic
aggccctggctgctgatatggtggatccccagaagagggactagtggttagaggagaccccccggaaaacgcaaaacagcatattgacgctgggaaagaccagagactccatgagtttccgaccttttgggacagcggtg

SEQ ID NO: 1202 - DNA, 140 bp, Artificial Sequence
  Synthetic
caccgctgtcccaaaaggtcggaaactcatggagtctctggtctttcccagcgtcaatatgctgttttgcgttttccggggggtctcctctaaccactagtccctcttctggggatccaccatatcagcagccagggcct

SEQ ID NO: 1203 - DNA, 140 bp, Artificial Sequence
  Synthetic
aggccctggctgctgatatggtgaatcagactgcgacagttcgagtttgaagcgaaagctagcaacagtatcaacaggttttattttggatttggaaacgagagtttctggtcatgaaaagaccttttgggacagcggtg

SEQ ID NO: 1204 - DNA, 140 bp, Artificial Sequence
  Synthetic
caccgctgtcccaaaaggtcttttcatgaccagaaactctcgtttccaaatccaaaataaaacctgttgatactgttgctagctttcgcttcaaactcgaactgtcgcagtctgattcaccatatcagcagccagggcct

SEQ ID NO: 1205 - DNA, 140 bp, Artificial Sequence
  Synthetic
aggccctggctgctgatatgccctcccattccactaggaagctgcaaacgcggtcgcaaacctggttggaatcaagagaatacacaaagcacttgattagagtcgaaaattggatatttagaccttttgggacagcggtg

SEQ ID NO: 1206 - DNA, 140 bp, Artificial Sequence
  Synthetic
caccgctgtcccaaaaggtctaaatatccaattttcgactctaatcaagtgctttgtgtattctcttgattccaaccaggtttgcgaccgcgtttgcagcttcctagtggaatgggagggcatatcagcagccagggcct

SEQ ID NO: 1207 - DNA, 140 bp, Artificial Sequence
  Synthetic
atacgccatgctgggtctcccccggcatacagcatcaggtgcataggagtcagcaatagggactttgtggaaggtatgtcaggtgggacctgggttgatgttgtcttggaacatggaggtcgtacttgggagtcggccat

SEQ ID NO: 1208 - DNA, 140 bp, Artificial Sequence
  Synthetic
atggccgactcccaagtacgacctccatgttccaagacaacatcaacccaggtcccacctgacataccttccacaaagtccctattgctgactcctatgcacctgatgctgtatgccgggggagacccagcatggcgtat

SEQ ID NO: 1209 - DNA, 140 bp, Artificial Sequence
  Synthetic
aggccctggctgctgatatgccagcacagtgggatgattgttaatgacacaggacatgaaactgatgagaatagagcgaaagttgagataacgcccaattcaccaagagccgaagccaccgaccttttgggacagcggtg

SEQ ID NO: 1210 - DNA, 140 bp, Artificial Sequence
  Synthetic
caccgctgtcccaaaaggtcggtggcttcggctcttggtgaattgggcgttatctcaactttcgctctattctcatcagtttcatgtcctgtgtcattaacaatcatcccactgtgctggcatatcagcagccagggcct

SEQ ID NO: 1211 - DNA, 140 bp, Artificial Sequence
  Synthetic
aggccctggctgctgatatggcagcaaagacaaataacagctttgtcgtggatggtgacacactgaaggaatgcccactcaaacatagagcatggaacagctttcttgtggaggatcatggaccttttgggacagcggtg

SEQ ID NO: 1212 - DNA, 140 bp, Artificial Sequence
  Synthetic
caccgctgtcccaaaaggtccatgatcctccacaagaaagctgttccatgctctatgtttgagtgggcattccttcagtgtgtcaccatccacgacaaagctgttatttgtctttgctgccatatcagcagccagggcct

SEQ ID NO: 1213 - DNA, 140 bp, Artificial Sequence
  Synthetic
aggccctggctgctgatatgaaagatggctgttggtatggaatggagataaggcccaggaaagaaccagaaagcaacttagtaaggtcaatggtgactgcaggatcaactgatcacatgggaccttttgggacagcggtg

SEQ ID NO: 1214 - DNA, 140 bp, Artificial Sequence
  Synthetic
caccgctgtcccaaaaggtcccatgtgatcagttgatcctgcagtcaccattgaccttactaagttgctttctggttctttcctgggccttatctccattccataccaacagccatctttcatatcagcagccagggcct

SEQ ID NO: 1215 - DNA, 140 bp, Artificial Sequence
  Synthetic
atacgccatgctgggtctccaagcaacttagtaaggtcaatggtgactgcaggatcaactgatcacatggaccacttctcccttggagtgcttgtgattctgctcatggtgcaggaagggcgtacttgggagtcggccat

SEQ ID NO: 1216 - DNA, 140 bp, Artificial Sequence
  Synthetic
atggccgactcccaagtacgcccttcctgcaccatgagcagaatcacaagcactccaagggagaagtggtccatgtgatcagttgatcctgcagtcaccattgaccttactaagttgcttggagacccagcatggcgtat

SEQ ID NO: 1217 - DNA, 140 bp, Artificial Sequence
  Synthetic
atacgccatgctgggtctccgctggtagctatgatcctgggaggattttcaatgagtgacctggctaagcttgcaattttgatgggtgccaccttcgcggaaatgaacactggaggagatcgtacttgggagtcggccat

SEQ ID NO: 1218 - DNA, 140 bp, Artificial Sequence
  Synthetic
atggccgactcccaagtacgatctcctccagtgttcatttccgcgaaggtggcacccatcaaaattgcaagcttagccaggtcactcattgaaaatcctcccaggatcatagctaccagcggagacccagcatggcgtat

SEQ ID NO: 1219 - DNA, 140 bp, Artificial Sequence
  Synthetic
aggccctggctgctgatatgaccacagatggagtgtacagagtaatgactcgtagactgctaggttcaacacaagttggagtgggagttatgcaagagggggtctttcacactatgtggcgaccttttgggacagcggtg

SEQ ID NO: 1220 - DNA, 140 bp, Artificial Sequence
  Synthetic
caccgctgtcccaaaaggtcgccacatagtgtgaaagaccccctcttgcataactcccactccaacttgtgttgaacctagcagtctacgagtcattactctgtacactccatctgtggtcatatcagcagccagggcct

SEQ ID NO: 1221 - DNA, 140 bp, Artificial Sequence
  Synthetic
aggccctggctgctgatatgttcaggatctccaatcctagacaagtgtgggagagtgataggactttatggcaatggggtcgtgatcaaaaatgggagttatgttagtgccatcacccaagaccttttgggacagcggtg

SEQ ID NO: 1222 - DNA, 140 bp, Artificial Sequence
  Synthetic
caccgctgtcccaaaaggtcttgggtgatggcactaacataactcccatttttgatcacgaccccattgccataaagtcctatcactctcccacacttgtctaggattggagatcctgaacatatcagcagccagggcct

SEQ ID NO: 1223 - DNA, 140 bp, Artificial Sequence
  Synthetic
atacgccatgctgggtctccccaggagagttcttcctgaaatagtccgtgaagccataaaaacaagactccgcaccgtgatcttagctccaaccagggttgtcgctgctgaaatggaggacgtacttgggagtcggccat

SEQ ID NO: 1224 - DNA, 140 bp, Artificial Sequence
  Synthetic
atggccgactcccaagtacgtcctccatttcagcagcgacaaccctggttggagctaagatcacggtgcggagtcttgtttttatggcttcacggactatttcaggaagaactctcctggggagacccagcatggcgtat

SEQ ID NO: 1225 - DNA, 140 bp, Artificial Sequence
  Synthetic
aggccctggctgctgatatgtttcaacaagggttgagatgggcgaggcggctgccatcttcatgaccgccacgccaccaggaacccgtgacgcatttccggactccaactcaccaattatgaccttttgggacagcggtg

SEQ ID NO: 1226 - DNA, 140 bp, Artificial Sequence
  Synthetic
caccgctgtcccaaaaggtcataattggtgagttggagtccggaaatgcgtcacgggttcctggtggcgtggcggtcatgaagatggcagccgcctcgcccatctcaacccttgttgaaacatatcagcagccagggcct

SEQ ID NO: 1227 - DNA, 140 bp, Artificial Sequence
  Synthetic
atacgccatgctgggtctccgagccagccagaattgcatgtgtcctcattgttgtgtttctattgctggtggtgctcatacctgagccagaaaagcaaagatctccccaggacaaccaaacgtacttgggagtcggccat

SEQ ID NO: 1228 - DNA, 140 bp, Artificial Sequence
  Synthetic
atggccgactcccaagtacgtttggttgtcctggggagatctttgcttttctggctcaggtatgagcaccaccagcaatagaaacacaacaatgaggacacatgcaattctggctggctcggagacccagcatggcgtat

SEQ ID NO: 1229 - DNA, 140 bp, Artificial Sequence
  Synthetic
aggccctggctgctgatatgaccccagccgtccaacatgcagtgaccacttcatacaacaactactccttaatggcgatggccacgcaagctggagtgttgtttggtatgggcaaagggagaccttttgggacagcggtg

SEQ ID NO: 1230 - DNA, 140 bp, Artificial Sequence
  Synthetic
caccgctgtcccaaaaggtctccctttgcccataccaaacaacactccagcttgcgtggccatcgccattaaggagtagttgttgtatgaagtggtcactgcatgttggacggctggggtcatatcagcagccagggcct

SEQ ID NO: 1231 - DNA, 140 bp, Artificial Sequence
  Synthetic
aggccctggctgctgatatgctgcccagaagagaacggcagctggcatcatgaagaaccctgttgtggatggaatagtggtgactgacattgacacaatgacaattgacccccaagtggagaccttttgggacagcggtg

SEQ ID NO: 1232 - DNA, 140 bp, Artificial Sequence
  Synthetic
caccgctgtcccaaaaggtctccacttgggggtcaattgtcattgtgtcaatgtcagtcaccactattccatccacaacagggttcttcatgatgccagctgccgttctcttctgggcagcatatcagcagccagggcct

SEQ ID NO: 1233 - DNA, 140 bp, Artificial Sequence
  Synthetic
aggccctggctgctgatatggaaaaagatgggacaggtgctactcatagcagtagccgtctccagcgccatactgtcgcggaccgcctgggggtggggggaggctggggccctgatcacagaccttttgggacagcggtg

SEQ ID NO: 1234 - DNA, 140 bp, Artificial Sequence
  Synthetic
caccgctgtcccaaaaggtctgtgatcagggccccagcctccccccacccccaggcggtccgcgacagtatggcgctggagacggctactgctatgagtagcacctgtcccatctttttccatatcagcagccagggcct

SEQ ID NO: 1235 - DNA, 140 bp, Artificial Sequence
  Synthetic
aggccctggctgctgatatgcatggtgggggattggcttgaaaaaagaccaggagccttttgtataaaggtgttgtgcccatacaccagcactatgatggaaaccctggagcgactgcaggaccttttgggacagcggtg

SEQ ID NO: 1236 - DNA, 140 bp, Artificial Sequence
  Synthetic
caccgctgtcccaaaaggtcctgcagtcgctccagggtttccatcatagtgctggtgtatgggcacaacacctttatacaaaaggctcctggtcttttttcaagccaatcccccaccatgcatatcagcagccagggcct

SEQ ID NO: 1237 - DNA, 140 bp, Artificial Sequence
  Synthetic
aggccctggctgctgatatgcgtaggtatgggggaggactggtcagagtgccactctcccgcaactctacacatgagatgtattgggtctctggagcgaaaagcaacaccataaaaagtggaccttttgggacagcggtg

SEQ ID NO: 1238 - DNA, 140 bp, Artificial Sequence
  Synthetic
caccgctgtcccaaaaggtccactttttatggtgttgcttttcgctccagagacccaatacatctcatgtgtagagttgcgggagagtggcactctgaccagtcctcccccatacctacgcatatcagcagccagggcct

SEQ ID NO: 1239 - DNA, 140 bp, Artificial Sequence
  Synthetic
aggccctggctgctgatatgtgtccaccacgagccagctcctcttggggcgcatggacgggcctaggaggccagtgaaatatgaggaggatgtggatctcggctctggcacgcgggctgtgaccttttgggacagcggtg

SEQ ID NO: 1240 - DNA, 140 bp, Artificial Sequence
  Synthetic
caccgctgtcccaaaaggtcacagcccgcgtgccagagccgagatccacatcctcctcatatttcactggcctcctaggcccgtccatgcgccccaagaggagctggctcgtggtggacacatatcagcagccagggcct

SEQ ID NO: 1241 - DNA, 140 bp, Artificial Sequence
  Synthetic
atacgccatgctgggtctccggaaaaagagtggaagactgcagtggaagctgtgaacgatccaaggttctgggctctagtggataaggaaagagagcaccacctgagaggagagtgccagcgtacttgggagtcggccat

SEQ ID NO: 1242 - DNA, 140 bp, Artificial Sequence
  Synthetic
atggccgactcccaagtacgctggcactctcctctcaggtggtgctctctttccttatccactagagcccagaaccttggatcgttcacagcttccactgcagtcttccactctttttccggagacccagcatggcgtat

SEQ ID NO: 1243 - DNA, 140 bp, Artificial Sequence
  Synthetic
aggccctggctgctgatatgcagatgacactgctggctgggacacccgcatcagcaggtttgatctggagaatgaagctctaatcaccaaccaaatggaaaaagggcacagggccttggcgaccttttgggacagcggtg

SEQ ID NO: 1244 - DNA, 140 bp, Artificial Sequence
  Synthetic
caccgctgtcccaaaaggtcgccaaggccctgtgccctttttccatttggttggtgattagagcttcattctccagatcaaacctgctgatgcgggtgtcccagccagcagtgtcatctgcatatcagcagccagggcct

SEQ ID NO: 1245 - DNA, 140 bp, Artificial Sequence
  Synthetic
aggccctggctgctgatatgcagagtgtggattgaggagaacgaccacatggaagacaagaccccagttacgaaatggacagacatcccctatttgggaaaaagggaagacttgtggtgtgaccttttgggacagcggtg

SEQ ID NO: 1246 - DNA, 140 bp, Artificial Sequence
  Synthetic
caccgctgtcccaaaaggtcacaccacaagtcttccctttttcccaaataggggatgtctgtccatttcgtaactggggtcttgtcttccatgtggtcgttctcctcaatccacactctgcatatcagcagccagggcct

SEQ ID NO: 1247 - DNA, 140 bp, Artificial Sequence
  Synthetic
aggccctggctgctgatatgccacagcttggggaaagctgtgcagcctgtgaccccccaggagaagctgggaaaccaagcctatagtcaggccgagaacgccatggcacggaagaagccagaccttttgggacagcggtg

SEQ ID NO: 1248 - DNA, 140 bp, Artificial Sequence
  Synthetic
caccgctgtcccaaaaggtctggcttcttccgtgccatggcgttctcggcctgactataggcttggtttcccagcttctcctggggggtcacaggctgcacagctttccccaagctgtggcatatcagcagccagggcct

SEQ ID NO: 1249 - DNA, 140 bp, Artificial Sequence
  Synthetic
aggccctggctgctgatatgttggaggcgcaggatgggaaaagaaggtggcgaccttccccacccttcaatctggggcctgaactggagatcagctgtggatctccagaagagggactaggaccttttgggacagcggtg

SEQ ID NO: 1250 - DNA, 140 bp, Artificial Sequence
  Synthetic
caccgctgtcccaaaaggtcctagtccctcttctggagatccacagctgatctccagttcaggccccagattgaagggtggggaaggtcgccaccttcttttcccatcctgcgcctccaacatatcagcagccagggcct

SEQ ID NO: 1251 - DNA, 140 bp, Artificial Sequence
  Synthetic
aggccctggctgctgatatggatgggaaaagaaggtggcgaccttccccacccttcaatctggggcctgaactggagatcagctgtggatctccagaagagggactagtggttagaggaggaccttttgggacagcggtg

SEQ ID NO: 1252 - DNA, 140 bp, Artificial Sequence
  Synthetic
caccgctgtcccaaaaggtcctcctctaaccactagtccctcttctggagatccacagctgatctccagttcaggccccagattgaagggtggggaaggtcgccaccttcttttcccatccatatcagcagccagggcct

SEQ ID NO: 1253 - DNA, 140 bp, Artificial Sequence
  Synthetic
atacgccatgctgggtctccatgaaaaacccaaagaagaaatccggaggattccggattgtcaatatgctaaaacgcggagtagcccgtgtaaaccccttgggaggtttgaagaggttgccgtacttgggagtcggccat

SEQ ID NO: 1254 - DNA, 140 bp, Artificial Sequence
  Synthetic
atggccgactcccaagtacggcaacctcttcaaacctcccaaggggtttacacgggctactccgcgttttagcatattgacaatccggaatcctccggatttcttctttgggtttttcatggagacccagcatggcgtat

SEQ ID NO: 1255 - DNA, 140 bp, Artificial Sequence
  Synthetic
aggccctggctgctgatatgaaaacgcggagtagcccgtgtaaaccccttgggaggtttgaagaggttgccagccggacttctgctgggtcatggacccatcagaatggttttggcgatagaccttttgggacagcggtg

SEQ ID NO: 1256 - DNA, 140 bp, Artificial Sequence
  Synthetic
caccgctgtcccaaaaggtctatcgccaaaaccattctgatgggtccatgacccagcagaagtccggctggcaacctcttcaaacctcccaaggggtttacacgggctactccgcgttttcatatcagcagccagggcct

SEQ ID NO: 1257 - DNA, 140 bp, Artificial Sequence
  Synthetic
atacgccatgctgggtctcccagccggacttctgctgggtcatggacccatcagaatggttttggcgatactagcctttttgagatttacagcaatcaagccatcactgggccttatcaacgtacttgggagtcggccat

SEQ ID NO: 1258 - DNA, 140 bp, Artificial Sequence
  Synthetic
atggccgactcccaagtacgttgataaggcccagtgatggcttgattgctgtaaatctcaaaaaggctagtatcgccaaaaccattctgatgggtccatgacccagcagaagtccggctgggagacccagcatggcgtat

SEQ ID NO: 1259 - DNA, 140 bp, Artificial Sequence
  Synthetic
atacgccatgctgggtctcccagatggggttccgtggggaaaaaagaggctatggaaataataaagaagttcaagaaagatcttgctgccatgttgagaataatcaatgctaggaaagagcgtacttgggagtcggccat

SEQ ID NO: 1260 - DNA, 140 bp, Artificial Sequence
  Synthetic
atggccgactcccaagtacgctctttcctagcattgattattctcaacatggcagcaagatctttcttgaacttctttattatttccatagcctcttttttccccacggaaccccatctgggagacccagcatggcgtat

SEQ ID NO: 1261 - DNA, 140 bp, Artificial Sequence
  Synthetic
atacgccatgctgggtctccaggaagagacgtggcgcagacaccagcatcggaatcattggcctcctgctgactacagccatggcagcagagatcactagacgcgggagtgcatactacacgtacttgggagtcggccat

SEQ ID NO: 1262 - DNA, 140 bp, Artificial Sequence
  Synthetic
atggccgactcccaagtacgtgtagtatgcactcccgcgtctagtgatctctgctgccatggctgtagtcagcaggaggccaatgattccgatgctggtgtctgcgccacgtctcttcctggagacccagcatggcgtat

SEQ ID NO: 1263 - DNA, 140 bp, Artificial Sequence
  Synthetic
atacgccatgctgggtctcctgtacttggataggagcgatgccgggaaggccatttcgtttgctaccacattgggagtgaacaagtgccacgtacagatcatggacctcgggcacatgtgcgtacttgggagtcggccat

SEQ ID NO: 1264 - DNA, 140 bp, Artificial Sequence
  Synthetic
atggccgactcccaagtacgcacatgtgcccgaggtccatgatctgtacgtggcacttgttcactcccaatgtggtagcaaacgaaatggccttcccggcatcgctcctatccaagtacaggagacccagcatggcgtat

SEQ ID NO: 1265 - DNA, 140 bp, Artificial Sequence
  Synthetic
atacgccatgctgggtctcctgacgccaccatgagttatgagtgccctatgctggatgagggagtggaaccagatgatgtcgattgctggtgcaacacgacatcaacttgggttgtgtaccgtacttgggagtcggccat

SEQ ID NO: 1266 - DNA, 140 bp, Artificial Sequence
  Synthetic
atggccgactcccaagtacggtacacaacccaagttgatgtcgtgttgcaccagcaatcgacatcatctggttccactccctcatccagcatagggcactcataactcatggtggcgtcaggagacccagcatggcgtat

SEQ ID NO: 1267 - DNA, 140 bp, Artificial Sequence
  Synthetic
atacgccatgctgggtctccggaacctgtcatcacaaaaaaggtgaggcacggcgatctagaagagccgtgacgctcccttctcactctacaaggaagttgcaaacgcggtcgcagacctcgtacttgggagtcggccat

SEQ ID NO: 1268 - DNA, 140 bp, Artificial Sequence
  Synthetic
atggccgactcccaagtacgaggtctgcgaccgcgtttgcaacttccttgtagagtgagaagggagcgtcacggctcttctagatcgccgtgcctcaccttttttgtgatgacaggttccggagacccagcatggcgtat

SEQ ID NO: 1269 - DNA, 140 bp, Artificial Sequence
  Synthetic
atacgccatgctgggtctccggttagaatcaagagaatacacgaagcacttgatcaaggttgaaaactggatattcaggaaccccgggtttgcgctagtggccgttgccattgcctggctcgtacttgggagtcggccat

SEQ ID NO: 1270 - DNA, 140 bp, Artificial Sequence
  Synthetic
atggccgactcccaagtacgagccaggcaatggcaacggccactagcgcaaacccggggttcctgaatatccagttttcaaccttgatcaagtgcttcgtgtattctcttgattctaaccggagacccagcatggcgtat

SEQ ID NO: 1271 - DNA, 140 bp, Artificial Sequence
  Synthetic
aggccctggctgctgatatgatattcaggaaccccgggtttgcgctagtggccgttgccattgcctggcttttgggaagctcgacgagccaaaaagtcatatacttggtcatgatactgcgaccttttgggacagcggtg

SEQ ID NO: 1272 - DNA, 140 bp, Artificial Sequence
  Synthetic
caccgctgtcccaaaaggtcgcagtatcatgaccaagtatatgactttttggctcgtcgagcttcccaaaagccaggcaatggcaacggccactagcgcaaacccggggttcctgaatatcatatcagcagccagggcct

SEQ ID NO: 1273 - DNA, 140 bp, Artificial Sequence
  Synthetic
atacgccatgctgggtctcctgattgccccggcatacagtatcaggtgcattggagtcagcaatagagacttcgtggagggcatgtcaggtgggacctgggttgatgttgtcttggaacacgtacttgggagtcggccat

SEQ ID NO: 1274 - DNA, 140 bp, Artificial Sequence
  Synthetic
atggccgactcccaagtacgtgttccaagacaacatcaacccaggtcccacctgacatgccctccacgaagtctctattgctgactccaatgcacctgatactgtatgccggggcaatcaggagacccagcatggcgtat

SEQ ID NO: 1275 - DNA, 140 bp, Artificial Sequence
  Synthetic
aggccctggctgctgatatgttcgtggagggcatgtcaggtgggacctgggttgatgttgtcttggaacatggaggctgcgttaccgtgatggcacaggacaagccaacagttgacataggaccttttgggacagcggtg

SEQ ID NO: 1276 - DNA, 140 bp, Artificial Sequence
  Synthetic
caccgctgtcccaaaaggtcctatgtcaactgttggcttgtcctgtgccatcacggtaacgcagcctccatgttccaagacaacatcaacccaggtcccacctgacatgccctccacgaacatatcagcagccagggcct

SEQ ID NO: 1277 - DNA, 140 bp, Artificial Sequence
  Synthetic
atacgccatgctgggtctccagttggtcacgacgacggttagtaacatggccgaggtaagatcctattgctacgaggcatcgatatcggacatggcttcggacagtcgttgcccaacacacgtacttgggagtcggccat

SEQ ID NO: 1278 - DNA, 140 bp, Artificial Sequence
  Synthetic
atggccgactcccaagtacgtgtgttgggcaacgactgtccgaagccatgtccgatatcgatgcctcgtagcaataggatcttacctcggccatgttactaaccgtcgtcgtgaccaactggagacccagcatggcgtat

SEQ ID NO: 1279 - DNA, 140 bp, Artificial Sequence
  Synthetic
atacgccatgctgggtctccaggtgaagcctaccttgacaagcaatcagacactcaatatgtctgcaaaagaacattagtggacagaggttggggaaatggttgtggactttttggcaaacgtacttgggagtcggccat

SEQ ID NO: 1280 - DNA, 140 bp, Artificial Sequence
  Synthetic
atggccgactcccaagtacgtttgccaaaaagtccacaaccatttccccaacctctgtccactaatgttcttttgcagacatattgagtgtctgattgcttgtcaaggtaggcttcacctggagacccagcatggcgtat

SEQ ID NO: 1281 - DNA, 140 bp, Artificial Sequence
  Synthetic
atacgccatgctgggtctccgggagcttggtgacatgtgccaagttcacgtgttctaagaagatgaccgggaagagcattcaaccggaaaatctggagtatcggataatgctatcagtgccgtacttgggagtcggccat

SEQ ID NO: 1282 - DNA, 140 bp, Artificial Sequence
  Synthetic
atggccgactcccaagtacggcactgatagcattatccgatactccagattttccggttgaatgctcttcccggtcatcttcttagaacacgtgaacttggcacatgtcaccaagctcccggagacccagcatggcgtat

SEQ ID NO: 1283 - DNA, 140 bp, Artificial Sequence
  Synthetic
aggccctggctgctgatatgatggctcccagcatagcgggatgattgtcaatgatataggacatgaaactgacgaaaacagagcgaaagtcgaggttacgcctaattcaccaagagcggagaccttttgggacagcggtg

SEQ ID NO: 1284 - DNA, 140 bp, Artificial Sequence
  Synthetic
caccgctgtcccaaaaggtctccgctcttggtgaattaggcgtaacctcgactttcgctctgttttcgtcagtttcatgtcctatatcattgacaatcatcccgctatgctgggagccatcatatcagcagccagggcct

SEQ ID NO: 1285 - DNA, 140 bp, Artificial Sequence
  Synthetic
aggccctggctgctgatatgagcaaccttgggaggctttggaagcttaggacttgactgtgaaccaaggacaggccttgacttttcagatctgtattacctgaccatgaacaataagcatgaccttttgggacagcggtg

SEQ ID NO: 1286 - DNA, 140 bp, Artificial Sequence
  Synthetic
caccgctgtcccaaaaggtcatgcttattgttcatggtcaggtaatacagatctgaaaagtcaaggcctgtccttggttcacagtcaagtcctaagcttccaaagcctcccaaggttgctcatatcagcagccagggcct

SEQ ID NO: 1287 - DNA, 140 bp, Artificial Sequence
  Synthetic
atacgccatgctgggtctcctggttggtgcacaaagagtggtttcatgacatcccattgccttggcatgctggggcagacaccggaactccacactggaacaacaaagaggcattggtagcgtacttgggagtcggccat

SEQ ID NO: 1288 - DNA, 140 bp, Artificial Sequence
  Synthetic
atggccgactcccaagtacgctaccaatgcctctttgttgttccagtgtggagttccggtgtctgccccagcatgccaaggcaatgggatgtcatgaaaccactctttgtgcaccaaccaggagacccagcatggcgtat

SEQ ID NO: 1289 - DNA, 140 bp, Artificial Sequence
  Synthetic
atacgccatgctgggtctccaattcaaggatgcccacgccaagaggcaaaccgtcgtcgttctggggagccaggaaggagccgttcacacggctctcgctggagctctagaggctgagatcgtacttgggagtcggccat

SEQ ID NO: 1290 - DNA, 140 bp, Artificial Sequence
  Synthetic
atggccgactcccaagtacgatctcagcctctagagctccagcgagagccgtgtgaacggctccttcctggctccccagaacgacgacggtttgcctcttggcgtgggcatccttgaattggagacccagcatggcgtat

SEQ ID NO: 1291 - DNA, 140 bp, Artificial Sequence
  Synthetic
atacgccatgctgggtctccaaatggacaagcttagattgaagggcgtgtcatattccttgtgcactgcggcattcacattcaccaaggtcccagctgaaacactgcatggaacagtcaccgtacttgggagtcggccat

SEQ ID NO: 1292 - DNA, 140 bp, Artificial Sequence
  Synthetic
atggccgactcccaagtacggtgactgttccatgcagtgtttcagctgggaccttggtgaatgtgaatgccgcagtgcacaaggaatatgacacgcccttcaatctaagcttgtccatttggagacccagcatggcgtat

SEQ ID NO: 1293 - DNA, 140 bp, Artificial Sequence
  Synthetic
aggccctggctgctgatatgagtggaggtgcagtatgcagggacagatggaccctgcaaggtcccagcccagatggcggtggacatgcagaccctgaccccagttggaaggctgataaccgaccttttgggacagcggtg

SEQ ID NO: 1294 - DNA, 140 bp, Artificial Sequence
  Synthetic
caccgctgtcccaaaaggtcggttatcagccttccaactggggtcagggtctgcatgtccaccgccatctgggctgggaccttgcagggtccatctgtccctgcatactgcacctccactcatatcagcagccagggcct

SEQ ID NO: 1295 - DNA, 140 bp, Artificial Sequence
  Synthetic
atacgccatgctgggtctccgccaaccccgtgattactgaaagcactgagaactcaaagatgatgttggagcttgacccaccatttggggattcttacattgtcataggagttggggacacgtacttgggagtcggccat

SEQ ID NO: 1296 - DNA, 140 bp, Artificial Sequence
  Synthetic
atggccgactcccaagtacgtgtccccaactcctatgacaatgtaagaatccccaaatggtgggtcaagctccaacatcatctttgagttctcagtgctttcagtaatcacggggttggcggagacccagcatggcgtat

SEQ ID NO: 1297 - DNA, 140 bp, Artificial Sequence
  Synthetic
atacgccatgctgggtctccagaaaatcacccaccactggcataggagtggtagcaccatcggaaaggcatttgaagccactgtgagaggcgccaagagaatggcagtcctgggggataccgtacttgggagtcggccat

SEQ ID NO: 1298 - DNA, 140 bp, Artificial Sequence
  Synthetic
atggccgactcccaagtacggtatcccccaggactgccattctcttggcgcctctcacagtggcttcaaatgcctttccgatggtgctaccactcctatgccagtggtgggtgattttctggagacccagcatggcgtat

SEQ ID NO: 1299 - DNA, 140 bp, Artificial Sequence
  Synthetic
atacgccatgctgggtctccagcctgggacttcggatcagtcgggggtgtgttcaactcactgggtaagggcattcaccagatttttggagcagccttcaaatcactgtttggaggaatgcgtacttgggagtcggccat

SEQ ID NO: 1300 - DNA, 140 bp, Artificial Sequence
  Synthetic
atggccgactcccaagtacgcattcctccaaacagtgatttgaaggctgctccaaaaatctggtgaatgcccttacccagtgagttgaacacacccccgactgatccgaagtcccaggctggagacccagcatggcgtat

SEQ ID NO: 1301 - DNA, 140 bp, Artificial Sequence
  Synthetic
atacgccatgctgggtctcctcctggttctcacagatcctcataggcacgctgctagtgtggttaggtttgaacacaaagaatggatctatctccctcacatgcttggccctggggggagcgtacttgggagtcggccat

SEQ ID NO: 1302 - DNA, 140 bp, Artificial Sequence
  Synthetic
atggccgactcccaagtacgctccccccagggccaagcatgtgagggagatagatccattctttgtgttcaaacctaaccacactagcagcgtgcctatgaggatctgtgagaaccaggaggagacccagcatggcgtat

SEQ ID NO: 1303 - DNA, 140 bp, Artificial Sequence
  Synthetic
atacgccatgctgggtctcctgatgatcttcctctccacggctgtttctgctgacgtggggtgctcagtggacttctcaaaaagagaaacgagatgtggcacgggggtattcatctataacgtacttgggagtcggccat

SEQ ID NO: 1304 - DNA, 140 bp, Artificial Sequence
  Synthetic
atggccgactcccaagtacgttatagatgaatacccccgtgccacatctcgtttctctttttgagaagtccactgagcaccccacgtcagcagaaacagccgtggagaggaagatcatcaggagacccagcatggcgtat

SEQ ID NO: 1305 - DNA, 140 bp, Artificial Sequence
  Synthetic
atacgccatgctgggtctcctgatgttgaagcctggagggaccggtacaagtaccatcctgactccccccgcagattggcagcagcagtcaagcaggcctgggaagaggggatctgtgggcgtacttgggagtcggccat

SEQ ID NO: 1306 - DNA, 140 bp, Artificial Sequence
  Synthetic
atggccgactcccaagtacgcccacagatcccctcttcccaggcctgcttgactgctgctgccaatctgcggggggagtcaggatggtacttgtaccggtccctccaggcttcaacatcaggagacccagcatggcgtat

SEQ ID NO: 1307 - DNA, 140 bp, Artificial Sequence
  Synthetic
atacgccatgctgggtctccatctcatccgtttcaagaatggaaaacatcatgtggaaatcagtagaaggggagctcaatgctatcctagaggagaatggagttcaactgacagttgttgcgtacttgggagtcggccat

SEQ ID NO: 1308 - DNA, 140 bp, Artificial Sequence
  Synthetic
atggccgactcccaagtacgcaacaactgtcagttgaactccattctcctctaggatagcattgagctccccttctactgatttccacatgatgttttccattcttgaaacggatgagatggagacccagcatggcgtat

SEQ ID NO: 1309 - DNA, 140 bp, Artificial Sequence
  Synthetic
aggccctggctgctgatatgggagctcaatgctatcctagaggagaatggagttcaactgacagttgttgtgggatctgtaaaaaaccccatgtggagaggtccacaaagattgccagtggaccttttgggacagcggtg

SEQ ID NO: 1310 - DNA, 140 bp, Artificial Sequence
  Synthetic
caccgctgtcccaaaaggtccactggcaatctttgtggacctctccacatggggttttttacagatcccacaacaactgtcagttgaactccattctcctctaggatagcattgagctcccatatcagcagccagggcct

SEQ ID NO: 1311 - DNA, 140 bp, Artificial Sequence
  Synthetic
atacgccatgctgggtctcctgggatctgtaaaaaaccccatgtggagaggtccacaaagattgccagtgcctgtgaatgggctgccccatggctggaaagcctgggggaaatcgtatttcgtacttgggagtcggccat

SEQ ID NO: 1312 - DNA, 140 bp, Artificial Sequence
  Synthetic
atggccgactcccaagtacgaaatacgatttcccccaggctttccagccatggggcagcccattcacaggcactggcaatctttgtggacctctccacatggggttttttacagatcccaggagacccagcatggcgtat

SEQ ID NO: 1313 - DNA, 140 bp, Artificial Sequence
  Synthetic
atacgccatgctgggtctcctgttagggcggcaaagaccaacaacagttttgttgtcgacggtgacacactgaaggaatgtccgcttaagcacagagcatggaatagttttcttgtggagcgtacttgggagtcggccat

SEQ ID NO: 1314 - DNA, 140 bp, Artificial Sequence
  Synthetic
atggccgactcccaagtacgctccacaagaaaactattccatgctctgtgcttaagcggacattccttcagtgtgtcaccgtcgacaacaaaactgttgttggtctttgccgccctaacaggagacccagcatggcgtat

SEQ ID NO: 1315 - DNA, 140 bp, Artificial Sequence
  Synthetic
aggccctggctgctgatatgtgaaggaatgtccgcttaagcacagagcatggaatagttttcttgtggaggatcacgggtttggagtcttccacaccagtgtttggcttaaggtcagagagaccttttgggacagcggtg

SEQ ID NO: 1316 - DNA, 140 bp, Artificial Sequence
  Synthetic
caccgctgtcccaaaaggtctctctgaccttaagccaaacactggtgtggaagactccaaacccgtgatcctccacaagaaaactattccatgctctgtgcttaagcggacattccttcacatatcagcagccagggcct

SEQ ID NO: 1317 - DNA, 140 bp, Artificial Sequence
  Synthetic
atacgccatgctgggtctccagattactcattagaatgtgacccagccgtcataggaacagctgttaagggaagggaggccgcgcacagtgatctgggctattggattgaaagtgaaaagcgtacttgggagtcggccat

SEQ ID NO: 1318 - DNA, 140 bp, Artificial Sequence
  Synthetic
atggccgactcccaagtacgcttttcactttcaatccaatagcccagatcactgtgcgcggcctcccttcccttaacagctgttcctatgacggctgggtcacattctaatgagtaatctggagacccagcatggcgtat

SEQ ID NO: 1319 - DNA, 140 bp, Artificial Sequence
  Synthetic
aggccctggctgctgatatggaagggaggccgcgcacagtgatctgggctattggattgaaagtgaaaagaatgacacatggaggctgaagagggcccacctgattgagatgaaaacatggaccttttgggacagcggtg

SEQ ID NO: 1320 - DNA, 140 bp, Artificial Sequence
  Synthetic
caccgctgtcccaaaaggtccatgttttcatctcaatcaggtgggccctcttcagcctccatgtgtcattcttttcactttcaatccaatagcccagatcactgtgcgcggcctcccttccatatcagcagccagggcct

SEQ ID NO: 1321 - DNA, 140 bp, Artificial Sequence
  Synthetic
atacgccatgctgggtctccagagagggttacagaacccaagtgaaagggccatggcacagtgaagagcttgaaatccggtttgaggaatgtccaggcaccaaggttcacgtggaggagacgtacttgggagtcggccat

SEQ ID NO: 1322 - DNA, 140 bp, Artificial Sequence
  Synthetic
atggccgactcccaagtacgtctcctccacgtgaaccttggtgcctggacattcctcaaaccggatttcaagctcttcactgtgccatggccctttcacttgggttctgtaaccctctctggagacccagcatggcgtat

SEQ ID NO: 1323 - DNA, 140 bp, Artificial Sequence
  Synthetic
atacgccatgctgggtctcctggcagtgctggtagtcatgatcttgggaggattttcaatgagtgacctggccaagcttgtgatcctgatgggtgctactttcgcagaaatgaacactggcgtacttgggagtcggccat

SEQ ID NO: 1324 - DNA, 140 bp, Artificial Sequence
  Synthetic
atggccgactcccaagtacgccagtgttcatttctgcgaaagtagcacccatcaggatcacaagcttggccaggtcactcattgaaaatcctcccaagatcatgactaccagcactgccaggagacccagcatggcgtat

SEQ ID NO: 1325 - DNA, 140 bp, Artificial Sequence
  Synthetic
aggccctggctgctgatatggccaagcttgtgatcctgatgggtgctactttcgcagaaatgaacactggaggagatgtagctcacttggcattggtagcggcatttaaagtcagaccaggaccttttgggacagcggtg

SEQ ID NO: 1326 - DNA, 140 bp, Artificial Sequence
  Synthetic
caccgctgtcccaaaaggtcctggtctgactttaaatgccgctaccaatgccaagtgagctacatctcctccagtgttcatttctgcgaaagtagcacccatcaggatcacaagcttggccatatcagcagccagggcct

SEQ ID NO: 1327 - DNA, 140 bp, Artificial Sequence
  Synthetic
atacgccatgctgggtctccaggagatgtagctcacttggcattggtagcggcatttaaagtcagaccagccttgctggtctccttcattctcagagccaattggacaccccgtgagagccgtacttgggagtcggccat

SEQ ID NO: 1328 - DNA, 140 bp, Artificial Sequence
  Synthetic
atggccgactcccaagtacggctctcacggggtgtccaattggctctgagaatgaaggagaccagcaaggctggtctgactttaaatgccgctaccaatgccaagtgagctacatctcctggagacccagcatggcgtat

SEQ ID NO: 1329 - DNA, 140 bp, Artificial Sequence
  Synthetic
atacgccatgctgggtctccatgctgctagccctggcttcgtgtcttctgcaaactgcgatctctgctcttgaaggtgacttgatggtcctcgttaatggatttgctttggcctggttggcgtacttgggagtcggccat

SEQ ID NO: 1330 - DNA, 140 bp, Artificial Sequence
  Synthetic
atggccgactcccaagtacgccaaccaggccaaagcaaatccattaacgaggaccatcaagtcaccttcaagagcagagatcgcagtttgcagaagacacgaagccagggctagcagcatggagacccagcatggcgtat

SEQ ID NO: 1331 - DNA, 140 bp, Artificial Sequence
  Synthetic
atacgccatgctgggtctcccaattcgagcaatggccgtgccacgcactgacaacatcgctctagcaatcttggctgctctaacaccactagctcgaggcacactgctcgtggcatggagcgtacttgggagtcggccat

SEQ ID NO: 1332 - DNA, 140 bp, Artificial Sequence
  Synthetic
atggccgactcccaagtacgctccatgccacgagcagtgtgcctcgagctagtggtgttagagcagccaagattgctagagcgatgttgtcagtgcgtggcacggccattgctcgaattgggagacccagcatggcgtat

SEQ ID NO: 1333 - DNA, 140 bp, Artificial Sequence
  Synthetic
aggccctggctgctgatatgttggctgctctaacaccactagctcgaggcacactgctcgtggcatggagagcgggcctggctacttgtggagggttcatgctcctctccctgaaagggagaccttttgggacagcggtg

SEQ ID NO: 1334 - DNA, 140 bp, Artificial Sequence
  Synthetic
caccgctgtcccaaaaggtctccctttcagggagaggagcatgaaccctccacaagtagccaggcccgctctccatgccacgagcagtgtgcctcgagctagtggtgttagagcagccaacatatcagcagccagggcct

SEQ ID NO: 1335 - DNA, 140 bp, Artificial Sequence
  Synthetic
atacgccatgctgggtctccaaggtagtgtgaagaagaacctgccatttgtcatggccctgggattgacagctgtgagggtagtagaccctattaatgtggtaggactactgttactcaccgtacttgggagtcggccat

SEQ ID NO: 1336 - DNA, 140 bp, Artificial Sequence
  Synthetic
atggccgactcccaagtacggtgagtaacagtagtcctaccacattaatagggtctactaccctcacagctgtcaatcccagggccatgacaaatggcaggttcttcttcacactaccttggagacccagcatggcgtat

SEQ ID NO: 1337 - DNA, 140 bp, Artificial Sequence
  Synthetic
atacgccatgctgggtctccaaggagtgggaagcggagctggccccctagtgaagttctcacagccgttggcctgatatgtgcactggccggagggtttgccaaggcagacattgagatgcgtacttgggagtcggccat

SEQ ID NO: 1338 - DNA, 140 bp, Artificial Sequence
  Synthetic
atggccgactcccaagtacgcatctcaatgtctgccttggcaaaccctccggccagtgcacatatcaggccaacggctgtgagaacttcactagggggccagctccgcttcccactccttggagacccagcatggcgtat

SEQ ID NO: 1339 - DNA, 140 bp, Artificial Sequence
  Synthetic
atacgccatgctgggtctccgctggacccatggctgcagtaggcttgctaattgtcagctatgtggtctcgggaaagagtgtggacatgtacattgaaagagcaggtgacatcacatgggcgtacttgggagtcggccat

SEQ ID NO: 1340 - DNA, 140 bp, Artificial Sequence
  Synthetic
atggccgactcccaagtacgcccatgtgatgtcacctgctctttcaatgtacatgtccacactctttcccgagaccacatagctgacaattagcaagcctactgcagccatgggtccagcggagacccagcatggcgtat

SEQ ID NO: 1341 - DNA, 140 bp, Artificial Sequence
  Synthetic
aggccctggctgctgatatggggaaagagtgtggacatgtacattgaaagagcaggtgacatcacatgggaaaaggacgcggaagtcactggaaacagtcctcggcttgacgtggcactggaccttttgggacagcggtg

SEQ ID NO: 1342 - DNA, 140 bp, Artificial Sequence
  Synthetic
caccgctgtcccaaaaggtccagtgccacgtcaagccgaggactgtttccagtgacttccgcgtccttttcccatgtgatgtcacctgctctttcaatgtacatgtccacactctttccccatatcagcagccagggcct

SEQ ID NO: 1343 - DNA, 140 bp, Artificial Sequence
  Synthetic
atacgccatgctgggtctccaaaaggacgcggaagtcactggaaacagtcctcggcttgacgtggcactggatgagagtggtgatttctccttggtagaggaagatggtccacccatgagcgtacttgggagtcggccat

SEQ ID NO: 1344 - DNA, 140 bp, Artificial Sequence
  Synthetic
atggccgactcccaagtacgctcatgggtggaccatcttcctctaccaaggagaaatcaccactctcatccagtgccacgtcaagccgaggactgtttccagtgacttccgcgtccttttggagacccagcatggcgtat

SEQ ID NO: 1345 - DNA, 140 bp, Artificial Sequence
  Synthetic
atacgccatgctgggtctccagagatcatactcaaggtggtcctgatggccatctgtggcatgaacccaatagctataccttttgctgcaggagcgtggtatgtgtatgtgaagactgggcgtacttgggagtcggccat

SEQ ID NO: 1346 - DNA, 140 bp, Artificial Sequence
  Synthetic
atggccgactcccaagtacgcccagtcttcacatacacataccacgctcctgcagcaaaaggtatagctattgggttcatgccacagatggccatcaggaccaccttgagtatgatctctggagacccagcatggcgtat

SEQ ID NO: 1347 - DNA, 140 bp, Artificial Sequence
  Synthetic
aggccctggctgctgatatgtagctataccttttgctgcaggagcgtggtatgtgtatgtgaagactgggaaaaggagtggcgccctctgggacgtgcctgctcccaaagaagtgaagaagaccttttgggacagcggtg

SEQ ID NO: 1348 - DNA, 140 bp, Artificial Sequence
  Synthetic
caccgctgtcccaaaaggtcttcttcacttctttgggagcaggcacgtcccagagggcgccactccttttcccagtcttcacatacacataccacgctcctgcagcaaaaggtatagctacatatcagcagccagggcct

SEQ ID NO: 1349 - DNA, 140 bp, Artificial Sequence
  Synthetic
atacgccatgctgggtctccaggagagaccacagatggagtgtacagagtgatgactcgcagactgctaggttcaacacaggttggagtgggagtcatgcaagagggagtcttccacacccgtacttgggagtcggccat

SEQ ID NO: 1350 - DNA, 140 bp, Artificial Sequence
  Synthetic
atggccgactcccaagtacgggtgtggaagactccctcttgcatgactcccactccaacctgtgttgaacctagcagtctgcgagtcatcactctgtacactccatctgtggtctctcctggagacccagcatggcgtat

SEQ ID NO: 1351 - DNA, 140 bp, Artificial Sequence
  Synthetic
atacgccatgctgggtctccatgtggcacgttacaaaaggagccgcactgaggagcggtgagggaagacttgatccatactggggggatgtcaagcaggacttggtgtcatactgtgggccgtacttgggagtcggccat

SEQ ID NO: 1352 - DNA, 140 bp, Artificial Sequence
  Synthetic
atggccgactcccaagtacggcccacagtatgacaccaagtcctgcttgacatccccccagtatggatcaagtcttccctcaccgctcctcagtgcggctccttttgtaacgtgccacatggagacccagcatggcgtat

SEQ ID NO: 1353 - DNA, 140 bp, Artificial Sequence
  Synthetic
aggccctggctgctgatatgtgatccatactggggggatgtcaagcaggacttggtgtcatactgtgggccttggaagttggatgcagcttgggatggacttagcgaggtacagcttttggaccttttgggacagcggtg

SEQ ID NO: 1354 - DNA, 140 bp, Artificial Sequence
  Synthetic
caccgctgtcccaaaaggtccaaaagctgtacctcgctaagtccatcccaagctgcatccaacttccaaggcccacagtatgacaccaagtcctgcttgacatccccccagtatggatcacatatcagcagccagggcct

SEQ ID NO: 1355 - DNA, 140 bp, Artificial Sequence
  Synthetic
atacgccatgctgggtctccgccgtacctcccggagagagggccagaaacattcagaccctgcctggaatattcaagacaaaggacggggacatcggagcagttgctctggactaccctgcgtacttgggagtcggccat

SEQ ID NO: 1356 - DNA, 140 bp, Artificial Sequence
  Synthetic
atggccgactcccaagtacgcagggtagtccagagcaactgctccgatgtccccgtcctttgtcttgaatattccaggcagggtctgaatgtttctggccctctctccgggaggtacggcggagacccagcatggcgtat

SEQ ID NO: 1357 - DNA, 140 bp, Artificial Sequence
  Synthetic
atacgccatgctgggtctcccagggacctcaggatctccgatcctagacaaatgtggaagagtgataggactctatggcaatggggttgtgatcaagaatggaagctatgttagtgctatcgtacttgggagtcggccat

SEQ ID NO: 1358 - DNA, 140 bp, Artificial Sequence
  Synthetic
atggccgactcccaagtacgatagcactaacatagcttccattcttgatcacaaccccattgccatagagtcctatcactcttccacatttgtctaggatcggagatcctgaggtccctgggagacccagcatggcgtat

SEQ ID NO: 1359 - DNA, 140 bp, Artificial Sequence
  Synthetic
atacgccatgctgggtctccaacccagggaaagagggaggaggagactccggttgaatgtttcgaaccctcgatgctgaagaagaagcagctaactgtcctggatctgcatccaggagcccgtacttgggagtcggccat

SEQ ID NO: 1360 - DNA, 140 bp, Artificial Sequence
  Synthetic
atggccgactcccaagtacgggctcctggatgcagatccaggacagttagctgcttcttcttcagcatcgagggttcgaaacattcaaccggagtctcctcctccctctttccctgggttggagacccagcatggcgtat

SEQ ID NO: 1361 - DNA, 140 bp, Artificial Sequence
  Synthetic
atacgccatgctgggtctccggaaaaaccaggagagttcttcctgaaatagtccgtgaagccataaaaaagagactccggacagtgatcttggcaccaactagggttgtcgctgctgagacgtacttgggagtcggccat

SEQ ID NO: 1362 - DNA, 140 bp, Artificial Sequence
  Synthetic
atggccgactcccaagtacgtctcagcagcgacaaccctagttggtgccaagatcactgtccggagtctcttttttatggcttcacggactatttcaggaagaactctcctggtttttccggagacccagcatggcgtat

SEQ ID NO: 1363 - DNA, 140 bp, Artificial Sequence
  Synthetic
aggccctggctgctgatatggagactccggacagtgatcttggcaccaactagggttgtcgctgctgagatggaggaagccttgagaggacttccggtgcgttacatgacaacagcagtcgaccttttgggacagcggtg

SEQ ID NO: 1364 - DNA, 140 bp, Artificial Sequence
  Synthetic
caccgctgtcccaaaaggtcgactgctgttgtcatgtaacgcaccggaagtcctctcaaggcttcctccatctcagcagcgacaaccctagttggtgccaagatcactgtccggagtctccatatcagcagccagggcct

SEQ ID NO: 1365 - DNA, 140 bp, Artificial Sequence
  Synthetic
atacgccatgctgggtctcctttgattgggtgacagaccattctgggaaaacagtttggttcgttccaagcgtgagaaacggaaatgaaatcgcagcctgtctgacaaaggctggaaagccgtacttgggagtcggccat

SEQ ID NO: 1366 - DNA, 140 bp, Artificial Sequence
  Synthetic
atggccgactcccaagtacggctttccagcctttgtcagacaggctgcgatttcatttccgtttctcacgcttggaacgaaccaaactgttttcccagaatggtctgtcacccaatcaaaggagacccagcatggcgtat

SEQ ID NO: 1367 - DNA, 140 bp, Artificial Sequence
  Synthetic
atacgccatgctgggtctccgggtcatacagctcagcaggaagacttttgagacagaatttcagaaaacaaaaaatcaagagtgggactttgtcataacaactgacatctcagagatgggcgtacttgggagtcggccat

SEQ ID NO: 1368 - DNA, 140 bp, Artificial Sequence
  Synthetic
atggccgactcccaagtacgcccatctctgagatgtcagttgttatgacaaagtcccactcttgattttttgttttctgaaattctgtctcaaaagtcttcctgctgagctgtatgacccggagacccagcatggcgtat

SEQ ID NO: 1369 - DNA, 140 bp, Artificial Sequence
  Synthetic
aggccctggctgctgatatgaaaaatcaagagtgggactttgtcataacaactgacatctcagagatgggcgccaacttcaaggctgaccgggtcatagactctaggagatgcctaaaacgaccttttgggacagcggtg

SEQ ID NO: 1370 - DNA, 140 bp, Artificial Sequence
  Synthetic
caccgctgtcccaaaaggtcgttttaggcatctcctagagtctatgacccggtcagccttgaagttggcgcccatctctgagatgtcagttgttatgacaaagtcccactcttgatttttcatatcagcagccagggcct

SEQ ID NO: 1371 - DNA, 140 bp, Artificial Sequence
  Synthetic
atacgccatgctgggtctcccaaacctggagatgagtacatgtatggaggtgggtgtgcagagactgatgaaggccatgcacactggcttgaagcaagaatgcttcttgacaacatctaccgtacttgggagtcggccat

SEQ ID NO: 1372 - DNA, 140 bp, Artificial Sequence
  Synthetic
atggccgactcccaagtacggtagatgttgtcaagaagcattcttgcttcaagccagtgtgcatggccttcatcagtctctgcacacccacctccatacatgtactcatctccaggtttgggagacccagcatggcgtat

SEQ ID NO: 1373 - DNA, 140 bp, Artificial Sequence
  Synthetic
atacgccatgctgggtctccctccaggatggcctcatagcctcgctctatcggcctgaggccgataaggtagccgccattgagggagagtttaagctgaggacagagcaaaggaagacctcgtacttgggagtcggccat

SEQ ID NO: 1374 - DNA, 140 bp, Artificial Sequence
  Synthetic
atggccgactcccaagtacgaggtcttcctttgctctgtcctcagcttaaactctccctcaatggcggctaccttatcggcctcaggccgatagagcgaggctatgaggccatcctggagggagacccagcatggcgtat

SEQ ID NO: 1375 - DNA, 140 bp, Artificial Sequence
  Synthetic
atacgccatgctgggtctcctcgtggaactcatgaagagaggagaccttcccgtctggctagcctatcaggttgcatctgccggaataacttacacagacagaagatggtgctttgatggcgtacttgggagtcggccat

SEQ ID NO: 1376 - DNA, 140 bp, Artificial Sequence
  Synthetic
atggccgactcccaagtacgccatcaaagcaccatcttctgtctgtgtaagttattccggcagatgcaacctgataggctagccagacgggaaggtctcctctcttcatgagttccacgaggagacccagcatggcgtat

SEQ ID NO: 1377 - DNA, 140 bp, Artificial Sequence
  Synthetic
aggccctggctgctgatatggttgcatctgccggaataacttacacagacagaagatggtgctttgatggcacaaccaacaacaccataatggaagacagtgtaccagcagaggtttggagaccttttgggacagcggtg

SEQ ID NO: 1378 - DNA, 140 bp, Artificial Sequence
  Synthetic
caccgctgtcccaaaaggtctccaaacctctgctggtacactgtcttccattatggtgttgttggttgtgccatcaaagcaccatcttctgtctgtgtaagttattccggcagatgcaaccatatcagcagccagggcct

SEQ ID NO: 1379 - DNA, 140 bp, Artificial Sequence
  Synthetic
atacgccatgctgggtctcccaaagtatggagagaagagagtgctcaaaccgagatggatggatgctagggtctgttcagaccatgcggccctgaagtcgttcaaagaattcgccgctggcgtacttgggagtcggccat

SEQ ID NO: 1380 - DNA, 140 bp, Artificial Sequence
  Synthetic
atggccgactcccaagtacgccagcggcgaattctttgaacgacttcagggccgcatggtctgaacagaccctagcatccatccatctcggtttgagcactctcttctctccatactttgggagacccagcatggcgtat

SEQ ID NO: 1381 - DNA, 140 bp, Artificial Sequence
  Synthetic
atacgccatgctgggtctccaaaaagaggagcggctttgggagtaatggaggccctgggaacactgccaggacacatgacagagaggtttcaggaagccattgacaacctcgccgtgctccgtacttgggagtcggccat

SEQ ID NO: 1382 - DNA, 140 bp, Artificial Sequence
  Synthetic
atggccgactcccaagtacggagcacggcgaggttgtcaatggcttcctgaaacctctctgtcatgtgtcctggcagtgttcccagggcctccattactcccaaagccgctcctctttttggagacccagcatggcgtat

SEQ ID NO: 1383 - DNA, 140 bp, Artificial Sequence
  Synthetic
atacgccatgctgggtctccatgcgagcagagactggaagcaggccttataaggcagcggcagcccaactgccggagaccctagagaccattatgctcttaggtttgctgggaacagtttcgtacttgggagtcggccat

SEQ ID NO: 1384 - DNA, 140 bp, Artificial Sequence
  Synthetic
atggccgactcccaagtacgaaactgttcccagcaaacctaagagcataatggtctctagggtctccggcagttgggctgccgctgccttataaggcctgcttccagtctctgctcgcatggagacccagcatggcgtat

SEQ ID NO: 1385 - DNA, 140 bp, Artificial Sequence
  Synthetic
aggccctggctgctgatatggccggagaccctagagaccattatgctcttaggtttgctgggaacagtttcactggggatcttctttgtcttgatgcggaataagggcatcgggaagatggaccttttgggacagcggtg

SEQ ID NO: 1386 - DNA, 140 bp, Artificial Sequence
  Synthetic
caccgctgtcccaaaaggtccatcttcccgatgcccttattccgcatcaagacaaagaagatccccagtgaaactgttcccagcaaacctaagagcataatggtctctagggtctccggccatatcagcagccagggcct

SEQ ID NO: 1387 - DNA, 140 bp, Artificial Sequence
  Synthetic
atacgccatgctgggtctccggctttggaatggtaacccttggggccagtgcatggctcatgtggctttcggaaattgaaccagccagaattgcatgtgtcctcattgttgtgtttttatcgtacttgggagtcggccat

SEQ ID NO: 1388 - DNA, 140 bp, Artificial Sequence
  Synthetic
atggccgactcccaagtacgataaaaacacaacaatgaggacacatgcaattctggctggttcaatttccgaaagccacatgagccatgcactggccccaagggttaccattccaaagccggagacccagcatggcgtat

SEQ ID NO: 1389 - DNA, 140 bp, Artificial Sequence
  Synthetic
atacgccatgctgggtctcctactggtggtgctcatacccgagccagagaagcaaagatctccccaagataaccagatggcaattatcatcatggtggcagtgggccttctaggtttgatcgtacttgggagtcggccat

SEQ ID NO: 1390 - DNA, 140 bp, Artificial Sequence
  Synthetic
atggccgactcccaagtacgatcaaacctagaaggcccactgccaccatgatgataattgccatctggttatcttggggagatctttgcttctctggctcgggtatgagcaccaccagtaggagacccagcatggcgtat

SEQ ID NO: 1391 - DNA, 140 bp, Artificial Sequence
  Synthetic
atacgccatgctgggtctccaactgcaaacgaacttggatggctggaaagaacaaaaaatgacatagctcatctaatgggaaggagagaagaaggagcaaccatgggattctcaatggaccgtacttgggagtcggccat

SEQ ID NO: 1392 - DNA, 140 bp, Artificial Sequence
  Synthetic
atggccgactcccaagtacggtccattgagaatcccatggttgctccttcttctctccttcccattagatgagctatgtcattttttgttctttccagccatccaagttcgtttgcagttggagacccagcatggcgtat

SEQ ID NO: 1393 - DNA, 140 bp, Artificial Sequence
  Synthetic
atacgccatgctgggtctccattgatctgcggccagcctccgcctgggctatctatgccgcattgacaactctcatcaccccagctgtccaacatgcggtaaccacttcatacaacaactcgtacttgggagtcggccat

SEQ ID NO: 1394 - DNA, 140 bp, Artificial Sequence
  Synthetic
atggccgactcccaagtacgagttgttgtatgaagtggttaccgcatgttggacagctggggtgatgagagttgtcaatgcggcatagatagcccaggcggaggctggccgcagatcaatggagacccagcatggcgtat

SEQ ID NO: 1395 - DNA, 140 bp, Artificial Sequence
  Synthetic
aggccctggctgctgatatggggttgctattcacaattaacacccctgactctgatagtagctatcattctgcttgtggcgcactacatgtacttgatcccaggcctacaagcggcagcagaccttttgggacagcggtg

SEQ ID NO: 1396 - DNA, 140 bp, Artificial Sequence
  Synthetic
caccgctgtcccaaaaggtctgctgccgcttgtaggcctgggatcaagtacatgtagtgcgccacaagcagaatgatagctactatcagagtcaggggtgttaattgtgaatagcaaccccatatcagcagccagggcct

SEQ ID NO: 1397 - DNA, 140 bp, Artificial Sequence
  Synthetic
atacgccatgctgggtctccgcgcgtgctgcccagaaaaggacagcagctggcatcatgaagaatcccgttgtggatggaatagtggtaactgacattgacacaatgacaatagaccccccgtacttgggagtcggccat

SEQ ID NO: 1398 - DNA, 140 bp, Artificial Sequence
  Synthetic
atggccgactcccaagtacggggggtctattgtcattgtgtcaatgtcagttaccactattccatccacaacgggattcttcatgatgccagctgctgtccttttctgggcagcacgcgcggagacccagcatggcgtat

SEQ ID NO: 1399 - DNA, 140 bp, Artificial Sequence
  Synthetic
atacgccatgctgggtctccaggtggagaagaagatgggacaagtgttactcatagcagtagccatctccagtgctgtgctgctgcggaccgcctggggatggggggaggctggagctctcgtacttgggagtcggccat

SEQ ID NO: 1400 - DNA, 140 bp, Artificial Sequence
  Synthetic
atggccgactcccaagtacgagagctccagcctccccccatccccaggcggtccgcagcagcacagcactggagatggctactgctatgagtaacacttgtcccatcttcttctccacctggagacccagcatggcgtat

SEQ ID NO: 1401 - DNA, 140 bp, Artificial Sequence
  Synthetic
atacgccatgctgggtctccgatcacagcagcgacctccaccttgtgggaaggctctccaaacaaatactggaactcctctacagccacctcactgtgcaacatcttcagaggaagctatcgtacttgggagtcggccat

SEQ ID NO: 1402 - DNA, 140 bp, Artificial Sequence
  Synthetic
atggccgactcccaagtacgatagcttcctctgaagatgttgcacagtgaggtggctgtagaggagttccagtatttgtttggagagccttcccacaaggtggaggtcgctgctgtgatcggagacccagcatggcgtat

SEQ ID NO: 1403 - DNA, 140 bp, Artificial Sequence
  Synthetic
atacgccatgctgggtctccctggcaggagcttcccttatctatacagtgacgagaaacgctggcctggttaagagacgtggaggtgggacgggagagactctgggagagaagtggaaagcgtacttgggagtcggccat

SEQ ID NO: 1404 - DNA, 140 bp, Artificial Sequence
  Synthetic
atggccgactcccaagtacgctttccacttctctcccagagtctctcccgtcccacctccacgtctcttaaccaggccagcgtttctcgtcactgtatagataagggaagctcctgccagggagacccagcatggcgtat

SEQ ID NO: 1405 - DNA, 140 bp, Artificial Sequence
  Synthetic
atacgccatgctgggtctccctcgtctgaatcagatgtcggccctggagttctactcttataaaaagtcaggtatcactgaagtgtgtagagaggaggctcgccgtgccctcaaggatggcgtacttgggagtcggccat

SEQ ID NO: 1406 - DNA, 140 bp, Artificial Sequence
  Synthetic
atggccgactcccaagtacgccatccttgagggcacggcgagcctcctctctacacacttcagtgatacctgactttttataagagtagaactccagggccgacatctgattcagacgagggagacccagcatggcgtat

SEQ ID NO: 1407 - DNA, 140 bp, Artificial Sequence
  Synthetic
atacgccatgctgggtctccagtggccacaggaggacatgccgtatcccggggaagtgcaaagctcagatggttggtggagagaggatatctgcagccccatgggaaggttgttgacctccgtacttgggagtcggccat

SEQ ID NO: 1408 - DNA, 140 bp, Artificial Sequence
  Synthetic
atggccgactcccaagtacggaggtcaacaaccttcccatggggctgcagatatcctctctccaccaaccatctgagctttgcacttccccgggatacggcatgtcctcctgtggccactggagacccagcatggcgtat

SEQ ID NO: 1409 - DNA, 140 bp, Artificial Sequence
  Synthetic
atacgccatgctgggtctccggatgtggcagagggggctggagctattatgccgccaccatccgcaaagtgcaggaggtgagaggatacacaaagggaggtcccggtcatgaagaacccacgtacttgggagtcggccat

SEQ ID NO: 1410 - DNA, 140 bp, Artificial Sequence
  Synthetic
atggccgactcccaagtacgtgggttcttcatgaccgggacctccctttgtgtatcctctcacctcctgcactttgcggatggtggcggcataatagctccagccccctctgccacatccggagacccagcatggcgtat

SEQ ID NO: 1411 - DNA, 140 bp, Artificial Sequence
  Synthetic
atacgccatgctgggtctcctgctggtgcaaagctatgggtggaacatagttcgtctcaagagtggagtggacgtcttccacatggcggctgagccgtgtgacactctgctgtgtgacatcgtacttgggagtcggccat

SEQ ID NO: 1412 - DNA, 140 bp, Artificial Sequence
  Synthetic
atggccgactcccaagtacgatgtcacacagcagagtgtcacacggctcagccgccatgtggaagacgtccactccactcttgagacgaactatgttccacccatagctttgcaccagcaggagacccagcatggcgtat

SEQ ID NO: 1413 - DNA, 140 bp, Artificial Sequence
  Synthetic
atacgccatgctgggtctccaggtgagtcatcatctagtcctgaagtggaagagacacgaacactcagagtgctctctatggtgggggactggcttgaaaaaagaccaggggccttctgtcgtacttgggagtcggccat

SEQ ID NO: 1414 - DNA, 140 bp, Artificial Sequence
  Synthetic
atggccgactcccaagtacgacagaaggcccctggtcttttttcaagccagtcccccaccatagagagcactctgagtgttcgtgtctcttccacttcaggactagatgatgactcacctggagacccagcatggcgtat

SEQ ID NO: 1415 - DNA, 140 bp, Artificial Sequence
  Synthetic
atacgccatgctgggtctccataaaggtgctgtgcccatacaccagcactatgatggaaaccatggagcgactgcaacgtaggcatgggggaggattagtcagagtgccattgtctcgcacgtacttgggagtcggccat

SEQ ID NO: 1416 - DNA, 140 bp, Artificial Sequence
  Synthetic
atggccgactcccaagtacgtgcgagacaatggcactctgactaatcctcccccatgcctacgttgcagtcgctccatggtttccatcatagtgctggtgtatgggcacagcacctttatggagacccagcatggcgtat

SEQ ID NO: 1417 - DNA, 140 bp, Artificial Sequence
  Synthetic
aggccctggctgctgatatgactgcaacgtaggcatgggggaggattagtcagagtgccattgtctcgcaactccacacatgagatgtactgggtctctggggcaaaaagcaacatcatagaccttttgggacagcggtg

SEQ ID NO: 1418 - DNA, 140 bp, Artificial Sequence
  Synthetic
caccgctgtcccaaaaggtctatgatgttgctttttgccccagagacccagtacatctcatgtgtggagttgcgagacaatggcactctgactaatcctcccccatgcctacgttgcagtcatatcagcagccagggcct

SEQ ID NO: 1419 - DNA, 140 bp, Artificial Sequence
  Synthetic
atacgccatgctgggtctccaaaagtgtgtccaccacaagtcagctcctcctgggacgcatggatggccccaggaggccagtgaaatatgaggaggatgtgaacctcggctcgggtacaccgtacttgggagtcggccat

SEQ ID NO: 1420 - DNA, 140 bp, Artificial Sequence
  Synthetic
atggccgactcccaagtacggtgtacccgagccgaggttcacatcctcctcatatttcactggcctcctggggccatccatgcgtcccaggaggagctgacttgtggtggacacacttttggagacccagcatggcgtat

SEQ ID NO: 1421 - DNA, 140 bp, Artificial Sequence
  Synthetic
atacgccatgctgggtctccgagctgtggcaagctgtgctgaggctcctaacatgaaaatcatcggcaggcgcattgagagaatccgcaatgaacatgcagaaacatggtttcttgatgacgtacttgggagtcggccat

SEQ ID NO: 1422 - DNA, 140 bp, Artificial Sequence
  Synthetic
atggccgactcccaagtacgtcatcaagaaaccatgtttctgcatgttcattgcggattctctcaatgcgcctgccgatgattttcatgttaggagcctcagcacagcttgccacagctcggagacccagcatggcgtat

SEQ ID NO: 1423 - DNA, 140 bp, Artificial Sequence
  Synthetic
aggccctggctgctgatatgcgcattgagagaatccgcaatgaacatgcagaaacatggtttcttgatgaaaaccacccatacaggacatgggcctaccatgggagctacgaagcccccagaccttttgggacagcggtg

SEQ ID NO: 1424 - DNA, 140 bp, Artificial Sequence
  Synthetic
caccgctgtcccaaaaggtctgggggcttcgtagctcccatggtaggcccatgtcctgtatgggtggttttcatcaagaaaccatgtttctgcatgttcattgcggattctctcaatgcgcatatcagcagccagggcct

SEQ ID NO: 1425 - DNA, 140 bp, Artificial Sequence
  Synthetic
atacgccatgctgggtctcccgcaaggatcagcgtcttccctcgtgaacggggttgttagactcctgtcaaagccttgggacgtggtgactggagttacaggaatagccatgactgacaccgtacttgggagtcggccat

SEQ ID NO: 1426 - DNA, 140 bp, Artificial Sequence
  Synthetic
atggccgactcccaagtacggtgtcagtcatggctattcctgtaactccagtcaccacgtcccaaggctttgacaggagtctaacaaccccgttcacgagggaagacgctgatccttgcgggagacccagcatggcgtat

SEQ ID NO: 1427 - DNA, 140 bp, Artificial Sequence
  Synthetic
atacgccatgctgggtctcccacaccatacggccaacaaagagtcttcaaagaaaaagtggacaccagggtgccagatccccaagaaggcactcgccaggtaatgaacatggtctcttcccgtacttgggagtcggccat

SEQ ID NO: 1428 - DNA, 140 bp, Artificial Sequence
  Synthetic
atggccgactcccaagtacgggaagagaccatgttcattacctggcgagtgccttcttggggatctggcaccctggtgtccactttttctttgaagactctttgttggccgtatggtgtgggagacccagcatggcgtat

SEQ ID NO: 1429 - DNA, 140 bp, Artificial Sequence
  Synthetic
aggccctggctgctgatatgttgaagaggaaaaagaatggaagacggctgtggaagctgtgaatgatccaaggttttgggccctagtggatagggagagagaacaccacctgagaggagagaccttttgggacagcggtg

SEQ ID NO: 1430 - DNA, 140 bp, Artificial Sequence
  Synthetic
caccgctgtcccaaaaggtctctcctctcaggtggtgttctctctccctatccactagggcccaaaaccttggatcattcacagcttccacagccgtcttccattctttttcctcttcaacatatcagcagccagggcct

SEQ ID NO: 1431 - DNA, 140 bp, Artificial Sequence
  Synthetic
atacgccatgctgggtctccgtgtcacagctgtgtgtacaacatgatgggaaaaagagaaaagaagcaaggagagttcgggaaagcaaaaggtagccgcgccatctggtacatgtggttgcgtacttgggagtcggccat

SEQ ID NO: 1432 - DNA, 140 bp, Artificial Sequence
  Synthetic
atggccgactcccaagtacgcaaccacatgtaccagatggcgcggctaccttttgctttcccgaactctccttgcttcttttctctttttcccatcatgttgtacacacagctgtgacacggagacccagcatggcgtat

SEQ ID NO: 1433 - DNA, 140 bp, Artificial Sequence
  Synthetic
aggccctggctgctgatatgatgtacgcagatgacactgctggctgggacacccgcattagtaagtttgatctggagaatgaagctttgattaccaaccaaatggaggaagggcacagaagaccttttgggacagcggtg

SEQ ID NO: 1434 - DNA, 140 bp, Artificial Sequence
  Synthetic
caccgctgtcccaaaaggtcttctgtgcccttcctccatttggttggtaatcaaagcttcattctccagatcaaacttactaatgcgggtgtcccagccagcagtgtcatctgcgtacatcatatcagcagccagggcct

SEQ ID NO: 1435 - DNA, 140 bp, Artificial Sequence
  Synthetic
atacgccatgctgggtctccctctggcgttggccgtgattaaatacacataccaaaacaaagtggtgaaggtcctcagaccagctgaaggaggaaaaacagttatggacatcatttcaagcgtacttgggagtcggccat

SEQ ID NO: 1436 - DNA, 140 bp, Artificial Sequence
  Synthetic
atggccgactcccaagtacgcttgaaatgatgtccataactgtttttcctccttcagctggtctgaggaccttcaccactttgttttggtatgtgtatttaatcacggccaacgccagagggagacccagcatggcgtat

SEQ ID NO: 1437 - DNA, 140 bp, Artificial Sequence
  Synthetic
atacgccatgctgggtctccacaagaccagagagggagtggacaagttgtcacttatgctctcaacacattcaccaacttggtggtgcagcttatccggaacatggaagctgaggaagtgcgtacttgggagtcggccat

SEQ ID NO: 1438 - DNA, 140 bp, Artificial Sequence
  Synthetic
atggccgactcccaagtacgcacttcctcagcttccatgttccggataagctgcaccaccaagttggtgaatgtgttgagagcataagtgacaacttgtccactccctctctggtcttgtggagacccagcatggcgtat

SEQ ID NO: 1439 - DNA, 140 bp, Artificial Sequence
  Synthetic
atacgccatgctgggtctccttagagatgcaagacttatggctgttgaggaagccagagaaagtgaccagatggttgcagagcaatggatgggatggactcaaacgaatggcggtcagtgcgtacttgggagtcggccat

SEQ ID NO: 1440 - DNA, 140 bp, Artificial Sequence
  Synthetic
atggccgactcccaagtacgcactgaccgccattcgtttgagtccatcccatccattgctctgcaaccatctggtcactttctctggcttcctcaacagccataagtcttgcatctctaaggagacccagcatggcgtat

SEQ ID NO: 1441 - DNA, 140 bp, Artificial Sequence
  Synthetic
aggccctggctgctgatatggagatgactgcgttgtgaagccaatcgatgataggtttgcacatgccctcaggttcttgaatgacatgggaaaagttaggaaagacacacaggagtggaagaccttttgggacagcggtg

SEQ ID NO: 1442 - DNA, 140 bp, Artificial Sequence
  Synthetic
caccgctgtcccaaaaggtcttccactcctgtgtgtctttcctaacttttcccatgtcattcaagaacctgagggcatgtgcaaacctatcatcgattggcttcacaacgcagtcatctccatatcagcagccagggcct

SEQ ID NO: 1443 - DNA, 140 bp, Artificial Sequence
  Synthetic
aggccctggctgctgatatgaccctcgactggatggagcaattgggaagaagtcccgttctgctcccaccacttcaacaagctgtacctcaaggatgggagatccattgtggtcccttgcgaccttttgggacagcggtg

SEQ ID NO: 1444 - DNA, 140 bp, Artificial Sequence
  Synthetic
caccgctgtcccaaaaggtcgcaagggaccacaatggatctcccatccttgaggtacagcttgttgaagtggtgggagcagaacgggacttcttcccaattgctccatccagtcgagggtcatatcagcagccagggcct

SEQ ID NO: 1445 - DNA, 140 bp, Artificial Sequence
  Synthetic
aggccctggctgctgatatgacttcaacaagctgtacctcaaggatgggagatccattgtggtcccttgccgccaccaagatgaactgattggccgagctcgcgtttcaccaggggcagggaccttttgggacagcggtg

SEQ ID NO: 1446 - DNA, 140 bp, Artificial Sequence
  Synthetic
caccgctgtcccaaaaggtccctgcccctggtgaaacgcgagctcggccaatcagttcatcttggtggcggcaagggaccacaatggatctcccatccttgaggtacagcttgttgaagtcatatcagcagccagggcct

SEQ ID NO: 1447 - DNA, 140 bp, Artificial Sequence
  Synthetic
atacgccatgctgggtctccatggagcatccgggagactgcctgtcttgcaaaatcatatgcgcagatgtggcagctcctttatttccacagaagagaccttcgactgatggctaatgcccgtacttgggagtcggccat

SEQ ID NO: 1448 - DNA, 140 bp, Artificial Sequence
  Synthetic
atggccgactcccaagtacgggcattagccatcagtcgaaggtctcttctgtggaaataaaggagctgccacatctgcgcatatgattttgcaagacaggcagtctcccggatgctccatggagacccagcatggcgtat

SEQ ID NO: 1449 - DNA, 140 bp, Artificial Sequence
  Synthetic
atacgccatgctgggtctccatttgctcggctgtaccagttgactgggtaccaactgggagaaccacctggtcaatccatggaaagggagaatggatgaccactgaggacatgctcatggcgtacttgggagtcggccat

SEQ ID NO: 1450 - DNA, 140 bp, Artificial Sequence
  Synthetic
atggccgactcccaagtacgccatgagcatgtcctcagtggtcatccattctccctttccatggattgaccaggtggttctcccagttggtacccagtcaactggtacagccgagcaaatggagacccagcatggcgtat

SEQ ID NO: 1451 - DNA, 140 bp, Artificial Sequence
  Synthetic
atacgccatgctgggtctcctgtggaatagagtgtggattgaggagaacgaccatatggaggacaagactcctgtaacaaaatggacagacattccctatctaggaaaaagggaggacttcgtacttgggagtcggccat

SEQ ID NO: 1452 - DNA, 140 bp, Artificial Sequence
  Synthetic
atggccgactcccaagtacgaagtcctccctttttcctagatagggaatgtctgtccattttgttacaggagtcttgtcctccatatggtcgttctcctcaatccacactctattccacaggagacccagcatggcgtat

SEQ ID NO: 1453 - DNA, 140 bp, Artificial Sequence
  Synthetic
aggccctggctgctgatatgcctgtaacaaaatggacagacattccctatctaggaaaaagggaggacttatggtgtggatcccttatagggcacagaccccgcaccacttgggctgaaagaccttttgggacagcggtg

SEQ ID NO: 1454 - DNA, 140 bp, Artificial Sequence
  Synthetic
caccgctgtcccaaaaggtctttcagcccaagtggtgcggggtctgtgccctataagggatccacaccataagtcctccctttttcctagatagggaatgtctgtccattttgttacaggcatatcagcagccagggcct

SEQ ID NO: 1455 - DNA, 140 bp, Artificial Sequence
  Synthetic
atacgccatgctgggtctccacatcaaagacacagtcaacatggtgcgcaggatcataggtgatgaagaaaagtacatggactatctatccacccaagtccgctacttgggtgaggaaggcgtacttgggagtcggccat

SEQ ID NO: 1456 - DNA, 140 bp, Artificial Sequence
  Synthetic
atggccgactcccaagtacgccttcctcacccaagtagcggacttgggtggatagatagtccatgtacttttcttcatcacctatgatcctgcgcaccatgttgactgtgtctttgatgtggagacccagcatggcgtat

SEQ ID NO: 1457 - DNA, 140 bp, Artificial Sequence
  Synthetic
aggccctggctgctgatatgggtgcgcaggatcataggtgatgaagaaaagtacatggactatctatccacccaagtccgctacttgggtgaggaagggtccacacccggagtgttgtaagaccttttgggacagcggtg

SEQ ID NO: 1458 - DNA, 140 bp, Artificial Sequence
  Synthetic
caccgctgtcccaaaaggtcttacaacactccgggtgtggacccttcctcacccaagtagcggacttgggtggatagatagtccatgtacttttcttcatcacctatgatcctgcgcacccatatcagcagccagggcct

SEQ ID NO: 1459 - DNA, 140 bp, Artificial Sequence
  Synthetic
atacgccatgctgggtctccagttgttgatctgtgtgagtcagactgcgacagttcgagtctgaagcgagagctaacaacagtatcaacaggtttaatttggatttggaaacgagagtttcgtacttgggagtcggccat

SEQ ID NO: 1460 - DNA, 140 bp, Artificial Sequence
  Synthetic
atggccgactcccaagtacgaaactctcgtttccaaatccaaattaaacctgttgatactgttgttagctctcgcttcagactcgaactgtcgcagtctgactcacacagatcaacaactggagacccagcatggcgtat

SEQ ID NO: 1461 - DNA, 140 bp, Artificial Sequence
  Synthetic
atacgccatgctgggtctccctggtcatgaaaaaccccaaagaagaaatccggaggatccggattgtcaatatgctaaaacgcggagtagcccgtgtaaaccccttgggaggtttgaagacgtacttgggagtcggccat

SEQ ID NO: 1462 - DNA, 140 bp, Artificial Sequence
  Synthetic
atggccgactcccaagtacgtcttcaaacctcccaaggggtttacacgggctactccgcgttttagcatattgacaatccggatcctccggatttcttctttggggtttttcatgaccagggagacccagcatggcgtat

SEQ ID NO: 1463 - DNA, 140 bp, Artificial Sequence
  Synthetic
aggccctggctgctgatatgggaacatggaggctgcgttaccgtgatggcacaggacaagccaacagtcgacatagagttggtcacgacgacggttagtaacatggccgaggtaagatccgaccttttgggacagcggtg

SEQ ID NO: 1464 - DNA, 140 bp, Artificial Sequence
  Synthetic
caccgctgtcccaaaaggtcggatcttacctcggccatgttactaaccgtcgtcgtgaccaactctatgtcgactgttggcttgtcctgtgccatcacggtaacgcagcctccatgttcccatatcagcagccagggcct

SEQ ID NO: 1465 - DNA, 140 bp, Artificial Sequence
  Synthetic
aggccctggctgctgatatgcagtgcatggctcccagcatagcgggatgattggatatgaaactgacgaagatagagcgaaagtcgaggttacgcctaattcaccaagagcggaagcaacgaccttttgggacagcggtg

SEQ ID NO: 1466 - DNA, 140 bp, Artificial Sequence
  Synthetic
caccgctgtcccaaaaggtcgttgcttccgctcttggtgaattaggcgtaacctcgactttcgctctatcttcgtcagtttcatatccaatcatcccgctatgctgggagccatgcactgcatatcagcagccagggcct

SEQ ID NO: 1467 - DNA, 140 bp, Artificial Sequence
  Synthetic
atacgccatgctgggtctccctgtaaaaaaccccatgtggagaggtccacaaagattgccagtgcctgtgaatgagctgccccatggctggaaagcctgggggaaatcgtattttgttagcgtacttgggagtcggccat

SEQ ID NO: 1468 - DNA, 140 bp, Artificial Sequence
  Synthetic
atggccgactcccaagtacgctaacaaaatacgatttcccccaggctttccagccatggggcagctcattcacaggcactggcaatctttgtggacctctccacatggggttttttacagggagacccagcatggcgtat

SEQ ID NO: 1469 - DNA, 140 bp, Artificial Sequence
  Synthetic
atacgccatgctgggtctccggcggcaaagaccaacaacagttttgttgtcgacggtgacacactgaaggaatgtccgcttgagcacagagcatggaatagttttcttgtggaggatcaccgtacttgggagtcggccat

SEQ ID NO: 1470 - DNA, 140 bp, Artificial Sequence
  Synthetic
atggccgactcccaagtacggtgatcctccacaagaaaactattccatgctctgtgctcaagcggacattccttcagtgtgtcaccgtcgacaacaaaactgttgttggtctttgccgccggagacccagcatggcgtat

SEQ ID NO: 1471 - DNA, 140 bp, Artificial Sequence
  Synthetic
aggccctggctgctgatatgaatgtccgcttgagcacagagcatggaatagttttcttgtggaggatcacgggtttggagtcttccacaccagtgtctggcttaaggtcagagaagattagaccttttgggacagcggtg

SEQ ID NO: 1472 - DNA, 140 bp, Artificial Sequence
  Synthetic
caccgctgtcccaaaaggtctaatcttctctgaccttaagccagacactggtgtggaagactccaaacccgtgatcctccacaagaaaactattccatgctctgtgctcaagcggacattcatatcagcagccagggcct

SEQ ID NO: 1473 - DNA, 140 bp, Artificial Sequence
  Synthetic
atacgccatgctgggtctcctgtagctcacttggcattggtagcggcatttaaagtcagaccagccttgctggtctccttcattttcagagccaattggacaccccgtgagagcatgctgcgtacttgggagtcggccat

SEQ ID NO: 1474 - DNA, 140 bp, Artificial Sequence
  Synthetic
atggccgactcccaagtacgcagcatgctctcacggggtgtccaattggctctgaaaatgaaggagaccagcaaggctggtctgactttaaatgccgctaccaatgccaagtgagctacaggagacccagcatggcgtat

SEQ ID NO: 1475 - DNA, 140 bp, Artificial Sequence
  Synthetic
atacgccatgctgggtctccctagccctggcttcgtgtcttctgcaaactgcgatctctgctcttgaaggtgacttgatggtcctcattaatggatttgctttggcctggttggcaattccgtacttgggagtcggccat

SEQ ID NO: 1476 - DNA, 140 bp, Artificial Sequence
  Synthetic
atggccgactcccaagtacggaattgccaaccaggccaaagcaaatccattaatgaggaccatcaagtcaccttcaagagcagagatcgcagtttgcagaagacacgaagccagggctagggagacccagcatggcgtat

SEQ ID NO: 1477 - DNA, 140 bp, Artificial Sequence
  Synthetic
atacgccatgctgggtctccgagcaatggccgtgccacgcactgacaacatcgctctaccaatcttggctgctctaacaccactagctcgaggcacactgctcgtggcatggagagcgggcgtacttgggagtcggccat

SEQ ID NO: 1478 - DNA, 140 bp, Artificial Sequence
  Synthetic
atggccgactcccaagtacgcccgctctccatgccacgagcagtgtgcctcgagctagtggtgttagagcagccaagattggtagagcgatgttgtcagtgcgtggcacggccattgctcggagacccagcatggcgtat

SEQ ID NO: 1479 - DNA, 140 bp, Artificial Sequence
  Synthetic
aggccctggctgctgatatggctctaacaccactagctcgaggcacactgctcgtggcatggagagcgggcctggctacttgtggagggatcatgctcctctccctgaaagggaaaggtagaccttttgggacagcggtg

SEQ ID NO: 1480 - DNA, 140 bp, Artificial Sequence
  Synthetic
caccgctgtcccaaaaggtctacctttccctttcagggagaggagcatgatccctccacaagtagccaggcccgctctccatgccacgagcagtgtgcctcgagctagtggtgttagagccatatcagcagccagggcct

SEQ ID NO: 1481 - DNA, 140 bp, Artificial Sequence
  Synthetic
atacgccatgctgggtctccacgcggaagtcactggaaacagtcctcggcttgacgtggcactggatgagagtggtgacttctccttggtagaggaagatggtccacccatgagagagatcgtacttgggagtcggccat

SEQ ID NO: 1482 - DNA, 140 bp, Artificial Sequence
  Synthetic
atggccgactcccaagtacgatctctctcatgggtggaccatcttcctctaccaaggagaagtcaccactctcatccagtgccacgtcaagccgaggactgtttccagtgacttccgcgtggagacccagcatggcgtat

SEQ ID NO: 1483 - DNA, 140 bp, Artificial Sequence
  Synthetic
aggccctggctgctgatatgatactggggggatgtcaagcaggacttggtgtcatactgtgggccttggaagttggatgcagcttgggatggactcagcgaggtacagcttttggccgtagaccttttgggacagcggtg

SEQ ID NO: 1484 - DNA, 140 bp, Artificial Sequence
  Synthetic
caccgctgtcccaaaaggtctacggccaaaagctgtacctcgctgagtccatcccaagctgcatccaacttccaaggcccacagtatgacaccaagtcctgcttgacatccccccagtatcatatcagcagccagggcct

SEQ ID NO: 1485 - DNA, 140 bp, Artificial Sequence
  Synthetic
aggccctggctgctgatatgatatcaacaagggttgaaatgggcgaggcggctgccatttttatgactgccacaccaccaggaacccgtgatgcgtttcctgactctaactcaccaatcagaccttttgggacagcggtg

SEQ ID NO: 1486 - DNA, 140 bp, Artificial Sequence
  Synthetic
caccgctgtcccaaaaggtctgattggtgagttagagtcaggaaacgcatcacgggttcctggtggtgtggcagtcataaaaatggcagccgcctcgcccatttcaacccttgttgatatcatatcagcagccagggcct

SEQ ID NO: 1487 - DNA, 140 bp, Artificial Sequence
  Synthetic
aggccctggctgctgatatggaccctagagaccattatgctcttaggtttgctgggaacagtttcactggggatcttcttcgtcttgatgcggaataagggcatcgggaagatgggctttgaccttttgggacagcggtg

SEQ ID NO: 1488 - DNA, 140 bp, Artificial Sequence
  Synthetic
caccgctgtcccaaaaggtcaaagcccatcttcccgatgcccttattccgcatcaagacgaagaagatccccagtgaaactgttcccagcaaacctaagagcataatggtctctagggtccatatcagcagccagggcct

SEQ ID NO: 1489 - DNA, 140 bp, Artificial Sequence
  Synthetic
aggccctggctgctgatatgcaccccagctgtccaacatgcggtaaccacttcatacaacaactactccttaatggcgatggccacacaagctggagtgctgtttggcatgggcaaaggggaccttttgggacagcggtg

SEQ ID NO: 1490 - DNA, 140 bp, Artificial Sequence
  Synthetic
caccgctgtcccaaaaggtcccctttgcccatgccaaacagcactccagcttgtgtggccatcgccattaaggagtagttgttgtatgaagtggttaccgcatgttggacagctggggtgcatatcagcagccagggcct

SEQ ID NO: 1491 - DNA, 140 bp, Artificial Sequence
  Synthetic
atacgccatgctgggtctcctaatggcgatggccacacaagctggagtgctgtttggcatgggcaaagggatgccatttatgcatggggaccttggagtcccgctgctaatgatgggttgcgtacttgggagtcggccat

SEQ ID NO: 1492 - DNA, 140 bp, Artificial Sequence
  Synthetic
atggccgactcccaagtacgcaacccatcattagcagcgggactccaaggtccccatgcataaatggcatccctttgcccatgccaaacagcactccagcttgtgtggccatcgccattaggagacccagcatggcgtat

SEQ ID NO: 1493 - DNA, 140 bp, Artificial Sequence
  Synthetic
aggccctggctgctgatatgtgaatcagatgtcggccctggagttctactcttataaaaagtcaggtatcactgaagtgtgtagagaggaggctcgccgtgccctcaaggatggagtggcgaccttttgggacagcggtg

SEQ ID NO: 1494 - DNA, 140 bp, Artificial Sequence
  Synthetic
caccgctgtcccaaaaggtcgccactccatccttgagggcacggcgagcctcctctctacacacttcagtgatacctgactttttataagagtagaactccagggccgacatctgattcacatatcagcagccagggcct

SEQ ID NO: 1495 - DNA, 140 bp, Artificial Sequence
  Synthetic
atacgccatgctgggtctcccacaggaggacatgccgtatcccggggaagtgcaaagatcagatggttggaggagagaggatatctgcagccctatgggaaggttgttgacctcggatgtcgtacttgggagtcggccat

SEQ ID NO: 1496 - DNA, 140 bp, Artificial Sequence
  Synthetic
atggccgactcccaagtacgacatccgaggtcaacaaccttcccatagggctgcagatatcctctctcctccaaccatctgatctttgcacttccccgggatacggcatgtcctcctgtgggagacccagcatggcgtat

SEQ ID NO: 1497 - DNA, 140 bp, Artificial Sequence
  Synthetic
atacgccatgctgggtctccgtgctgtgcccatacaccagcactatgatggaaaccatggagcgactgcaacgtaggcatgggggaggattagtcagagtgccattgtgtcgcaactccacgtacttgggagtcggccat

SEQ ID NO: 1498 - DNA, 140 bp, Artificial Sequence
  Synthetic
atggccgactcccaagtacgtggagttgcgacacaatggcactctgactaatcctcccccatgcctacgttgcagtcgctccatggtttccatcatagtgctggtgtatgggcacagcacggagacccagcatggcgtat

SEQ ID NO: 1499 - DNA, 140 bp, Artificial Sequence
  Synthetic
aggccctggctgctgatatgtgggacgtggtgactggagttacaggaatagccatgactgacaccacaccatacggccaacaaagagtcttcaaagaaaaagtggacaccagggtgccaggaccttttgggacagcggtg

SEQ ID NO: 1500 - DNA, 140 bp, Artificial Sequence
  Synthetic
caccgctgtcccaaaaggtcctggcaccctggtgtccactttttctttgaagactctttgttggccgtatggtgtggtgtcagtcatggctattcctgtaactccagtcaccacgtcccacatatcagcagccagggcct

SEQ ID NO: 1501 - DNA, 140 bp, Artificial Sequence
  Synthetic
atacgccatgctgggtctccatacggccaacaaagagtcttcaaagaaaaagtggacaccagggtgccagatccccaagaaggcactcgccaggtaatgaacatagtctcttcctggctgcgtacttgggagtcggccat

SEQ ID NO: 1502 - DNA, 140 bp, Artificial Sequence
  Synthetic
atggccgactcccaagtacgcagccaggaagagactatgttcattacctggcgagtgccttcttggggatctggcaccctggtgtccactttttctttgaagactctttgttggccgtatggagacccagcatggcgtat

SEQ ID NO: 1503 - DNA, 140 bp, Artificial Sequence
  Synthetic
aggccctggctgctgatatgcagctgtgtgtacaacatgatgggaaaaagagaaaagaagcaaggagagttcgggaaagcaaaaggtagccgcgccatctggtacatgtggttgggagccgaccttttgggacagcggtg

SEQ ID NO: 1504 - DNA, 140 bp, Artificial Sequence
  Synthetic
caccgctgtcccaaaaggtcggctcccaaccacatgtaccagatggcgcggctaccttttgctttcccgaactctccttgcttcttttctctttttcccatcatgttgtacacacagctgcatatcagcagccagggcct

SEQ ID NO: 1505 - DNA, 140 bp, Artificial Sequence
  Synthetic
aggccctggctgctgatatgtcgggaaagcaaaaggtagccgcgccatctggtacatgtggttgggagccagattcttggagtttgaagcccttggattcttgaacgaggaccattggatgaccttttgggacagcggtg

SEQ ID NO: 1506 - DNA, 140 bp, Artificial Sequence
  Synthetic
caccgctgtcccaaaaggtcatccaatggtcctcgttcaagaatccaagggcttcaaactccaagaatctggctcccaaccacatgtaccagatggcgcggctaccttttgctttcccgacatatcagcagccagggcct

SEQ ID NO: 1507 - DNA, 140 bp, Artificial Sequence
  Synthetic
atacgccatgctgggtctccagattcttggagtttgaagcccttggattcttgaacgaggaccattggatgggaagagaaaactcaggaggtggagtcgaagggttaggattgcaaagaccgtacttgggagtcggccat

SEQ ID NO: 1508 - DNA, 140 bp, Artificial Sequence
  Synthetic
atggccgactcccaagtacggtctttgcaatcctaacccttcgactccacctcctgagttttctcttcccatccaatggtcctcgttcaagaatccaagggcttcaaactccaagaatctggagacccagcatggcgtat

SEQ ID NO: 1509 - DNA, 140 bp, Artificial Sequence
  Synthetic
atacgccatgctgggtctccttggatacattctagaagaaatgaatcgggcaccaggaggaaagatgtacgcagatgacactgctggctgggacacccgcattagtaagtttgatctggacgtacttgggagtcggccat

SEQ ID NO: 1510 - DNA, 140 bp, Artificial Sequence
  Synthetic
atggccgactcccaagtacgtccagatcaaacttactaatgcgggtgtcccagccagcagtgtcatctgcgtacatctttcctcctggtgcccgattcatttcttctagaatgtatccaaggagacccagcatggcgtat

SEQ ID NO: 1511 - DNA, 140 bp, Artificial Sequence
  Synthetic
atacgccatgctgggtctccgaatgaagctctgattaccaaccaaatggaggaagggcacagaactctggcgttggccgtgattaaatacacataccaaaacaaagtggtgaaggttctccgtacttgggagtcggccat

SEQ ID NO: 1512 - DNA, 140 bp, Artificial Sequence
  Synthetic
atggccgactcccaagtacggagaaccttcaccactttgttttggtatgtgtatttaatcacggccaacgccagagttctgtgcccttcctccatttggttggtaatcagagcttcattcggagacccagcatggcgtat

SEQ ID NO: 1513 - DNA, 140 bp, Artificial Sequence
  Synthetic
aggccctggctgctgatatgcgttggccgtgattaaatacacataccaaaacaaagtggtgaaggttctcagaccagctgaaggaggaaaaacagttatggacatcatttcaagacaagagaccttttgggacagcggtg

SEQ ID NO: 1514 - DNA, 140 bp, Artificial Sequence
  Synthetic
caccgctgtcccaaaaggtctcttgtcttgaaatgatgtccataactgtttttcctccttcagctggtctgagaaccttcaccactttgttttggtatgtgtatttaatcacggccaacgcatatcagcagccagggcct

SEQ ID NO: 1515 - DNA, 140 bp, Artificial Sequence
  Synthetic
aggccctggctgctgatatgccagagagggagtggacaagttgtcacttatgctctcaacacattcaccaacttggtggtgcagcttatccggaacatggaagctgaggaagtgttagaggaccttttgggacagcggtg

SEQ ID NO: 1516 - DNA, 140 bp, Artificial Sequence
  Synthetic
caccgctgtcccaaaaggtcctctaacacttcctcagcttccatgttccggataagctgcaccaccaagttggtgaatgtgttgagagcataagtgacaacttgtccactccctctctggcatatcagcagccagggcct

SEQ ID NO: 1517 - DNA, 140 bp, Artificial Sequence
  Synthetic
aggccctggctgctgatatgacttggtggtgcagcttatccggaacatggaagctgaggaagtgttagagatgcaagacttatggttgttgaggaagccagagaaagtgaccagatggttgaccttttgggacagcggtg

SEQ ID NO: 1518 - DNA, 140 bp, Artificial Sequence
  Synthetic
caccgctgtcccaaaaggtcaaccatctggtcactttctctggcttcctcaacaaccataagtcttgcatctctaacacttcctcagcttccatgttccggataagctgcaccaccaagtcatatcagcagccagggcct

SEQ ID NO: 1519 - DNA, 140 bp, Artificial Sequence
  Synthetic
aggccctggctgctgatatgacaagctgtacctcaaggatgggagatccattgtggtcccttgccgccaccaagatgaactgattggccgagctcgcgtctcaccaggggcaggatggaggaccttttgggacagcggtg

SEQ ID NO: 1520 - DNA, 140 bp, Artificial Sequence
  Synthetic
caccgctgtcccaaaaggtcctccatcctgcccctggtgagacgcgagctcggccaatcagttcatcttggtggcggcaagggaccacaatggatctcccatccttgaggtacagcttgtcatatcagcagccagggcct

SEQ ID NO: 1521 - DNA, 140 bp, Artificial Sequence
  Synthetic
atacgccatgctgggtctccacccggagtgttgtaagcaccaattttagtgttgtcaggcctgctagtcagccacagtttggggaaagctgtgcagcctgtaacccccccaggagaagctcgtacttgggagtcggccat

SEQ ID NO: 1522 - DNA, 140 bp, Artificial Sequence
  Synthetic
atggccgactcccaagtacgagcttctcctgggggggttacaggctgcacagctttccccaaactgtggctgactagcaggcctgacaacactaaaattggtgcttacaacactccgggtggagacccagcatggcgtat

SEQ ID NO: 1523 - DNA, 140 bp, Artificial Sequence
  Synthetic
aggccctggctgctgatatggggaaaccaagctcatagtcaggccgagaacgccatggcacggaagaagccatgctgcctgtgagcccctcagaggacactgagtcaaaaaaccccacgcgaccttttgggacagcggtg

SEQ ID NO: 1524 - DNA, 140 bp, Artificial Sequence
  Synthetic
caccgctgtcccaaaaggtcgcgtggggttttttgactcagtgtcctctgaggggctcacaggcagcatggcttcttccgtgccatggcgttctcggcctgactatgagcttggtttccccatatcagcagccagggcct

SEQ ID NO: 1525 - DNA, 140 bp, Artificial Sequence
  Synthetic
atacgccatgctgggtctcccatgctgcctgtgagcccctcagaggacactgagtcaaaaaaccccacgcgcttggaagcgcaggatgggaaaagaaggtggcgaccttccccacccttccgtacttgggagtcggccat

SEQ ID NO: 1526 - DNA, 140 bp, Artificial Sequence
  Synthetic
atggccgactcccaagtacggaagggtggggaaggtcgccaccttcttttcccatcctgcgcttccaagcgcgtggggttttttgactcagtgtcctctgaggggctcacaggcagcatgggagacccagcatggcgtat

SEQ ID NO: 1527 - DNA, 140 bp, Artificial Sequence
  Synthetic
aggccctggctgctgatatgaatctggggcctgaactggagactagctgtgaatctccagcagagggactagtggttagaggagaccccccggaaaacgcaaaacagcatattgacgtgggaccttttgggacagcggtg

SEQ ID NO: 1528 - DNA, 140 bp, Artificial Sequence
  Synthetic
caccgctgtcccaaaaggtcccacgtcaatatgctgttttgcgttttccggggggtctcctctaaccactagtccctctgctggagattcacagctagtctccagttcaggccccagattcatatcagcagccagggcct

SEQ ID NO: 1529 - DNA, 140 bp, Artificial Sequence
  Synthetic
atacgccatgctgggtctccacgtgggaaagaccagagactccatgagtttccaccacgctggccgccaggcacagatcgccgaacttcggcggccggtgtggggaaatccatggtttctcgtacttgggagtcggccat

SEQ ID NO: 1530 - DNA, 140 bp, Artificial Sequence
  Synthetic
atggccgactcccaagtacgagaaaccatggatttccccacaccggccgccgaagttcggcgatctgtgcctggcggccagcgtggtggaaactcatggagtctctggtctttcccacgtggagacccagcatggcgtat

SEQ ID NO: 1531 - DNA, 140 bp, Artificial Sequence
  Synthetic
aggccctggctgctgatatgcagtgcatggctcccagcatagcgggatgactgtcaatgatataggatatgaaactgacgaaaatagagcgaaagtcgaggttacgcctaattcaccaaggaccttttgggacagcggtg

SEQ ID NO: 1532 - DNA, 140 bp, Artificial Sequence
  Synthetic
caccgctgtcccaaaaggtccttggtgaattaggcgtaacctcgactttcgctctattttcgtcagtttcatatcctatatcattgacagtcatcccgctatgctgggagccatgcactgcatatcagcagccagggcct

SEQ ID NO: 1533 - DNA, 140 bp, Artificial Sequence
  Synthetic
atacgccatgctgggtctccaagcattggttggtgcacaaagagtggtttcatgacatcccattgccttggcatgctggggcagacactggaactccacactggaacaacaaagaggcatcgtacttgggagtcggccat

SEQ ID NO: 1534 - DNA, 140 bp, Artificial Sequence
  Synthetic
atggccgactcccaagtacgatgcctctttgttgttccagtgtggagttccagtgtctgccccagcatgccaaggcaatgggatgtcatgaaaccactctttgtgcaccaaccaatgcttggagacccagcatggcgtat

SEQ ID NO: 1535 - DNA, 140 bp, Artificial Sequence
  Synthetic
aggccctggctgctgatatggcatgctggggcagacactggaactccacactggaacaacaaagaggcattggtagaattcaaggatgcccacgccaagaggcaaaccgtcgtcgttctggaccttttgggacagcggtg

SEQ ID NO: 1536 - DNA, 140 bp, Artificial Sequence
  Synthetic
caccgctgtcccaaaaggtccagaacgacgacggtttgcctcttggcgtgggcatccttgaattctaccaatgcctctttgttgttccagtgtggagttccagtgtctgccccagcatgccatatcagcagccagggcct

SEQ ID NO: 1537 - DNA, 140 bp, Artificial Sequence
  Synthetic
aggccctggctgctgatatgtgagatggatggtgcaaagggaaagctgttctctggccatttgaaatgccgcctaaaaatggacaagcttagattgaagggcgtgtcatattccttgtgcgaccttttgggacagcggtg

SEQ ID NO: 1538 - DNA, 140 bp, Artificial Sequence
  Synthetic
caccgctgtcccaaaaggtcgcacaaggaatatgacacgcccttcaatctaagcttgtccatttttaggcggcatttcaaatggccagagaacagctttccctttgcaccatccatctcacatatcagcagccagggcct

SEQ ID NO: 1539 - DNA, 140 bp, Artificial Sequence
  Synthetic
aggccctggctgctgatatgcatgagagagatcatacttaaggtggtcctgatggccatctgtggcatgaacccaatagctataccttttgctgcaggagcgtggtatgtgtatgtgaaggaccttttgggacagcggtg

SEQ ID NO: 1540 - DNA, 140 bp, Artificial Sequence
  Synthetic
caccgctgtcccaaaaggtccttcacatacacataccacgctcctgcagcaaaaggtatagctattgggttcatgccacagatggccatcaggaccaccttaagtatgatctctctcatgcatatcagcagccagggcct

SEQ ID NO: 1541 - DNA, 140 bp, Artificial Sequence
  Synthetic
aggccctggctgctgatatgaaaaaagagactccggacagtgatcttggcaccaactagggttgtcgctgctgagatggaggaggccttgagaggacttccggtgcgttacatgacaacagaccttttgggacagcggtg

SEQ ID NO: 1542 - DNA, 140 bp, Artificial Sequence
  Synthetic
caccgctgtcccaaaaggtctgttgtcatgtaacgcaccggaagtcctctcaaggcctcctccatctcagcagcgacaaccctagttggtgccaagatcactgtccggagtctcttttttcatatcagcagccagggcct

SEQ ID NO: 1543 - DNA, 140 bp, Artificial Sequence
  Synthetic
aggccctggctgctgatatggcagtcaacgtcacccattctgggacagaaatcgttgatttgatgtgccatgccactttcacttcacgcttactacaacccatcagagtccctaattacagaccttttgggacagcggtg

SEQ ID NO: 1544 - DNA, 140 bp, Artificial Sequence
  Synthetic
caccgctgtcccaaaaggtctgtaattagggactctgatgggttgtagtaagcgtgaagtgaaagtggcatggcacatcaaatcaacgatttctgtcccagaatgggtgacgttgactgccatatcagcagccagggcct

SEQ ID NO: 1545 - DNA, 140 bp, Artificial Sequence
  Synthetic
aggccctggctgctgatatgtgccactttcacttcacgcttactacaacccatcagagtccctaattacaatctctacatcatggatgaagcccacttcacagacccctcaagtatagctgaccttttgggacagcggtg

SEQ ID NO: 1546 - DNA, 140 bp, Artificial Sequence
  Synthetic
caccgctgtcccaaaaggtcagctatacttgaggggtctgtgaagtgggcttcatccatgatgtagagattgtaattagggactctgatgggttgtagtaagcgtgaagtgaaagtggcacatatcagcagccagggcct

SEQ ID NO: 1547 - DNA, 140 bp, Artificial Sequence
  Synthetic
atacgccatgctgggtctccatctctacatcatggatgaagcccacttcacagacccctcaagtatagctgcaagaggatatatatcaacaagggttgaaatgggcgaggcggctgccatcgtacttgggagtcggccat

SEQ ID NO: 1548 - DNA, 140 bp, Artificial Sequence
  Synthetic
atggccgactcccaagtacgatggcagccgcctcgcccatttcaacccttgttgatatatatcctcttgcagctatacttgaggggtctgtgaagtgggcttcatccatgatgtagagatggagacccagcatggcgtat

SEQ ID NO: 1549 - DNA, 140 bp, Artificial Sequence
  Synthetic
aggccctggctgctgatatgaaaacaaaaaatcaagagtgggactttgtcataacaactgacatctcagagatgggcgccaacttcaaggctgaccgggtcatagactctaggagatgccgaccttttgggacagcggtg

SEQ ID NO: 1550 - DNA, 140 bp, Artificial Sequence
  Synthetic
caccgctgtcccaaaaggtcggcatctcctagagtctatgacccggtcagccttgaagttggcgcccatctctgagatgtcagttgttatgacaaagtcccactcttgattttttgttttcatatcagcagccagggcct

SEQ ID NO: 1551 - DNA, 140 bp, Artificial Sequence
  Synthetic
aggccctggctgctgatatgtgatggcacaaccaacaacaccataatggaagacagcgtaccagcagaggtgtggacaaagtatggagagaagagagtgctcaaaccgagatggatggatgaccttttgggacagcggtg

SEQ ID NO: 1552 - DNA, 140 bp, Artificial Sequence
  Synthetic
caccgctgtcccaaaaggtcatccatccatctcggtttgagcactctcttctctccatactttgtccacacctctgctggtacgctgtcttccattatggtgttgttggttgtgccatcacatatcagcagccagggcct

SEQ ID NO: 1553 - DNA, 140 bp, Artificial Sequence
  Synthetic
atacgccatgctgggtctccatgggcaaagggatgccattttatgcatgggaccttggagtcccgctgctaatgatgggttgctattcacaattaacacccctgactctgatagtagctacgtacttgggagtcggccat

SEQ ID NO: 1554 - DNA, 140 bp, Artificial Sequence
  Synthetic
atggccgactcccaagtacgtagctactatcagagtcaggggtgttaattgtgaatagcaacccatcattagcagcgggactccaaggtcccatgcataaaatggcatccctttgcccatggagacccagcatggcgtat

SEQ ID NO: 1555 - DNA, 140 bp, Artificial Sequence
  Synthetic
aggccctggctgctgatatgttctgtataaaggtgctgtgcccatacaccagcactatgatggaaaccatggagcgactgcaacgtaggcatgggggaggattagtcagagtgccattgtgaccttttgggacagcggtg

SEQ ID NO: 1556 - DNA, 140 bp, Artificial Sequence
  Synthetic
caccgctgtcccaaaaggtcacaatggcactctgactaatcctcccccatgcctacgttgcagtcgctccatggtttccatcatagtgctggtgtatgggcacagcacctttatacagaacatatcagcagccagggcct

SEQ ID NO: 1557 - DNA, 140 bp, Artificial Sequence
  Synthetic
aggccctggctgctgatatgtcttcctggctgtggaaggagctggggaaacgcaagcggccacgcgtctgcaccaaagaagagtttatcaacaaggtgcgcagcaatgcagcactgggaggaccttttgggacagcggtg

SEQ ID NO: 1558 - DNA, 140 bp, Artificial Sequence
  Synthetic
caccgctgtcccaaaaggtcctcccagtgctgcattgctgcgcaccttgttgataaactcttctttggtgcagacgcgtggccgcttgcgtttccccagctccttccacagccaggaagacatatcagcagccagggcct

SEQ ID NO: 1559 - DNA, 140 bp, Artificial Sequence
  Synthetic
atacgccatgctgggtctcctccccacccttcaatctggggcctgaactggagactagctgtgaatctccagcagagggactagtggttagaggagaccccccggaaaacgcaaaacagccgtacttgggagtcggccat

SEQ ID NO: 1560 - DNA, 140 bp, Artificial Sequence
  Synthetic
atggccgactcccaagtacggctgttttgcgttttccggggggtctcctctaaccactagtccctctgctggagattcacagctagtctccagttcaggccccagattgaagggtggggaggagacccagcatggcgtat

SEQ ID NO: 1561 - DNA, 140 bp, Artificial Sequence
  Synthetic
atacgccatgctgggtctcccgctgggaaagaccagagactccatgagtttccaccacgctggccgccaggcacagatcgccgaacagcggcggccggtgtggggaaatccatggtttctcgtacttgggagtcggccat

SEQ ID NO: 1562 - DNA, 140 bp, Artificial Sequence
  Synthetic
atggccgactcccaagtacgagaaaccatggatttccccacaccggccgccgctgttcggcgatctgtgcctggcggccagcgtggtggaaactcatggagtctctggtctttcccagcgggagacccagcatggcgtat

SEQ ID NO: 1563 - DNA, 140 bp, Artificial Sequence
  Synthetic
aggccctggctgctgatatgaaaacgcggagtagcccgtgtaaaccccttgggaggtttgaagaggctgccagccggacttctgctgggtcatggacccatcagaatggttttggcgatagaccttttgggacagcggtg

SEQ ID NO: 1564 - DNA, 140 bp, Artificial Sequence
  Synthetic
caccgctgtcccaaaaggtctatcgccaaaaccattctgatgggtccatgacccagcagaagtccggctggcagcctcttcaaacctcccaaggggtttacacgggctactccgcgttttcatatcagcagccagggcct

SEQ ID NO: 1565 - DNA, 140 bp, Artificial Sequence
  Synthetic
atacgccatgctgggtctccttagcctttttgagattcacagcaatcaagccatcactgggcctcatcaacagatggggtaccgtggggaaaaaagaggctatggaaataataaaaaaatcgtacttgggagtcggccat

SEQ ID NO: 1566 - DNA, 140 bp, Artificial Sequence
  Synthetic
atggccgactcccaagtacgatttttttattatttccatagcctcttttttccccacggtaccccatctgttgatgaggcccagtgatggcttgattgctgtgaatctcaaaaaggctaaggagacccagcatggcgtat

SEQ ID NO: 1567 - DNA, 140 bp, Artificial Sequence
  Synthetic
atacgccatgctgggtctccttaagaaagatcttgctgccatgttgagaataatcaatgctaggaaggagaggaagagacgtggcgcagacaccagcatcggaatcgttggcctcctgttcgtacttgggagtcggccat

SEQ ID NO: 1568 - DNA, 140 bp, Artificial Sequence
  Synthetic
atggccgactcccaagtacgaacaggaggccaacgattccgatgctggtgtctgcgccacgtctcttcctctccttcctagcattgattattctcaacatggcagcaagatctttcttaaggagacccagcatggcgtat

SEQ ID NO: 1569 - DNA, 140 bp, Artificial Sequence
  Synthetic
atacgccatgctgggtctccgactacagccatggcagcagagatcactagacgtgggagtgcatactacatgtacttggataggagcgatgcagggaaggccatttctttcgctaccacacgtacttgggagtcggccat

SEQ ID NO: 1570 - DNA, 140 bp, Artificial Sequence
  Synthetic
atggccgactcccaagtacgtgtggtagcgaaagaaatggccttccctgcatcgctcctatccaagtacatgtagtatgcactcccacgtctagtgatctctgctgccatggctgtagtcggagacccagcatggcgtat

SEQ ID NO: 1571 - DNA, 140 bp, Artificial Sequence
  Synthetic
atacgccatgctgggtctccttgggggtgaacaaatgccatgtgcagatcatggacctcgggcacatgtgtgacgccaccatgagctatgaatgccctatgctggacgagggggtggaaccgtacttgggagtcggccat

SEQ ID NO: 1572 - DNA, 140 bp, Artificial Sequence
  Synthetic
atggccgactcccaagtacggttccaccccctcgtccagcatagggcattcatagctcatggtggcgtcacacatgtgcccgaggtccatgatctgcacatggcatttgttcacccccaaggagacccagcatggcgtat

SEQ ID NO: 1573 - DNA, 140 bp, Artificial Sequence
  Synthetic
atacgccatgctgggtctcccagatgacgtcgattgctggtgcaacacgacatcaacttgggttgtgtacggaacctgtcatcataaaaaaggtgaagcacggcgatctagaagagccgtcgtacttgggagtcggccat

SEQ ID NO: 1574 - DNA, 140 bp, Artificial Sequence
  Synthetic
atggccgactcccaagtacgacggctcttctagatcgccgtgcttcaccttttttatgatgacaggttccgtacacaacccaagttgatgtcgtgttgcaccagcaatcgacgtcatctgggagacccagcatggcgtat

SEQ ID NO: 1575 - DNA, 140 bp, Artificial Sequence
  Synthetic
atacgccatgctgggtctcccacgctcccatctcactccacaaggaaattgcaaacgcggtcgcagacttggctagaatcaagagaatacacaaagcacctgatcaaggttgaaaattggcgtacttgggagtcggccat

SEQ ID NO: 1576 - DNA, 140 bp, Artificial Sequence
  Synthetic
atggccgactcccaagtacgccaattttcaaccttgatcaggtgctttgtgtattctcttgattctagccaagtctgcgaccgcgtttgcaatttccttgtggagtgagatgggagcgtgggagacccagcatggcgtat

SEQ ID NO: 1577 - DNA, 140 bp, Artificial Sequence
  Synthetic
atacgccatgctgggtctccatattcaggaaccctggttttacgctagtggctgtcgccatcgcctggcttttgggaagctcgacgagccaaaaagtcatatacttggtcatgatactgccgtacttgggagtcggccat

SEQ ID NO: 1578 - DNA, 140 bp, Artificial Sequence
  Synthetic
atggccgactcccaagtacggcagtatcatgaccaagtatatgactttttggctcgtcgagcttcccaaaagccaggcgatggcgacagccactagcgtaaaaccagggttcctgaatatggagacccagcatggcgtat

SEQ ID NO: 1579 - DNA, 140 bp, Artificial Sequence
  Synthetic
atacgccatgctgggtctcctgattgccccggcatacagtatcaggtgcataggagtcagcaatagagacttcgtggagggcatgtcaggtgggacctgggttgacgttgtcctggaacacgtacttgggagtcggccat

SEQ ID NO: 1580 - DNA, 140 bp, Artificial Sequence
  Synthetic
atggccgactcccaagtacgtgttccaggacaacgtcaacccaggtcccacctgacatgccctccacgaagtctctattgctgactcctatgcacctgatactgtatgccggggcaatcaggagacccagcatggcgtat

SEQ ID NO: 1581 - DNA, 140 bp, Artificial Sequence
  Synthetic
atacgccatgctgggtctcctggaggctgcgtcaccgtgatggcacaggacaagccaacagttgacatagagctggtcacaacaacggttagtaacatggccgaggtgagatcctattgtcgtacttgggagtcggccat

SEQ ID NO: 1582 - DNA, 140 bp, Artificial Sequence
  Synthetic
atggccgactcccaagtacgacaataggatctcacctcggccatgttactaaccgttgttgtgaccagctctatgtcaactgttggcttgtcctgtgccatcacggtgacgcagcctccaggagacccagcatggcgtat

SEQ ID NO: 1583 - DNA, 140 bp, Artificial Sequence
  Synthetic
atacgccatgctgggtctcctacgaggcatcaatatcggacatggcttcggacagtcgctgcccaacacaaggtgaagcctaccttgacaagcaatcagacactcaatatgtttgcaaaacgtacttgggagtcggccat

SEQ ID NO: 1584 - DNA, 140 bp, Artificial Sequence
  Synthetic
atggccgactcccaagtacgttttgcaaacatattgagtgtctgattgcttgtcaaggtaggcttcaccttgtgttgggcagcgactgtccgaagccatgtccgatattgatgcctcgtaggagacccagcatggcgtat

SEQ ID NO: 1585 - DNA, 140 bp, Artificial Sequence
  Synthetic
atacgccatgctgggtctccgaacattggtggacagaggttggggaaatgggtgtggactctttggcaaagggagtttggtgacatgtgctaagttcacgtgctccaagaagatgactggcgtacttgggagtcggccat

SEQ ID NO: 1586 - DNA, 140 bp, Artificial Sequence
  Synthetic
atggccgactcccaagtacgccagtcatcttcttggagcacgtgaacttagcacatgtcaccaaactccctttgccaaagagtccacacccatttccccaacctctgtccaccaatgttcggagacccagcatggcgtat

SEQ ID NO: 1587 - DNA, 140 bp, Artificial Sequence
  Synthetic
atacgccatgctgggtctccgaagagcattcagccggagaacctggagtatcggataatgctatcagtgcatggctcccagcacagtgggatgattgttaatgatgaaaacagagcgaagcgtacttgggagtcggccat

SEQ ID NO: 1588 - DNA, 140 bp, Artificial Sequence
  Synthetic
atggccgactcccaagtacgcttcgctctgttttcatcattaacaatcatcccactgtgctgggagccatgcactgatagcattatccgatactccaggttctccggctgaatgctcttcggagacccagcatggcgtat

SEQ ID NO: 1589 - DNA, 140 bp, Artificial Sequence
  Synthetic
atacgccatgctgggtctccgtcgaggttacgcccaattcaccaagagcagaagcaaccctgggaggctttggaagcttaggacttgattgtgaaccaaggacaggccttgacttttcagcgtacttgggagtcggccat

SEQ ID NO: 1590 - DNA, 140 bp, Artificial Sequence
  Synthetic
atggccgactcccaagtacgctgaaaagtcaaggcctgtccttggttcacaatcaagtcctaagcttccaaagcctcccagggttgcttctgctcttggtgaattgggcgtaacctcgacggagacccagcatggcgtat

SEQ ID NO: 1591 - DNA, 140 bp, Artificial Sequence
  Synthetic
atacgccatgctgggtctccatctgtattacctaaccatgaataacaagcattggttggtgcacaaagagtggtttcatgacatcccattgccctggcatgctggggcagacactggaaccgtacttgggagtcggccat

SEQ ID NO: 1592 - DNA, 140 bp, Artificial Sequence
  Synthetic
atggccgactcccaagtacggttccagtgtctgccccagcatgccagggcaatgggatgtcatgaaaccactctttgtgcaccaaccaatgcttgttattcatggttaggtaatacagatggagacccagcatggcgtat

SEQ ID NO: 1593 - DNA, 140 bp, Artificial Sequence
  Synthetic
atacgccatgctgggtctcctccacattggaacaacaaggaggcattagtggaattcaaggacgcccacgccaagaggcaaaccgtcgtggttttggggagccaggaaggagccgtccaccgtacttgggagtcggccat

SEQ ID NO: 1594 - DNA, 140 bp, Artificial Sequence
  Synthetic
atggccgactcccaagtacggtggacggctccttcctggctccccaaaaccacgacggtttgcctcttggcgtgggcgtccttgaattccactaatgcctccttgttgttccaatgtggaggagacccagcatggcgtat

SEQ ID NO: 1595 - DNA, 140 bp, Artificial Sequence
  Synthetic
aggccctggctgctgatatgccaagaggcaaaccgtcgtggttttggggagccaggaaggagccgtccacacggctcttgctggagctctagaggctgagatggatggtgcaaagggaaggaccttttgggacagcggtg

SEQ ID NO: 1596 - DNA, 140 bp, Artificial Sequence
  Synthetic
caccgctgtcccaaaaggtccttccctttgcaccatccatctcagcctctagagctccagcaagagccgtgtggacggctccttcctggctccccaaaaccacgacggtttgcctcttggcatatcagcagccagggcct

SEQ ID NO: 1597 - DNA, 140 bp, Artificial Sequence
  Synthetic
atacgccatgctgggtctccacggctcttgctggagctctagaggctgagatggatggtgcaaagggaaggctattctctggccacttgaaatgtcgcttaaaaatggacaagcttagatcgtacttgggagtcggccat

SEQ ID NO: 1598 - DNA, 140 bp, Artificial Sequence
  Synthetic
atggccgactcccaagtacgatctaagcttgtccatttttaagcgacatttcaagtggccagagaatagccttccctttgcaccatccatctcagcctctagagctccagcaagagccgtggagacccagcatggcgtat

SEQ ID NO: 1599 - DNA, 140 bp, Artificial Sequence
  Synthetic
atacgccatgctgggtctcctgaagggcgtgtcatattccttgtgcaccgcggcattcacattcaccaaggtcccggctgaaacactacatggaacagtcacagtggaggtgcagtatgccgtacttgggagtcggccat

SEQ ID NO: 1600 - DNA, 140 bp, Artificial Sequence
  Synthetic
atggccgactcccaagtacggcatactgcacctccactgtgactgttccatgtagtgtttcagccgggaccttggtgaatgtgaatgccgcggtgcacaaggaatatgacacgcccttcaggagacccagcatggcgtat

SEQ ID NO: 1601 - DNA, 140 bp, Artificial Sequence
  Synthetic
aggccctggctgctgatatgagggacagatggaccctgcaaggtcccagcccagatggcggtggacatgcagaccttgaccccagtcggaaggctgataaccgccaaccccgtgattactgaccttttgggacagcggtg

SEQ ID NO: 1602 - DNA, 140 bp, Artificial Sequence
  Synthetic
caccgctgtcccaaaaggtcagtaatcacggggttggcggttatcagccttccgactggggtcaaggtctgcatgtccaccgccatctgggctgggaccttgcagggtccatctgtccctcatatcagcagccagggcct

SEQ ID NO: 1603 - DNA, 140 bp, Artificial Sequence
  Synthetic
aggccctggctgctgatatgggcataggagtggcagcaccattggaaaagcatttgaagccactgtgagaggcgctaagagaatggcagtcctgggggacacagcttgggactttggatcgaccttttgggacagcggtg

SEQ ID NO: 1604 - DNA, 140 bp, Artificial Sequence
  Synthetic
caccgctgtcccaaaaggtcgatccaaagtcccaagctgtgtcccccaggactgccattctcttagcgcctctcacagtggcttcaaatgcttttccaatggtgctgccactcctatgcccatatcagcagccagggcct

SEQ ID NO: 1605 - DNA, 140 bp, Artificial Sequence
  Synthetic
atacgccatgctgggtctccagtcggaggtgtgtttaactcattgggcaagggcattcatcagatttttggagcagctttcaaatcactgtttggaggaatgtcctggttctcacagatccgtacttgggagtcggccat

SEQ ID NO: 1606 - DNA, 140 bp, Artificial Sequence
  Synthetic
atggccgactcccaagtacggatctgtgagaaccaggacattcctccaaacagtgatttgaaagctgctccaaaaatctgatgaatgcccttgcccaatgagttaaacacacctccgactggagacccagcatggcgtat

SEQ ID NO: 1607 - DNA, 140 bp, Artificial Sequence
  Synthetic
atacgccatgctgggtctccctcataggcactctgctggtgtggttaggtctgaacacaaagaatgggtctatctccctcacatgcttagccctggggggagtgatgatcttcctctccacgtacttgggagtcggccat

SEQ ID NO: 1608 - DNA, 140 bp, Artificial Sequence
  Synthetic
atggccgactcccaagtacgtggagaggaagatcatcactccccccagggctaagcatgtgagggagatagacccattctttgtgttcagacctaaccacaccagcagagtgcctatgagggagacccagcatggcgtat

SEQ ID NO: 1609 - DNA, 140 bp, Artificial Sequence
  Synthetic
atacgccatgctgggtctcccggctgtttctgctgacgtggggtgctcggtggacttctcaaaaaaagaaacgagatgtggcacgggggtgttcgtctacaatgacgttgaagcctggagcgtacttgggagtcggccat

SEQ ID NO: 1610 - DNA, 140 bp, Artificial Sequence
  Synthetic
atggccgactcccaagtacgctccaggcttcaacgtcattgtagacgaacacccccgtgccacatctcgtttctttttttgagaagtccaccgagcaccccacgtcagcagaaacagccgggagacccagcatggcgtat

SEQ ID NO: 1611 - DNA, 140 bp, Artificial Sequence
  Synthetic
atacgccatgctgggtctccggaccggtacaagtaccatcctgactcccctcgtagactggcagcagccgttaagcaagcttgggaagaggggatttgtgggatctcctctgtttctagacgtacttgggagtcggccat

SEQ ID NO: 1612 - DNA, 140 bp, Artificial Sequence
  Synthetic
atggccgactcccaagtacgtctagaaacagaggagatcccacaaatcccctcttcccaagcttgcttaacggctgctgccagtctacgaggggagtcaggatggtacttgtaccggtccggagacccagcatggcgtat

SEQ ID NO: 1613 - DNA, 140 bp, Artificial Sequence
  Synthetic
atacgccatgctgggtctccatggaaaacataatgtggaaatcagtggaaggagagctcaatgcaatcctagaggagaatggagtccaactgacagttgttgtgggatctgtaaaaaacccgtacttgggagtcggccat

SEQ ID NO: 1614 - DNA, 140 bp, Artificial Sequence
  Synthetic
atggccgactcccaagtacgggttttttacagatcccacaacaactgtcagttggactccattctcctctaggattgcattgagctctccttccactgatttccacattatgttttccatggagacccagcatggcgtat

SEQ ID NO: 1615 - DNA, 140 bp, Artificial Sequence
  Synthetic
atacgccatgctgggtctccccatgtggagaggcccacaaagattgccagtgcctgtgaatgagctgccccatggctggaaagcctgggggaaatcgtactttgttagggcggcaaagaccgtacttgggagtcggccat

SEQ ID NO: 1616 - DNA, 140 bp, Artificial Sequence
  Synthetic
atggccgactcccaagtacggtctttgccgccctaacaaagtacgatttcccccaggctttccagccatggggcagctcattcacaggcactggcaatctttgtgggcctctccacatggggagacccagcatggcgtat

SEQ ID NO: 1617 - DNA, 140 bp, Artificial Sequence
  Synthetic
atacgccatgctgggtctcccaacaacagttttgttgtcgacggtgacacattgaaggaatgtccgctcaagcacagagcatggaacagcttcctcgtggaggatcacgggtttggggtccgtacttgggagtcggccat

SEQ ID NO: 1618 - DNA, 140 bp, Artificial Sequence
  Synthetic
atggccgactcccaagtacggaccccaaacccgtgatcctccacgaggaagctgttccatgctctgtgcttgagcggacattccttcaatgtgtcaccgtcgacaacaaaactgttgttgggagacccagcatggcgtat

SEQ ID NO: 1619 - DNA, 140 bp, Artificial Sequence
  Synthetic
atacgccatgctgggtctccttccacaccagtgtttggcttaaggttagagaagattactcactggagtgtgacccagccgtcataggaacagctgttaagggaaaggaggccgcgcacacgtacttgggagtcggccat

SEQ ID NO: 1620 - DNA, 140 bp, Artificial Sequence
  Synthetic
atggccgactcccaagtacgtgtgcgcggcctcctttcccttaacagctgttcctatgacggctgggtcacactccagtgagtaatcttctctaaccttaagccaaacactggtgtggaaggagacccagcatggcgtat

SEQ ID NO: 1621 - DNA, 140 bp, Artificial Sequence
  Synthetic
atacgccatgctgggtctccgtgatctaggctattggattgaaagtgaaaagaatgacacatggaggctgaagagggctcatttgattgagatgaaaacatgtgagtggccaaagtctcacgtacttgggagtcggccat

SEQ ID NO: 1622 - DNA, 140 bp, Artificial Sequence
  Synthetic
atggccgactcccaagtacgtgagactttggccactcacatgttttcatctcaatcaaatgagccctcttcagcctccatgtgtcattcttttcactttcaatccaatagcctagatcacggagacccagcatggcgtat

SEQ ID NO: 1623 - DNA, 140 bp, Artificial Sequence
  Synthetic
atacgccatgctgggtctcccacactgtggacagatggagtggaagaaagtgatctgatcatacccaagtctttagctggtccactcagccaccacaacaccagagagggttacagaactcgtacttgggagtcggccat

SEQ ID NO: 1624 - DNA, 140 bp, Artificial Sequence
  Synthetic
atggccgactcccaagtacgagttctgtaaccctctctggtgttgtggtggctgagtggaccagctaaagacttgggtatgatcagatcactttcttccactccatctgtccacagtgtgggagacccagcatggcgtat

SEQ ID NO: 1625 - DNA, 140 bp, Artificial Sequence
  Synthetic
atacgccatgctgggtctcccaagtgaaagggccatggcatagtgaggagcttgaaatccgatttgaggaatgtccaggtaccaaggttcatgtggaggagacatgcggaacgagaggaccgtacttgggagtcggccat

SEQ ID NO: 1626 - DNA, 140 bp, Artificial Sequence
  Synthetic
atggccgactcccaagtacggtcctctcgttccgcatgtctcctccacatgaaccttggtacctggacattcctcaaatcggatttcaagctcctcactatgccatggccctttcacttgggagacccagcatggcgtat

SEQ ID NO: 1627 - DNA, 140 bp, Artificial Sequence
  Synthetic
atacgccatgctgggtctcccatctctgagatcaaccactgcaagcggaagggtcattgaggaatggtgctgtagggaatgcacaatgcccccactatcgttccgagcaaaagatggctgcgtacttgggagtcggccat

SEQ ID NO: 1628 - DNA, 140 bp, Artificial Sequence
  Synthetic
atggccgactcccaagtacgcagccatcttttgctcggaacgatagtgggggcattgtgcattccctacagcaccattcctcaatgacccttccgcttgcagtggttgatctcagagatgggagacccagcatggcgtat

SEQ ID NO: 1629 - DNA, 140 bp, Artificial Sequence
  Synthetic
atacgccatgctgggtctccctggtatggaatggagataaggcctaggaaagaaccagagagcaacttagtgaggtcaatggtgacagcgggatcaaccgatcatatggatcatttttctcgtacttgggagtcggccat

SEQ ID NO: 1630 - DNA, 140 bp, Artificial Sequence
  Synthetic
atggccgactcccaagtacgagaaaaatgatccatatgatcggttgatcccgctgtcaccattgacctcactaagttgctctctggttctttcctaggccttatctccattccataccagggagacccagcatggcgtat

SEQ ID NO: 1631 - DNA, 140 bp, Artificial Sequence
  Synthetic
atacgccatgctgggtctcccttggagtgcttgtgattctactcatggtgcaggaagggttgaagaagagaatgaccacaaagatcatcatgagcacatcaatggcagtgctggtggccacgtacttgggagtcggccat

SEQ ID NO: 1632 - DNA, 140 bp, Artificial Sequence
  Synthetic
atggccgactcccaagtacgtggccaccagcactgccattgatgtgctcatgatgatctttgtggtcattctcttcttcaacccttcctgcaccatgagtagaatcacaagcactccaagggagacccagcatggcgtat

SEQ ID NO: 1633 - DNA, 140 bp, Artificial Sequence
  Synthetic
atacgccatgctgggtctcctgatcttgggaggattctcaatgagtgacctggctaagcttgtgatcctgatgggggccactttcgcagaaatgaacactggaggagacgtagctcacttcgtacttgggagtcggccat

SEQ ID NO: 1634 - DNA, 140 bp, Artificial Sequence
  Synthetic
atggccgactcccaagtacgaagtgagctacgtctcctccagtgttcatttctgcgaaagtggcccccatcaggatcacaagcttagccaggtcactcattgagaatcctcccaagatcaggagacccagcatggcgtat

SEQ ID NO: 1635 - DNA, 140 bp, Artificial Sequence
  Synthetic
atacgccatgctgggtctccggcattagtagcggcatttaaagtcagaccagccttgctggtctcatttatcttcagagccaactggacacctcgtgagagcatgctgctagccttggctcgtacttgggagtcggccat

SEQ ID NO: 1636 - DNA, 140 bp, Artificial Sequence
  Synthetic
atggccgactcccaagtacgagccaaggctagcagcatgctctcacgaggtgtccagttggctctgaagataaatgagaccagcaaggctggtctgactttaaatgccgctactaatgccggagacccagcatggcgtat

SEQ ID NO: 1637 - DNA, 140 bp, Artificial Sequence
  Synthetic
atacgccatgctgggtctcctcgtgtcttctgcaaactgcgatctccgctcttgaaggcgacttgatggtcctcgttaatggatttgctttggcctggttggcaatacgtgcaatggccgcgtacttgggagtcggccat

SEQ ID NO: 1638 - DNA, 140 bp, Artificial Sequence
  Synthetic
atggccgactcccaagtacgcggccattgcacgtattgccaaccaggccaaagcaaatccattaacgaggaccatcaagtcgccttcaagagcggagatcgcagtttgcagaagacacgaggagacccagcatggcgtat

SEQ ID NO: 1639 - DNA, 140 bp, Artificial Sequence
  Synthetic
atacgccatgctgggtctcctgccacgcactgacaacatcgctctagcaattctggctgctctaacaccactagcccgaggcacactgctcgtggcatggagagcgggcctcgccacttgcgtacttgggagtcggccat

SEQ ID NO: 1640 - DNA, 140 bp, Artificial Sequence
  Synthetic
atggccgactcccaagtacgcaagtggcgaggcccgctctccatgccacgagcagtgtgcctcgggctagtggtgttagagcagccagaattgctagagcgatgttgtcagtgcgtggcaggagacccagcatggcgtat

SEQ ID NO: 1641 - DNA, 140 bp, Artificial Sequence
  Synthetic
atacgccatgctgggtctcctggagggttcatgctcctctccctgaaagggaaaggtagtgtgaagaagaacctgccattcgtcgcggccttgggattgaccgctgtgagaatagtggaccgtacttgggagtcggccat

SEQ ID NO: 1642 - DNA, 140 bp, Artificial Sequence
  Synthetic
atggccgactcccaagtacggtccactattctcacagcggtcaatcccaaggccgcgacgaatggcaggttcttcttcacactacctttccctttcagggagaggagcatgaaccctccaggagacccagcatggcgtat

SEQ ID NO: 1643 - DNA, 140 bp, Artificial Sequence
  Synthetic
atacgccatgctgggtctcccccattaatgtggtgggactactgttactcacaaggagtgggaagcggagctggccccctagtgaagtgctcactgctgtcggcctgatatgtgcattggcgtacttgggagtcggccat

SEQ ID NO: 1644 - DNA, 140 bp, Artificial Sequence
  Synthetic
atggccgactcccaagtacgccaatgcacatatcaggccgacagcagtgagcacttcactagggggccagctccgcttcccactccttgtgagtaacagtagtcccaccacattaatgggggagacccagcatggcgtat

SEQ ID NO: 1645 - DNA, 140 bp, Artificial Sequence
  Synthetic
atacgccatgctgggtctccccggagggtttgccaaggcagacatagagatggctgggcccatggcggcagtgggcctgctaattgtcagttatgtggtctcgggaaagagtgtagatatcgtacttgggagtcggccat

SEQ ID NO: 1646 - DNA, 140 bp, Artificial Sequence
  Synthetic
atggccgactcccaagtacgatatctacactctttcccgagaccacataactgacaattagcaggcccactgccgccatgggcccagccatctctatgtctgccttggcaaaccctccggggagacccagcatggcgtat

SEQ ID NO: 1647 - DNA, 140 bp, Artificial Sequence
  Synthetic
atacgccatgctgggtctccgtacattgaaagagcaggtgacatcacatgggagaaagacgcggaagtcactggaaacagtcctcggcttgacgtggcactagatgagagtggtgatttccgtacttgggagtcggccat

SEQ ID NO: 1648 - DNA, 140 bp, Artificial Sequence
  Synthetic
atggccgactcccaagtacggaaatcaccactctcatctagtgccacgtcaagccgaggactgtttccagtgacttccgcgtctttctcccatgtgatgtcacctgctctttcaatgtacggagacccagcatggcgtat

SEQ ID NO: 1649 - DNA, 140 bp, Artificial Sequence
  Synthetic
atacgccatgctgggtctcctctctggtggaggaagatggtccacccatgagagagatcatacttaaggtggtcttgatggccatctgtggcatgaacccaatagccataccttttgctgcgtacttgggagtcggccat

SEQ ID NO: 1650 - DNA, 140 bp, Artificial Sequence
  Synthetic
atggccgactcccaagtacgcagcaaaaggtatggctattgggttcatgccacagatggccatcaagaccaccttaagtatgatctctctcatgggtggaccatcttcctccaccagagaggagacccagcatggcgtat

SEQ ID NO: 1651 - DNA, 140 bp, Artificial Sequence
  Synthetic
atacgccatgctgggtctcccaggagcgtggtatgtgtatgtgaagactgggaaaaggagtggtgccctctgggacgtgcctgctccgaaagaagtgaaaaaaggagagaccacagatggcgtacttgggagtcggccat

SEQ ID NO: 1652 - DNA, 140 bp, Artificial Sequence
  Synthetic
atggccgactcccaagtacgccatctgtggtctctccttttttcacttctttcggagcaggcacgtcccagagggcaccactccttttcccagtcttcacatacacataccacgctcctgggagacccagcatggcgtat

SEQ ID NO: 1653 - DNA, 140 bp, Artificial Sequence
  Synthetic
atacgccatgctgggtctccagtgtacagagtgatgactcgcagactgctgggttcaacacaagttggagtgggagtcatgcaggagggagtcttccacaccatgtggcacgtcacaaaacgtacttgggagtcggccat

SEQ ID NO: 1654 - DNA, 140 bp, Artificial Sequence
  Synthetic
atggccgactcccaagtacgttttgtgacgtgccacatggtgtggaagactccctcctgcatgactcccactccaacttgtgttgaacccagcagtctgcgagtcatcactctgtacactggagacccagcatggcgtat

SEQ ID NO: 1655 - DNA, 140 bp, Artificial Sequence
  Synthetic
atacgccatgctgggtctccggggccgcattgaggagcggtgaagggagacttgatccatactggggggatgtcaagcaggacttggtgtcatattgtgggccttggaagctggacgcagcgtacttgggagtcggccat

SEQ ID NO: 1656 - DNA, 140 bp, Artificial Sequence
  Synthetic
atggccgactcccaagtacgctgcgtccagcttccaaggcccacaatatgacaccaagtcctgcttgacatccccccagtatggatcaagtctcccttcaccgctcctcaatgcggccccggagacccagcatggcgtat

SEQ ID NO: 1657 - DNA, 140 bp, Artificial Sequence
  Synthetic
atacgccatgctgggtctcccttgggacggagttagtgaggtgcagcttctggccgtaccccctggagagagagccagaaacattcagactctgcctggaatatttaagacaaaggatggcgtacttgggagtcggccat

SEQ ID NO: 1658 - DNA, 140 bp, Artificial Sequence
  Synthetic
atggccgactcccaagtacgccatcctttgtcttaaatattccaggcagagtctgaatgtttctggctctctctccagggggtacggccagaagctgcacctcactaactccgtcccaagggagacccagcatggcgtat

SEQ ID NO: 1659 - DNA, 140 bp, Artificial Sequence
  Synthetic
atacgccatgctgggtctccggacatcggagcagttgctttggactatcctgcaggaacctcaggatctccgatcctagacaaatgcgggagagtgataggactctatggcaatggggttcgtacttgggagtcggccat

SEQ ID NO: 1660 - DNA, 140 bp, Artificial Sequence
  Synthetic
atggccgactcccaagtacgaaccccattgccatagagtcctatcactctcccgcatttgtctaggatcggagatcctgaggttcctgcaggatagtccaaagcaactgctccgatgtccggagacccagcatggcgtat

SEQ ID NO: 1661 - DNA, 140 bp, Artificial Sequence
  Synthetic
atacgccatgctgggtctccgtgatcaagaacggaagctatgttagtgctataacccagggaaagagggaggaggagactccggttgagtgttttgaaccctcgatgctgaagaagaagccgtacttgggagtcggccat

SEQ ID NO: 1662 - DNA, 140 bp, Artificial Sequence
  Synthetic
atggccgactcccaagtacggcttcttcttcagcatcgagggttcaaaacactcaaccggagtctcctcctccctctttccctgggttatagcactaacatagcttccgttcttgatcacggagacccagcatggcgtat

SEQ ID NO: 1663 - DNA, 140 bp, Artificial Sequence
  Synthetic
atacgccatgctgggtctccagctaactgtcctggacctgcatccaggggctgggaaaaccaggagagttcttcctgaaatagtccgtgaagctataaagaagagactccgcacggtgatcgtacttgggagtcggccat

SEQ ID NO: 1664 - DNA, 140 bp, Artificial Sequence
  Synthetic
atggccgactcccaagtacgatcaccgtgcggagtctcttctttatagcttcacggactatttcaggaagaactctcctggttttcccagcccctggatgcaggtccaggacagttagctggagacccagcatggcgtat

SEQ ID NO: 1665 - DNA, 140 bp, Artificial Sequence
  Synthetic
atacgccatgctgggtctcccttggcaccaaccagggtcgtcgctgctgagatggaggaagccctgagaggacttccggtgcgttacatgacaacagcagtcaaggtcacccattctgggcgtacttgggagtcggccat

SEQ ID NO: 1666 - DNA, 140 bp, Artificial Sequence
  Synthetic
atggccgactcccaagtacgcccagaatgggtgaccttgactgctgttgtcatgtaacgcaccggaagtcctctcagggcttcctccatctcagcagcgacgaccctggttggtgccaagggagacccagcatggcgtat

SEQ ID NO: 1667 - DNA, 140 bp, Artificial Sequence
  Synthetic
atacgccatgctgggtctccacagaaatcgttgatttgatgtgccatgccaccttcacttcacgcctactacaacccattagagtccctaattacaacctctacatcatggatgaagccccgtacttgggagtcggccat

SEQ ID NO: 1668 - DNA, 140 bp, Artificial Sequence
  Synthetic
atggccgactcccaagtacggggcttcatccatgatgtagaggttgtaattagggactctaatgggttgtagtaggcgtgaagtgaaggtggcatggcacatcaaatcaacgatttctgtggagacccagcatggcgtat

SEQ ID NO: 1669 - DNA, 140 bp, Artificial Sequence
  Synthetic
atacgccatgctgggtctccatttcacagacccctcaagcatagctgcaagaggatatatatcaacaagggttgagatgggcgaggcagcagccatctttatgactgccacaccaccaggcgtacttgggagtcggccat

SEQ ID NO: 1670 - DNA, 140 bp, Artificial Sequence
  Synthetic
atggccgactcccaagtacgcctggtggtgtggcagtcataaagatggctgctgcctcgcccatctcaacccttgttgatatatatcctcttgcagctatgcttgaggggtctgtgaaatggagacccagcatggcgtat

SEQ ID NO: 1671 - DNA, 140 bp, Artificial Sequence
  Synthetic
atacgccatgctgggtctccaacccgcgatgcgtttccagattccaactcaccaatcatggacacagaagtggaagtcccagagagagcctggagctcaggctttgattgggtgacggaccgtacttgggagtcggccat

SEQ ID NO: 1672 - DNA, 140 bp, Artificial Sequence
  Synthetic
atggccgactcccaagtacggtccgtcacccaatcaaagcctgagctccaggctctctctgggacttccacttctgtgtccatgattggtgagttggaatctggaaacgcatcgcgggttggagacccagcatggcgtat

SEQ ID NO: 1673 - DNA, 140 bp, Artificial Sequence
  Synthetic
atacgccatgctgggtctcccattctgggaaaacagtttggttcgttccaagcgtgaggaatggaaatgaaatcgcagcctgtctgacaaaggctggaaagcgggttatacagcttagtacgtacttgggagtcggccat

SEQ ID NO: 1674 - DNA, 140 bp, Artificial Sequence
  Synthetic
atggccgactcccaagtacgtactaagctgtataacccgctttccagcctttgtcagacaggctgcgatttcatttccattcctcacgcttggaacgaaccaaactgttttcccagaatgggagacccagcatggcgtat

SEQ ID NO: 1675 - DNA, 140 bp, Artificial Sequence
  Synthetic
atacgccatgctgggtctccggaaaacttttgagacagagtttcagaaaacaaaaaatcaagagtgggactttgtcataacaactgacatctcagagatgggtgccaacttcaaggctgacgtacttgggagtcggccat

SEQ ID NO: 1676 - DNA, 140 bp, Artificial Sequence
  Synthetic
atggccgactcccaagtacgtcagccttgaagttggcacccatctctgagatgtcagttgttatgacaaagtcccactcttgattttttgttttctgaaactctgtctcaaaagttttccggagacccagcatggcgtat

SEQ ID NO: 1677 - DNA, 140 bp, Artificial Sequence
  Synthetic
atacgccatgctgggtctccccgggttatagattccaggagatgcctaaagccagttatacttgatggtgagagagtcatcttggctgggcccatgcctgtcacgcatgctagcgctgctcgtacttgggagtcggccat

SEQ ID NO: 1678 - DNA, 140 bp, Artificial Sequence
  Synthetic
atggccgactcccaagtacgagcagcgctagcatgcgtgacaggcatgggcccagccaagatgactctctcaccatcaagtataactggctttaggcatctcctggaatctataacccggggagacccagcatggcgtat

SEQ ID NO: 1679 - DNA, 140 bp, Artificial Sequence
  Synthetic
atacgccatgctgggtctcccagaggagaggacgtataggcaggaaccccaacaagcctggagatgagtacatgtatggaggtgggtgtgcggagactgatgaagaccatgcacattggccgtacttgggagtcggccat

SEQ ID NO: 1680 - DNA, 140 bp, Artificial Sequence
  Synthetic
atggccgactcccaagtacggccaatgtgcatggtcttcatcagtctccgcacacccacctccatacatgtactcatctccaggcttgttggggttcctgcctatacgtcctctcctctgggagacccagcatggcgtat

SEQ ID NO: 1681 - DNA, 140 bp, Artificial Sequence
  Synthetic
atacgccatgctgggtctccttgaagcaagaatgcttcttgacaacatttacctccaggatggcctcatagcctcgctctatcgacctgaggccgacaaggtagccgccattgagggagacgtacttgggagtcggccat

SEQ ID NO: 1682 - DNA, 140 bp, Artificial Sequence
  Synthetic
atggccgactcccaagtacgtctccctcaatggcggctaccttgtcggcctcaggtcgatagagcgaggctatgaggccatcctggaggtaaatgttgtcaagaagcattcttgcttcaaggagacccagcatggcgtat

SEQ ID NO: 1683 - DNA, 140 bp, Artificial Sequence
  Synthetic
atacgccatgctgggtctccgtttaagctgaggacagagcaaaggaagacctttgtggaactcatgaagagaggagatcttcccgtttggttggcctaccaggttgcatctgccggaatacgtacttgggagtcggccat

SEQ ID NO: 1684 - DNA, 140 bp, Artificial Sequence
  Synthetic
atggccgactcccaagtacgtattccggcagatgcaacctggtaggccaaccaaacgggaagatctcctctcttcatgagttccacaaaggtcttcctttgctctgtcctcagcttaaacggagacccagcatggcgtat

SEQ ID NO: 1685 - DNA, 140 bp, Artificial Sequence
  Synthetic
atacgccatgctgggtctccacttatacagacagaagatggtgttttgatggcacaaccaacaacaccataatggaagacagtgtaccagcagaggtgtggaccaagtatggagagaagacgtacttgggagtcggccat

SEQ ID NO: 1686 - DNA, 140 bp, Artificial Sequence
  Synthetic
atggccgactcccaagtacgtcttctctccatacttggtccacacctctgctggtacactgtcttccattatggtgttgttggttgtgccatcaaaacaccatcttctgtctgtataagtggagacccagcatggcgtat

SEQ ID NO: 1687 - DNA, 140 bp, Artificial Sequence
  Synthetic
atacgccatgctgggtctccgagtgctcaaaccaagatggatggacgccagggtctgctcagatcatgcggccctgaagtcgttcaaagaattcgccgctgggaaaagaggagcggctttcgtacttgggagtcggccat

SEQ ID NO: 1688 - DNA, 140 bp, Artificial Sequence
  Synthetic
atggccgactcccaagtacgaaagccgctcctcttttcccagcggcgaattctttgaacgacttcagggccgcatgatctgagcagaccctggcgtccatccatcttggtttgagcactcggagacccagcatggcgtat

SEQ ID NO: 1689 - DNA, 140 bp, Artificial Sequence
  Synthetic
atacgccatgctgggtctccgggagtaatggaggccctgggaacattaccaggacacatgacagagaggtttcaggaagccattgataacctcgctgtgctcatgcgagcagagactggacgtacttgggagtcggccat

SEQ ID NO: 1690 - DNA, 140 bp, Artificial Sequence
  Synthetic
atggccgactcccaagtacgtccagtctctgctcgcatgagcacagcgaggttatcaatggcttcctgaaacctctctgtcatgtgtcctggtaatgttcccagggcctccattactcccggagacccagcatggcgtat

SEQ ID NO: 1691 - DNA, 140 bp, Artificial Sequence
  Synthetic
atacgccatgctgggtctccagcaggccctacaaggcagcggcagcccaattgccggagaccctagagaccatcatgcttttaggcctgctgggaacagtatcgctggggatcttttttgcgtacttgggagtcggccat

SEQ ID NO: 1692 - DNA, 140 bp, Artificial Sequence
  Synthetic
atggccgactcccaagtacgcaaaaaagatccccagcgatactgttcccagcaggcctaaaagcatgatggtctctagggtctccggcaattgggctgccgctgccttgtagggcctgctggagacccagcatggcgtat

SEQ ID NO: 1693 - DNA, 140 bp, Artificial Sequence
  Synthetic
atacgccatgctgggtctcctcttgatgaggaacaagggcatcgggaagatgggctttgaaatggtaacccttggggccagcgcatggctcatgtggctctcagaaatcgaaccagccagcgtacttgggagtcggccat

SEQ ID NO: 1694 - DNA, 140 bp, Artificial Sequence
  Synthetic
atggccgactcccaagtacgctggctggttcgatttctgagagccacatgagccatgcgctggccccaagggttaccatttcaaagcccatcttcccgatgcccttgttcctcatcaagaggagacccagcatggcgtat

SEQ ID NO: 1695 - DNA, 140 bp, Artificial Sequence
  Synthetic
atacgccatgctgggtctccaattgcatgtgtccttattgttgtgtttttattactggtggtgctaataccagagccagagaagcaaagatccccccaggacaatcagatggcaatcattcgtacttgggagtcggccat

SEQ ID NO: 1696 - DNA, 140 bp, Artificial Sequence
  Synthetic
atggccgactcccaagtacgaatgattgccatctgattgtcctggggggatctttgcttctctggctctggtattagcaccaccagtaataaaaacacaacaataaggacacatgcaattggagacccagcatggcgtat

SEQ ID NO: 1697 - DNA, 140 bp, Artificial Sequence
  Synthetic
atacgccatgctgggtctccattatggtggcagtgggccttttggggttgataactgcaaatgaacttggatggctggagagaacaaaaaatgacatagctcatctgatgggaaagagagcgtacttgggagtcggccat

SEQ ID NO: 1698 - DNA, 140 bp, Artificial Sequence
  Synthetic
atggccgactcccaagtacgctctctttcccatcagatgagctatgtcattttttgttctctccagccatccaagttcatttgcagttatcaaccccaaaaggcccactgccaccataatggagacccagcatggcgtat

SEQ ID NO: 1699 - DNA, 140 bp, Artificial Sequence
  Synthetic
atacgccatgctgggtctccaagagggaacaaccgtgggattctcaatggacatcgatctgcgaccagcctccgcatgggctatttatgccgcattgacaaccctcatcaccccagccgtcgtacttgggagtcggccat

SEQ ID NO: 1700 - DNA, 140 bp, Artificial Sequence
  Synthetic
atggccgactcccaagtacgacggctggggtgatgagggttgtcaatgcggcataaatagcccatgcggaggctggtcgcagatcgatgtccattgagaatcccacggttgttccctcttggagacccagcatggcgtat

SEQ ID NO: 1701 - DNA, 140 bp, Artificial Sequence
  Synthetic
atacgccatgctgggtctccccagcacgcggtaactacctcgtacaacaactactccttaatggcgatggccacacaagctggagtgctgtttggcatgggcaaagggatgccattttatcgtacttgggagtcggccat

SEQ ID NO: 1702 - DNA, 140 bp, Artificial Sequence
  Synthetic
atggccgactcccaagtacgataaaatggcatccctttgcccatgccaaacagcactccagcttgtgtggccatcgccattaaggagtagttgttgtacgaggtagttaccgcgtgctggggagacccagcatggcgtat

SEQ ID NO: 1703 - DNA, 140 bp, Artificial Sequence
  Synthetic
atacgccatgctgggtctccgcatgggacttaggagtcccgttgctaatgatgggctgctactcacaactaacacccctgaccctgatagtagccatcattttgcttgtggcacattacacgtacttgggagtcggccat

SEQ ID NO: 1704 - DNA, 140 bp, Artificial Sequence
  Synthetic
atggccgactcccaagtacgtgtaatgtgccacaagcaaaatgatggctactatcagggtcaggggtgttagttgtgagtagcagcccatcattagcaacgggactcctaagtcccatgcggagacccagcatggcgtat

SEQ ID NO: 1705 - DNA, 140 bp, Artificial Sequence
  Synthetic
atacgccatgctgggtctcctgtacttgatcccaggcctacaggcagcagcagcacgcgctgcccagaagagaacagcagccggcatcatgaagaatcccgttgtggatggaatagtggtcgtacttgggagtcggccat

SEQ ID NO: 1706 - DNA, 140 bp, Artificial Sequence
  Synthetic
atggccgactcccaagtacgaccactattccatccacaacgggattcttcatgatgccggctgctgttctcttctgggcagcgcgtgctgctgctgcctgtaggcctgggatcaagtacaggagacccagcatggcgtat

SEQ ID NO: 1707 - DNA, 140 bp, Artificial Sequence
  Synthetic
atacgccatgctgggtctccaactgacattgacacaatgacaattgacccccaagtggagaagaagatgggacaagtgctacttatagcagtggctgtctccagtgctgtgttgctgcggcgtacttgggagtcggccat

SEQ ID NO: 1708 - DNA, 140 bp, Artificial Sequence
  Synthetic
atggccgactcccaagtacgccgcagcaacacagcactggagacagccactgctataagtagcacttgtcccatcttcttctccacttgggggtcaattgtcattgtgtcaatgtcagttggagacccagcatggcgtat

SEQ ID NO: 1709 - DNA, 140 bp, Artificial Sequence
  Synthetic
atacgccatgctgggtctccaccgcttggggatggggggaggctggagctttgatcacagcagcaacttccaccctgtgggaaggctccccaaacaaatactggaactcctccacagccacgtacttgggagtcggccat

SEQ ID NO: 1710 - DNA, 140 bp, Artificial Sequence
  Synthetic
atggccgactcccaagtacgtggctgtggaggagttccagtatttgtttggggagccttcccacagggtggaagttgctgctgtgatcaaagctccagcctccccccatccccaagcggtggagacccagcatggcgtat

SEQ ID NO: 1711 - DNA, 140 bp, Artificial Sequence
  Synthetic
atacgccatgctgggtctcccctcactgtgcaacatcttcagaggaagttacttggcaggagcttcccttatttacacagtgacaagaaatgccggcctggttaagagacgtggaggtggcgtacttgggagtcggccat

SEQ ID NO: 1712 - DNA, 140 bp, Artificial Sequence
  Synthetic
atggccgactcccaagtacgccacctccacgtctcttaaccaggccggcatttcttgtcactgtgtaaataagggaagctcctgccaagtaacttcctctgaagatgttgcacagtgaggggagacccagcatggcgtat

SEQ ID NO: 1713 - DNA, 140 bp, Artificial Sequence
  Synthetic
atacgccatgctgggtctccaacgggagaaactctgggagagaagtggaaagcccgcctgaatcagatgtcggccttggagttctactcttacaaaaagtcaggcatcactgaagtatgtcgtacttgggagtcggccat

SEQ ID NO: 1714 - DNA, 140 bp, Artificial Sequence
  Synthetic
atggccgactcccaagtacgacatacttcagtgatgcctgactttttgtaagagtagaactccaaggccgacatctgattcaggcgggctttccacttctctcccagagtttctcccgttggagacccagcatggcgtat

SEQ ID NO: 1715 - DNA, 140 bp, Artificial Sequence
  Synthetic
atacgccatgctgggtctccagagaggaggctcgccgcgccctcaaggatggagtggccacaggaggacatgctgtatcccgaggaagcgcaaaactcagatggttggtggagagaggatcgtacttgggagtcggccat

SEQ ID NO: 1716 - DNA, 140 bp, Artificial Sequence
  Synthetic
atggccgactcccaagtacgatcctctctccaccaaccatctgagttttgcgcttcctcgggatacagcatgtcctcctgtggccactccatccttgagggcgcggcgagcctcctctctggagacccagcatggcgtat

SEQ ID NO: 1717 - DNA, 140 bp, Artificial Sequence
  Synthetic
atacgccatgctgggtctccatctgcagccctatggaaaggttgttgatctcggatgcggcagagggggctggagttattatgccgccaccatccgcaaagtgcaggaggtgagaggatacgtacttgggagtcggccat

SEQ ID NO: 1718 - DNA, 140 bp, Artificial Sequence
  Synthetic
atggccgactcccaagtacgtatcctctcacctcctgcactttgcggatggtggcggcataataactccagccccctctgccgcatccgagatcaacaacctttccatagggctgcagatggagacccagcatggcgtat

SEQ ID NO: 1719 - DNA, 140 bp, Artificial Sequence
  Synthetic
atacgccatgctgggtctcccacaaagggaggtcccggtcatgaagagcccatgctggtgcaaagctatgggtggaacataattcgtctcaagagtggagtggacgtcttccacatggcgcgtacttgggagtcggccat

SEQ ID NO: 1720 - DNA, 140 bp, Artificial Sequence
  Synthetic
atggccgactcccaagtacgcgccatgtggaagacgtccactccactcttgagacgaattatgttccacccatagctttgcaccagcatgggctcttcatgaccgggacctccctttgtgggagacccagcatggcgtat

SEQ ID NO: 1721 - DNA, 140 bp, Artificial Sequence
  Synthetic
atacgccatgctgggtctccgctgagtcgtgtgacactttgctgtgtgacataggtgagtcatcatccagtcctgaagtggaggagacgcgaacactcagagtgctctccatggtgggggcgtacttgggagtcggccat

SEQ ID NO: 1722 - DNA, 140 bp, Artificial Sequence
  Synthetic
atggccgactcccaagtacgcccccaccatggagagcactctgagtgttcgcgtctcctccacttcaggactggatgatgactcacctatgtcacacagcaaagtgtcacacgactcagcggagacccagcatggcgtat

SEQ ID NO: 1723 - DNA, 140 bp, Artificial Sequence
  Synthetic
atacgccatgctgggtctccactggcttgagaagagaccaggggccttctgcataaaggtgttatgcccatacaccagcaccatgatggagaccatggagcgactgcaacgtaggtatggcgtacttgggagtcggccat

SEQ ID NO: 1724 - DNA, 140 bp, Artificial Sequence
  Synthetic
atggccgactcccaagtacgccatacctacgttgcagtcgctccatggtctccatcatggtgctggtgtatgggcataacacctttatgcagaaggcccctggtctcttctcaagccagtggagacccagcatggcgtat

SEQ ID NO: 1725 - DNA, 140 bp, Artificial Sequence
  Synthetic
atacgccatgctgggtctccgggaggactagtcagagtgccactgtcccgcaattctacacatgagatgtattgggtctctggagcaaaaagtaacatcataaaaagtgtgtccaccacacgtacttgggagtcggccat

SEQ ID NO: 1726 - DNA, 140 bp, Artificial Sequence
  Synthetic
atggccgactcccaagtacgtgtggtggacacactttttatgatgttactttttgctccagagacccaatacatctcatgtgtagaattgcgggacagtggcactctgactagtcctcccggagacccagcatggcgtat

SEQ ID NO: 1727 - DNA, 140 bp, Artificial Sequence
  Synthetic
aggccctggctgctgatatgagtcagctcctcctgggacgcatggatgggcccaggaggccagtgaagtatgaggaggatgtgaacctcggctcaggcacacgagctgtggcaagctgtggaccttttgggacagcggtg

SEQ ID NO: 1728 - DNA, 140 bp, Artificial Sequence
  Synthetic
caccgctgtcccaaaaggtccacagcttgccacagctcgtgtgcctgagccgaggttcacatcctcctcatacttcactggcctcctgggcccatccatgcgtcccaggaggagctgactcatatcagcagccagggcct

SEQ ID NO: 1729 - DNA, 140 bp, Artificial Sequence
  Synthetic
atacgccatgctgggtctccctgaggctcccaacatgaaggtcattggtaggcgcattgagagaatccgtagtgaacatgcagaaacatggttctttgatgaaaaccatccatacaggaccgtacttgggagtcggccat

SEQ ID NO: 1730 - DNA, 140 bp, Artificial Sequence
  Synthetic
atggccgactcccaagtacggtcctgtatggatggttttcatcaaagaaccatgtttctgcatgttcactacggattctctcaatgcgcctaccaatgaccttcatgttgggagcctcagggagacccagcatggcgtat

SEQ ID NO: 1731 - DNA, 140 bp, Artificial Sequence
  Synthetic
atacgccatgctgggtctccatgggcctaccacgggagctacgaagcccccacgcaagggtcagcatcttccctcgtgaatggggttgttagactcctgtcaaagccctgggatgtggtgcgtacttgggagtcggccat

SEQ ID NO: 1732 - DNA, 140 bp, Artificial Sequence
  Synthetic
atggccgactcccaagtacgcaccacatcccagggctttgacaggagtctaacaaccccattcacgagggaagatgctgacccttgcgtgggggcttcgtagctcccgtggtaggcccatggagacccagcatggcgtat

SEQ ID NO: 1733 - DNA, 140 bp, Artificial Sequence
  Synthetic
atacgccatgctgggtctccactggagttacaggaatagctatgactgacaccacaccgtacggccaacaaagagtcttcaaagaaaaagtggacaccagggtgccagaccctcaagaagcgtacttgggagtcggccat

SEQ ID NO: 1734 - DNA, 140 bp, Artificial Sequence
  Synthetic
atggccgactcccaagtacgcttcttgagggtctggcaccctggtgtccactttttctttgaagactctttgttggccgtacggtgtggtgtcagtcatagctattcctgtaactccagtggagacccagcatggcgtat

SEQ ID NO: 1735 - DNA, 140 bp, Artificial Sequence
  Synthetic
atacgccatgctgggtctccgtactcgccaggtaatgaacatggtcgcttcctggctgtggaaggagctgggaaaacgtaagcggccacgtgtctgcaccaaagaagagttcatcaacaacgtacttgggagtcggccat

SEQ ID NO: 1736 - DNA, 140 bp, Artificial Sequence
  Synthetic
atggccgactcccaagtacgttgttgatgaactcttctttggtgcagacacgtggccgcttacgttttcccagctccttccacagccaggaagcgaccatgttcattacctggcgagtacggagacccagcatggcgtat

SEQ ID NO: 1737 - DNA, 140 bp, Artificial Sequence
  Synthetic
atacgccatgctgggtctccggtgcgcagcaatgcagcactgggagcaatatttgaagaggaaaaagaatggaagacggctgtggaagctgtgaatgatccaaggttttgggccctagtgcgtacttgggagtcggccat

SEQ ID NO: 1738 - DNA, 140 bp, Artificial Sequence
  Synthetic
atggccgactcccaagtacgcactagggcccaaaaccttggatcattcacagcttccacagccgtcttccattctttttcctcttcaaatattgctcccagtgctgcattgctgcgcaccggagacccagcatggcgtat

SEQ ID NO: 1739 - DNA, 140 bp, Artificial Sequence
  Synthetic
atacgccatgctgggtctccgataaggaaagagaacaccacctgagaggagagtgccatagttgtgtgtacaacatgatgggaaaaagagaaaagaagcaaggggaattcgggaaagcaacgtacttgggagtcggccat

SEQ ID NO: 1740 - DNA, 140 bp, Artificial Sequence
  Synthetic
atggccgactcccaagtacgttgctttcccgaattccccttgcttcttttctctttttcccatcatgttgtacacacaactatggcactctcctctcaggtggtgttctctttccttatcggagacccagcatggcgtat

SEQ ID NO: 1741 - DNA, 140 bp, Artificial Sequence
  Synthetic
aggccctggctgctgatatgctcaggaggtggtgtcgaagggttgggactgcaaagacttggatacgttctagaagaaatgagccgggcaccaggaggaaagatgtatgcagatgacaccgaccttttgggacagcggtg

SEQ ID NO: 1742 - DNA, 140 bp, Artificial Sequence
  Synthetic
caccgctgtcccaaaaggtcggtgtcatctgcatacatctttcctcctggtgcccggctcatttcttctagaacgtatccaagtctttgcagtcccaacccttcgacaccacctcctgagcatatcagcagccagggcct

SEQ ID NO: 1743 - DNA, 140 bp, Artificial Sequence
  Synthetic
atacgccatgctgggtctccgctggctgggacacccgcattagcaagtttgatttggagaatgaagccttgattactaaccaaatggatgaagggcacagaactctggcgttggccgtgacgtacttgggagtcggccat

SEQ ID NO: 1744 - DNA, 140 bp, Artificial Sequence
  Synthetic
atggccgactcccaagtacgtcacggccaacgccagagttctgtgcccttcatccatttggttagtaatcaaggcttcattctccaaatcaaacttgctaatgcgggtgtcccagccagcggagacccagcatggcgtat

SEQ ID NO: 1745 - DNA, 140 bp, Artificial Sequence
  Synthetic
atacgccatgctgggtctccttaagtacacataccaaaacaaagtggtgaaggtcctcagaccagctgaaggaggaaaaacagtcatggacatcatttcaagacaagaccagagggggagcgtacttgggagtcggccat

SEQ ID NO: 1746 - DNA, 140 bp, Artificial Sequence
  Synthetic
atggccgactcccaagtacgctccccctctggtcttgtcttgaaatgatgtccatgactgtttttcctccttcagctggtctgaggaccttcaccactttgttttggtatgtgtacttaaggagacccagcatggcgtat

SEQ ID NO: 1747 - DNA, 140 bp, Artificial Sequence
  Synthetic
atacgccatgctgggtctcccggacaagttgtcacttatgctctcaacacatttaccaacttggtggtgcagctcatccggaacatggaggctgaggaagtgttagagatgcaagacttacgtacttgggagtcggccat

SEQ ID NO: 1748 - DNA, 140 bp, Artificial Sequence
  Synthetic
atggccgactcccaagtacgtaagtcttgcatctctaacacttcctcagcctccatgttccggatgagctgcaccaccaagttggtaaatgtgttgagagcataagtgacaacttgtccgggagacccagcatggcgtat

SEQ ID NO: 1749 - DNA, 140 bp, Artificial Sequence
  Synthetic
atacgccatgctgggtctcctggctgttgaggaagccagagaaagtaaccagatggctgcagagtagcggatgggacagactcaaacgaatggcagtcagtggtgatgactgtgttgtaacgtacttgggagtcggccat

SEQ ID NO: 1750 - DNA, 140 bp, Artificial Sequence
  Synthetic
atggccgactcccaagtacgttacaacacagtcatcaccactgactgccattcgtttgagtctgtcccatccgctactctgcagccatctggttactttctctggcttcctcaacagccaggagacccagcatggcgtat

SEQ ID NO: 1751 - DNA, 140 bp, Artificial Sequence
  Synthetic
atacgccatgctgggtctccagccaattgatgacaggtttgcacacgccctcaggttcttgaatgatatggggaaagttaggaaagacacacaggaatggaaaccctcaactggatggagcgtacttgggagtcggccat

SEQ ID NO: 1752 - DNA, 140 bp, Artificial Sequence
  Synthetic
atggccgactcccaagtacgctccatccagttgagggtttccattcctgtgtgtctttcctaactttccccatatcattcaagaacctgagggcgtgtgcaaacctgtcatcaattggctggagacccagcatggcgtat

SEQ ID NO: 1753 - DNA, 140 bp, Artificial Sequence
  Synthetic
atacgccatgctgggtctcccaactgggaagaagtcccgttctgctcccaccactttaacaagctgcacctcaaagacgggagatccattgtggtcccttgccgccaccaagatgaactgcgtacttgggagtcggccat

SEQ ID NO: 1754 - DNA, 140 bp, Artificial Sequence
  Synthetic
atggccgactcccaagtacgcagttcatcttggtggcggcaagggaccacaatggatctcccgtctttgaggtgcagcttgttaaagtggtgggagcagaacgggacttcttcccagttgggagacccagcatggcgtat

SEQ ID NO: 1755 - DNA, 140 bp, Artificial Sequence
  Synthetic
atacgccatgctgggtctccattggccgggctcgcgtttcgccgggggcaggatggagcatccgggagactgcctgtcttgcaaaatcatatgcacagatgtggcagcttctttatttcccgtacttgggagtcggccat

SEQ ID NO: 1756 - DNA, 140 bp, Artificial Sequence
  Synthetic
atggccgactcccaagtacgggaaataaagaagctgccacatctgtgcatatgattttgcaagacaggcagtctcccggatgctccatcctgcccccggcgaaacgcgagcccggccaatggagacccagcatggcgtat

SEQ ID NO: 1757 - DNA, 140 bp, Artificial Sequence
  Synthetic
atacgccatgctgggtctccacagaagagacctccgactgatggccaatgccatttgctcggccgtgccagttgactgggtcccaactgggagaactacctggtcaatccatggaaagggcgtacttgggagtcggccat

SEQ ID NO: 1758 - DNA, 140 bp, Artificial Sequence
  Synthetic
atggccgactcccaagtacgccctttccatggattgaccaggtagttctcccagttgggacccagtcaactggcacggccgagcaaatggcattggccatcagtcggaggtctcttctgtggagacccagcatggcgtat

SEQ ID NO: 1759 - DNA, 140 bp, Artificial Sequence
  Synthetic
atacgccatgctgggtctccagaatggatgactactgaggacatgctcatggtgtggaatagagtgtggattgaggagaatgatcacatggaggacaagacccctgtaacaaaatggacacgtacttgggagtcggccat

SEQ ID NO: 1760 - DNA, 140 bp, Artificial Sequence
  Synthetic
atggccgactcccaagtacgtgtccattttgttacaggggtcttgtcctccatgtgatcattctcctcaatccacactctattccacaccatgagcatgtcctcagtagtcatccattctggagacccagcatggcgtat

SEQ ID NO: 1761 - DNA, 140 bp, Artificial Sequence
  Synthetic
atacgccatgctgggtctccgacattccctatttgggaaaaagggaggacttatggtgtggatcccttataggacacagacctcgcaccacttgggctgagaacatcaaagacacagtcacgtacttgggagtcggccat

SEQ ID NO: 1762 - DNA, 140 bp, Artificial Sequence
  Synthetic
atggccgactcccaagtacgtgactgtgtctttgatgttctcagcccaagtggtgcgaggtctgtgtcctataagggatccacaccataagtcctccctttttcccaaatagggaatgtcggagacccagcatggcgtat

SEQ ID NO: 1763 - DNA, 140 bp, Artificial Sequence
  Synthetic
atacgccatgctgggtctccgcatggtgcgcagaatcataggtgatgaagaaaagtacatggactacctatccactcaagttcgctacttgggtgaggaagggtctacacctggagtgctcgtacttgggagtcggccat

SEQ ID NO: 1764 - DNA, 140 bp, Artificial Sequence
  Synthetic
atggccgactcccaagtacgagcactccaggtgtagacccttcctcacccaagtagcgaacttgagtggataggtagtccatgtacttttcttcatcacctatgattctgcgcaccatgcggagacccagcatggcgtat

SEQ ID NO: 1765 - DNA, 140 bp, Artificial Sequence
  Synthetic
aggccctggctgctgatatgggtgcgcagaatcataggtgatgaagaaaagtacatggactacctatccactcaagttcgctacttgggtgaggaagggtctacacctggagtgctgtaagaccttttgggacagcggtg

SEQ ID NO: 1766 - DNA, 140 bp, Artificial Sequence
  Synthetic
caccgctgtcccaaaaggtcttacagcactccaggtgtagacccttcctcacccaagtagcgaacttgagtggataggtagtccatgtacttttcttcatcacctatgattctgcgcacccatatcagcagccagggcct

SEQ ID NO: 1767 - DNA, 140 bp, Artificial Sequence
  Synthetic
aggccctggctgctgatatgagtatcaacaggttttattttggatttggaaacgagagtttctggtcatgaaaaacccaaaaaagaaatccggaggattccggattgtcaatatgctaaagaccttttgggacagcggtg

SEQ ID NO: 1768 - DNA, 140 bp, Artificial Sequence
  Synthetic
caccgctgtcccaaaaggtctttagcatattgacaatccggaatcctccggatttcttttttgggtttttcatgaccagaaactctcgtttccaaatccaaaataaaacctgttgatactcatatcagcagccagggcct

SEQ ID NO: 1769 - DNA, 140 bp, Artificial Sequence
  Synthetic
atacgccatgctgggtctcccacagctatggcagcggaggtcactagacgtgggagtgcatactatatgtacttggacagaaacgacgctggggaggccatatcttttccaaccacattgcgtacttgggagtcggccat

SEQ ID NO: 1770 - DNA, 140 bp, Artificial Sequence
  Synthetic
atggccgactcccaagtacgcaatgtggttggaaaagatatggcctccccagcgtcgtttctgtccaagtacatatagtatgcactcccacgtctagtgacctccgctgccatagctgtgggagacccagcatggcgtat

SEQ ID NO: 1771 - DNA, 140 bp, Artificial Sequence
  Synthetic
atacgccatgctgggtctccgctcccctcccattccactaggaagctgcaaacgcggtcgcaaacctggttggaatcaagagaatacacaaagcacttgattagagtcgaaaattggatacgtacttgggagtcggccat

SEQ ID NO: 1772 - DNA, 140 bp, Artificial Sequence
  Synthetic
atggccgactcccaagtacgtatccaattttcgactctaatcaagtgctttgtgtattctcttgattccaaccaggtttgcgaccgcgtttgcagcttcctagtggaatgggaggggagcggagacccagcatggcgtat

SEQ ID NO: 1773 - DNA, 140 bp, Artificial Sequence
  Synthetic
aggccctggctgctgatatggctcccagcacagtgggatgatcgttaatgacacaggacatgaaactgatgagaatagagcgaaggttgagataacgcccaattcaccaagagccgaagcgaccttttgggacagcggtg

SEQ ID NO: 1774 - DNA, 140 bp, Artificial Sequence
  Synthetic
caccgctgtcccaaaaggtcgcttcggctcttggtgaattgggcgttatctcaaccttcgctctattctcatcagtttcatgtcctgtgtcattaacgatcatcccactgtgctgggagccatatcagcagccagggcct

SEQ ID NO: 1775 - DNA, 140 bp, Artificial Sequence
  Synthetic
aggccctggctgctgatatgcaccctggggggttttggaagcctaggacttgattgtgaaccgaggacaggccttgacttttcagatttgtattacttgactatgaataacaagcactgggaccttttgggacagcggtg

SEQ ID NO: 1776 - DNA, 140 bp, Artificial Sequence
  Synthetic
caccgctgtcccaaaaggtcccagtgcttgttattcatagtcaagtaatacaaatctgaaaagtcaaggcctgtcctcggttcacaatcaagtcctaggcttccaaaaccccccagggtgcatatcagcagccagggcct

SEQ ID NO: 1777 - DNA, 140 bp, Artificial Sequence
  Synthetic
aggccctggctgctgatatgtggtgcaaagggaaggctgtcctctggccacttgaaatgtcgcctgaaaatggataaacttagattgaagggcgtgtcatactccttgtgtaccgcagcggaccttttgggacagcggtg

SEQ ID NO: 1778 - DNA, 140 bp, Artificial Sequence
  Synthetic
caccgctgtcccaaaaggtccgctgcggtacacaaggagtatgacacgcccttcaatctaagtttatccattttcaggcgacatttcaagtggccagaggacagccttccctttgcaccacatatcagcagccagggcct

SEQ ID NO: 1779 - DNA, 140 bp, Artificial Sequence
  Synthetic
aggccctggctgctgatatgtccatcaaatttttggagcagctttcaaatcattgtttggaggaatgtcctggttctcacaaattctcattggaacgttgctgatgtggttgggtctgaagaccttttgggacagcggtg

SEQ ID NO: 1780 - DNA, 140 bp, Artificial Sequence
  Synthetic
caccgctgtcccaaaaggtcttcagacccaaccacatcagcaacgttccaatgagaatttgtgagaaccaggacattcctccaaacaatgatttgaaagctgctccaaaaatttgatggacatatcagcagccagggcct

SEQ ID NO: 1781 - DNA, 140 bp, Artificial Sequence
  Synthetic
atacgccatgctgggtctcccacaaagaatggatctatttcccttatgtgcttggccttagggggagtgttgatcttcttatccacagctgtctctgctgatgtggggtgctcggtggaccgtacttgggagtcggccat

SEQ ID NO: 1782 - DNA, 140 bp, Artificial Sequence
  Synthetic
atggccgactcccaagtacggtccaccgagcaccccacatcagcagagacagctgtggataagaagatcaacactccccctaaggccaagcacataagggaaatagatccattctttgtgggagacccagcatggcgtat

SEQ ID NO: 1783 - DNA, 140 bp, Artificial Sequence
  Synthetic
aggccctggctgctgatatgcgttgaagcctggagggacaggtacaagtaccatcctgactccccccgtagattggcagcagcagtcaagcaagcctgggaagatggtatctgtgggatcgaccttttgggacagcggtg

SEQ ID NO: 1784 - DNA, 140 bp, Artificial Sequence
  Synthetic
caccgctgtcccaaaaggtcgatcccacagataccatcttcccaggcttgcttgactgctgctgccaatctacggggggagtcaggatggtacttgtacctgtccctccaggcttcaacgcatatcagcagccagggcct

SEQ ID NO: 1785 - DNA, 140 bp, Artificial Sequence
  Synthetic
aggccctggctgctgatatgggctaaagatggctgttggtatggaatggagataaggcccaggaaagaaccagaaagtaacttagtaaggtcaatggtgactgcaggatcaactgatcacgaccttttgggacagcggtg

SEQ ID NO: 1786 - DNA, 140 bp, Artificial Sequence
  Synthetic
caccgctgtcccaaaaggtcgtgatcagttgatcctgcagtcaccattgaccttactaagttactttctggttctttcctgggccttatctccattccataccaacagccatctttagcccatatcagcagccagggcct

SEQ ID NO: 1787 - DNA, 140 bp, Artificial Sequence
  Synthetic
aggccctggctgctgatatgagggctgaagaagagaatgaccacaaagatcatcataagcacatcgatggcagtgctggtagctatgatcctgggaggattttcaatgagtgacctggctgaccttttgggacagcggtg

SEQ ID NO: 1788 - DNA, 140 bp, Artificial Sequence
  Synthetic
caccgctgtcccaaaaggtcagccaggtcactcattgaaaatcctcccaggatcatagctaccagcactgccatcgatgtgcttatgatgatctttgtggtcattctcttcttcagccctcatatcagcagccagggcct

SEQ ID NO: 1789 - DNA, 140 bp, Artificial Sequence
  Synthetic
atacgccatgctgggtctcctatggcaatggggtcgtgatcaaaaatgggagttatgttagtgccatcacccaagggaggagggaggaagagactcctgttgagtgcttcgagccttcgacgtacttgggagtcggccat

SEQ ID NO: 1790 - DNA, 140 bp, Artificial Sequence
  Synthetic
atggccgactcccaagtacgtcgaaggctcgaagcactcaacaggagtctcttcctccctcctcccttgggtgatggcactaacataactcccatttttgatcacgaccccattgccataggagacccagcatggcgtat

SEQ ID NO: 1791 - DNA, 140 bp, Artificial Sequence
  Synthetic
aggccctggctgctgatatgttatggatgaggcccacttcacagatccctcaagtatagcagcaagaggatacatttcaacaagggttgagatgggcgaggcggctgccatcttcatgacgaccttttgggacagcggtg

SEQ ID NO: 1792 - DNA, 140 bp, Artificial Sequence
  Synthetic
caccgctgtcccaaaaggtcgtcatgaagatggcagccgcctcgcccatctcaacccttgttgaaatgtatcctcttgctgctatacttgagggatctgtgaagtgggcctcatccataacatatcagcagccagggcct

SEQ ID NO: 1793 - DNA, 140 bp, Artificial Sequence
  Synthetic
aggccctggctgctgatatgacctggagatgagtatctgtatggaggtgggtgcgcagagactgacgaagaccatgcacactggcttgaagcaagaatgctccttgacaatatttacctcgaccttttgggacagcggtg

SEQ ID NO: 1794 - DNA, 140 bp, Artificial Sequence
  Synthetic
caccgctgtcccaaaaggtcgaggtaaatattgtcaaggagcattcttgcttcaagccagtgtgcatggtcttcgtcagtctctgcgcacccacctccatacagatactcatctccaggtcatatcagcagccagggcct

SEQ ID NO: 1795 - DNA, 140 bp, Artificial Sequence
  Synthetic
aggccctggctgctgatatggcatctgccggaataacctacacagatagaagatggtgctttgatggcacgaccaacaacaccataatggaagacagtgtgccggcagaggtgtggaccagaccttttgggacagcggtg

SEQ ID NO: 1796 - DNA, 140 bp, Artificial Sequence
  Synthetic
caccgctgtcccaaaaggtctggtccacacctctgccggcacactgtcttccattatggtgttgttggtcgtgccatcaaagcaccatcttctatctgtgtaggttattccggcagatgccatatcagcagccagggcct

SEQ ID NO: 1797 - DNA, 140 bp, Artificial Sequence
  Synthetic
atacgccatgctgggtctccggagaccctagagaccattatgcttttggggttgctgggaacagtctcgctgggaatctttttcgtcttgatgaggaacaagggcatagggaagatgggccgtacttgggagtcggccat

SEQ ID NO: 1798 - DNA, 140 bp, Artificial Sequence
  Synthetic
atggccgactcccaagtacggcccatcttccctatgcccttgttcctcatcaagacgaaaaagattcccagcgagactgttcccagcaaccccaaaagcataatggtctctagggtctccggagacccagcatggcgtat

SEQ ID NO: 1799 - DNA, 140 bp, Artificial Sequence
  Synthetic
aggccctggctgctgatatggccatactgtcgcggaccgcctgggggtggggggaggctggggccctgatcacagcggcaacttccactttgtgggaaggctctccgaacaagtactggagaccttttgggacagcggtg

SEQ ID NO: 1800 - DNA, 140 bp, Artificial Sequence
  Synthetic
caccgctgtcccaaaaggtctccagtacttgttcggagagccttcccacaaagtggaagttgccgctgtgatcagggccccagcctccccccacccccaggcggtccgcgacagtatggccatatcagcagccagggcct

SEQ ID NO: 1801 - DNA, 140 bp, Artificial Sequence
  Synthetic
atacgccatgctgggtctccaaagtgttgtgcccatacaccagcactatgatggaaaccctggagcgactgcagcgtaggtatgggggaggactggtcagagtgccactctcccgcaactcgtacttgggagtcggccat

SEQ ID NO: 1802 - DNA, 140 bp, Artificial Sequence
  Synthetic
atggccgactcccaagtacgagttgcgggagagtggcactctgaccagtcctcccccatacctacgctgcagtcgctccagggtttccatcatagtgctggtgtatgggcacaacactttggagacccagcatggcgtat

SEQ ID NO: 1803 - DNA, 140 bp, Artificial Sequence
  Synthetic
atacgccatgctgggtctccagtgtgtccaccacgagccagctcctcttggggcgcatggacgggcccaggaggccagtgaaatatgaggaggatgtgaatctcggctctggcacgcgggcgtacttgggagtcggccat

SEQ ID NO: 1804 - DNA, 140 bp, Artificial Sequence
  Synthetic
atggccgactcccaagtacgcccgcgtgccagagccgagattcacatcctcctcatatttcactggcctcctgggcccgtccatgcgccccaagaggagctggctcgtggtggacacactggagacccagcatggcgtat

SEQ ID NO: 1805 - DNA, 140 bp, Artificial Sequence
  Synthetic
aggccctggctgctgatatgaccgtatggtcagcaaagagttttcaaggaaaaagtggacactagggtgccagacccccaagaaggcactcgtcaggttatgagcatggtctcttcctgggaccttttgggacagcggtg

SEQ ID NO: 1806 - DNA, 140 bp, Artificial Sequence
  Synthetic
caccgctgtcccaaaaggtcccaggaagagaccatgctcataacctgacgagtgccttcttgggggtctggcaccctagtgtccactttttccttgaaaactctttgctgaccatacggtcatatcagcagccagggcct

SEQ ID NO: 1807 - DNA, 140 bp, Artificial Sequence
  Synthetic
aggccctggctgctgatatgaagaggaaaaagagtggaagactgcagtggaagctgtgaacgatccaaggttctgggctctagtggacaaggaaagagagcaccacctgagaggagagtggaccttttgggacagcggtg

SEQ ID NO: 1808 - DNA, 140 bp, Artificial Sequence
  Synthetic
caccgctgtcccaaaaggtccactctcctctcaggtggtgctctctttccttgtccactagagcccagaaccttggatcgttcacagcttccactgcagtcttccactctttttcctcttcatatcagcagccagggcct

SEQ ID NO: 1809 - DNA, 140 bp, Artificial Sequence
  Synthetic
aggccctggctgctgatatgggagaatgaagctctaatcaccaaccaaatggagaaagggcacagggccttggcattggccataatcaagtacacataccaaaacaaagtggtaaaggtcgaccttttgggacagcggtg

SEQ ID NO: 1810 - DNA, 140 bp, Artificial Sequence
  Synthetic
caccgctgtcccaaaaggtcgacctttaccactttgttttggtatgtgtacttgattatggccaatgccaaggccctgtgccctttctccatttggttggtgattagagcttcattctcccatatcagcagccagggcct

SEQ ID NO: 1811 - DNA, 140 bp, Artificial Sequence
  Synthetic
aggccctggctgctgatatgctcaactggatgggacaactgggaagaagttccgttttgctcccaccacttcaacaagctccatctcaaggacgggaggtccattgtggttccctgccgcgaccttttgggacagcggtg

SEQ ID NO: 1812 - DNA, 140 bp, Artificial Sequence
  Synthetic
caccgctgtcccaaaaggtcgcggcagggaaccacaatggacctcccgtccttgagatggagcttgttgaagtggtgggagcaaaacggaacttcttcccagttgtcccatccagttgagcatatcagcagccagggcct

SEQ ID NO: 1813 - DNA, 140 bp, Artificial Sequence
  Synthetic
aggccctggctgctgatatgtacatggactacctatccacccaagttcgctacttgggtgaagaagggtctacacctggagtgctgtaagcaccaatcttagtgttgtcaggcctgctaggaccttttgggacagcggtg

SEQ ID NO: 1814 - DNA, 140 bp, Artificial Sequence
  Synthetic
caccgctgtcccaaaaggtcctagcaggcctgacaacactaagattggtgcttacagcactccaggtgtagacccttcttcacccaagtagcgaacttgggtggataggtagtccatgtacatatcagcagccagggcct

SEQ ID NO: 1815 - DNA, 140 bp, Artificial Sequence
  Synthetic
atacgccatgctgggtctccccaggagagttcttcctgaaatagtccgtgaagccataaaaacaagactccgtactgtgatcttagctccaaccagggttgtcgctgctgaaatggaggacgtacttgggagtcggccat

SEQ ID NO: 1816 - DNA, 140 bp, Artificial Sequence
  Synthetic
atggccgactcccaagtacgtcctccatttcagcagcgacaaccctggttggagctaagatcacagtacggagtcttgtttttatggcttcacggactatttcaggaagaactctcctggggagacccagcatggcgtat

SEQ ID NO: 1817 - DNA, 140 bp, Artificial Sequence
  Synthetic
atacgccatgctgggtctccgttgttgatctgtgtgaatcagactgcgacagttcgagtttgaagcgagagctaacaacagtatcaacaggtttaatttggatttggaaacgagagtttccgtacttgggagtcggccat

SEQ ID NO: 1818 - DNA, 140 bp, Artificial Sequence
  Synthetic
atggccgactcccaagtacggaaactctcgtttccaaatccaaattaaacctgttgatactgttgttagctctcgcttcaaactcgaactgtcgcagtctgattcacacagatcaacaacggagacccagcatggcgtat

SEQ ID NO: 1819 - DNA, 140 bp, Artificial Sequence
  Synthetic
aggccctggctgctgatatgatgctaaaacgcggagtagcccgtgtaaaccccttgggaggtttgaagaggctgccagccggactcctgctgggtcatggacccatcagaatggttttgggaccttttgggacagcggtg

SEQ ID NO: 1820 - DNA, 140 bp, Artificial Sequence
  Synthetic
caccgctgtcccaaaaggtcccaaaaccattctgatgggtccatgacccagcaggagtccggctggcagcctcttcaaacctcccaaggggtttacacgggctactccgcgttttagcatcatatcagcagccagggcct

SEQ ID NO: 1821 - DNA, 140 bp, Artificial Sequence
  Synthetic
atacgccatgctgggtctcccaatactagcctttttgagatttacagcaatcaagccatcactgggcctcatcaacagatggggttcagtggggaaaaaagaggctatggaaataataaacgtacttgggagtcggccat

SEQ ID NO: 1822 - DNA, 140 bp, Artificial Sequence
  Synthetic
atggccgactcccaagtacgtttattatttccatagcctcttttttccccactgaaccccatctgttgatgaggcccagtgatggcttgattgctgtaaatctcaaaaaggctagtattgggagacccagcatggcgtat

SEQ ID NO: 1823 - DNA, 140 bp, Artificial Sequence
  Synthetic
aggccctggctgctgatatggaagtttaagaaagatcttgctgccatgttgagaataatcaatgctaggaaggagaggaagagacgtggtgcagacaccagcatcggaatcattggtctcgaccttttgggacagcggtg

SEQ ID NO: 1824 - DNA, 140 bp, Artificial Sequence
  Synthetic
caccgctgtcccaaaaggtcgagaccaatgattccgatgctggtgtctgcaccacgtctcttcctctccttcctagcattgattattctcaacatggcagcaagatctttcttaaacttccatatcagcagccagggcct

SEQ ID NO: 1825 - DNA, 140 bp, Artificial Sequence
  Synthetic
atacgccatgctgggtctccctgctgactacagccatggcagcagagattaccagacgtggaagtgcatactacatgtacttggacaggagcgatgctgggaaggccatctcctttgctacgtacttgggagtcggccat

SEQ ID NO: 1826 - DNA, 140 bp, Artificial Sequence
  Synthetic
atggccgactcccaagtacgtagcaaaggagatggccttcccagcatcgctcctgtccaagtacatgtagtatgcacttccacgtctggtaatctctgctgccatggctgtagtcagcagggagacccagcatggcgtat

SEQ ID NO: 1827 - DNA, 140 bp, Artificial Sequence
  Synthetic
atacgccatgctgggtctccccaatttgggagttaacaaatgccatgtacagatcatggatctcgggcacatgtgtgacgccaccatgagttatgagtgtcctatgttggacgagggagtcgtacttgggagtcggccat

SEQ ID NO: 1828 - DNA, 140 bp, Artificial Sequence
  Synthetic
atggccgactcccaagtacgactccctcgtccaacataggacactcataactcatggtggcgtcacacatgtgcccgagatccatgatctgtacatggcatttgttaactcccaaattggggagacccagcatggcgtat

SEQ ID NO: 1829 - DNA, 140 bp, Artificial Sequence
  Synthetic
aggccctggctgctgatatgtgtacggaacctgtcatcacaaaaaaggtgaagcacggcgatctagaagagctgtgacgctcccttctcactctacaaggaagctgcaaacgcggtcgcagaccttttgggacagcggtg

SEQ ID NO: 1830 - DNA, 140 bp, Artificial Sequence
  Synthetic
caccgctgtcccaaaaggtctgcgaccgcgtttgcagcttccttgtagagtgagaagggagcgtcacagctcttctagatcgccgtgcttcaccttttttgtgatgacaggttccgtacacatatcagcagccagggcct

SEQ ID NO: 1831 - DNA, 140 bp, Artificial Sequence
  Synthetic
atacgccatgctgggtctccgacttggttagaatcaagagaatacacgaagcacttgatcaaggttgaaaactggatattcaggaaccccgggtttgcgctcgcagctgttgccattgcccgtacttgggagtcggccat

SEQ ID NO: 1832 - DNA, 140 bp, Artificial Sequence
  Synthetic
atggccgactcccaagtacgggcaatggcaacagctgcgagcgcaaacccggggttcctgaatatccagttttcaaccttgatcaagtgcttcgtgtattctcttgattctaaccaagtcggagacccagcatggcgtat

SEQ ID NO: 1833 - DNA, 140 bp, Artificial Sequence
  Synthetic
aggccctggctgctgatatgactggatattcaggaaccccgggtttgcgctcgcagctgttgccattgcctggcttttgggaagctcgacgagccaaaaagtcatatacttggtcatgatgaccttttgggacagcggtg

SEQ ID NO: 1834 - DNA, 140 bp, Artificial Sequence
  Synthetic
caccgctgtcccaaaaggtcatcatgaccaagtatatgactttttggctcgtcgagcttcccaaaagccaggcaatggcaacagctgcgagcgcaaacccggggttcctgaatatccagtcatatcagcagccagggcct

SEQ ID NO: 1835 - DNA, 140 bp, Artificial Sequence
  Synthetic
atacgccatgctgggtctccgaacatggaggttgcgtcaccgtaatggcacaggacaagccaacagttgacatagagttggtcacgacaacggtcagtaacatggccgaggtaagatcctcgtacttgggagtcggccat

SEQ ID NO: 1836 - DNA, 140 bp, Artificial Sequence
  Synthetic
atggccgactcccaagtacgaggatcttacctcggccatgttactgaccgttgtcgtgaccaactctatgtcaactgttggcttgtcctgtgccattacggtgacgcaacctccatgttcggagacccagcatggcgtat

SEQ ID NO: 1837 - DNA, 140 bp, Artificial Sequence
  Synthetic
atacgccatgctgggtctccactgttatgaggcatcaatatcggacatggcttcggacagtcgctgcccaacacaaggtgaagcctaccttgacaagcaatcagacactcaatatgtatgcgtacttgggagtcggccat

SEQ ID NO: 1838 - DNA, 140 bp, Artificial Sequence
  Synthetic
atggccgactcccaagtacgcatacatattgagtgtctgattgcttgtcaaggtaggcttcaccttgtgttgggcagcgactgtccgaagccatgtccgatattgatgcctcataacagtggagacccagcatggcgtat

SEQ ID NO: 1839 - DNA, 140 bp, Artificial Sequence
  Synthetic
aggccctggctgctgatatgaccgggaagagcattcagccggagaatctggagtatcgaataatgctatcagtgcatggctcccagcacagcgggatgattgttaatgacgaaaataggggaccttttgggacagcggtg

SEQ ID NO: 1840 - DNA, 140 bp, Artificial Sequence
  Synthetic
caccgctgtcccaaaaggtcccctattttcgtcattaacaatcatcccgctgtgctgggagccatgcactgatagcattattcgatactccagattctccggctgaatgctcttcccggtcatatcagcagccagggcct

SEQ ID NO: 1841 - DNA, 140 bp, Artificial Sequence
  Synthetic
atacgccatgctgggtctcccgaaagtcgaggtcacgcccaattcaccaagagcagaagcaaccttgggaggctttggaagcttaggacttgattgtgaaccaaggacaggcctggacttcgtacttgggagtcggccat

SEQ ID NO: 1842 - DNA, 140 bp, Artificial Sequence
  Synthetic
atggccgactcccaagtacgaagtccaggcctgtccttggttcacaatcaagtcctaagcttccaaagcctcccaaggttgcttctgctcttggtgaattgggcgtgacctcgactttcgggagacccagcatggcgtat

SEQ ID NO: 1843 - DNA, 140 bp, Artificial Sequence
  Synthetic
atacgccatgctgggtctccttcagatttgtactacttgaccatgaacaataagcactggttagtgcacaaagagtggtttcatgacatcccattgccctggcatgctggggcagacacccgtacttgggagtcggccat

SEQ ID NO: 1844 - DNA, 140 bp, Artificial Sequence
  Synthetic
atggccgactcccaagtacgggtgtctgccccagcatgccagggcaatgggatgtcatgaaaccactctttgtgcactaaccagtgcttattgttcatggtcaagtagtacaaatctgaaggagacccagcatggcgtat

SEQ ID NO: 1845 - DNA, 140 bp, Artificial Sequence
  Synthetic
atacgccatgctgggtctccggaactccacattggaacaacaaggaggcattggtagagttcaaagatgcccacgctaagaggcaaaccgtcgttgttctagggagccaggaaggagccgcgtacttgggagtcggccat

SEQ ID NO: 1846 - DNA, 140 bp, Artificial Sequence
  Synthetic
atggccgactcccaagtacgcggctccttcctggctccctagaacaacgacggtttgcctcttagcgtgggcatctttgaactctaccaatgcctccttgttgttccaatgtggagttccggagacccagcatggcgtat

SEQ ID NO: 1847 - DNA, 140 bp, Artificial Sequence
  Synthetic
atacgccatgctgggtctccttcacacggctcttgctggagctctggaggctgagatggatggtgcaaaaggaaggttgttctccggccatttgaaatgccgcttaaaaatggacaagctcgtacttgggagtcggccat

SEQ ID NO: 1848 - DNA, 140 bp, Artificial Sequence
  Synthetic
atggccgactcccaagtacgagcttgtccatttttaagcggcatttcaaatggccggagaacaaccttccttttgcaccatccatctcagcctccagagctccagcaagagccgtgtgaaggagacccagcatggcgtat

SEQ ID NO: 1849 - DNA, 140 bp, Artificial Sequence
  Synthetic
atacgccatgctgggtctcctagattgaagggcgtgtcatattccttgtgcaccgcagcgttcacattcaccaaggtcccagctgaaacattgcatggaacagttacagtggaggtgcagcgtacttgggagtcggccat

SEQ ID NO: 1850 - DNA, 140 bp, Artificial Sequence
  Synthetic
atggccgactcccaagtacgctgcacctccactgtaactgttccatgcaatgtttcagctgggaccttggtgaatgtgaacgctgcggtgcacaaggaatatgacacgcccttcaatctaggagacccagcatggcgtat

SEQ ID NO: 1851 - DNA, 140 bp, Artificial Sequence
  Synthetic
atacgccatgctgggtctcctatgcagggacagatggaccctgcaaggtcccagctcagatggcggtggacatgcagaccctgaccccagtcggaaggctgataaccgccaaccccgtgacgtacttgggagtcggccat

SEQ ID NO: 1852 - DNA, 140 bp, Artificial Sequence
  Synthetic
atggccgactcccaagtacgtcacggggttggcggttatcagccttccgactggggtcagggtctgcatgtccaccgccatctgagctgggaccttgcagggtccatctgtccctgcataggagacccagcatggcgtat

SEQ ID NO: 1853 - DNA, 140 bp, Artificial Sequence
  Synthetic
atacgccatgctgggtctccttactgaaagcactgagaattcaaagatgatgttggagctcgacccaccatttggggattcttacattgtcataggagttggggacaagaaaattacccacgtacttgggagtcggccat

SEQ ID NO: 1854 - DNA, 140 bp, Artificial Sequence
  Synthetic
atggccgactcccaagtacgtgggtaattttcttgtccccaactcctatgacaatgtaagaatccccaaatggtgggtcgagctccaacatcatctttgaattctcagtgctttcagtaaggagacccagcatggcgtat

SEQ ID NO: 1855 - DNA, 140 bp, Artificial Sequence
  Synthetic
atacgccatgctgggtctccccactggcataggagtggtagcaccatcggaaaagcatttgaggccactgtgagaggtgccaagagaatggcagttctgggggacacagcctgggactttcgtacttgggagtcggccat

SEQ ID NO: 1856 - DNA, 140 bp, Artificial Sequence
  Synthetic
atggccgactcccaagtacgaaagtcccaggctgtgtcccccagaactgccattctcttggcacctctcacagtggcctcaaatgcttttccgatggtgctaccactcctatgccagtggggagacccagcatggcgtat

SEQ ID NO: 1857 - DNA, 140 bp, Artificial Sequence
  Synthetic
atacgccatgctgggtctccggatcagtcgggggcgtgtttaactcattgggcaagggcatccaccagatttttggagcagccttcaaatcactgtttggaggaatgtcctggttctcaccgtacttgggagtcggccat

SEQ ID NO: 1858 - DNA, 140 bp, Artificial Sequence
  Synthetic
atggccgactcccaagtacggtgagaaccaggacattcctccaaacagtgatttgaaggctgctccaaaaatctggtggatgcccttgcccaatgagttaaacacgcccccgactgatccggagacccagcatggcgtat

SEQ ID NO: 1859 - DNA, 140 bp, Artificial Sequence
  Synthetic
aggccctggctgctgatatggagaaacgagatgtggcacgggggtgttcgtctacaatgatgttgaagcctggagggacaggtacaagtaccatcctgactccccccgcagattggcagcgaccttttgggacagcggtg

SEQ ID NO: 1860 - DNA, 140 bp, Artificial Sequence
  Synthetic
caccgctgtcccaaaaggtcgctgccaatctgcggggggagtcaggatggtacttgtacctgtccctccaggcttcaacatcattgtagacgaacacccccgtgccacatctcgtttctccatatcagcagccagggcct

SEQ ID NO: 1861 - DNA, 140 bp, Artificial Sequence
  Synthetic
atacgccatgctgggtctcctggagggacaggtacaagtaccatcctgactccccccgcagattggcagcagcagtcaagcaggcttgggaagagggaatttgtgggatctcctccgtttcgtacttgggagtcggccat

SEQ ID NO: 1862 - DNA, 140 bp, Artificial Sequence
  Synthetic
atggccgactcccaagtacgaaacggaggagatcccacaaattccctcttcccaagcctgcttgactgctgctgccaatctgcggggggagtcaggatggtacttgtacctgtccctccaggagacccagcatggcgtat

SEQ ID NO: 1863 - DNA, 140 bp, Artificial Sequence
  Synthetic
aggccctggctgctgatatgcaagaatggaaaacatcatgtggaaatcagtggaaggggagctcaatgctatcttagaggagaatggagttcaactgacagttgttgtaggatctgtaaagaccttttgggacagcggtg

SEQ ID NO: 1864 - DNA, 140 bp, Artificial Sequence
  Synthetic
caccgctgtcccaaaaggtctttacagatcctacaacaactgtcagttgaactccattctcctctaagatagcattgagctccccttccactgatttccacatgatgttttccattcttgcatatcagcagccagggcct

SEQ ID NO: 1865 - DNA, 140 bp, Artificial Sequence
  Synthetic
atacgccatgctgggtctccaaaccccatgtggagaggtccacaaagattgccagtgcctgtgaatgagctgccccatggctggaaagcctgggggaaatcatattttgtcagagcggcacgtacttgggagtcggccat

SEQ ID NO: 1866 - DNA, 140 bp, Artificial Sequence
  Synthetic
atggccgactcccaagtacgtgccgctctgacaaaatatgatttcccccaggctttccagccatggggcagctcattcacaggcactggcaatctttgtggacctctccacatggggtttggagacccagcatggcgtat

SEQ ID NO: 1867 - DNA, 140 bp, Artificial Sequence
  Synthetic
atacgccatgctgggtctccaagaccaacaacaggtttgttgtcgatggtgacacactgaaggaatgtccgctcaaacacagagcatggaatagtttccttgtggaggatcatgggtttgcgtacttgggagtcggccat

SEQ ID NO: 1868 - DNA, 140 bp, Artificial Sequence
  Synthetic
atggccgactcccaagtacgcaaacccatgatcctccacaaggaaactattccatgctctgtgtttgagcggacattccttcagtgtgtcaccatcgacaacaaacctgttgttggtcttggagacccagcatggcgtat

SEQ ID NO: 1869 - DNA, 140 bp, Artificial Sequence
  Synthetic
atacgccatgctgggtctccgggtcttccacaccagtgtttggcttaaggttagagaagattactcactagaatgtgacccagccgtcataggaacagctgttaagggaaaggaggccgccgtacttgggagtcggccat

SEQ ID NO: 1870 - DNA, 140 bp, Artificial Sequence
  Synthetic
atggccgactcccaagtacggcggcctcctttcccttaacagctgttcctatgacggctgggtcacattctagtgagtaatcttctctaaccttaagccaaacactggtgtggaagacccggagacccagcatggcgtat

SEQ ID NO: 1871 - DNA, 140 bp, Artificial Sequence
  Synthetic
atacgccatgctgggtctccgcacagtgacctaggctactggattgaaagtgaaaagaatgacacatggaggctgaagagggcccacctgattgagatgaaaacatgtgagtggccaaagcgtacttgggagtcggccat

SEQ ID NO: 1872 - DNA, 140 bp, Artificial Sequence
  Synthetic
atggccgactcccaagtacgctttggccactcacatgttttcatctcaatcaggtgggccctcttcagcctccatgtgtcattcttttcactttcaatccagtagcctaggtcactgtgcggagacccagcatggcgtat

SEQ ID NO: 1873 - DNA, 140 bp, Artificial Sequence
  Synthetic
aggccctggctgctgatatgtaaatctttagctggtccactcagccaccacaacactagagagggttacagaactcaagcaaaagggccatggcatagtgaagagcttgaaatccggtttgaccttttgggacagcggtg

SEQ ID NO: 1874 - DNA, 140 bp, Artificial Sequence
  Synthetic
caccgctgtcccaaaaggtcaaaccggatttcaagctcttcactatgccatggcccttttgcttgagttctgtaaccctctctagtgttgtggtggctgagtggaccagctaaagatttacatatcagcagccagggcct

SEQ ID NO: 1875 - DNA, 140 bp, Artificial Sequence
  Synthetic
aggccctggctgctgatatggaactcaagcaaaagggccatggcatagtgaagagcttgaaatccggtttgaggaatgtccaggcaccaaggttcatgtggaggagacatgcggaactaggaccttttgggacagcggtg

SEQ ID NO: 1876 - DNA, 140 bp, Artificial Sequence
  Synthetic
caccgctgtcccaaaaggtcctagttccgcatgtctcctccacatgaaccttggtgcctggacattcctcaaaccggatttcaagctcttcactatgccatggcccttttgcttgagttccatatcagcagccagggcct

SEQ ID NO: 1877 - DNA, 140 bp, Artificial Sequence
  Synthetic
aggccctggctgctgatatgggtgctgtagagaatgcacaatgcccccactatcgtttcgagcaaaagatggctgctggtatggaatggagataaggcccaggaaagaaccagagagcaagaccttttgggacagcggtg

SEQ ID NO: 1878 - DNA, 140 bp, Artificial Sequence
  Synthetic
caccgctgtcccaaaaggtcttgctctctggttctttcctgggccttatctccattccataccagcagccatcttttgctcgaaacgatagtgggggcattgtgcattctctacagcacccatatcagcagccagggcct

SEQ ID NO: 1879 - DNA, 140 bp, Artificial Sequence
  Synthetic
aggccctggctgctgatatgcttagtgaggtcaatggtgacagcgggatcaaccgatcacatggaccacttctctcttggagtgcttgtgattctactcatggtgcaggaagggttgaaggaccttttgggacagcggtg

SEQ ID NO: 1880 - DNA, 140 bp, Artificial Sequence
  Synthetic
caccgctgtcccaaaaggtccttcaacccttcctgcaccatgagtagaatcacaagcactccaagagagaagtggtccatgtgatcggttgatcccgctgtcaccattgacctcactaagcatatcagcagccagggcct

SEQ ID NO: 1881 - DNA, 140 bp, Artificial Sequence
  Synthetic
atacgccatgctgggtctccaagagaatgaccacgaagatcattatgagcacatcaatggcagtgctggtagccatgatcctgggaggattttcaatgagtgacctggctaagcttgtgacgtacttgggagtcggccat

SEQ ID NO: 1882 - DNA, 140 bp, Artificial Sequence
  Synthetic
atggccgactcccaagtacgtcacaagcttagccaggtcactcattgaaaatcctcccaggatcatggctaccagcactgccattgatgtgctcataatgatcttcgtggtcattctcttggagacccagcatggcgtat

SEQ ID NO: 1883 - DNA, 140 bp, Artificial Sequence
  Synthetic
aggccctggctgctgatatgagccatgatcctgggaggattttcaatgagtgacctggctaagcttgtgatcctgatgggtgccaccttcgcagaaatgaacactggaggagatgtggctgaccttttgggacagcggtg

SEQ ID NO: 1884 - DNA, 140 bp, Artificial Sequence
  Synthetic
caccgctgtcccaaaaggtcagccacatctcctccagtgttcatttctgcgaaggtggcacccatcaggatcacaagcttagccaggtcactcattgaaaatcctcccaggatcatggctcatatcagcagccagggcct

SEQ ID NO: 1885 - DNA, 140 bp, Artificial Sequence
  Synthetic
aggccctggctgctgatatgcacttggcattggttgcggcatttaaagtcagaccagccttgctggtctcctttattttcagagctaattggacacctcgtgagagcatgctgctagcccgaccttttgggacagcggtg

SEQ ID NO: 1886 - DNA, 140 bp, Artificial Sequence
  Synthetic
caccgctgtcccaaaaggtcgggctagcagcatgctctcacgaggtgtccaattagctctgaaaataaaggagaccagcaaggctggtctgactttaaatgccgcaaccaatgccaagtgcatatcagcagccagggcct

SEQ ID NO: 1887 - DNA, 140 bp, Artificial Sequence
  Synthetic
atacgccatgctgggtctcctggcttcgtgtcttttacaaactgcaatctctgctcttgaaggtgacttgatggtcctcgtcaatggatttgctttggcctggttggcaatacgagcaatcgtacttgggagtcggccat

SEQ ID NO: 1888 - DNA, 140 bp, Artificial Sequence
  Synthetic
atggccgactcccaagtacgattgctcgtattgccaaccaggccaaagcaaatccattgacgaggaccatcaagtcaccttcaagagcagagattgcagtttgtaaaagacacgaagccaggagacccagcatggcgtat

SEQ ID NO: 1889 - DNA, 140 bp, Artificial Sequence
  Synthetic
atacgccatgctgggtctccggccgtgccacgcactgacaacattgctctagcagtcctggctgctctgacaccactagcccgaggcacactgctcgtggcatggagagcgggcctcgctcgtacttgggagtcggccat

SEQ ID NO: 1890 - DNA, 140 bp, Artificial Sequence
  Synthetic
atggccgactcccaagtacgagcgaggcccgctctccatgccacgagcagtgtgcctcgggctagtggtgtcagagcagccaggactgctagagcaatgttgtcagtgcgtggcacggccggagacccagcatggcgtat

SEQ ID NO: 1891 - DNA, 140 bp, Artificial Sequence
  Synthetic
atacgccatgctgggtctccacttgtggagggttcatgctcctttccctgaaggggaaaggtagtgtgaagaagaacctgccatttgtcatggccttgggattgaccgctgtgaggatagcgtacttgggagtcggccat

SEQ ID NO: 1892 - DNA, 140 bp, Artificial Sequence
  Synthetic
atggccgactcccaagtacgctatcctcacagcggtcaatcccaaggccatgacaaatggcaggttcttcttcacactacctttccccttcagggaaaggagcatgaaccctccacaagtggagacccagcatggcgtat

SEQ ID NO: 1893 - DNA, 140 bp, Artificial Sequence
  Synthetic
atacgccatgctgggtctcctagaccccattaatgtggtaggactactgttactcacaaggagcgggaagcggagctggccccctagtgaagtgcttacagctgttggcctgatatgtgccgtacttgggagtcggccat

SEQ ID NO: 1894 - DNA, 140 bp, Artificial Sequence
  Synthetic
atggccgactcccaagtacggcacatatcaggccaacagctgtaagcacttcactagggggccagctccgcttcccgctccttgtgagtaacagtagtcctaccacattaatggggtctaggagacccagcatggcgtat

SEQ ID NO: 1895 - DNA, 140 bp, Artificial Sequence
  Synthetic
atacgccatgctgggtctcctgctgcaggagcgtggtatgtgtatgtgaagactgggaaaaggagtggtgccctctgggatgtgcccgctcccaaagaagtgaaaaaaggagagaccacacgtacttgggagtcggccat

SEQ ID NO: 1896 - DNA, 140 bp, Artificial Sequence
  Synthetic
atggccgactcccaagtacgtgtggtctctccttttttcacttctttgggagcgggcacatcccagagggcaccactccttttcccagtcttcacatacacataccacgctcctgcagcaggagacccagcatggcgtat

SEQ ID NO: 1897 - DNA, 140 bp, Artificial Sequence
  Synthetic
atacgccatgctgggtctccgatggagtatacagagtgatgacccgcagactgctgggttcaacacaggttggagttggagtcatgcaagagggagtcttccacaccatgtggcacgtcacgtacttgggagtcggccat

SEQ ID NO: 1898 - DNA, 140 bp, Artificial Sequence
  Synthetic
atggccgactcccaagtacgtgacgtgccacatggtgtggaagactccctcttgcatgactccaactccaacctgtgttgaacccagcagtctgcgggtcatcactctgtatactccatcggagacccagcatggcgtat

SEQ ID NO: 1899 - DNA, 140 bp, Artificial Sequence
  Synthetic
aggccctggctgctgatatgtggagttggagtcatgcaagagggagtcttccacaccatgtggcacgtcacaaaaggagctgcactgaggagcggcgaagggagacttgatccatactgggaccttttgggacagcggtg

SEQ ID NO: 1900 - DNA, 140 bp, Artificial Sequence
  Synthetic
caccgctgtcccaaaaggtcccagtatggatcaagtctcccttcgccgctcctcagtgcagctccttttgtgacgtgccacatggtgtggaagactccctcttgcatgactccaactccacatatcagcagccagggcct

SEQ ID NO: 1901 - DNA, 140 bp, Artificial Sequence
  Synthetic
aggccctggctgctgatatgtgcagcttgggatggacttagtgaggtgcagctcttggcagtaccccccggagagagggccagaaacattcagactctgcctggaatattcaagacaaaggaccttttgggacagcggtg

SEQ ID NO: 1902 - DNA, 140 bp, Artificial Sequence
  Synthetic
caccgctgtcccaaaaggtcctttgtcttgaatattccaggcagagtctgaatgtttctggccctctctccggggggtactgccaagagctgcacctcactaagtccatcccaagctgcacatatcagcagccagggcct

SEQ ID NO: 1903 - DNA, 140 bp, Artificial Sequence
  Synthetic
atacgccatgctgggtctccgagagagggccagaaacattcagactctgcctggaatattcaagacaaaggatggggacatcggagcagttgctctggactaccccgcaggaacttcaggcgtacttgggagtcggccat

SEQ ID NO: 1904 - DNA, 140 bp, Artificial Sequence
  Synthetic
atggccgactcccaagtacgcctgaagttcctgcggggtagtccagagcaactgctccgatgtccccatcctttgtcttgaatattccaggcagagtctgaatgtttctggccctctctcggagacccagcatggcgtat

SEQ ID NO: 1905 - DNA, 140 bp, Artificial Sequence
  Synthetic
atacgccatgctgggtctccctgggacagaaatcgttgatttgatgtgccatgccaccttcacttcacgcttattacaacccatcagagtccctaattacaatctctacatcatggatgacgtacttgggagtcggccat

SEQ ID NO: 1906 - DNA, 140 bp, Artificial Sequence
  Synthetic
atggccgactcccaagtacgtcatccatgatgtagagattgtaattagggactctgatgggttgtaataagcgtgaagtgaaggtggcatggcacatcaaatcaacgatttctgtcccagggagacccagcatggcgtat

SEQ ID NO: 1907 - DNA, 140 bp, Artificial Sequence
  Synthetic
atacgccatgctgggtctccagcccatttcacagacccctcaagtatagctgcaagaggatacatatcaacaagggttgaaatgggcgaggcggctgccatctttatgacagccacgccacgtacttgggagtcggccat

SEQ ID NO: 1908 - DNA, 140 bp, Artificial Sequence
  Synthetic
atggccgactcccaagtacgtggcgtggctgtcataaagatggcagccgcctcgcccatttcaacccttgttgatatgtatcctcttgcagctatacttgaggggtctgtgaaatgggctggagacccagcatggcgtat

SEQ ID NO: 1909 - DNA, 140 bp, Artificial Sequence
  Synthetic
atacgccatgctgggtctccccaggaacccgagatgcatttccagactccaactcaccaatcatggacacagaagtggaagtcccagagagagcctggagctcaggctttgattgggtgacgtacttgggagtcggccat

SEQ ID NO: 1910 - DNA, 140 bp, Artificial Sequence
  Synthetic
atggccgactcccaagtacgtcacccaatcaaagcctgagctccaggctctctctgggacttccacttctgtgtccatgattggtgagttggagtctggaaatgcatctcgggttcctggggagacccagcatggcgtat

SEQ ID NO: 1911 - DNA, 140 bp, Artificial Sequence
  Synthetic
aggccctggctgctgatatgagaagtggaagtcccagagagagcctggagctcaggctttgattgggtgacagaccattctggaaaaacagtttggtttgttccaagtgtgagaaatggagaccttttgggacagcggtg

SEQ ID NO: 1912 - DNA, 140 bp, Artificial Sequence
  Synthetic
caccgctgtcccaaaaggtctccatttctcacacttggaacaaaccaaactgtttttccagaatggtctgtcacccaatcaaagcctgagctccaggctctctctgggacttccacttctcatatcagcagccagggcct

SEQ ID NO: 1913 - DNA, 140 bp, Artificial Sequence
  Synthetic
aggccctggctgctgatatgcagcaggaagacttttgagacagagtttcagaaaacaaaaaatcaagagtgggactttgtcataacaactgacatctcagagatgggtgccaatttcaaggaccttttgggacagcggtg

SEQ ID NO: 1914 - DNA, 140 bp, Artificial Sequence
  Synthetic
caccgctgtcccaaaaggtccttgaaattggcacccatctctgagatgtcagttgttatgacaaagtcccactcttgattttttgttttctgaaactctgtctcaaaagtcttcctgctgcatatcagcagccagggcct

SEQ ID NO: 1915 - DNA, 140 bp, Artificial Sequence
  Synthetic
atacgccatgctgggtctccgctgaccgggtcatagactctaggagatgcctaaagccagttatacttgatggtgagagagtcatcttggctgggcccatgcctgtcacgcatgctagtgcgtacttgggagtcggccat

SEQ ID NO: 1916 - DNA, 140 bp, Artificial Sequence
  Synthetic
atggccgactcccaagtacgcactagcatgcgtgacaggcatgggcccagccaagatgactctctcaccatcaagtataactggctttaggcatctcctagagtctatgacccggtcagcggagacccagcatggcgtat

SEQ ID NO: 1917 - DNA, 140 bp, Artificial Sequence
  Synthetic
aggccctggctgctgatatggagtacatgtatggaggtggatgtgcagagaccgatgaagaccatgcacactggcttgaagcaagaatgcttcttgacaacatctacctccaggatggccgaccttttgggacagcggtg

SEQ ID NO: 1918 - DNA, 140 bp, Artificial Sequence
  Synthetic
caccgctgtcccaaaaggtcggccatcctggaggtagatgttgtcaagaagcattcttgcttcaagccagtgtgcatggtcttcatcggtctctgcacatccacctccatacatgtactccatatcagcagccagggcct

SEQ ID NO: 1919 - DNA, 140 bp, Artificial Sequence
  Synthetic
atacgccatgctgggtctcctcatagcttcgctctaccggcctgaggccgacaaggtagccgccattgagggagagttcaagctgaggacggagcaaaggaaaacctttgtggaacttatcgtacttgggagtcggccat

SEQ ID NO: 1920 - DNA, 140 bp, Artificial Sequence
  Synthetic
atggccgactcccaagtacgataagttccacaaaggttttcctttgctccgtcctcagcttgaactctccctcaatggcggctaccttgtcggcctcaggccggtagagcgaagctatgaggagacccagcatggcgtat

SEQ ID NO: 1921 - DNA, 140 bp, Artificial Sequence
  Synthetic
atacgccatgctgggtctccgaagagaggagaccttcccgtttggctggcctatcaggttgcatctgccggaataacttacacagacagaagatggtgctttgatggcacaaccaacaaccgtacttgggagtcggccat

SEQ ID NO: 1922 - DNA, 140 bp, Artificial Sequence
  Synthetic
atggccgactcccaagtacggttgttggttgtgccatcaaagcaccatcttctgtctgtgtaagttattccggcagatgcaacctgataggccagccaaacgggaaggtctcctctcttcggagacccagcatggcgtat

SEQ ID NO: 1923 - DNA, 140 bp, Artificial Sequence
  Synthetic
atacgccatgctgggtctccaccataatggaagatagtgtaccagcagaggtgtggacaaaatatggagagaagagagtgcttaaaccaagatggatggatgcgagggtctgttctgatccgtacttgggagtcggccat

SEQ ID NO: 1924 - DNA, 140 bp, Artificial Sequence
  Synthetic
atggccgactcccaagtacggatcagaacagaccctcgcatccatccatcttggtttaagcactctcttctctccatattttgtccacacctctgctggtacactatcttccattatggtggagacccagcatggcgtat

SEQ ID NO: 1925 - DNA, 140 bp, Artificial Sequence
  Synthetic
atacgccatgctgggtctccatgctgccctgaagtcgttcaaagaatttgctgccgggaaaagaggagcggctttaggagtaatggaggccctgggaacattaccaggacacatgacagacgtacttgggagtcggccat

SEQ ID NO: 1926 - DNA, 140 bp, Artificial Sequence
  Synthetic
atggccgactcccaagtacgtctgtcatgtgtcctggtaatgttcccagggcctccattactcctaaagccgctcctcttttcccggcagcaaattctttgaacgacttcagggcagcatggagacccagcatggcgtat

SEQ ID NO: 1927 - DNA, 140 bp, Artificial Sequence
  Synthetic
atacgccatgctgggtctccgaggtttcaggaggccattgacaatctcgctgtgcttatgcgagcagagactggaagtaggccttacaaggcagcggcagcccaactgccggagaccctacgtacttgggagtcggccat

SEQ ID NO: 1928 - DNA, 140 bp, Artificial Sequence
  Synthetic
atggccgactcccaagtacgtagggtctccggcagttgggctgccgctgccttgtaaggcctacttccagtctctgctcgcataagcacagcgagattgtcaatggcctcctgaaacctcggagacccagcatggcgtat

SEQ ID NO: 1929 - DNA, 140 bp, Artificial Sequence
  Synthetic
aggccctggctgctgatatgctggaagtaggccttacaaggcagcggcagcccaactgccggagaccctagagaccatcatgctcctaggtttgctgggaacagtttcgttggggatcttgaccttttgggacagcggtg

SEQ ID NO: 1930 - DNA, 140 bp, Artificial Sequence
  Synthetic
caccgctgtcccaaaaggtcaagatccccaacgaaactgttcccagcaaacctaggagcatgatggtctctagggtctccggcagttgggctgccgctgccttgtaaggcctacttccagcatatcagcagccagggcct

SEQ ID NO: 1931 - DNA, 140 bp, Artificial Sequence
  Synthetic
aggccctggctgctgatatgtaactcttggggccagtgcatggctcatgtggctttcggaaattgagccagccagaattgcatgtgtcctcattgttgtgttcttgttactggtggtactgaccttttgggacagcggtg

SEQ ID NO: 1932 - DNA, 140 bp, Artificial Sequence
  Synthetic
caccgctgtcccaaaaggtcagtaccaccagtaacaagaacacaacaatgaggacacatgcaattctggctggctcaatttccgaaagccacatgagccatgcactggccccaagagttacatatcagcagccagggcct

SEQ ID NO: 1933 - DNA, 140 bp, Artificial Sequence
  Synthetic
aggccctggctgctgatatgcttggatggctggaaagaacaaaaaatgacatagctcatctaatgggaaggagagaagaaggagtaactatgggattctcaatggacatcgatttgcggcgaccttttgggacagcggtg

SEQ ID NO: 1934 - DNA, 140 bp, Artificial Sequence
  Synthetic
caccgctgtcccaaaaggtcgccgcaaatcgatgtccattgagaatcccatagttactccttcttctctccttcccattagatgagctatgtcattttttgttctttccagccatccaagcatatcagcagccagggcct

SEQ ID NO: 1935 - DNA, 140 bp, Artificial Sequence
  Synthetic
atacgccatgctgggtctcccagcctccgcctgggctatttatgccgcactgacaactctcatcaccccagctgtccaacacgcggtaaccacttcatacaacaactactccctaatggccgtacttgggagtcggccat

SEQ ID NO: 1936 - DNA, 140 bp, Artificial Sequence
  Synthetic
atggccgactcccaagtacggccattagggagtagttgttgtatgaagtggttaccgcgtgttggacagctggggtgatgagagttgtcagtgcggcataaatagcccaggcggaggctgggagacccagcatggcgtat

SEQ ID NO: 1937 - DNA, 140 bp, Artificial Sequence
  Synthetic
atacgccatgctgggtctccgatggccacacaagctggagtgctatttggcatgggcaaagggatgccattttatgcatgggactttggagtcccgctgctaatggtgggttgctactcacgtacttgggagtcggccat

SEQ ID NO: 1938 - DNA, 140 bp, Artificial Sequence
  Synthetic
atggccgactcccaagtacgtgagtagcaacccaccattagcagcgggactccaaagtcccatgcataaaatggcatccctttgcccatgccaaatagcactccagcttgtgtggccatcggagacccagcatggcgtat

SEQ ID NO: 1939 - DNA, 140 bp, Artificial Sequence
  Synthetic
atacgccatgctgggtctcccaattaacacccctaaccttgatagtggctatcattctgcttgtggcacactacatgtacttgatcccaggcctacaggcagcagcagcgcgtgctgccccgtacttgggagtcggccat

SEQ ID NO: 1940 - DNA, 140 bp, Artificial Sequence
  Synthetic
atggccgactcccaagtacggggcagcacgcgctgctgctgcctgtaggcctgggatcaagtacatgtagtgtgccacaagcagaatgatagccactatcaaggttaggggtgttaattgggagacccagcatggcgtat

SEQ ID NO: 1941 - DNA, 140 bp, Artificial Sequence
  Synthetic
atacgccatgctgggtctccgtggtaactgacattgacacaatgacaattgacccccaagtggagaagaagatgggacaagtgttactcatagcagtagccatctccagtgctgtgctgccgtacttgggagtcggccat

SEQ ID NO: 1942 - DNA, 140 bp, Artificial Sequence
  Synthetic
atggccgactcccaagtacggcagcacagcactggagatggctactgctatgagtaacacttgtcccatcttcttctccacttgggggtcaattgtcattgtgtcaatgtcagttaccacggagacccagcatggcgtat

SEQ ID NO: 1943 - DNA, 140 bp, Artificial Sequence
  Synthetic
atacgccatgctgggtctcctgcgaactgcttggggatggggggaggctggagctctgatcacagcagcaacctccaccttgtgggaaggttctccaaacaaatactggaactcctctaccgtacttgggagtcggccat

SEQ ID NO: 1944 - DNA, 140 bp, Artificial Sequence
  Synthetic
atggccgactcccaagtacggtagaggagttccagtatttgtttggagaaccttcccacaaggtggaggttgctgctgtgatcagagctccagcctccccccatccccaagcagttcgcaggagacccagcatggcgtat

SEQ ID NO: 1945 - DNA, 140 bp, Artificial Sequence
  Synthetic
atacgccatgctgggtctccagccacctcactgtgcaacatctttagaggaagttacctggcaggcgcttctctcatttatacagtgacaagaaatgctggcctagtcaagagacgtggacgtacttgggagtcggccat

SEQ ID NO: 1946 - DNA, 140 bp, Artificial Sequence
  Synthetic
atggccgactcccaagtacgtccacgtctcttgactaggccagcatttcttgtcactgtataaatgagagaagcgcctgccaggtaacttcctctaaagatgttgcacagtgaggtggctggagacccagcatggcgtat

SEQ ID NO: 1947 - DNA, 140 bp, Artificial Sequence
  Synthetic
aggccctggctgctgatatgtgtgtagagaggaggctcgccgcgccctcaagaatggagtggccacaggaggacatgctgtatcccggggaagcgcaaagctcagatggctggtggagaggaccttttgggacagcggtg

SEQ ID NO: 1948 - DNA, 140 bp, Artificial Sequence
  Synthetic
caccgctgtcccaaaaggtcctctccaccagccatctgagctttgcgcttccccgggatacagcatgtcctcctgtggccactccattcttgagggcgcggcgagcctcctctctacacacatatcagcagccagggcct

SEQ ID NO: 1949 - DNA, 140 bp, Artificial Sequence
  Synthetic
atacgccatgctgggtctccaggatacctgcaaccccatggaaaggttgttgacctcggatgtggcagagggggttggagctattatgccgccaccatccggaaagtgcaggaggtgaaacgtacttgggagtcggccat

SEQ ID NO: 1950 - DNA, 140 bp, Artificial Sequence
  Synthetic
atggccgactcccaagtacgtttcacctcctgcactttccggatggtggcggcataatagctccaaccccctctgccacatccgaggtcaacaacctttccatggggttgcaggtatcctggagacccagcatggcgtat

SEQ ID NO: 1951 - DNA, 140 bp, Artificial Sequence
  Synthetic
atacgccatgctgggtctccggatacacaaagggaggtcctggtcatgaagaacccatgctggtgcaaagctatgggtggaacatagttcgtctcaagagtggagtggatgtcttccacacgtacttgggagtcggccat

SEQ ID NO: 1952 - DNA, 140 bp, Artificial Sequence
  Synthetic
atggccgactcccaagtacgtgtggaagacatccactccactcttgagacgaactatgttccacccatagctttgcaccagcatgggttcttcatgaccaggacctccctttgtgtatccggagacccagcatggcgtat

SEQ ID NO: 1953 - DNA, 140 bp, Artificial Sequence
  Synthetic
atacgccatgctgggtctcctggcggccgagccgtgtgacaccttgctgtgcgacataggtgagtcatcatctagtcctgaagtggaagagacgcgaacactcagagtgctctctatggtcgtacttgggagtcggccat

SEQ ID NO: 1954 - DNA, 140 bp, Artificial Sequence
  Synthetic
atggccgactcccaagtacgaccatagagagcactctgagtgttcgcgtctcttccacttcaggactagatgatgactcacctatgtcgcacagcaaggtgtcacacggctcggccgccaggagacccagcatggcgtat

SEQ ID NO: 1955 - DNA, 140 bp, Artificial Sequence
  Synthetic
atacgccatgctgggtctccgggggactggcttgagaaaagaccgggagccttctgcataaaggtgctgtgcccatacaccagcactatgatggagaccatggagcgcctgcaacgtaggcgtacttgggagtcggccat

SEQ ID NO: 1956 - DNA, 140 bp, Artificial Sequence
  Synthetic
atggccgactcccaagtacgcctacgttgcaggcgctccatggtctccatcatagtgctggtgtatgggcacagcacctttatgcagaaggctcccggtcttttctcaagccagtcccccggagacccagcatggcgtat

SEQ ID NO: 1957 - DNA, 140 bp, Artificial Sequence
  Synthetic
atacgccatgctgggtctcctatgggggaggattagtcagagtgccattgtctcgcaactccacacatgaaatgtattgggtctctggagcaaaaagtaacatcataaaaagtgtgtccacgtacttgggagtcggccat

SEQ ID NO: 1958 - DNA, 140 bp, Artificial Sequence
  Synthetic
atggccgactcccaagtacgtggacacactttttatgatgttactttttgctccagagacccaatacatttcatgtgtggagttgcgagacaatggcactctgactaatcctcccccataggagacccagcatggcgtat

SEQ ID NO: 1959 - DNA, 140 bp, Artificial Sequence
  Synthetic
atacgccatgctgggtctccccacaagtcagctcctcctgggacgcatggatggccccaggaggccagtgaaatatgaggaagatgtgaacctcggctcgggcacacgagctgtggcaagcgtacttgggagtcggccat

SEQ ID NO: 1960 - DNA, 140 bp, Artificial Sequence
  Synthetic
atggccgactcccaagtacgcttgccacagctcgtgtgcccgagccgaggttcacatcttcctcatatttcactggcctcctggggccatccatgcgtcccaggaggagctgacttgtggggagacccagcatggcgtat

SEQ ID NO: 1961 - DNA, 140 bp, Artificial Sequence
  Synthetic
atacgccatgctgggtctccctgtgctgaagctcccaacatgaagatcattggcaagcgcattgagagaatccgcagtgaacatgcagaaacatggttctttgatgaaaaccacccataccgtacttgggagtcggccat

SEQ ID NO: 1962 - DNA, 140 bp, Artificial Sequence
  Synthetic
atggccgactcccaagtacggtatgggtggttttcatcaaagaaccatgtttctgcatgttcactgcggattctctcaatgcgcttgccaatgatcttcatgttgggagcttcagcacagggagacccagcatggcgtat

SEQ ID NO: 1963 - DNA, 140 bp, Artificial Sequence
  Synthetic
atacgccatgctgggtctccaggacatgggcctaccatgggagctacgaagcccccacccaaggatcagcgtcttccctcgtgaatggggttgttagactcctgtcaaagccctgggatgcgtacttgggagtcggccat

SEQ ID NO: 1964 - DNA, 140 bp, Artificial Sequence
  Synthetic
atggccgactcccaagtacgcatcccagggctttgacaggagtctaacaaccccattcacgagggaagacgctgatccttgggtgggggcttcgtagctcccatggtaggcccatgtcctggagacccagcatggcgtat

SEQ ID NO: 1965 - DNA, 140 bp, Artificial Sequence
  Synthetic
atacgccatgctgggtctccttgtgactggagttacaggaatagctatgactgacactacaccatacggccaacaaagagtcttcaaagaaaaagtggacaccagggtgccagatcctcacgtacttgggagtcggccat

SEQ ID NO: 1966 - DNA, 140 bp, Artificial Sequence
  Synthetic
atggccgactcccaagtacgtgaggatctggcaccctggtgtccactttttctttgaagactctttgttggccgtatggtgtagtgtcagtcatagctattcctgtaactccagtcacaaggagacccagcatggcgtat

SEQ ID NO: 1967 - DNA, 140 bp, Artificial Sequence
  Synthetic
atacgccatgctgggtctccagaaggcactcgccagacaatgaacatggtttcttcctggctgtggaaggagctggggaaacgcaagcggccacgtgtctgcaccaaagaagagttcatccgtacttgggagtcggccat

SEQ ID NO: 1968 - DNA, 140 bp, Artificial Sequence
  Synthetic
atggccgactcccaagtacggatgaactcttctttggtgcagacacgtggccgcttgcgtttccccagctccttccacagccaggaagaaaccatgttcattgtctggcgagtgccttctggagacccagcatggcgtat

SEQ ID NO: 1969 - DNA, 140 bp, Artificial Sequence
  Synthetic
atacgccatgctgggtctccaacaaggtgcgcagcaatgcagcactgggagcaatatttgaagaggaaaaagaatggaagacggccgtggaagctgtgaatgatccaaggttttgggccccgtacttgggagtcggccat

SEQ ID NO: 1970 - DNA, 140 bp, Artificial Sequence
  Synthetic
atggccgactcccaagtacggggcccaaaaccttggatcattcacagcttccacggccgtcttccattctttttcctcttcaaatattgctcccagtgctgcattgctgcgcaccttgttggagacccagcatggcgtat

SEQ ID NO: 1971 - DNA, 140 bp, Artificial Sequence
  Synthetic
aggccctggctgctgatatgagaatggaagacggccgtggaagctgtgaatgatccaaggttttgggccctagtggacaaggagagagaacatcacctgagaggagagtgccatagctgtgaccttttgggacagcggtg

SEQ ID NO: 1972 - DNA, 140 bp, Artificial Sequence
  Synthetic
caccgctgtcccaaaaggtcacagctatggcactctcctctcaggtgatgttctctctccttgtccactagggcccaaaaccttggatcattcacagcttccacggccgtcttccattctcatatcagcagccagggcct

SEQ ID NO: 1973 - DNA, 140 bp, Artificial Sequence
  Synthetic
atacgccatgctgggtctcctggagtttgaagcccttggattcttgaatgaggaccattggatgggaagagaaaactcaggaggtggtgtcgaagggctaggactgcaaagacttggatacgtacttgggagtcggccat

SEQ ID NO: 1974 - DNA, 140 bp, Artificial Sequence
  Synthetic
atggccgactcccaagtacgtatccaagtctttgcagtcctagcccttcgacaccacctcctgagttttctcttcccatccaatggtcctcattcaagaatccaagggcttcaaactccaggagacccagcatggcgtat

SEQ ID NO: 1975 - DNA, 140 bp, Artificial Sequence
  Synthetic
atacgccatgctgggtctcccattctagaagaaatgaatcgagcaccaggaggaaagatgtatgcagatgacaccgctggctgggatacccgtattagtaagtttgatctggagaatgaacgtacttgggagtcggccat

SEQ ID NO: 1976 - DNA, 140 bp, Artificial Sequence
  Synthetic
atggccgactcccaagtacgttcattctccagatcaaacttactaatacgggtatcccagccagcggtgtcatctgcatacatctttcctcctggtgctcgattcatttcttctagaatgggagacccagcatggcgtat

SEQ ID NO: 1977 - DNA, 140 bp, Artificial Sequence
  Synthetic
atacgccatgctgggtctccgccttaattaccaaccaaatggaggaagggcatagagctctagcattggctgtgattaagtacacataccaaaacaaagtggtgaaggtcctcagaccagcgtacttgggagtcggccat

SEQ ID NO: 1978 - DNA, 140 bp, Artificial Sequence
  Synthetic
atggccgactcccaagtacgctggtctgaggaccttcaccactttgttttggtatgtgtacttaatcacagccaatgctagagctctatgcccttcctccatttggttggtaattaaggcggagacccagcatggcgtat

SEQ ID NO: 1979 - DNA, 140 bp, Artificial Sequence
  Synthetic
atacgccatgctgggtctccctgaaggagggaaaacagttatggacatcatttcaagacaagaccagagagggagtggacaagttgtcacttatgctctcaacacatttaccaacttggtcgtacttgggagtcggccat

SEQ ID NO: 1980 - DNA, 140 bp, Artificial Sequence
  Synthetic
atggccgactcccaagtacgaccaagttggtaaatgtgttgagagcataagtgacaacttgtccactccctctctggtcttgtcttgaaatgatgtccataactgttttccctccttcagggagacccagcatggcgtat

SEQ ID NO: 1981 - DNA, 140 bp, Artificial Sequence
  Synthetic
atacgccatgctgggtctccggtgcagcttatccggaacatggaggctgaggaagtgctagagatgcaagacttatggctgctgaggaagccagagaaagtgaccagatggttgcagtgccgtacttgggagtcggccat

SEQ ID NO: 1982 - DNA, 140 bp, Artificial Sequence
  Synthetic
atggccgactcccaagtacggcactgcaaccatctggtcactttctctggcttcctcagcagccataagtcttgcatctctagcacttcctcagcctccatgttccggataagctgcaccggagacccagcatggcgtat

SEQ ID NO: 1983 - DNA, 140 bp, Artificial Sequence
  Synthetic
atacgccatgctgggtctccaatggatgggacagactcaaacgaatggcagtcagtggagatgactgcgttgtgaagccaattgatgataggtttgcacatgccctcaggttcttgaatgcgtacttgggagtcggccat

SEQ ID NO: 1984 - DNA, 140 bp, Artificial Sequence
  Synthetic
atggccgactcccaagtacgcattcaagaacctgagggcatgtgcaaacctatcatcaattggcttcacaacgcagtcatctccactgactgccattcgtttgagtctgtcccatccattggagacccagcatggcgtat

SEQ ID NO: 1985 - DNA, 140 bp, Artificial Sequence
  Synthetic
aggccctggctgctgatatggcacctcaaggatggtagatccattgtggtcccttgccgccaccaagatgaattgattggccgagcccgtgtatcaccaggggcaggatggagcatccgggaccttttgggacagcggtg

SEQ ID NO: 1986 - DNA, 140 bp, Artificial Sequence
  Synthetic
caccgctgtcccaaaaggtcccggatgctccatcctgcccctggtgatacacgggctcggccaatcaattcatcttggtggcggcaagggaccacaatggatctaccatccttgaggtgccatatcagcagccagggcct

SEQ ID NO: 1987 - DNA, 140 bp, Artificial Sequence
  Synthetic
aggccctggctgctgatatggagactgcctgtctagcaaaatcatatgcacagatgtggcagcttctttacttccacagaagagaccttcgactgatggccaatgctatttgttcggctggaccttttgggacagcggtg

SEQ ID NO: 1988 - DNA, 140 bp, Artificial Sequence
  Synthetic
caccgctgtcccaaaaggtccagccgaacaaatagcattggccatcagtcgaaggtctcttctgtggaagtaaagaagctgccacatctgtgcatatgattttgctagacaggcagtctccatatcagcagccagggcct

SEQ ID NO: 1989 - DNA, 140 bp, Artificial Sequence
  Synthetic
atacgccatgctgggtctcctgccagttgactgggtgccaaccgggagaaccacctggtcaatccacggaaagggagaatggatgactactgaggacatgctcatggtgtggaatagagtcgtacttgggagtcggccat

SEQ ID NO: 1990 - DNA, 140 bp, Artificial Sequence
  Synthetic
atggccgactcccaagtacgactctattccacaccatgagcatgtcctcagtagtcatccattctccctttccgtggattgaccaggtggttctcccggttggcacccagtcaactggcaggagacccagcatggcgtat

SEQ ID NO: 1991 - DNA, 140 bp, Artificial Sequence
  Synthetic
aggccctggctgctgatatgaagggagaatggatgactactgaggacatgctcatggtgtggaatagagtgtggattgaggagaacgaccacatggaggacaagactcctgtgacaaagtgaccttttgggacagcggtg

SEQ ID NO: 1992 - DNA, 140 bp, Artificial Sequence
  Synthetic
caccgctgtcccaaaaggtcactttgtcacaggagtcttgtcctccatgtggtcgttctcctcaatccacactctattccacaccatgagcatgtcctcagtagtcatccattctcccttcatatcagcagccagggcct

SEQ ID NO: 1993 - DNA, 140 bp, Artificial Sequence
  Synthetic
atacgccatgctgggtctccgtgttgtaagcaccaatttcagtgttgtcaggcctgctagtcagccacagtttggggaaagctgtgcagcctgtagcccccccaggagacgctgggaaaccgtacttgggagtcggccat

SEQ ID NO: 1994 - DNA, 140 bp, Artificial Sequence
  Synthetic
atggccgactcccaagtacggtttcccagcgtctcctgggggggctacaggctgcacagctttccccaaactgtggctgactagcaggcctgacaacactgaaattggtgcttacaacacggagacccagcatggcgtat

SEQ ID NO: 1995 - DNA, 140 bp, Artificial Sequence
  Synthetic
aggccctggctgctgatatgcctgtgagcccctcagaggacactgagtcaaaaaaccccacgcgcttggaagcgcaggatgggaaaagaaggtggcgaccttccccaccctttaatctgggaccttttgggacagcggtg

SEQ ID NO: 1996 - DNA, 140 bp, Artificial Sequence
  Synthetic
caccgctgtcccaaaaggtcccagattaaagggtggggaaggtcgccaccttcttttcccatcctgcgcttccaagcgcgtggggttttttgactcagtgtcctctgaggggctcacaggcatatcagcagccagggcct

SEQ ID NO: 1997 - DNA, 140 bp, Artificial Sequence
  Synthetic
aggccctggctgctgatatgacagcatattgacgctgggaaagaccagagactccatgagtttccaccacgctggccgccaggcacagatcgccgaacagcggcggccagtgtggtggaagaccttttgggacagcggtg

SEQ ID NO: 1998 - DNA, 140 bp, Artificial Sequence
  Synthetic
caccgctgtcccaaaaggtcttccaccacactggccgccgctgttcggcgatctgtgcctggcggccagcgtggtggaaactcatggagtctctggtctttcccagcgtcaatatgctgtcatatcagcagccagggcct

SEQ ID NO: 1999 - DNA, 140 bp, Artificial Sequence
  Synthetic
aggccctggctgctgatatgatgaaaaacccaaaaaagaaatccggaggattccggattgtcaatatgctaaaacgcggagtagcccgtgtgagcccctttgggggcttgaagaggctgcgaccttttgggacagcggtg

SEQ ID NO: 2000 - DNA, 140 bp, Artificial Sequence
  Synthetic
caccgctgtcccaaaaggtcgcagcctcttcaagcccccaaaggggctcacacgggctactccgcgttttagcatattgacaatccggaatcctccggatttcttttttgggtttttcatcatatcagcagccagggcct

SEQ ID NO: 2001 - DNA, 140 bp, Artificial Sequence
  Synthetic
atacgccatgctgggtctccctagcctttttgagattcacggcaatcaagccatcactgggtctcatcaatagatggggttcagtggggaaaaaagaggctatggaaataataaagaagtcgtacttgggagtcggccat

SEQ ID NO: 2002 - DNA, 140 bp, Artificial Sequence
  Synthetic
atggccgactcccaagtacgacttctttattatttccatagcctcttttttccccactgaaccccatctattgatgagacccagtgatggcttgattgccgtgaatctcaaaaaggctagggagacccagcatggcgtat

SEQ ID NO: 2003 - DNA, 140 bp, Artificial Sequence
  Synthetic
aggccctggctgctgatatgggttggaatcaagagaatacacaaagcacttgattagagtcgaaaattggatattcaggaaccctggcttcgcgttagcagcagctgccatcgcttggctgaccttttgggacagcggtg

SEQ ID NO: 2004 - DNA, 140 bp, Artificial Sequence
  Synthetic
caccgctgtcccaaaaggtcagccaagcgatggcagctgctgctaacgcgaagccagggttcctgaatatccaattttcgactctaatcaagtgctttgtgtattctcttgattccaacccatatcagcagccagggcct

SEQ ID NO: 2005 - DNA, 140 bp, Artificial Sequence
  Synthetic
aggccctggctgctgatatgtgattgccccggcatacagcatcaggtgcataggagtcagcaatagggactttgtggaaggtatgtcaggtgggacttgggttgatgttgtcttggaacagaccttttgggacagcggtg

SEQ ID NO: 2006 - DNA, 140 bp, Artificial Sequence
  Synthetic
caccgctgtcccaaaaggtctgttccaagacaacatcaacccaagtcccacctgacataccttccacaaagtccctattgctgactcctatgcacctgatgctgtatgccggggcaatcacatatcagcagccagggcct

SEQ ID NO: 2007 - DNA, 140 bp, Artificial Sequence
  Synthetic
aggccctggctgctgatatgtggaggttgtgtcaccgtaatggcacaggacaaaccgactgtcgacatagagctggttacaacaacagtcagcaacatggcggagataagatcctactgcgaccttttgggacagcggtg

SEQ ID NO: 2008 - DNA, 140 bp, Artificial Sequence
  Synthetic
caccgctgtcccaaaaggtcgcagtaggatcttatctccgccatgttgctgactgttgttgtaaccagctctatgtcgacagtcggtttgtcctgtgccattacggtgacacaacctccacatatcagcagccagggcct

SEQ ID NO: 2009 - DNA, 140 bp, Artificial Sequence
  Synthetic
aggccctggctgctgatatggaacgttagtggacagaggctggggaaatggatgtggactttttggcaaagggagcctggtgacatgcgctaagtttgcatgctccaagaaaatgaccgggaccttttgggacagcggtg

SEQ ID NO: 2010 - DNA, 140 bp, Artificial Sequence
  Synthetic
caccgctgtcccaaaaggtcccggtcattttcttggagcatgcaaacttagcgcatgtcaccaggctccctttgccaaaaagtccacatccatttccccagcctctgtccactaacgttccatatcagcagccagggcct

SEQ ID NO: 2011 - DNA, 140 bp, Artificial Sequence
  Synthetic
atacgccatgctgggtctcctggggcagacaccggaactccacactggaacaacaaagaagcactggtggagttcaaggacgcacatgccaaaaggcaaactgtcgtggttctagggagtcgtacttgggagtcggccat

SEQ ID NO: 2012 - DNA, 140 bp, Artificial Sequence
  Synthetic
atggccgactcccaagtacgactccctagaaccacgacagtttgccttttggcatgtgcgtccttgaactccaccagtgcttctttgttgttccagtgtggagttccggtgtctgccccaggagacccagcatggcgtat

SEQ ID NO: 2013 - DNA, 140 bp, Artificial Sequence
  Synthetic
atacgccatgctgggtctccagatggcggtggacatgcaaactctgaccccagttgggaggttgataaccgctaaccccgtaatcactgaaagcactgagaactctaagatgatgctggacgtacttgggagtcggccat

SEQ ID NO: 2014 - DNA, 140 bp, Artificial Sequence
  Synthetic
atggccgactcccaagtacgtccagcatcatcttagagttctcagtgctttcagtgattacggggttagcggttatcaacctcccaactggggtcagagtttgcatgtccaccgccatctggagacccagcatggcgtat

SEQ ID NO: 2015 - DNA, 140 bp, Artificial Sequence
  Synthetic
atacgccatgctgggtctccagaagatcacccaccactggcacaggagtggcagcaccattggaaaagcatttgaagccactgtgagaggtgccaagagaatggcagtcttgggagacaccgtacttgggagtcggccat

SEQ ID NO: 2016 - DNA, 140 bp, Artificial Sequence
  Synthetic
atggccgactcccaagtacggtgtctcccaagactgccattctcttggcacctctcacagtggcttcaaatgcttttccaatggtgctgccactcctgtgccagtggtgggtgatcttctggagacccagcatggcgtat

SEQ ID NO: 2017 - DNA, 140 bp, Artificial Sequence
  Synthetic
atacgccatgctgggtctccagcctgggactttggatcagttggaggcgctctcaactcattgggcaagggcatccatcaaatttttggagctgctttcaaatcattgtttggaggaatgcgtacttgggagtcggccat

SEQ ID NO: 2018 - DNA, 140 bp, Artificial Sequence
  Synthetic
atggccgactcccaagtacgcattcctccaaacaatgatttgaaagcagctccaaaaatttgatggatgcccttgcccaatgagttgagagcgcctccaactgatccaaagtcccaggctggagacccagcatggcgtat

SEQ ID NO: 2019 - DNA, 140 bp, Artificial Sequence
  Synthetic
atacgccatgctgggtctccatctcctctgtttcaagaatggaaaacatcatgtggagatcagtagaaggggagctcaacgcaatcctggaagagaatggagttcaactgacggtcgttgcgtacttgggagtcggccat

SEQ ID NO: 2020 - DNA, 140 bp, Artificial Sequence
  Synthetic
atggccgactcccaagtacgcaacgaccgtcagttgaactccattctcttccaggattgcgttgagctccccttctactgatctccacatgatgttttccattcttgaaacagaggagatggagacccagcatggcgtat

SEQ ID NO: 2021 - DNA, 140 bp, Artificial Sequence
  Synthetic
atacgccatgctgggtctcctgggatctgtaaaaaaccccatgtggagagctccacagagattgcccgtgcctgtgaacgagctgccccacggctggaaggcttgggggaaatcgtacttcgtacttgggagtcggccat

SEQ ID NO: 2022 - DNA, 140 bp, Artificial Sequence
  Synthetic
atggccgactcccaagtacgaagtacgatttcccccaagccttccagccgtggggcagctcgttcacaggcacgggcaatctctgtggagctctccacatggggttttttacagatcccaggagacccagcatggcgtat

SEQ ID NO: 2023 - DNA, 140 bp, Artificial Sequence
  Synthetic
aggccctggctgctgatatgcatgtggaacaagaggaccatctctgagatcaaccactgcaagcggaagggtgatcgaggaatggtgctgcagggagtgcacaatgcccccactgtcgttgaccttttgggacagcggtg

SEQ ID NO: 2024 - DNA, 140 bp, Artificial Sequence
  Synthetic
caccgctgtcccaaaaggtcaacgacagtgggggcattgtgcactccctgcagcaccattcctcgatcacccttccgcttgcagtggttgatctcagagatggtcctcttgttccacatgcatatcagcagccagggcct

SEQ ID NO: 2025 - DNA, 140 bp, Artificial Sequence
  Synthetic
atacgccatgctgggtctcccacatggatcacttctcccttggagtgcttgtgattctgctcatggtgcaggaagggctaaagaagagaatgaccacaaagatcatcataagcacatcaacgtacttgggagtcggccat

SEQ ID NO: 2026 - DNA, 140 bp, Artificial Sequence
  Synthetic
atggccgactcccaagtacgttgatgtgcttatgatgatctttgtggtcattctcttctttagcccttcctgcaccatgagcagaatcacaagcactccaagggagaagtgatccatgtgggagacccagcatggcgtat

SEQ ID NO: 2027 - DNA, 140 bp, Artificial Sequence
  Synthetic
atacgccatgctgggtctcccgttgctggtatctttcatcttcagagctaattggacaccccgtgaaagcatgctactggccttggcctcgtgtcttttgcaaactgcgatctccgccttcgtacttgggagtcggccat

SEQ ID NO: 2028 - DNA, 140 bp, Artificial Sequence
  Synthetic
atggccgactcccaagtacgaaggcggagatcgcagtttgcaaaagacacgaggccaaggccagtagcatgctttcacggggtgtccaattagctctgaagatgaaagataccagcaacgggagacccagcatggcgtat

SEQ ID NO: 2029 - DNA, 140 bp, Artificial Sequence
  Synthetic
atacgccatgctgggtctccaaggcagtgtgaagaagaacttaccatttgtcatggccctgggactaaccgctgtgaggctggtcgaccccatcaacgtggtgggactgctgttgctcaccgtacttgggagtcggccat

SEQ ID NO: 2030 - DNA, 140 bp, Artificial Sequence
  Synthetic
atggccgactcccaagtacggtgagcaacagcagtcccaccacgttgatggggtcgaccagcctcacagcggttagtcccagggccatgacaaatggtaagttcttcttcacactgccttggagacccagcatggcgtat

SEQ ID NO: 2031 - DNA, 140 bp, Artificial Sequence
  Synthetic
atacgccatgctgggtctccatgtggcacgtcacaaaaggatccgcactgagaagcggtgaagggagacttgatccatactggggagatgtcaagcaggatctggtgtcatactgtggtccgtacttgggagtcggccat

SEQ ID NO: 2032 - DNA, 140 bp, Artificial Sequence
  Synthetic
atggccgactcccaagtacggaccacagtatgacaccagatcctgcttgacatctccccagtatggatcaagtctcccttcaccgcttctcagtgcggatccttttgtgacgtgccacatggagacccagcatggcgtat

SEQ ID NO: 2033 - DNA, 140 bp, Artificial Sequence
  Synthetic
atacgccatgctgggtctcccgatgctgaagaagaagcagctaactgtcttagacttacatcctggagctgggaaaaccaggagagttcttcctgaaatagtccgtgaagccataaaaaccgtacttgggagtcggccat

SEQ ID NO: 2034 - DNA, 140 bp, Artificial Sequence
  Synthetic
atggccgactcccaagtacggtttttatggcttcacggactatttcaggaagaactctcctggttttcccagctccaggatgtaagtctaagacagttagctgcttcttcttcagcatcgggagacccagcatggcgtat

SEQ ID NO: 2035 - DNA, 140 bp, Artificial Sequence
  Synthetic
atacgccatgctgggtctccatattatggatgaggcccacttcacagatccctcaagtatagcagcaagaggatacatttcaacaagggttgagatgggcgaggcggctgccatcttcatcgtacttgggagtcggccat

SEQ ID NO: 2036 - DNA, 140 bp, Artificial Sequence
  Synthetic
atggccgactcccaagtacgatgaagatggcagccgcctcgcccatctcaacccttgttgaaatgtatcctcttgctgctatacttgagggatctgtgaagtgggcctcatccataatatggagacccagcatggcgtat

SEQ ID NO: 2037 - DNA, 140 bp, Artificial Sequence
  Synthetic
aggccctggctgctgatatgcggtcatacttgatggcgagagagtcattctggctggacccatgcctgtcacacatgccagcgctgcccagaggagggggcgcataggcaggaatcccaagaccttttgggacagcggtg

SEQ ID NO: 2038 - DNA, 140 bp, Artificial Sequence
  Synthetic
caccgctgtcccaaaaggtcttgggattcctgcctatgcgccccctcctctgggcagcgctggcatgtgtgacaggcatgggtccagccagaatgactctctcgccatcaagtatgaccgcatatcagcagccagggcct

SEQ ID NO: 2039 - DNA, 140 bp, Artificial Sequence
  Synthetic
aggccctggctgctgatatggttgcatctgccggaataacctacacagatagaagatggtgctttgatggcacgaccaacaacaccatactggaagacagtgtgccggcagaggtgtggagaccttttgggacagcggtg

SEQ ID NO: 2040 - DNA, 140 bp, Artificial Sequence
  Synthetic
caccgctgtcccaaaaggtctccacacctctgccggcacactgtcttccagtatggtgttgttggtcgtgccatcaaagcaccatcttctatctgtgtaggttattccggcagatgcaaccatatcagcagccagggcct

SEQ ID NO: 2041 - DNA, 140 bp, Artificial Sequence
  Synthetic
atacgccatgctgggtctccgaaaagaggagcggcttttggagtgatggaagccttgggaacactgccaggacacatgacagagagattccaggaagccattgacaacctcgctgtgctccgtacttgggagtcggccat

SEQ ID NO: 2042 - DNA, 140 bp, Artificial Sequence
  Synthetic
atggccgactcccaagtacggagcacagcgaggttgtcaatggcttcctggaatctctctgtcatgtgtcctggcagtgttcccaaggcttccatcactccaaaagccgctcctcttttcggagacccagcatggcgtat

SEQ ID NO: 2043 - DNA, 140 bp, Artificial Sequence
  Synthetic
aggccctggctgctgatatgcgctgggaatctttttcgtcttgatgaggaacaagggcatagggaagatgggctttggaatggtgacccttggggccagtgcatggctcatgtggctctcgaccttttgggacagcggtg

SEQ ID NO: 2044 - DNA, 140 bp, Artificial Sequence
  Synthetic
caccgctgtcccaaaaggtcgagagccacatgagccatgcactggccccaagggtcaccattccaaagcccatcttccctatgcccttgttcctcatcaagacgaaaaagattcccagcgcatatcagcagccagggcct

SEQ ID NO: 2045 - DNA, 140 bp, Artificial Sequence
  Synthetic
aggccctggctgctgatatgtaccgccaatgaactcggatggttggagagaacaaagagtgacctaagccatctaatgggaaggagagaggagggagcaaccataggattctcaatggacgaccttttgggacagcggtg

SEQ ID NO: 2046 - DNA, 140 bp, Artificial Sequence
  Synthetic
caccgctgtcccaaaaggtcgtccattgagaatcctatggttgctccctcctctctccttcccattagatggcttaggtcactctttgttctctccaaccatccgagttcattggcggtacatatcagcagccagggcct

SEQ ID NO: 2047 - DNA, 140 bp, Artificial Sequence
  Synthetic
aggccctggctgctgatatgcccgcttgaaccagatgtcggccctggagttctactcctacaaaaagtcaggcatcactgaggtgtgcagagaagaggcccgccgcgccctcaaggacgggaccttttgggacagcggtg

SEQ ID NO: 2048 - DNA, 140 bp, Artificial Sequence
  Synthetic
caccgctgtcccaaaaggtcccgtccttgagggcgcggcgggcctcttctctgcacacctcagtgatgcctgactttttgtaggagtagaactccagggccgacatctggttcaagcgggcatatcagcagccagggcct

SEQ ID NO: 2049 - DNA, 140 bp, Artificial Sequence
  Synthetic
atacgccatgctgggtctcctgttggtgcaaagctatgggtggaacatagtccgtcttaagagtggggtggacgtctttcatatggcggctgagccgtgtgacacgttgctgtgtgacatcgtacttgggagtcggccat

SEQ ID NO: 2050 - DNA, 140 bp, Artificial Sequence
  Synthetic
atggccgactcccaagtacgatgtcacacagcaacgtgtcacacggctcagccgccatatgaaagacgtccaccccactcttaagacggactatgttccacccatagctttgcaccaacaggagacccagcatggcgtat

SEQ ID NO: 2051 - DNA, 140 bp, Artificial Sequence
  Synthetic
atacgccatgctgggtctccaggcgagtcatcatctagtcctgaagtggaagaagcacggacgctcagagtcctctccatggtgggggattggcttgaaagaagaccaggagccttttgtcgtacttgggagtcggccat

SEQ ID NO: 2052 - DNA, 140 bp, Artificial Sequence
  Synthetic
atggccgactcccaagtacgacaaaaggctcctggtcttctttcaagccaatcccccaccatggagaggactctgagcgtccgtgcttcttccacttcaggactagatgatgactcgcctggagacccagcatggcgtat

SEQ ID NO: 2053 - DNA, 140 bp, Artificial Sequence
  Synthetic
aggccctggctgctgatatgactctacacatgagatgtactgggtctctggagcgaaaagcaacaccataaaaagtgtgtccaccacgagccagctcctcttggggcgcatggacgggccgaccttttgggacagcggtg

SEQ ID NO: 2054 - DNA, 140 bp, Artificial Sequence
  Synthetic
caccgctgtcccaaaaggtcggcccgtccatgcgccccaagaggagctggctcgtggtggacacactttttatggtgttgcttttcgctccagagacccagtacatctcatgtgtagagtcatatcagcagccagggcct

SEQ ID NO: 2055 - DNA, 140 bp, Artificial Sequence
  Synthetic
aggccctggctgctgatatgctggatggggagagagaactcaggaggtggtgttgaagggctgggattacaaagactcggatatgtcctagaagagatgagttgcataccaggaggaagggaccttttgggacagcggtg

SEQ ID NO: 2056 - DNA, 140 bp, Artificial Sequence
  Synthetic
caccgctgtcccaaaaggtcccttcctcctggtatgcaactcatctcttctaggacatatccgagtctttgtaatcccagcccttcaacaccacctcctgagttctctctccccatccagcatatcagcagccagggcct

SEQ ID NO: 2057 - DNA, 140 bp, Artificial Sequence
  Synthetic
atacgccatgctgggtctccgtccttagaccagctgaaaaagggaaaacagttatggacattatttcaagacaagaccaaagggggagcggacaagttgtcacttacgctcttaacacatcgtacttgggagtcggccat

SEQ ID NO: 2058 - DNA, 140 bp, Artificial Sequence
  Synthetic
atggccgactcccaagtacgatgtgttaagagcgtaagtgacaacttgtccgctccccctttggtcttgtcttgaaataatgtccataactgttttccctttttcagctggtctaaggacggagacccagcatggcgtat

SEQ ID NO: 2059 - DNA, 140 bp, Artificial Sequence
  Synthetic
aggccctggctgctgatatgaggttcttgaatgatatgggaaaagttaggaaggacacacaagagtggaaaccctcaactggatgggacaactgggaagaagttccgttttgctcccaccgaccttttgggacagcggtg

SEQ ID NO: 2060 - DNA, 140 bp, Artificial Sequence
  Synthetic
caccgctgtcccaaaaggtcggtgggagcaaaacggaacttcttcccagttgtcccatccagttgagggtttccactcttgtgtgtccttcctaacttttcccatatcattcaagaacctcatatcagcagccagggcct

SEQ ID NO: 2061 - DNA, 140 bp, Artificial Sequence
  Synthetic
atacgccatgctgggtctccggtgcgcaggatcataggtgatgaagaaaagtacatggactacctatccacccaagttcgctacttgggtgaagaagggtctacacctggagtgctgtaacgtacttgggagtcggccat

SEQ ID NO: 2062 - DNA, 140 bp, Artificial Sequence
  Synthetic
atggccgactcccaagtacgttacagcactccaggtgtagacccttcttcacccaagtagcgaacttgggtggataggtagtccatgtacttttcttcatcacctatgatcctgcgcaccggagacccagcatggcgtat

SEQ ID NO: 2063 - DNA, 140 bp, Artificial Sequence
  Synthetic
atacgccatgctgggtctccagaaagatctggctgccatgctgagaataatcaatgctaggaaggagaagaagagacgaggcgcagaaactagtgtcggaattgttggcctcctgctgaccgtacttgggagtcggccat

SEQ ID NO: 2064 - DNA, 140 bp, Artificial Sequence
  Synthetic
atggccgactcccaagtacggtcagcaggaggccaacaattccgacactagtttctgcgcctcgtctcttcttctccttcctagcattgattattctcagcatggcagccagatctttctggagacccagcatggcgtat

SEQ ID NO: 2065 - DNA, 140 bp, Artificial Sequence
  Synthetic
aggccctggctgctgatatgatgacgtcgattgttggtgcaacacgacgtcaacttgggttgtgtacggaacctgccatcacaaaaaaggtgaagcacggagatctagaagagccgtgacgaccttttgggacagcggtg

SEQ ID NO: 2066 - DNA, 140 bp, Artificial Sequence
  Synthetic
caccgctgtcccaaaaggtcgtcacggctcttctagatctccgtgcttcaccttttttgtgatggcaggttccgtacacaacccaagttgacgtcgtgttgcaccaacaatcgacgtcatcatatcagcagccagggcct

SEQ ID NO: 2067 - DNA, 140 bp, Artificial Sequence
  Synthetic
atacgccatgctgggtctccttcaggaaccctggtttcgctttagcagcagctgccatcgcgtggcttttgggaagctcaacgagccaaaaagtcatatacttggtcatgatactgctgacgtacttgggagtcggccat

SEQ ID NO: 2068 - DNA, 140 bp, Artificial Sequence
  Synthetic
atggccgactcccaagtacgtcagcagtatcatgaccaagtatatgactttttggctcgttgagcttcccaaaagccacgcgatggcagctgctgctaaagcgaaaccagggttcctgaaggagacccagcatggcgtat

SEQ ID NO: 2069 - DNA, 140 bp, Artificial Sequence
  Synthetic
aggccctggctgctgatatgagcctggtgacatgcgctaagtttgcatgctccaagaaaatgaccgggaagagcatccagccagagaatctggagtaccggataatgttgtcagttcatggaccttttgggacagcggtg

SEQ ID NO: 2070 - DNA, 140 bp, Artificial Sequence
  Synthetic
caccgctgtcccaaaaggtccatgaactgacaacattatccggtactccagattctctggctggatgctcttcccggtcattttcttggagcatgcaaacttagcgcatgtcaccaggctcatatcagcagccagggcct

SEQ ID NO: 2071 - DNA, 140 bp, Artificial Sequence
  Synthetic
aggccctggctgctgatatgttcacattcaccaagatcccggctgaaacactgcacgggacagtcacagtggaggtacagtacgcagggacagatggaccttgcaaggttccagcccagagaccttttgggacagcggtg

SEQ ID NO: 2072 - DNA, 140 bp, Artificial Sequence
  Synthetic
caccgctgtcccaaaaggtctctgggctggaaccttgcaaggtccatctgtccctgcgtactgtacctccactgtgactgtcccgtgcagtgtttcagccgggatcttggtgaatgtgaacatatcagcagccagggcct

SEQ ID NO: 2073 - DNA, 140 bp, Artificial Sequence
  Synthetic
aggccctggctgctgatatgtgatcttcttatccacagccgtctctgctgatgtggggtgctcggtggacttctcaaagaaggagacgagatgtggtacaggggtgttcgtctataacgagaccttttgggacagcggtg

SEQ ID NO: 2074 - DNA, 140 bp, Artificial Sequence
  Synthetic
caccgctgtcccaaaaggtctcgttatagacgaacacccctgtaccacatctcgtctccttctttgagaagtccaccgagcaccccacatcagcagagacggctgtggataagaagatcacatatcagcagccagggcct

SEQ ID NO: 2075 - DNA, 140 bp, Artificial Sequence
  Synthetic
atacgccatgctgggtctccatggccaaaatcccacacattgtggacagatggaatagaagagagtgatctgatcatacccaagtctttagctgggccactcagccatcacaataccagacgtacttgggagtcggccat

SEQ ID NO: 2076 - DNA, 140 bp, Artificial Sequence
  Synthetic
atggccgactcccaagtacgtctggtattgtgatggctgagtggcccagctaaagacttgggtatgatcagatcactctcttctattccatctgtccacaatgtgtgggattttggccatggagacccagcatggcgtat

SEQ ID NO: 2077 - DNA, 140 bp, Artificial Sequence
  Synthetic
atacgccatgctgggtctccatcgaggaatggtgctgcagggagtgcacaatgcccccactgtcgttctgggctaaagatggctgttggtatggaatggagataaggcccaggaaagaaccgtacttgggagtcggccat

SEQ ID NO: 2078 - DNA, 140 bp, Artificial Sequence
  Synthetic
atggccgactcccaagtacggttctttcctgggccttatctccattccataccaacagccatctttagcccagaacgacagtgggggcattgtgcactccctgcagcaccattcctcgatggagacccagcatggcgtat

SEQ ID NO: 2079 - DNA, 140 bp, Artificial Sequence
  Synthetic
aggccctggctgctgatatgatggatcacttctcccttggagtgcttgtgattctgctcatggtgcaggaagggctgaagaagagaatgaccacaaagatcatcataagcacatcaatgggaccttttgggacagcggtg

SEQ ID NO: 2080 - DNA, 140 bp, Artificial Sequence
  Synthetic
caccgctgtcccaaaaggtcccattgatgtgcttatgatgatctttgtggtcattctcttcttcagcccttcctgcaccatgagcagaatcacaagcactccaagggagaagtgatccatcatatcagcagccagggcct

SEQ ID NO: 2081 - DNA, 140 bp, Artificial Sequence
  Synthetic
aggccctggctgctgatatgaagcttgcaattttgatgggtgccaccttcgcggaaatgaacactggaggagatgtagctcatctggcgctgacagcggcattcaaagtcagaccagcgtgaccttttgggacagcggtg

SEQ ID NO: 2082 - DNA, 140 bp, Artificial Sequence
  Synthetic
caccgctgtcccaaaaggtcacgctggtctgactttgaatgccgctgtcagcgccagatgagctacatctcctccagtgttcatttccgcgaaggtggcacccatcaaaattgcaagcttcatatcagcagccagggcct

SEQ ID NO: 2083 - DNA, 140 bp, Artificial Sequence
  Synthetic
aggccctggctgctgatatgtgctggtatctttcatcttcagagctaattggacaccccgtgaaagcatgctgctggccttggcctcgtgtcttttgcaaactgcgatctctgccttggagaccttttgggacagcggtg

SEQ ID NO: 2084 - DNA, 140 bp, Artificial Sequence
  Synthetic
caccgctgtcccaaaaggtctccaaggcagagatcgcagtttgcaaaagacacgaggccaaggccagcagcatgctttcacggggtgtccaattagctctgaagatgaaagataccagcacatatcagcagccagggcct

SEQ ID NO: 2085 - DNA, 140 bp, Artificial Sequence
  Synthetic
atacgccatgctgggtctccgagtgggaagcggagctggccccctagcgaagtactcacagctgttggcctgatatgtgcattggctggagggttcgccaaggcagatatagagatggctcgtacttgggagtcggccat

SEQ ID NO: 2086 - DNA, 140 bp, Artificial Sequence
  Synthetic
atggccgactcccaagtacgagccatctctatatctgccttggcgaaccctccagccaatgcacatatcaggccaacagctgtgagtacttcgctagggggccagctccgcttcccactcggagacccagcatggcgtat

SEQ ID NO: 2087 - DNA, 140 bp, Artificial Sequence
  Synthetic
aggccctggctgctgatatgaaagagtgtggacatgtacattgaaagagcaggtgacatcacatgggaaaaagatgcggaagtcactggaaacagtccccggctcgacgtggcgctagatgaccttttgggacagcggtg

SEQ ID NO: 2088 - DNA, 140 bp, Artificial Sequence
  Synthetic
caccgctgtcccaaaaggtcatctagcgccacgtcgagccggggactgtttccagtgacttccgcatctttttcccatgtgatgtcacctgctctttcaatgtacatgtccacactctttcatatcagcagccagggcct

SEQ ID NO: 2089 - DNA, 140 bp, Artificial Sequence
  Synthetic
atacgccatgctgggtctccgggatgccattctacgcatgggactttggagtcccactgctaatgataggttgctactcacaattaacacccctgaccctaatagtggccatcattttgccgtacttgggagtcggccat

SEQ ID NO: 2090 - DNA, 140 bp, Artificial Sequence
  Synthetic
atggccgactcccaagtacggcaaaatgatggccactattagggtcaggggtgttaattgtgagtagcaacctatcattagcagtgggactccaaagtcccatgcgtagaatggcatcccggagacccagcatggcgtat

SEQ ID NO: 2091 - DNA, 140 bp, Artificial Sequence
  Synthetic
atacgccatgctgggtctcctggcattggccataatcaagtacacataccaaaacaaagtggtaaaggtccttagaccagctgaaaaagggaaaacagttatggacattatttcgagacacgtacttgggagtcggccat

SEQ ID NO: 2092 - DNA, 140 bp, Artificial Sequence
  Synthetic
atggccgactcccaagtacgtgtctcgaaataatgtccataactgttttccctttttcagctggtctaaggacctttaccactttgttttggtatgtgtacttgattatggccaatgccaggagacccagcatggcgtat

SEQ ID NO: 2093 - DNA, 140 bp, Artificial Sequence
  Synthetic
aggccctggctgctgatatgggaacagagtgtggattgaggagaacgaccacatggaagacaagaccccagttgcgaaatggacagacattccctatttgggaaaaagggaagacttgtggaccttttgggacagcggtg

SEQ ID NO: 2094 - DNA, 140 bp, Artificial Sequence
  Synthetic
caccgctgtcccaaaaggtccacaagtcttccctttttcccaaatagggaatgtctgtccatttcgcaactggggtcttgtcttccatgtggtcgttctcctcaatccacactctgttcccatatcagcagccagggcct

SEQ ID NO: 2095 - DNA, 140 bp, Artificial Sequence
  Synthetic
aggccctggctgctgatatggttgttgatctgtgtgaatcagactgcgacagttcgagtttgaagcgaaagctagcaacagtatcaacaggttttattttggatttggaaacgagagtttgaccttttgggacagcggtg

SEQ ID NO: 2096 - DNA, 140 bp, Artificial Sequence
  Synthetic
caccgctgtcccaaaaggtcaaactctcgtttccaaatccaaaataaaacctgttgatactgttgctagctttcgcttcaaactcgaactgtcgcagtctgattcacacagatcaacaaccatatcagcagccagggcct

SEQ ID NO: 2097 - DNA, 140 bp, Artificial Sequence
  Synthetic
aggccctggctgctgatatgcatcaatagatggggttcagtggggaaaaaagaggctatggaaacaataaagaagttcaagaaagatctggctgccatgctgagaataatcaatgctagggaccttttgggacagcggtg

SEQ ID NO: 2098 - DNA, 140 bp, Artificial Sequence
  Synthetic
caccgctgtcccaaaaggtccctagcattgattattctcagcatggcagccagatctttcttgaacttctttattgtttccatagcctcttttttccccactgaaccccatctattgatgcatatcagcagccagggcct

SEQ ID NO: 2099 - DNA, 140 bp, Artificial Sequence
  Synthetic
aggccctggctgctgatatggtgtacggaacctgccatcacaaaaaaggtgaagcacggagatctagaagagctgtgacgctcccctcccattccaccaggaagctgcaaacgcggtcgcgaccttttgggacagcggtg

SEQ ID NO: 2100 - DNA, 140 bp, Artificial Sequence
  Synthetic
caccgctgtcccaaaaggtcgcgaccgcgtttgcagcttcctggtggaatgggaggggagcgtcacagctcttctagatctccgtgcttcaccttttttgtgatggcaggttccgtacaccatatcagcagccagggcct

SEQ ID NO: 2101 - DNA, 140 bp, Artificial Sequence
  Synthetic
aggccctggctgctgatatgtactgctatgaggcatcaatatcagacatggcttctgacagccgctgcccaacacaaggtgaagcctaccttgacaagcaatcagacactcaatatgtctgaccttttgggacagcggtg

SEQ ID NO: 2102 - DNA, 140 bp, Artificial Sequence
  Synthetic
caccgctgtcccaaaaggtcagacatattgagtgtctgattgcttgtcaaggtaggcttcaccttgtgttgggcagcggctgtcagaagccatgtctgatattgatgcctcatagcagtacatatcagcagccagggcct

SEQ ID NO: 2103 - DNA, 140 bp, Artificial Sequence
  Synthetic
aggccctggctgctgatatgcagttcatggctcccagcacagtgggatgatcgttaatgacacaggacatgaaactgatgagaatagagcgaaagttgagataacgcccaattcaccgaggaccttttgggacagcggtg

SEQ ID NO: 2104 - DNA, 140 bp, Artificial Sequence
  Synthetic
caccgctgtcccaaaaggtcctcggtgaattgggcgttatctcaactttcgctctattctcatcagtttcatgtcctgtgtcattaacgatcatcccactgtgctgggagccatgaactgcatatcagcagccagggcct

SEQ ID NO: 2105 - DNA, 140 bp, Artificial Sequence
  Synthetic
atacgccatgctgggtctccgaaactgatgagaatagagcgaaagttgagataacgcccaattcaccgagagccgaagccaccctggggggttttggaagcctaggacttgattgtgaaccgtacttgggagtcggccat

SEQ ID NO: 2106 - DNA, 140 bp, Artificial Sequence
  Synthetic
atggccgactcccaagtacggttcacaatcaagtcctaggcttccaaaaccccccagggtggcttcggctctcggtgaattgggcgttatctcaactttcgctctattctcatcagtttcggagacccagcatggcgtat

SEQ ID NO: 2107 - DNA, 140 bp, Artificial Sequence
  Synthetic
aggccctggctgctgatatgactgcagcgttcacattcaccaagatcccggctgaaacactgcacgggacagtcacagtggaggtacagtacgcagggacagatggaccttgcaaggttcgaccttttgggacagcggtg

SEQ ID NO: 2108 - DNA, 140 bp, Artificial Sequence
  Synthetic
caccgctgtcccaaaaggtcgaaccttgcaaggtccatctgtccctgcgtactgtacctccactgtgactgtcccgtgcagtgtttcagccgggatcttggtgaatgtgaacgctgcagtcatatcagcagccagggcct

SEQ ID NO: 2109 - DNA, 140 bp, Artificial Sequence
  Synthetic
aggccctggctgctgatatgtgcgggatctcctctgtttcaagaatggaaaacatcatgtggagatcagtagaaggggagctcaacgcaatcctggaagagaatggagttcaactgacgggaccttttgggacagcggtg

SEQ ID NO: 2110 - DNA, 140 bp, Artificial Sequence
  Synthetic
caccgctgtcccaaaaggtcccgtcagttgaactccattctcttccaggattgcgttgagctccccttctactgatctccacatgatgttttccattcttgaaacagaggagatcccgcacatatcagcagccagggcct

SEQ ID NO: 2111 - DNA, 140 bp, Artificial Sequence
  Synthetic
atacgccatgctgggtctcccccgtgcctgtgaacgagctgccccacggctggaaggcttgggggaaatcgtatttcgtcagagcagcaaagacaaataacagctttgtcgtggatggtgcgtacttgggagtcggccat

SEQ ID NO: 2112 - DNA, 140 bp, Artificial Sequence
  Synthetic
atggccgactcccaagtacgcaccatccacgacaaagctgttatttgtctttgctgctctgacgaaatacgatttcccccaagccttccagccgtggggcagctcgttcacaggcacgggggagacccagcatggcgtat

SEQ ID NO: 2113 - DNA, 140 bp, Artificial Sequence
  Synthetic
aggccctggctgctgatatggtggtccatggaagctagatgccgcctgggatgggcacagcgaggtgcagctcttggccgtgccccccggagagagagcgaggaacatccagactctgccgaccttttgggacagcggtg

SEQ ID NO: 2114 - DNA, 140 bp, Artificial Sequence
  Synthetic
caccgctgtcccaaaaggtcggcagagtctggatgttcctcgctctctctccggggggcacggccaagagctgcacctcgctgtgcccatcccaggcggcatctagcttccatggaccaccatatcagcagccagggcct

SEQ ID NO: 2115 - DNA, 140 bp, Artificial Sequence
  Synthetic
atacgccatgctgggtctccataggactttatggcaatggggtcgtgatcaaaaacgggagttatgttagtgccatcacccaagggaggagggaggaagagactcctgttgagtgcttcgcgtacttgggagtcggccat

SEQ ID NO: 2116 - DNA, 140 bp, Artificial Sequence
  Synthetic
atggccgactcccaagtacgcgaagcactcaacaggagtctcttcctccctcctcccttgggtgatggcactaacataactcccgtttttgatcacgaccccattgccataaagtcctatggagacccagcatggcgtat

SEQ ID NO: 2117 - DNA, 140 bp, Artificial Sequence
  Synthetic
aggccctggctgctgatatgtgccatcacccaagggaggagggaggaagagactcctgttgagtgcttcgagccctcgatgctgaagaagaagcagctaactgtcttagacttgcatcctgaccttttgggacagcggtg

SEQ ID NO: 2118 - DNA, 140 bp, Artificial Sequence
  Synthetic
caccgctgtcccaaaaggtcaggatgcaagtctaagacagttagctgcttcttcttcagcatcgagggctcgaagcactcaacaggagtctcttcctccctcctcccttgggtgatggcacatatcagcagccagggcct

SEQ ID NO: 2119 - DNA, 140 bp, Artificial Sequence
  Synthetic
aggccctggctgctgatatgactcaccaattatggacaccgaagtggaagtcccagagagagcctggagctcaggctttgattgggtgacggatcattctggaaaaacagtttggtttgtgaccttttgggacagcggtg

SEQ ID NO: 2120 - DNA, 140 bp, Artificial Sequence
  Synthetic
caccgctgtcccaaaaggtcacaaaccaaactgtttttccagaatgatccgtcacccaatcaaagcctgagctccaggctctctctgggacttccacttcggtgtccataattggtgagtcatatcagcagccagggcct

SEQ ID NO: 2121 - DNA, 140 bp, Artificial Sequence
  Synthetic
aggccctggctgctgatatgtaagccatctaatgggaaggagagaggagggggcaaccataggattctcaatggacattgacctgcggccagcctcagcttgggccatctatgctgccttgaccttttgggacagcggtg

SEQ ID NO: 2122 - DNA, 140 bp, Artificial Sequence
  Synthetic
caccgctgtcccaaaaggtcaaggcagcatagatggcccaagctgaggctggccgcaggtcaatgtccattgagaatcctatggttgccccctcctctctccttcccattagatggcttacatatcagcagccagggcct

SEQ ID NO: 2123 - DNA, 140 bp, Artificial Sequence
  Synthetic
aggccctggctgctgatatgacaactactccttaatggcgatggccacgcaagctggagtgttgtttggcatgggcaaagggatgccattctacgcatgggactttggagtcccgctgctgaccttttgggacagcggtg

SEQ ID NO: 2124 - DNA, 140 bp, Artificial Sequence
  Synthetic
caccgctgtcccaaaaggtcagcagcgggactccaaagtcccatgcgtagaatggcatccctttgcccatgccaaacaacactccagcttgcgtggccatcgccattaaggagtagttgtcatatcagcagccagggcct

SEQ ID NO: 2125 - DNA, 140 bp, Artificial Sequence
  Synthetic
atacgccatgctgggtctccgtctccagcgccatactgtcgcggaccgcctgggggtggggggaggctggggctctgatcacagccgcaacttccactttgtgggaaggctctccgaacacgtacttgggagtcggccat

SEQ ID NO: 2126 - DNA, 140 bp, Artificial Sequence
  Synthetic
atggccgactcccaagtacgtgttcggagagccttcccacaaagtggaagttgcggctgtgatcagagccccagcctccccccacccccaggcggtccgcgacagtatggcgctggagacggagacccagcatggcgtat

SEQ ID NO: 2127 - DNA, 140 bp, Artificial Sequence
  Synthetic
atacgccatgctgggtctcctgagatggttggtggagcggggatacctgcagccctatggaaaggtcattgatcttggatgtggcagagggggctggagttactacgtcgccaccatccgcgtacttgggagtcggccat

SEQ ID NO: 2128 - DNA, 140 bp, Artificial Sequence
  Synthetic
atggccgactcccaagtacgcggatggtggcgacgtagtaactccagccccctctgccacatccaagatcaatgacctttccatagggctgcaggtatccccgctccaccaaccatctcaggagacccagcatggcgtat

SEQ ID NO: 2129 - DNA, 140 bp, Artificial Sequence
  Synthetic
aggccctggctgctgatatggatcttggatgtggcagagggggctggagttactacgtcgccaccatccgcaaagttcaagaagtgaaaggatacacaaaaggaggccctggtcatgaaggaccttttgggacagcggtg

SEQ ID NO: 2130 - DNA, 140 bp, Artificial Sequence
  Synthetic
caccgctgtcccaaaaggtccttcatgaccagggcctccttttgtgtatcctttcacttcttgaactttgcggatggtggcgacgtagtaactccagccccctctgccacatccaagatccatatcagcagccagggcct

SEQ ID NO: 2131 - DNA, 140 bp, Artificial Sequence
  Synthetic
atacgccatgctgggtctcctcttcctggttgtggaaagagctaggcaaacacaaacggccacgagtctgcaccaaagaagagttcatcaacaaggttcgtagcaatgcagcattaggggcgtacttgggagtcggccat

SEQ ID NO: 2132 - DNA, 140 bp, Artificial Sequence
  Synthetic
atggccgactcccaagtacgcccctaatgctgcattgctacgaaccttgttgatgaactcttctttggtgcagactcgtggccgtttgtgtttgcctagctctttccacaaccaggaagaggagacccagcatggcgtat

SEQ ID NO: 2133 - DNA, 140 bp, Artificial Sequence
  Synthetic
aggccctggctgctgatatggatccaaggttctgggctctagtggacaaggaaagagagcaccacctgagaggagagtgccagagctgtgtgtacaacatgatgggaaaaagagaaaagagaccttttgggacagcggtg

SEQ ID NO: 2134 - DNA, 140 bp, Artificial Sequence
  Synthetic
caccgctgtcccaaaaggtctcttttctctttttcccatcatgttgtacacacagctctggcactctcctctcaggtggtgctctctttccttgtccactagagcccagaaccttggatccatatcagcagccagggcct

SEQ ID NO: 2135 - DNA, 140 bp, Artificial Sequence
  Synthetic
aggccctggctgctgatatgggatgggaaaagaaggtggcgaccttccccacccttcaatctggggcctgaactggagatcagctgtggatctccagaagagggactagtggttagaggagaccttttgggacagcggtg

SEQ ID NO: 2136 - DNA, 140 bp, Artificial Sequence
  Synthetic
caccgctgtcccaaaaggtctcctctaaccactagtccctcttctggagatccacagctgatctccagttcaggccccagattgaagggtggggaaggtcgccaccttcttttcccatcccatatcagcagccagggcct

SEQ ID NO: 2137 - DNA, 140 bp, Artificial Sequence
  Synthetic
atacgccatgctgggtctccatgaaaaaccccaaagaagaaatccggaggatccggattgtcaatatgctaaaacgcggagtagcccgtgtgagcccctttgggggcttgaagaggctgccgtacttgggagtcggccat

SEQ ID NO: 2138 - DNA, 140 bp, Artificial Sequence
  Synthetic
atggccgactcccaagtacggcagcctcttcaagcccccaaaggggctcacacgggctactccgcgttttagcatattgacaatccggatcctccggatttcttctttggggtttttcatggagacccagcatggcgtat

SEQ ID NO: 2139 - DNA, 140 bp, Artificial Sequence
  Synthetic
aggccctggctgctgatatgaaaacgcggagtagcccgtgtgagcccctttgggggcttgaagaggctgccagccggacttctgctgggtcatgggcccatcaggatggtcttggcgatagaccttttgggacagcggtg

SEQ ID NO: 2140 - DNA, 140 bp, Artificial Sequence
  Synthetic
caccgctgtcccaaaaggtctatcgccaagaccatcctgatgggcccatgacccagcagaagtccggctggcagcctcttcaagcccccaaaggggctcacacgggctactccgcgttttcatatcagcagccagggcct

SEQ ID NO: 2141 - DNA, 140 bp, Artificial Sequence
  Synthetic
atacgccatgctgggtctcctcaagaaagatctggctgccatgctgagaataatcaatgctaggaaggagaagaagagacgaggcacagatactagtgtcggaattgttggcctcctgctcgtacttgggagtcggccat

SEQ ID NO: 2142 - DNA, 140 bp, Artificial Sequence
  Synthetic
atggccgactcccaagtacgagcaggaggccaacaattccgacactagtatctgtgcctcgtctcttcttctccttcctagcattgattattctcagcatggcagccagatctttcttgaggagacccagcatggcgtat

SEQ ID NO: 2143 - DNA, 140 bp, Artificial Sequence
  Synthetic
atacgccatgctgggtctccgaccacagccatggcagtggaggtcactagacgtgggagtgcatactatatgtacttggacagaagcgatgctggggaggccatatcttttccaaccacacgtacttgggagtcggccat

SEQ ID NO: 2144 - DNA, 140 bp, Artificial Sequence
  Synthetic
atggccgactcccaagtacgtgtggttggaaaagatatggcctccccagcatcgcttctgtccaagtacatatagtatgcactcccacgtctagtgacctccactgccatggctgtggtcggagacccagcatggcgtat

SEQ ID NO: 2145 - DNA, 140 bp, Artificial Sequence
  Synthetic
atacgccatgctgggtctccctggggatgaacaagtgttacatacagatcatggatcttggacacatgtgtgatgccaccatgagctatgaatgccctatgttggatgagggggtagaaccgtacttgggagtcggccat

SEQ ID NO: 2146 - DNA, 140 bp, Artificial Sequence
  Synthetic
atggccgactcccaagtacggttctaccccctcatccaacatagggcattcatagctcatggtggcatcacacatgtgtccaagatccatgatctgtatgtaacacttgttcatccccagggagacccagcatggcgtat

SEQ ID NO: 2147 - DNA, 140 bp, Artificial Sequence
  Synthetic
aggccctggctgctgatatgtgatgccaccatgagctatgaatgccctatgttggatgagggggtagaaccagatgacgtcgattgttggtgcaacacgacatcaacttgggttgtgtacgaccttttgggacagcggtg

SEQ ID NO: 2148 - DNA, 140 bp, Artificial Sequence
  Synthetic
caccgctgtcccaaaaggtcgtacacaacccaagttgatgtcgtgttgcaccaacaatcgacgtcatctggttctaccccctcatccaacatagggcattcatagctcatggtggcatcacatatcagcagccagggcct

SEQ ID NO: 2149 - DNA, 140 bp, Artificial Sequence
  Synthetic
atacgccatgctgggtctccggaacctgccaccacaaaaaaggtgaagcacggagatctagaagagctgtgacgctcccctcccattccactaggaagctgcaaacgcggtcgcagacctcgtacttgggagtcggccat

SEQ ID NO: 2150 - DNA, 140 bp, Artificial Sequence
  Synthetic
atggccgactcccaagtacgaggtctgcgaccgcgtttgcagcttcctagtggaatgggaggggagcgtcacagctcttctagatctccgtgcttcaccttttttgtggtggcaggttccggagacccagcatggcgtat

SEQ ID NO: 2151 - DNA, 140 bp, Artificial Sequence
  Synthetic
atacgccatgctgggtctccggttggaatcaagagaatatacaaagcacctgattagagtcgaaaattggatattcaggaaccctggcttcgcgttagcagcagctgccatcgcctggctcgtacttgggagtcggccat

SEQ ID NO: 2152 - DNA, 140 bp, Artificial Sequence
  Synthetic
atggccgactcccaagtacgagccaggcgatggcagctgctgctaacgcgaagccagggttcctgaatatccaattttcgactctaatcaggtgctttgtatattctcttgattccaaccggagacccagcatggcgtat

SEQ ID NO: 2153 - DNA, 140 bp, Artificial Sequence
  Synthetic
aggccctggctgctgatatgatattcaggaaccctggcttcgcgttagcagcagctgccatcgcctggcttttgggaagttcaacgagccaaaaagtcatatacttggtcatgatactgcgaccttttgggacagcggtg

SEQ ID NO: 2154 - DNA, 140 bp, Artificial Sequence
  Synthetic
caccgctgtcccaaaaggtcgcagtatcatgaccaagtatatgactttttggctcgttgaacttcccaaaagccaggcgatggcagctgctgctaacgcgaagccagggttcctgaatatcatatcagcagccagggcct

SEQ ID NO: 2155 - DNA, 140 bp, Artificial Sequence
  Synthetic
aggccctggctgctgatatgtttgtggaaggtatgtcaggtgggacttgggttgatgttgtcttggaacatggaggttgtgttaccgtaatggcacaggacaaaccggctgtcgacataggaccttttgggacagcggtg

SEQ ID NO: 2156 - DNA, 140 bp, Artificial Sequence
  Synthetic
caccgctgtcccaaaaggtcctatgtcgacagccggtttgtcctgtgccattacggtaacacaacctccatgttccaagacaacatcaacccaagtcccacctgacataccttccacaaacatatcagcagccagggcct

SEQ ID NO: 2157 - DNA, 140 bp, Artificial Sequence
  Synthetic
atacgccatgctgggtctccagctggttacaacaacagtcagcaacatggcggaggtaagatcctattgctatgaggcatcaatatcggacatggcttcggacagccgctgcccaacacacgtacttgggagtcggccat

SEQ ID NO: 2158 - DNA, 140 bp, Artificial Sequence
  Synthetic
atggccgactcccaagtacgtgtgttgggcagcggctgtccgaagccatgtccgatattgatgcctcatagcaataggatcttacctccgccatgttgctgactgttgttgtaaccagctggagacccagcatggcgtat

SEQ ID NO: 2159 - DNA, 140 bp, Artificial Sequence
  Synthetic
atacgccatgctgggtctccaggtgaagcctaccttgacaagcagtcagacactcaatatgtctgcaaaagaacgttagtggacagaggctggggaaatggatgtggactttttggcaaacgtacttgggagtcggccat

SEQ ID NO: 2160 - DNA, 140 bp, Artificial Sequence
  Synthetic
atggccgactcccaagtacgtttgccaaaaagtccacatccatttccccagcctctgtccactaacgttcttttgcagacatattgagtgtctgactgcttgtcaaggtaggcttcacctggagacccagcatggcgtat

SEQ ID NO: 2161 - DNA, 140 bp, Artificial Sequence
  Synthetic
atacgccatgctgggtctccgatgagaatagagcgaaggttgagataacgcccaattcaccaagagctgaagccaccctggggggttttggaagcctaggacttgattgtgaaccgaggacgtacttgggagtcggccat

SEQ ID NO: 2162 - DNA, 140 bp, Artificial Sequence
  Synthetic
atggccgactcccaagtacgtcctcggttcacaatcaagtcctaggcttccaaaaccccccagggtggcttcagctcttggtgaattgggcgttatctcaaccttcgctctattctcatcggagacccagcatggcgtat

SEQ ID NO: 2163 - DNA, 140 bp, Artificial Sequence
  Synthetic
aggccctggctgctgatatgcaggccttgacttttcagatttgtattacttgactatgaataacaagcactggttggttcacaaggagtggttccacgacattccattaccttggcatgcgaccttttgggacagcggtg

SEQ ID NO: 2164 - DNA, 140 bp, Artificial Sequence
  Synthetic
caccgctgtcccaaaaggtcgcatgccaaggtaatggaatgtcgtggaaccactccttgtgaaccaaccagtgcttgttattcatagtcaagtaatacaaatctgaaaagtcaaggcctgcatatcagcagccagggcct

SEQ ID NO: 2165 - DNA, 140 bp, Artificial Sequence
  Synthetic
atacgccatgctgggtctcctggggcagacaccggaactccacattggaacaacaaagaagcattggtagagttcaaggacgcacatgccaaaaggcaaactgtcgtggttctagggagtcgtacttgggagtcggccat

SEQ ID NO: 2166 - DNA, 140 bp, Artificial Sequence
  Synthetic
atggccgactcccaagtacgactccctagaaccacgacagtttgccttttggcatgtgcgtccttgaactctaccaatgcttctttgttgttccaatgtggagttccggtgtctgccccaggagacccagcatggcgtat

SEQ ID NO: 2167 - DNA, 140 bp, Artificial Sequence
  Synthetic
atacgccatgctgggtctccagtggaggtacagtacgcagggacagatggaccctgcaaggttccagctcagatggcggtggacatgcaaactctgaccccagttgggaggctgataacccgtacttgggagtcggccat

SEQ ID NO: 2168 - DNA, 140 bp, Artificial Sequence
  Synthetic
atggccgactcccaagtacgggttatcagcctcccaactggggtcagagtttgcatgtccaccgccatctgagctggaaccttgcagggtccatctgtccctgcgtactgtacctccactggagacccagcatggcgtat

SEQ ID NO: 2169 - DNA, 140 bp, Artificial Sequence
  Synthetic
atacgccatgctgggtctccgctaaccctgtaatcactgaaagcactgagaactctaagatgatgctggaacttgatccaccatttggggactcttacattgtcataggagtcggggagacgtacttgggagtcggccat

SEQ ID NO: 2170 - DNA, 140 bp, Artificial Sequence
  Synthetic
atggccgactcccaagtacgtctccccgactcctatgacaatgtaagagtccccaaatggtggatcaagttccagcatcatcttagagttctcagtgctttcagtgattacagggttagcggagacccagcatggcgtat

SEQ ID NO: 2171 - DNA, 140 bp, Artificial Sequence
  Synthetic
aggccctggctgctgatatgacttgatccaccatttggggactcttacattgtcataggagtcggggagaagaagatcacccatcactggcacaggagtggcagcaccattggaaaagcagaccttttgggacagcggtg

SEQ ID NO: 2172 - DNA, 140 bp, Artificial Sequence
  Synthetic
caccgctgtcccaaaaggtctgcttttccaatggtgctgccactcctgtgccagtgatgggtgatcttcttctccccgactcctatgacaatgtaagagtccccaaatggtggatcaagtcatatcagcagccagggcct

SEQ ID NO: 2173 - DNA, 140 bp, Artificial Sequence
  Synthetic
atacgccatgctgggtctcctttgaagccactgtgagaggtgccaagagaatggcagtcttgggagacacagcctgggattttggatcagttggaggtgctctcaactcattgggcaaggcgtacttgggagtcggccat

SEQ ID NO: 2174 - DNA, 140 bp, Artificial Sequence
  Synthetic
atggccgactcccaagtacgccttgcccaatgagttgagagcacctccaactgatccaaaatcccaggctgtgtctcccaagactgccattctcttggcacctctcacagtggcttcaaaggagacccagcatggcgtat

SEQ ID NO: 2175 - DNA, 140 bp, Artificial Sequence
  Synthetic
atacgccatgctgggtctccgcatccatcaaatttttggagcagctttcaaatcattgtttggaggaatgtcctggttctcacaaattctcattggaacgttgctggtgtggttgggtctcgtacttgggagtcggccat

SEQ ID NO: 2176 - DNA, 140 bp, Artificial Sequence
  Synthetic
atggccgactcccaagtacgagacccaaccacaccagcaacgttccaatgagaatttgtgagaaccaggacattcctccaaacaatgatttgaaagctgctccaaaaatttgatggatgcggagacccagcatggcgtat

SEQ ID NO: 2177 - DNA, 140 bp, Artificial Sequence
  Synthetic
aggccctggctgctgatatgtcctggttctcacaaattctcattggaacgttgctggtgtggttgggtctgaatacaaagaatggatctatttcccttacgtgcttggccttagggggaggaccttttgggacagcggtg

SEQ ID NO: 2178 - DNA, 140 bp, Artificial Sequence
  Synthetic
caccgctgtcccaaaaggtcctccccctaaggccaagcacgtaagggaaatagatccattctttgtattcagacccaaccacaccagcaacgttccaatgagaatttgtgagaaccaggacatatcagcagccagggcct

SEQ ID NO: 2179 - DNA, 140 bp, Artificial Sequence
  Synthetic
atacgccatgctgggtctcctgttgatctttttatccacagccgtctctgctgatgtggggtgctcggtggacttctcaaagaaggaaacgagatgcggtacgggggtgttcgtctataacgtacttgggagtcggccat

SEQ ID NO: 2180 - DNA, 140 bp, Artificial Sequence
  Synthetic
atggccgactcccaagtacgttatagacgaacacccccgtaccgcatctcgtttccttctttgagaagtccaccgagcaccccacatcagcagagacggctgtggataaaaagatcaacaggagacccagcatggcgtat

SEQ ID NO: 2181 - DNA, 140 bp, Artificial Sequence
  Synthetic
atacgccatgctgggtctcccgacgttgatgcctggagggacaggtacaagtaccatcctgactcccctcgtagattagcagcagcagtcaagcaagcctgggaagatgggatctgtgggcgtacttgggagtcggccat

SEQ ID NO: 2182 - DNA, 140 bp, Artificial Sequence
  Synthetic
atggccgactcccaagtacgcccacagatcccatcttcccaggcttgcttgactgctgctgctaatctacgaggggagtcaggatggtacttgtacctgtccctccaggcatcaacgtcgggagacccagcatggcgtat

SEQ ID NO: 2183 - DNA, 140 bp, Artificial Sequence
  Synthetic
atacgccatgctgggtctcccgacgttgatgcctggagggacaggtacaagtaccatcctgactcccctcgtagattagcagcagcagtcaagcaagcctgggtagatgggatctgtgggcgtacttgggagtcggccat

SEQ ID NO: 2184 - DNA, 140 bp, Artificial Sequence
  Synthetic
atggccgactcccaagtacgcccacagatcccatctacccaggcttgcttgactgctgctgctaatctacgaggggagtcaggatggtacttgtacctgtccctccaggcatcaacgtcgggagacccagcatggcgtat

SEQ ID NO: 2185 - DNA, 140 bp, Artificial Sequence
  Synthetic
atacgccatgctgggtctcccgacgttgatgcctggagggacaggtacaagtaccatcctgactcccctcgtagattagcagcagcagtcaagcaagcctgggcagatgggatctgtgggcgtacttgggagtcggccat

SEQ ID NO: 2186 - DNA, 140 bp, Artificial Sequence
  Synthetic
atggccgactcccaagtacgcccacagatcccatctgcccaggcttgcttgactgctgctgctaatctacgaggggagtcaggatggtacttgtacctgtccctccaggcatcaacgtcgggagacccagcatggcgtat

SEQ ID NO: 2187 - DNA, 140 bp, Artificial Sequence
  Synthetic
atacgccatgctgggtctcccgacgttgatgcctggagggacaggtacaagtaccatcctgactcccctcgtagattagcagcagcagtcaagcaagcctggggagatgggatctgtgggcgtacttgggagtcggccat

SEQ ID NO: 2188 - DNA, 140 bp, Artificial Sequence
  Synthetic
atggccgactcccaagtacgcccacagatcccatctccccaggcttgcttgactgctgctgctaatctacgaggggagtcaggatggtacttgtacctgtccctccaggcatcaacgtcgggagacccagcatggcgtat

SEQ ID NO: 2189 - DNA, 140 bp, Artificial Sequence
  Synthetic
atacgccatgctgggtctccagattattcattagagtgtgatccagccgttattggaacagctgctaagggaaaggaggctgtgcacagtgatctaggctactggattgagagtgagaagcgtacttgggagtcggccat

SEQ ID NO: 2190 - DNA, 140 bp, Artificial Sequence
  Synthetic
atggccgactcccaagtacgcttctcactctcaatccagtagcctagatcactgtgcacagcctcctttcccttagcagctgttccaataacggctggatcacactctaatgaataatctggagacccagcatggcgtat

SEQ ID NO: 2191 - DNA, 140 bp, Artificial Sequence
  Synthetic
aggccctggctgctgatatggaaaggaggctgtgcacagtgatctaggctactggattgagagtgagaagaatgacacatggaggctgaagagggcccacctgatcgagatgaaaacatggaccttttgggacagcggtg

SEQ ID NO: 2192 - DNA, 140 bp, Artificial Sequence
  Synthetic
caccgctgtcccaaaaggtccatgttttcatctcgatcaggtgggccctcttcagcctccatgtgtcattcttctcactctcaatccagtagcctagatcactgtgcacagcctcctttccatatcagcagccagggcct

SEQ ID NO: 2193 - DNA, 140 bp, Artificial Sequence
  Synthetic
aggccctggctgctgatatgtgaatggccaaagtcccacacattgtggacagatggaatagaagaaagtgatctgatcatacccaagtctttagctgggccactcagccatcacaacaccgaccttttgggacagcggtg

SEQ ID NO: 2194 - DNA, 140 bp, Artificial Sequence
  Synthetic
caccgctgtcccaaaaggtcggtgttgtgatggctgagtggcccagctaaagacttgggtatgatcagatcactttcttctattccatctgtccacaatgtgtgggactttggccattcacatatcagcagccagggcct

SEQ ID NO: 2195 - DNA, 140 bp, Artificial Sequence
  Synthetic
aggccctggctgctgatatgatctgatcatacccaagtctttagctgggccactcagccatcacaacaccagagagggctacaggactcaaatgaaagggccatggcacagtgaagagctgaccttttgggacagcggtg

SEQ ID NO: 2196 - DNA, 140 bp, Artificial Sequence
  Synthetic
caccgctgtcccaaaaggtcagctcttcactgtgccatggccctttcatttgagtcctgtagccctctctggtgttgtgatggctgagtggcccagctaaagacttgggtatgatcagatcatatcagcagccagggcct

SEQ ID NO: 2197 - DNA, 140 bp, Artificial Sequence
  Synthetic
aggccctggctgctgatatgcatgtggaacaagaggaccatctctgagatcaaccactgcaagcggaagggtgatcgaggaatggtgctgcagggaatgcacaatgcccccactgtcgttgaccttttgggacagcggtg

SEQ ID NO: 2198 - DNA, 140 bp, Artificial Sequence
  Synthetic
caccgctgtcccaaaaggtcaacgacagtgggggcattgtgcattccctgcagcaccattcctcgatcacccttccgcttgcagtggttgatctcagagatggtcctcttgttccacatgcatatcagcagccagggcct

SEQ ID NO: 2199 - DNA, 140 bp, Artificial Sequence
  Synthetic
atacgccatgctgggtctccgtgatcgaggaatggtgctgcagggaatgcacaatgcccccactgtcgttccgggctaaagatggctgttggtatggaatggagataaggcccaggaaagcgtacttgggagtcggccat

SEQ ID NO: 2200 - DNA, 140 bp, Artificial Sequence
  Synthetic
atggccgactcccaagtacgctttcctgggccttatctccattccataccaacagccatctttagcccggaacgacagtgggggcattgtgcattccctgcagcaccattcctcgatcacggagacccagcatggcgtat

SEQ ID NO: 2201 - DNA, 140 bp, Artificial Sequence
  Synthetic
aggccctggctgctgatatgggaagggctgaagaagagaatgaccacaaagatcatcataagcacatcaatggcagtgctggtagctatgatcctgggaggattttcaatgagtgacctggaccttttgggacagcggtg

SEQ ID NO: 2202 - DNA, 140 bp, Artificial Sequence
  Synthetic
caccgctgtcccaaaaggtccaggtcactcattgaaaatcctcccaggatcatagctaccagcactgccattgatgtgcttatgatgatctttgtggtcattctcttcttcagcccttcccatatcagcagccagggcct

SEQ ID NO: 2203 - DNA, 140 bp, Artificial Sequence
  Synthetic
atacgccatgctgggtctccgccaagcttgcaattttgatgggtgccacctttgcggaaatgaacactggaggagatgtagctcatctggcgctgatagcggcattcaaagtcagacctgcgtacttgggagtcggccat

SEQ ID NO: 2204 - DNA, 140 bp, Artificial Sequence
  Synthetic
atggccgactcccaagtacgcaggtctgactttgaatgccgctatcagcgccagatgagctacatctcctccagtgttcatttccgcaaaggtggcacccatcaaaattgcaagcttggcggagacccagcatggcgtat

SEQ ID NO: 2205 - DNA, 140 bp, Artificial Sequence
  Synthetic
atacgccatgctgggtctcccgttgctggtatctttcatcttcagagctaattggacaccccgtgagagcatgctgctggccctggcttcgtgtcttctgcaaactgcgatctccgccttcgtacttgggagtcggccat

SEQ ID NO: 2206 - DNA, 140 bp, Artificial Sequence
  Synthetic
atggccgactcccaagtacgaaggcggagatcgcagtttgcagaagacacgaagccagggccagcagcatgctctcacggggtgtccaattagctctgaagatgaaagataccagcaacgggagacccagcatggcgtat

SEQ ID NO: 2207 - DNA, 140 bp, Artificial Sequence
  Synthetic
atacgccatgctgggtctccggaaggcgacctgatggttctcatcaatggttttgctttggcctggttggcaatacgagcgatggttgttccacgcactgacaacatcaccttggcaatccgtacttgggagtcggccat

SEQ ID NO: 2208 - DNA, 140 bp, Artificial Sequence
  Synthetic
atggccgactcccaagtacggattgccaaggtgatgttgtcagtgcgtggaacaaccatcgctcgtattgccaaccaggccaaagcaaaaccattgatgagaaccatcaggtcgccttccggagacccagcatggcgtat

SEQ ID NO: 2209 - DNA, 140 bp, Artificial Sequence
  Synthetic
atacgccatgctgggtctccctgactgcgctgacaccactggcccggggcacgctgcttgtggcgtggagagcaggccttgctacttgcggggggttcatgcttctctctctgaaggggacgtacttgggagtcggccat

SEQ ID NO: 2210 - DNA, 140 bp, Artificial Sequence
  Synthetic
atggccgactcccaagtacgtccccttcagagagagaagcatgaaccccccgcaagtagcaaggcctgctctccacgccacaagcagcgtgccccgggccagtggtgtcagcgcagtcagggagacccagcatggcgtat

SEQ ID NO: 2211 - DNA, 140 bp, Artificial Sequence
  Synthetic
aggccctggctgctgatatgagcaggccttgctacttgcggggggttcatgcttctctctctgaaggggaagggcagtgtgaagaagaacctaccatttgtcatggccttgggactcaccgaccttttgggacagcggtg

SEQ ID NO: 2212 - DNA, 140 bp, Artificial Sequence
  Synthetic
caccgctgtcccaaaaggtcggtgagtcccaaggccatgacaaatggtaggttcttcttcacactgcccttccccttcagagagagaagcatgaaccccccgcaagtagcaaggcctgctcatatcagcagccagggcct

SEQ ID NO: 2213 - DNA, 140 bp, Artificial Sequence
  Synthetic
atacgccatgctgggtctccgctgtgaggctggtcgaccccatcaacgtggtgggactgctgttgctcacaaggagtgggaagcggagctggccccctagtgaagtactcacagctgttgcgtacttgggagtcggccat

SEQ ID NO: 2214 - DNA, 140 bp, Artificial Sequence
  Synthetic
atggccgactcccaagtacgcaacagctgtgagtacttcactagggggccagctccgcttcccactccttgtgagcaacagcagtcccaccacgttgatggggtcgaccagcctcacagcggagacccagcatggcgtat

SEQ ID NO: 2215 - DNA, 140 bp, Artificial Sequence
  Synthetic
aggccctggctgctgatatgaaggagtgggaagcggagctggccccctagtgaagtactcacagctgttggtctgatatgcgcgttggccggagggttcgccaaggcggatatagagatggaccttttgggacagcggtg

SEQ ID NO: 2216 - DNA, 140 bp, Artificial Sequence
  Synthetic
caccgctgtcccaaaaggtccatctctatatccgccttggcgaaccctccggccaacgcgcatatcagaccaacagctgtgagtacttcactagggggccagctccgcttcccactccttcatatcagcagccagggcct

SEQ ID NO: 2217 - DNA, 140 bp, Artificial Sequence
  Synthetic
aggccctggctgctgatatgaggaaagagtgtggacatgtacattgaaagagcaggtgacatcacatgggaaaaagatgcggaagtcactggaaacagtccccggctcgatgtggcactggaccttttgggacagcggtg

SEQ ID NO: 2218 - DNA, 140 bp, Artificial Sequence
  Synthetic
caccgctgtcccaaaaggtccagtgccacatcgagccggggactgtttccagtgacttccgcatctttttcccatgtgatgtcacctgctctttcaatgtacatgtccacactctttcctcatatcagcagccagggcct

SEQ ID NO: 2219 - DNA, 140 bp, Artificial Sequence
  Synthetic
atacgccatgctgggtctccgatgagagtggtgatttctccctagtggaggatgatggtccccccatgagagagatcatactcaaagtggtcctgatgaccatctgtggcatgaacccaacgtacttgggagtcggccat

SEQ ID NO: 2220 - DNA, 140 bp, Artificial Sequence
  Synthetic
atggccgactcccaagtacgttgggttcatgccacagatggtcatcaggaccactttgagtatgatctctctcatggggggaccatcatcctccactagggagaaatcaccactctcatcggagacccagcatggcgtat

SEQ ID NO: 2221 - DNA, 140 bp, Artificial Sequence
  Synthetic
atacgccatgctgggtctcctagccataccctttgcagctggagcgtggtacgtgtatgtgaagactggaaaaaggagtggtgctctatgggatgtgcctgctcccaaggaagtaaaaaacgtacttgggagtcggccat

SEQ ID NO: 2222 - DNA, 140 bp, Artificial Sequence
  Synthetic
atggccgactcccaagtacgttttttacttccttgggagcaggcacatcccatagagcaccactcctttttccagtcttcacatacacgtaccacgctccagctgcaaagggtatggctaggagacccagcatggcgtat

SEQ ID NO: 2223 - DNA, 140 bp, Artificial Sequence
  Synthetic
aggccctggctgctgatatgaaaaggagtggtgctctatgggatgtgcctgctcccaaggaagtaaaaaagggggagaccacagatggagtgtacagagtaatgactcgtagactgcttggaccttttgggacagcggtg

SEQ ID NO: 2224 - DNA, 140 bp, Artificial Sequence
  Synthetic
caccgctgtcccaaaaggtccaagcagtctacgagtcattactctgtacactccatctgtggtctcccccttttttacttccttgggagcaggcacatcccatagagcaccactccttttcatatcagcagccagggcct

SEQ ID NO: 2225 - DNA, 140 bp, Artificial Sequence
  Synthetic
atacgccatgctgggtctccgttcaacacaagttggagtgggagtcatgcaagagggggtcttccacactatgtggcacgtcacaaaaggatccgcgctgagaagcggtgaagggagactcgtacttgggagtcggccat

SEQ ID NO: 2226 - DNA, 140 bp, Artificial Sequence
  Synthetic
atggccgactcccaagtacgagtctcccttcaccgcttctcagcgcggatccttttgtgacgtgccacatagtgtggaagaccccctcttgcatgactcccactccaacttgtgttgaacggagacccagcatggcgtat

SEQ ID NO: 2227 - DNA, 140 bp, Artificial Sequence
  Synthetic
atacgccatgctgggtctcctgatccatactggggagatgtcaagcaggatctggtgtcatattgtggtccgtggaagctagacgccgcctgggacgggcacagcgaggtgcagctcttgcgtacttgggagtcggccat

SEQ ID NO: 2228 - DNA, 140 bp, Artificial Sequence
  Synthetic
atggccgactcccaagtacgcaagagctgcacctcgctgtgcccgtcccaggcggcgtctagcttccacggaccacaatatgacaccagatcctgcttgacatctccccagtatggatcaggagacccagcatggcgtat

SEQ ID NO: 2229 - DNA, 140 bp, Artificial Sequence
  Synthetic
atacgccatgctgggtctccgccgtgccccccggagagagagcgaggaacatccagactccgcccggaatatttaagacaaaggatggggacattggagcagttgcgttggactacccagcgtacttgggagtcggccat

SEQ ID NO: 2230 - DNA, 140 bp, Artificial Sequence
  Synthetic
atggccgactcccaagtacgctgggtagtccaacgcaactgctccaatgtccccatcctttgtcttaaatattccgggcggagtctggatgttcctcgctctctctccggggggcacggcggagacccagcatggcgtat

SEQ ID NO: 2231 - DNA, 140 bp, Artificial Sequence
  Synthetic
atacgccatgctgggtctcccaggaacttcaggatctccaatcctagacaagtgtgggagagtgataggactctatggtaatggggtcgtgataaaaaatgggagttatgttagtgccatcgtacttgggagtcggccat

SEQ ID NO: 2232 - DNA, 140 bp, Artificial Sequence
  Synthetic
atggccgactcccaagtacgatggcactaacataactcccattttttatcacgaccccattaccatagagtcctatcactctcccacacttgtctaggattggagatcctgaagttcctgggagacccagcatggcgtat

SEQ ID NO: 2233 - DNA, 140 bp, Artificial Sequence
  Synthetic
aggccctggctgctgatatgctctatggtaatggggtcgtgataaaaaatgggagttatgttagtgccatcacccaagggaggagggaggaagagactcctgttgagtgcttcgagccttgaccttttgggacagcggtg

SEQ ID NO: 2234 - DNA, 140 bp, Artificial Sequence
  Synthetic
caccgctgtcccaaaaggtcaaggctcgaagcactcaacaggagtctcttcctccctcctcccttgggtgatggcactaacataactcccattttttatcacgaccccattaccatagagcatatcagcagccagggcct

SEQ ID NO: 2235 - DNA, 140 bp, Artificial Sequence
  Synthetic
atacgccatgctgggtctcccgatgttgaagaagaagcagctaactgtcttagacctgcatcctggagctgggaaaaccaggagagttcttcctgaaatagtccgtgaagccataaaaaccgtacttgggagtcggccat

SEQ ID NO: 2236 - DNA, 140 bp, Artificial Sequence
  Synthetic
atggccgactcccaagtacggtttttatggcttcacggactatttcaggaagaactctcctggttttcccagctccaggatgcaggtctaagacagttagctgcttcttcttcaacatcgggagacccagcatggcgtat

SEQ ID NO: 2237 - DNA, 140 bp, Artificial Sequence
  Synthetic
aggccctggctgctgatatgtggaggaagcccttagagggcttccagtgcgttatatgacaacagcagtcaatgtcacccattctgggacagaaattgttgacttaatgtgccatgccacgaccttttgggacagcggtg

SEQ ID NO: 2238 - DNA, 140 bp, Artificial Sequence
  Synthetic
caccgctgtcccaaaaggtcgtggcatggcacattaagtcaacaatttctgtcccagaatgggtgacattgactgctgttgtcatataacgcactggaagccctctaagggcttcctccacatatcagcagccagggcct

SEQ ID NO: 2239 - DNA, 140 bp, Artificial Sequence
  Synthetic
atacgccatgctgggtctcccttcacttcacgtctactacaaccaatcagagtccccaactataatctgtatattatggacgaggcccacttcacagatccctcaagtatagcagcaagacgtacttgggagtcggccat

SEQ ID NO: 2240 - DNA, 140 bp, Artificial Sequence
  Synthetic
atggccgactcccaagtacgtcttgctgctatacttgagggatctgtgaagtgggcctcgtccataatatacagattatagttggggactctgattggttgtagtagacgtgaagtgaagggagacccagcatggcgtat

SEQ ID NO: 2241 - DNA, 140 bp, Artificial Sequence
  Synthetic
atacgccatgctgggtctccggatacatttcaacaagggttgagatgggcgaggcggccgccatcttcatgaccgccaccccaccaggaacccgtgacgcattcccggactccaactcaccgtacttgggagtcggccat

SEQ ID NO: 2242 - DNA, 140 bp, Artificial Sequence
  Synthetic
atggccgactcccaagtacggtgagttggagtccgggaatgcgtcacgggttcctggtggggtggcggtcatgaagatggcggccgcctcgcccatctcaacccttgttgaaatgtatccggagacccagcatggcgtat

SEQ ID NO: 2243 - DNA, 140 bp, Artificial Sequence
  Synthetic
aggccctggctgctgatatgcgtgaggaacggcaatgagatcgcagcttgtctgacaaaggctggaaaacgggtcatacagctcagcagaaagacttttgagacagagttcctgaaaacagaccttttgggacagcggtg

SEQ ID NO: 2244 - DNA, 140 bp, Artificial Sequence
  Synthetic
caccgctgtcccaaaaggtctgttttcaggaactctgtctcaaaagtctttctgctgagctgtatgacccgttttccagcctttgtcagacaagctgcgatctcattgccgttcctcacgcatatcagcagccagggcct

SEQ ID NO: 2245 - DNA, 140 bp, Artificial Sequence
  Synthetic
atacgccatgctgggtctccgggtcatacagctcagcagaaagacttttgagacagagttcctgaaaacaaaaaatcaagagtgggacttcgtcgtgacaactgacatttcagagatgggcgtacttgggagtcggccat

SEQ ID NO: 2246 - DNA, 140 bp, Artificial Sequence
  Synthetic
atggccgactcccaagtacgcccatctctgaaatgtcagttgtcacgacgaagtcccactcttgattttttgttttcaggaactctgtctcaaaagtctttctgctgagctgtatgacccggagacccagcatggcgtat

SEQ ID NO: 2247 - DNA, 140 bp, Artificial Sequence
  Synthetic
aggccctggctgctgatatgacacatgccagcgctgcccagaggagggggcgcataggcaggaatcccaacaaacctggagatgagtatctgtatggaggtgggtgcgcagagactgatggaccttttgggacagcggtg

SEQ ID NO: 2248 - DNA, 140 bp, Artificial Sequence
  Synthetic
caccgctgtcccaaaaggtccatcagtctctgcgcacccacctccatacagatactcatctccaggtttgttgggattcctgcctatgcgccccctcctctgggcagcgctggcatgtgtcatatcagcagccagggcct

SEQ ID NO: 2249 - DNA, 140 bp, Artificial Sequence
  Synthetic
atacgccatgctgggtctccaagaccatgcacactggcttgaagcaagaatgcttcttgacaacatttacctccaagatggcctcatagcctcgctctatcgacctgaggccgacaaagtcgtacttgggagtcggccat

SEQ ID NO: 2250 - DNA, 140 bp, Artificial Sequence
  Synthetic
atggccgactcccaagtacgactttgtcggcctcaggtcgatagagcgaggctatgaggccatcttggaggtaaatgttgtcaagaagcattcttgcttcaagccagtgtgcatggtcttggagacccagcatggcgtat

SEQ ID NO: 2251 - DNA, 140 bp, Artificial Sequence
  Synthetic
aggccctggctgctgatatgctccaagatggcctcatagcctcgctctatcgacctgaggccgacaaagtagcagctattgagggagagttcaagcttaggacggagcaaaggaagacctgaccttttgggacagcggtg

SEQ ID NO: 2252 - DNA, 140 bp, Artificial Sequence
  Synthetic
caccgctgtcccaaaaggtcaggtcttcctttgctccgtcctaagcttgaactctccctcaatagctgctactttgtcggcctcaggtcgatagagcgaggctatgaggccatcttggagcatatcagcagccagggcct

SEQ ID NO: 2253 - DNA, 140 bp, Artificial Sequence
  Synthetic
aggccctggctgctgatatgttgtggaactcatgaaaagaggagatcttcctgtttggctggcctatcaggttgcatctgccggaataacctacacagatagaaaatggtgctttgatgggaccttttgggacagcggtg

SEQ ID NO: 2254 - DNA, 140 bp, Artificial Sequence
  Synthetic
caccgctgtcccaaaaggtcccatcaaagcaccattttctatctgtgtaggttattccggcagatgcaacctgataggccagccaaacaggaagatctcctcttttcatgagttccacaacatatcagcagccagggcct

SEQ ID NO: 2255 - DNA, 140 bp, Artificial Sequence
  Synthetic
atacgccatgctgggtctcccacgaccaacaacaccataatggaagacagtgtgccggcagaggtgtggaccagatacggagagaaaagagtgctcaaaccaaggtggatggacgccagacgtacttgggagtcggccat

SEQ ID NO: 2256 - DNA, 140 bp, Artificial Sequence
  Synthetic
atggccgactcccaagtacgtctggcgtccatccaccttggtttgagcactcttttctctccgtatctggtccacacctctgccggcacactgtcttccattatggtgttgttggtcgtgggagacccagcatggcgtat

SEQ ID NO: 2257 - DNA, 140 bp, Artificial Sequence
  Synthetic
atacgccatgctgggtctccgtttgttcagatcatgcggccctgaagtcattcaaagagtttgccgctgggaaaagaggagaggcctttggagtgatggaagccctgggaacattgccggcgtacttgggagtcggccat

SEQ ID NO: 2258 - DNA, 140 bp, Artificial Sequence
  Synthetic
atggccgactcccaagtacgccggcaatgttcccagggcttccatcactccaaaggcctctcctcttttcccagcggcaaactctttgaatgacttcagggccgcatgatctgaacaaacggagacccagcatggcgtat

SEQ ID NO: 2259 - DNA, 140 bp, Artificial Sequence
  Synthetic
atacgccatgctgggtctccgtttgttcagatcatgcggccctgaagtcattcaaagagtttgccgctgggaaaagaggagtggcctttggagtgatggaagccctgggaacattgccggcgtacttgggagtcggccat

SEQ ID NO: 2260 - DNA, 140 bp, Artificial Sequence
  Synthetic
atggccgactcccaagtacgccggcaatgttcccagggcttccatcactccaaaggccactcctcttttcccagcggcaaactctttgaatgacttcagggccgcatgatctgaacaaacggagacccagcatggcgtat

SEQ ID NO: 2261 - DNA, 140 bp, Artificial Sequence
  Synthetic
atacgccatgctgggtctccgtttgttcagatcatgcggccctgaagtcattcaaagagtttgccgctgggaaaagaggagcggcctttggagtgatggaagccctgggaacattgccggcgtacttgggagtcggccat

SEQ ID NO: 2262 - DNA, 140 bp, Artificial Sequence
  Synthetic
atggccgactcccaagtacgccggcaatgttcccagggcttccatcactccaaaggccgctcctcttttcccagcggcaaactctttgaatgacttcagggccgcatgatctgaacaaacggagacccagcatggcgtat

SEQ ID NO: 2263 - DNA, 140 bp, Artificial Sequence
  Synthetic
atacgccatgctgggtctccgtttgttcagatcatgcggccctgaagtcattcaaagagtttgccgctgggaaaagaggaggggcctttggagtgatggaagccctgggaacattgccggcgtacttgggagtcggccat

SEQ ID NO: 2264 - DNA, 140 bp, Artificial Sequence
  Synthetic
atggccgactcccaagtacgccggcaatgttcccagggcttccatcactccaaaggcccctcctcttttcccagcggcaaactctttgaatgacttcagggccgcatgatctgaacaaacggagacccagcatggcgtat

SEQ ID NO: 2265 - DNA, 140 bp, Artificial Sequence
  Synthetic
atacgccatgctgggtctccgacacatgacagagagattccaggaagccattgacaacctcgctgtgctcatgcgggcagagactggaagcaggccttacgaagccgcggcggcccaattcgtacttgggagtcggccat

SEQ ID NO: 2266 - DNA, 140 bp, Artificial Sequence
  Synthetic
atggccgactcccaagtacgaattgggccgccgcggcttcgtaaggcctgcttccagtctctgcccgcatgagcacagcgaggttgtcaatggcttcctggaatctctctgtcatgtgtcggagacccagcatggcgtat

SEQ ID NO: 2267 - DNA, 140 bp, Artificial Sequence
  Synthetic
atacgccatgctgggtctccgccggagaccttagagaccatcatgcttttggggttgctgggaacagtctcgctgggaatctttttcgtcttgatgcggaataagggcatcgggaagatgcgtacttgggagtcggccat

SEQ ID NO: 2268 - DNA, 140 bp, Artificial Sequence
  Synthetic
atggccgactcccaagtacgcatcttcccgatgcccttattccgcatcaagacgaaaaagattcccagcgagactgttcccagcaaccccaaaagcatgatggtctctaaggtctccggcggagacccagcatggcgtat

SEQ ID NO: 2269 - DNA, 140 bp, Artificial Sequence
  Synthetic
aggccctggctgctgatatgcgctgggaatctttttcgtcttgatgcggaataagggcatcgggaagatgggctttggaatggtgactcttggggccagcgcatggcttatgtggctctcgaccttttgggacagcggtg

SEQ ID NO: 2270 - DNA, 140 bp, Artificial Sequence
  Synthetic
caccgctgtcccaaaaggtcgagagccacataagccatgcgctggccccaagagtcaccattccaaagcccatcttcccgatgcccttattccgcatcaagacgaaaaagattcccagcgcatatcagcagccagggcct

SEQ ID NO: 2271 - DNA, 140 bp, Artificial Sequence
  Synthetic
atacgccatgctgggtctccaaccaaatggcaatcatcatcatgatagcagtgggtcttctgggtttgattaccgccaatgaacttggatggttggaaagaacaaagagtgacctaagcccgtacttgggagtcggccat

SEQ ID NO: 2272 - DNA, 140 bp, Artificial Sequence
  Synthetic
atggccgactcccaagtacgggcttaggtcactctttgttctttccaaccatccaagttcattggcggtaatcaaacccagaagacccactgctatcatgatgatgattgccatttggttggagacccagcatggcgtat

SEQ ID NO: 2273 - DNA, 140 bp, Artificial Sequence
  Synthetic
aggccctggctgctgatatgtaccgccaatgaacttggatggttggaaagaacaaagagtgacctaagccatctaatgggaaggagagaggagggggcaaccataggattctcaatggacgaccttttgggacagcggtg

SEQ ID NO: 2274 - DNA, 140 bp, Artificial Sequence
  Synthetic
caccgctgtcccaaaaggtcgtccattgagaatcctatggttgccccctcctctctccttcccattagatggcttaggtcactctttgttctttccaaccatccaagttcattggcggtacatatcagcagccagggcct

SEQ ID NO: 2275 - DNA, 140 bp, Artificial Sequence
  Synthetic
atacgccatgctgggtctccattgacctgcggccagcctcagcttgggctatctatgctgctctgacaactttcatcaccccagccgtccaacatgcggtgaccacttcatacaacaactcgtacttgggagtcggccat

SEQ ID NO: 2276 - DNA, 140 bp, Artificial Sequence
  Synthetic
atggccgactcccaagtacgagttgttgtatgaagtggtcaccgcatgttggacggctggggtgatgaaagttgtcagagcagcatagatagcccaagctgaggctggccgcaggtcaatggagacccagcatggcgtat

SEQ ID NO: 2277 - DNA, 140 bp, Artificial Sequence
  Synthetic
atacgccatgctgggtctccactccttaatggcgatggccacgcaagctggagtgttgtttggtatgggtaaagggatgccattctacgcatgggactttggagtcccgctgctaatgatcgtacttgggagtcggccat

SEQ ID NO: 2278 - DNA, 140 bp, Artificial Sequence
  Synthetic
atggccgactcccaagtacgatcattagcagcgggactccaaagtcccatgcgtagaatggcatccctttacccataccaaacaacactccagcttgcgtggccatcgccattaaggagtggagacccagcatggcgtat

SEQ ID NO: 2279 - DNA, 140 bp, Artificial Sequence
  Synthetic
aggccctggctgctgatatgaaagggatgccattctacgcatgggactttggagtcccgctgctaatgatgggttgctactcacaattaacacccctgaccctaatagtggccatcatttgaccttttgggacagcggtg

SEQ ID NO: 2280 - DNA, 140 bp, Artificial Sequence
  Synthetic
caccgctgtcccaaaaggtcaaatgatggccactattagggtcaggggtgttaattgtgagtagcaacccatcattagcagcgggactccaaagtcccatgcgtagaatggcatccctttcatatcagcagccagggcct

SEQ ID NO: 2281 - DNA, 140 bp, Artificial Sequence
  Synthetic
atacgccatgctgggtctcctgtggatggaatagtggtgactgacattgacacaatgacaattgaccaccgagtggagaaaaagatgggacaggtgctactcatagcagtagccgtctcccgtacttgggagtcggccat

SEQ ID NO: 2282 - DNA, 140 bp, Artificial Sequence
  Synthetic
atggccgactcccaagtacgggagacggctactgctatgagtagcacctgtcccatctttttctccactcggtggtcaattgtcattgtgtcaatgtcagtcaccactattccatccacaggagacccagcatggcgtat

SEQ ID NO: 2283 - DNA, 140 bp, Artificial Sequence
  Synthetic
aggccctggctgctgatatgagcgccatactgtcgcggaccgcctgggggtggggggaggctggggccctgatcacagctgcaacttccactttgtgggaaggctctccgaacaagtactgaccttttgggacagcggtg

SEQ ID NO: 2284 - DNA, 140 bp, Artificial Sequence
  Synthetic
caccgctgtcccaaaaggtcagtacttgttcggagagccttcccacaaagtggaagttgcagctgtgatcagggccccagcctccccccacccccaggcggtccgcgacagtatggcgctcatatcagcagccagggcct

SEQ ID NO: 2285 - DNA, 140 bp, Artificial Sequence
  Synthetic
aggccctggctgctgatatggatcacagctgcaacttccactttgtgggaaggctctccgaacaagtactggaactcctccacagccacttcactgtgtaacatttttaggggaagttacgaccttttgggacagcggtg

SEQ ID NO: 2286 - DNA, 140 bp, Artificial Sequence
  Synthetic
caccgctgtcccaaaaggtcgtaacttcccctaaaaatgttacacagtgaagtggctgtggaggagttccagtacttgttcggagagccttcccacaaagtggaagttgcagctgtgatccatatcagcagccagggcct

SEQ ID NO: 2287 - DNA, 140 bp, Artificial Sequence
  Synthetic
atacgccatgctgggtctccggaactcctccacagccacttcactgtgtaacatttttaggggaagttacttggctggagcttctctaatctacacagtaacaagaaacgctggcttggtcgtacttgggagtcggccat

SEQ ID NO: 2288 - DNA, 140 bp, Artificial Sequence
  Synthetic
atggccgactcccaagtacgaccaagccagcgtttcttgttactgtgtagattagagaagctccagccaagtaacttcccctaaaaatgttacacagtgaagtggctgtggaggagttccggagacccagcatggcgtat

SEQ ID NO: 2289 - DNA, 140 bp, Artificial Sequence
  Synthetic
aggccctggctgctgatatgttggctggagcttctctaatctacacagtaacaagaaacgctggcttggtcaagagacgtgggggtggaacgggagagaccctgggagagaaatggaagggaccttttgggacagcggtg

SEQ ID NO: 2290 - DNA, 140 bp, Artificial Sequence
  Synthetic
caccgctgtcccaaaaggtcccttccatttctctcccagggtctctcccgttccacccccacgtctcttgaccaagccagcgtttcttgttactgtgtagattagagaagctccagccaacatatcagcagccagggcct

SEQ ID NO: 2291 - DNA, 140 bp, Artificial Sequence
  Synthetic
atacgccatgctgggtctcccccgcctgaaccagatgtcggccctagagttctactcctacaaaaagtcaggcatcaccgaggtgtgcagagaagaggcccgccgcgccctcaaggacggcgtacttgggagtcggccat

SEQ ID NO: 2292 - DNA, 140 bp, Artificial Sequence
  Synthetic
atggccgactcccaagtacgccgtccttgagggcgcggcgggcctcttctctgcacacctcggtgatgcctgactttttgtaggagtagaactctagggccgacatctggttcaggcgggggagacccagcatggcgtat

SEQ ID NO: 2293 - DNA, 140 bp, Artificial Sequence
  Synthetic
aggccctggctgctgatatgggcatcaccgaggtgtgcagagaagaggcccgccgcgccctcaaggacggtgtggcaacaggaggccatgctgtgtcccgaggaagtgcaaagcttagatgaccttttgggacagcggtg

SEQ ID NO: 2294 - DNA, 140 bp, Artificial Sequence
  Synthetic
caccgctgtcccaaaaggtcatctaagctttgcacttcctcgggacacagcatggcctcctgttgccacaccgtccttgagggcgcggcgggcctcttctctgcacacctcggtgatgcccatatcagcagccagggcct

SEQ ID NO: 2295 - DNA, 140 bp, Artificial Sequence
  Synthetic
atacgccatgctgggtctccggttggtggagagaggatacctgcagccctatggaaaggtcattgatcttggatgtggcagagggggctggagttactacgccgccaccatccgcaaagtcgtacttgggagtcggccat

SEQ ID NO: 2296 - DNA, 140 bp, Artificial Sequence
  Synthetic
atggccgactcccaagtacgactttgcggatggtggcggcgtagtaactccagccccctctgccacatccaagatcaatgacctttccatagggctgcaggtatcctctctccaccaaccggagacccagcatggcgtat

SEQ ID NO: 2297 - DNA, 140 bp, Artificial Sequence
  Synthetic
atacgccatgctgggtctcctcaagaagtgaaaggatacacaaaaggaggccctggtcatgaagaacccatgttggtgcaaagctatgggtggaacatagtccgtcttaagagtggggtgcgtacttgggagtcggccat

SEQ ID NO: 2298 - DNA, 140 bp, Artificial Sequence
  Synthetic
atggccgactcccaagtacgcaccccactcttaagacggactatgttccacccatagctttgcaccaacatgggttcttcatgaccagggcctccttttgtgtatcctttcacttcttgaggagacccagcatggcgtat

SEQ ID NO: 2299 - DNA, 140 bp, Artificial Sequence
  Synthetic
atacgccatgctgggtctccgacgtctttcatatggcggctgagccgtgtgacactttgctgtgtgatataggtgagtcatcatctagtcctgaagtggaagaagcacggacgctcagagcgtacttgggagtcggccat

SEQ ID NO: 2300 - DNA, 140 bp, Artificial Sequence
  Synthetic
atggccgactcccaagtacgctctgagcgtccgtgcttcttccacttcaggactagatgatgactcacctatatcacacagcaaagtgtcacacggctcagccgccatatgaaagacgtcggagacccagcatggcgtat

SEQ ID NO: 2301 - DNA, 140 bp, Artificial Sequence
  Synthetic
aggccctggctgctgatatgaggtgagtcatcatctagtcctgaagtggaagaagcacggacgctcagagtcctttccatggtgggggattggcttgaaaaaagaccaggagccttttgtgaccttttgggacagcggtg

SEQ ID NO: 2302 - DNA, 140 bp, Artificial Sequence
  Synthetic
caccgctgtcccaaaaggtcacaaaaggctcctggtcttttttcaagccaatcccccaccatggaaaggactctgagcgtccgtgcttcttccacttcaggactagatgatgactcacctcatatcagcagccagggcct

SEQ ID NO: 2303 - DNA, 140 bp, Artificial Sequence
  Synthetic
aggccctggctgctgatatgaaaagtgtgtccaccacgagccagctcctcttggggcgcatggacgggcccaggaggccagtgaaatatgaggaggatgtgaatctcggctccggcacgcgaccttttgggacagcggtg

SEQ ID NO: 2304 - DNA, 140 bp, Artificial Sequence
  Synthetic
caccgctgtcccaaaaggtcgcgtgccggagccgagattcacatcctcctcatatttcactggcctcctgggcccgtccatgcgccccaagaggagctggctcgtggtggacacacttttcatatcagcagccagggcct

SEQ ID NO: 2305 - DNA, 140 bp, Artificial Sequence
  Synthetic
aggccctggctgctgatatggggctgtggtaagctgcgctgaagctcccaacatgaagatcattggtaaccgcattgagaggatccgcagtgagcacgcggaaacgtggttctttgacgagaccttttgggacagcggtg

SEQ ID NO: 2306 - DNA, 140 bp, Artificial Sequence
  Synthetic
caccgctgtcccaaaaggtctcgtcaaagaaccacgtttccgcgtgctcactgcggatcctctcaatgcggttaccaatgatcttcatgttgggagcttcagcgcagcttaccacagccccatatcagcagccagggcct

SEQ ID NO: 2307 - DNA, 140 bp, Artificial Sequence
  Synthetic
atacgccatgctgggtctccgaaccacccatataggacatgggcttaccatggaagctatgaggcccctacacaagggtcagcgtcctctctaataaacggggttgtcaggctcctgtcacgtacttgggagtcggccat

SEQ ID NO: 2308 - DNA, 140 bp, Artificial Sequence
  Synthetic
atggccgactcccaagtacgtgacaggagcctgacaaccccgtttattagagaggacgctgacccttgtgtaggggcctcatagcttccatggtaagcccatgtcctatatgggtggttcggagacccagcatggcgtat

SEQ ID NO: 2309 - DNA, 140 bp, Artificial Sequence
  Synthetic
aggccctggctgctgatatgtgccagacccccaagaaggcactcgtcaggttatgagcatggtctcttcctggttatggaaagagctaggcaaacacaaacggccacgagtctgtaccaagaccttttgggacagcggtg

SEQ ID NO: 2310 - DNA, 140 bp, Artificial Sequence
  Synthetic
caccgctgtcccaaaaggtcttggtacagactcgtggccgtttgtgtttgcctagctctttccataaccaggaagagaccatgctcataacctgacgagtgccttcttgggggtctggcacatatcagcagccagggcct

SEQ ID NO: 2311 - DNA, 140 bp, Artificial Sequence
  Synthetic
atacgccatgctgggtctccgtgtcagagctgtgtgtacaacatgatgggaaaaagagaaaagaaacaaggggaatttggaaaggccaagggcagccgcgccatctggtatatgtggctacgtacttgggagtcggccat

SEQ ID NO: 2312 - DNA, 140 bp, Artificial Sequence
  Synthetic
atggccgactcccaagtacgtagccacatataccagatggcgcggctgcccttggcctttccaaattccccttgtttcttttctctttttcccatcatgttgtacacacagctctgacacggagacccagcatggcgtat

SEQ ID NO: 2313 - DNA, 140 bp, Artificial Sequence
  Synthetic
aggccctggctgctgatatggggaatttggaaaggccaagggcagccgcgccatctggtatatgtggctaggggctagattcctggagttcgaagcccttggattcttgaacgaggatcagaccttttgggacagcggtg

SEQ ID NO: 2314 - DNA, 140 bp, Artificial Sequence
  Synthetic
caccgctgtcccaaaaggtctgatcctcgttcaagaatccaagggcttcgaactccaggaatctagcccctagccacatataccagatggcgcggctgcccttggcctttccaaattccccatatcagcagccagggcct

SEQ ID NO: 2315 - DNA, 140 bp, Artificial Sequence
  Synthetic
atacgccatgctgggtctccctggatggggagagagaattcaggaggtggtgttgaagggctgggattacaaagactcggatatgtcctagaagagatgagtcgcataccaggaggaaggcgtacttgggagtcggccat

SEQ ID NO: 2316 - DNA, 140 bp, Artificial Sequence
  Synthetic
atggccgactcccaagtacgccttcctcctggtatgcgactcatctcttctaggacatatccgagtctttgtaatcccagcccttcaacaccacctcctgaattctctctccccatccagggagacccagcatggcgtat

SEQ ID NO: 2317 - DNA, 140 bp, Artificial Sequence
  Synthetic
aggccctggctgctgatatgaaagactcggatatgtcctagaagagatgagtcgcataccaggaggaaggatgtatgctgatgacacagctggctgggacacccgcatcagcaggtttgagaccttttgggacagcggtg

SEQ ID NO: 2318 - DNA, 140 bp, Artificial Sequence
  Synthetic
caccgctgtcccaaaaggtctcaaacctgctgatgcgggtgtcccagccagctgtgtcatcagcatacatccttcctcctggtatgcgactcatctcttctaggacatatccgagtctttcatatcagcagccagggcct

SEQ ID NO: 2319 - DNA, 140 bp, Artificial Sequence
  Synthetic
atacgccatgctgggtctccgtcctcagaccagctgaaaaagggaagacagttatggacattatttcaagacaagaccaaagggggagcggacaagttgtcacttacgctcttaatacatcgtacttgggagtcggccat

SEQ ID NO: 2320 - DNA, 140 bp, Artificial Sequence
  Synthetic
atggccgactcccaagtacgatgtattaagagcgtaagtgacaacttgtccgctccccctttggtcttgtcttgaaataatgtccataactgtcttccctttttcagctggtctgaggacggagacccagcatggcgtat

SEQ ID NO: 2321 - DNA, 140 bp, Artificial Sequence
  Synthetic
aggccctggctgctgatatggagatgattgcgttgtgaaaccaattgatgataggtttgcacatgccctcaggttcttgaatgatatgggaaaagtcaggaaggacacacaagagtggaagaccttttgggacagcggtg

SEQ ID NO: 2322 - DNA, 140 bp, Artificial Sequence
  Synthetic
caccgctgtcccaaaaggtcttccactcttgtgtgtccttcctgacttttcccatatcattcaagaacctgagggcatgtgcaaacctatcatcaattggtttcacaacgcaatcatctccatatcagcagccagggcct

SEQ ID NO: 2323 - DNA, 140 bp, Artificial Sequence
  Synthetic
atacgccatgctgggtctccaggttcttgaatgatatgggaaaagtcaggaaggacacacaagagtggaaaccctcaactggatgggacaattgggaagaagttccgttttgctcccacccgtacttgggagtcggccat

SEQ ID NO: 2324 - DNA, 140 bp, Artificial Sequence
  Synthetic
atggccgactcccaagtacgggtgggagcaaaacggaacttcttcccaattgtcccatccagttgagggtttccactcttgtgtgtccttcctgacttttcccatatcattcaagaacctggagacccagcatggcgtat

SEQ ID NO: 2325 - DNA, 140 bp, Artificial Sequence
  Synthetic
atacgccatgctgggtctccacttcaacaagctccatctcaaggacgggaggtccattgtggttccctgccgccaccaagatgaactgattggccgagcccgcgtctcaccaggggcgggcgtacttgggagtcggccat

SEQ ID NO: 2326 - DNA, 140 bp, Artificial Sequence
  Synthetic
atggccgactcccaagtacgcccgcccctggtgagacgcgggctcggccaatcagttcatcttggtggcggcagggaaccacaatggacctcccgtccttgagatggagcttgttgaagtggagacccagcatggcgtat

SEQ ID NO: 2327 - DNA, 140 bp, Artificial Sequence
  Synthetic
aggccctggctgctgatatgccagttacgaaatggacagacattccctatttgggaaaaagggaagacttgtggtgtggatctctcatagggcacagaccgcgcactacctgggctgagagaccttttgggacagcggtg

SEQ ID NO: 2328 - DNA, 140 bp, Artificial Sequence
  Synthetic
caccgctgtcccaaaaggtctctcagcccaggtagtgcgcggtctgtgccctatgagagatccacaccacaagtcttccctttttcccaaatagggaatgtctgtccatttcgtaactggcatatcagcagccagggcct

SEQ ID NO: 2329 - DNA, 140 bp, Artificial Sequence
  Synthetic
atacgccatgctgggtctccacatcaaaaacacagtcaacatgatgcgcaggatcataggtgatgaagaaaagtacatggactacctatccacccaagttcgctacttgggtgaagaaggcgtacttgggagtcggccat

SEQ ID NO: 2330 - DNA, 140 bp, Artificial Sequence
  Synthetic
atggccgactcccaagtacgccttcttcacccaagtagcgaacttgggtggataggtagtccatgtacttttcttcatcacctatgatcctgcgcatcatgttgactgtgtttttgatgtggagacccagcatggcgtat

SEQ ID NO: 2331 - DNA, 140 bp, Artificial Sequence
  Synthetic
aggccctggctgctgatatggatgcgcaggatcataggtgatgaagaaaagtacatggactacctatccacccaagttcgctacttgggtgaagaagggtccacacccggagtgttgtaagaccttttgggacagcggtg

SEQ ID NO: 2332 - DNA, 140 bp, Artificial Sequence
  Synthetic
caccgctgtcccaaaaggtcttacaacactccgggtgtggacccttcttcacccaagtagcgaacttgggtggataggtagtccatgtacttttcttcatcacctatgatcctgcgcatccatatcagcagccagggcct

SEQ ID NO: 2333 - DNA, 140 bp, Artificial Sequence
  Synthetic
aggccctggctgctgatatggacagttcgagtttgaagcgaaagctagcaacagtatcaacaggttttatttggatttggaaacgagagtttctggtcatgaaaaacccaaaaaagaaatgaccttttgggacagcggtg

SEQ ID NO: 2334 - DNA, 140 bp, Artificial Sequence
  Synthetic
caccgctgtcccaaaaggtcatttcttttttgggtttttcatgaccagaaactctcgtttccaaatccaaataaaacctgttgatactgttgctagctttcgcttcaaactcgaactgtccatatcagcagccagggcct

SEQ ID NO: 2335 - DNA, 140 bp, Artificial Sequence
  Synthetic
aggccctggctgctgatatgttggatttggaaacgagagtttctggtcatgaaaaacccaaaaaagaaatccggaggattccggattgtcaatatgctaaaacgcggagtagcccgtgtggaccttttgggacagcggtg

SEQ ID NO: 2336 - DNA, 140 bp, Artificial Sequence
  Synthetic
caccgctgtcccaaaaggtccacacgggctactccgcgttttagcatattgacaatccggaatcctccggatttcttttttgggtttttcatgaccagaaactctcgtttccaaatccaacatatcagcagccagggcct

SEQ ID NO: 2337 - DNA, 140 bp, Artificial Sequence
  Synthetic
aggccctggctgctgatatgcaatcaagccatcactgggtctcatcaatagatggggttcagtggggaaaaaagaggctatggaaataataaagaagttcaagaaagatctggctgccatgaccttttgggacagcggtg

SEQ ID NO: 2338 - DNA, 140 bp, Artificial Sequence
  Synthetic
caccgctgtcccaaaaggtcatggcagccagatctttcttgaacttctttattatttccatagcctcttttttccccactgaaccccatctattgatgagacccagtgatggcttgattgcatatcagcagccagggcct

SEQ ID NO: 2339 - DNA, 140 bp, Artificial Sequence
  Synthetic
aggccctggctgctgatatgaaagaggctatggaaataataaagaagttcaagaaagatctggctgccatgctgagaataatcaatgctaggaaggagaagaagagacgaggcgcagatagaccttttgggacagcggtg

SEQ ID NO: 2340 - DNA, 140 bp, Artificial Sequence
  Synthetic
caccgctgtcccaaaaggtctatctgcgcctcgtctcttcttctccttcctagcattgattattctcagcatggcagccagatctttcttgaacttctttattatttccatagcctctttcatatcagcagccagggcct

SEQ ID NO: 2341 - DNA, 140 bp, Artificial Sequence
  Synthetic
aggccctggctgctgatatgctagtgtcggaattgttggcctcctgctgaccacagctatggcagcggaggtcactagacgtgggagtgcatactatatgtacttggacagaaacgatgcgaccttttgggacagcggtg

SEQ ID NO: 2342 - DNA, 140 bp, Artificial Sequence
  Synthetic
caccgctgtcccaaaaggtcgcatcgtttctgtccaagtacatatagtatgcactcccacgtctagtgacctccgctgccatagctgtggtcagcaggaggccaacaattccgacactagcatatcagcagccagggcct

SEQ ID NO: 2343 - DNA, 140 bp, Artificial Sequence
  Synthetic
aggccctggctgctgatatgaggaagctgcaaacgcggtcgcaaacctggttggaatcaagagaatacacaaagcacttgattagagtcgaaaattggatattcaggaaccctggcttcggaccttttgggacagcggtg

SEQ ID NO: 2344 - DNA, 140 bp, Artificial Sequence
  Synthetic
caccgctgtcccaaaaggtccgaagccagggttcctgaatatccaattttcgactctaatcaagtgctttgtgtattctcttgattccaaccaggtttgcgaccgcgtttgcagcttcctcatatcagcagccagggcct

SEQ ID NO: 2345 - DNA, 140 bp, Artificial Sequence
  Synthetic
aggccctggctgctgatatgaaagtcatatacttggtcatgatactgctgattgccccggcatacagcatcaggtgcataggagtcagcaatagggactttgtggaaggtatgtcaggtggaccttttgggacagcggtg

SEQ ID NO: 2346 - DNA, 140 bp, Artificial Sequence
  Synthetic
caccgctgtcccaaaaggtccacctgacataccttccacaaagtccctattgctgactcctatgcacctgatgctgtatgccggggcaatcagcagtatcatgaccaagtatatgactttcatatcagcagccagggcct

SEQ ID NO: 2347 - DNA, 140 bp, Artificial Sequence
  Synthetic
atacgccatgctgggtctccgcacaggacaaaccgactgtcgacatagagctggttacaacaacagtcagcaacatggcggaggtaagatcctactgctatgaggcatcaatatcagacacgtacttgggagtcggccat

SEQ ID NO: 2348 - DNA, 140 bp, Artificial Sequence
  Synthetic
atggccgactcccaagtacgtgtctgatattgatgcctcatagcagtaggatcttacctccgccatgttgctgactgttgttgtaaccagctctatgtcgacagtcggtttgtcctgtgcggagacccagcatggcgtat

SEQ ID NO: 2349 - DNA, 140 bp, Artificial Sequence
  Synthetic
aggccctggctgctgatatggggaaatggatgtggactttttggcaaagggagcctggtgacatgcgctaagtttgcatgctccaagaaaatgaccgggaagagcatccagccagagaatgaccttttgggacagcggtg

SEQ ID NO: 2350 - DNA, 140 bp, Artificial Sequence
  Synthetic
caccgctgtcccaaaaggtcattctctggctggatgctcttcccggtcattttcttggagcatgcaaacttagcgcatgtcaccaggctccctttgccaaaaagtccacatccatttccccatatcagcagccagggcct

SEQ ID NO: 2351 - DNA, 140 bp, Artificial Sequence
  Synthetic
aggccctggctgctgatatggcactgagaactctaagatgatgctggaacttgatccaccatttggggactcttacattgtcataggagtcggggagaagaagatcacccaccactggcagaccttttgggacagcggtg

SEQ ID NO: 2352 - DNA, 140 bp, Artificial Sequence
  Synthetic
caccgctgtcccaaaaggtctgccagtggtgggtgatcttcttctccccgactcctatgacaatgtaagagtccccaaatggtggatcaagttccagcatcatcttagagttctcagtgccatatcagcagccagggcct

SEQ ID NO: 2353 - DNA, 140 bp, Artificial Sequence
  Synthetic
aggccctggctgctgatatgcaggagtggcagcaccattggaaaagcatttgaagccactgtgagaggtgccaagagaatggcagtcttgggagacacagcctgggactttggatcagttgaccttttgggacagcggtg

SEQ ID NO: 2354 - DNA, 140 bp, Artificial Sequence
  Synthetic
caccgctgtcccaaaaggtcaactgatccaaagtcccaggctgtgtctcccaagactgccattctcttggcacctctcacagtggcttcaaatgcttttccaatggtgctgccactcctgcatatcagcagccagggcct

SEQ ID NO: 2355 - DNA, 140 bp, Artificial Sequence
  Synthetic
aggccctggctgctgatatgttggaacgttgctgatgtggttgggtctgaacacaaagaatggatctatttcccttatgtgcttggccttagggggagtgttgatcttcttatccacagcgaccttttgggacagcggtg

SEQ ID NO: 2356 - DNA, 140 bp, Artificial Sequence
  Synthetic
caccgctgtcccaaaaggtcgctgtggataagaagatcaacactccccctaaggccaagcacataagggaaatagatccattctttgtgttcagacccaaccacatcagcaacgttccaacatatcagcagccagggcct

SEQ ID NO: 2357 - DNA, 140 bp, Artificial Sequence
  Synthetic
aggccctggctgctgatatgaaaacatcatgtggagatcagtagaaggggagctcaacgcaatcctggaagagaatggagttcaactgacggtcgttgtgggatctgtaaaaaaccccatgaccttttgggacagcggtg

SEQ ID NO: 2358 - DNA, 140 bp, Artificial Sequence
  Synthetic
caccgctgtcccaaaaggtcatggggttttttacagatcccacaacgaccgtcagttgaactccattctcttccaggattgcgttgagctccccttctactgatctccacatgatgttttcatatcagcagccagggcct

SEQ ID NO: 2359 - DNA, 140 bp, Artificial Sequence
  Synthetic
atacgccatgctgggtctccgtggagaggtccacagagattgcccgtgcctgtgaacgagctgccccacggctggaaggcttgggggaaatcgtacttcgtcagagcagcaaagacaaatcgtacttgggagtcggccat

SEQ ID NO: 2360 - DNA, 140 bp, Artificial Sequence
  Synthetic
atggccgactcccaagtacgatttgtctttgctgctctgacgaagtacgatttcccccaagccttccagccgtggggcagctcgttcacaggcacgggcaatctctgtggacctctccacggagacccagcatggcgtat

SEQ ID NO: 2361 - DNA, 140 bp, Artificial Sequence
  Synthetic
aggccctggctgctgatatgtagagcatggaacagctttcttgtggaggatcatgggttcggggtatttcacactagtgtctggctcaaggttagagaagattattcattagagtgtgatgaccttttgggacagcggtg

SEQ ID NO: 2362 - DNA, 140 bp, Artificial Sequence
  Synthetic
caccgctgtcccaaaaggtcatcacactctaatgaataatcttctctaaccttgagccagacactagtgtgaaataccccgaacccatgatcctccacaagaaagctgttccatgctctacatatcagcagccagggcct

SEQ ID NO: 2363 - DNA, 140 bp, Artificial Sequence
  Synthetic
aggccctggctgctgatatgagctgggccactcagccatcacaataccagagagggctacaggacccaaatgaaagggccatggcacagtgaagagcttgaaattcggtttgaggaatgcgaccttttgggacagcggtg

SEQ ID NO: 2364 - DNA, 140 bp, Artificial Sequence
  Synthetic
caccgctgtcccaaaaggtcgcattcctcaaaccgaatttcaagctcttcactgtgccatggccctttcatttgggtcctgtagccctctctggtattgtgatggctgagtggcccagctcatatcagcagccagggcct

SEQ ID NO: 2365 - DNA, 140 bp, Artificial Sequence
  Synthetic
aggccctggctgctgatatggagtgcttgtgattctgctcatggtgcaggaagggctgaagaagagaatgaccacaaagatcatcataagcacatcaatggcagtgctggtagctatgatgaccttttgggacagcggtg

SEQ ID NO: 2366 - DNA, 140 bp, Artificial Sequence
  Synthetic
caccgctgtcccaaaaggtcatcatagctaccagcactgccattgatgtgcttatgatgatctttgtggtcattctcttcttcagcccttcctgcaccatgagcagaatcacaagcactccatatcagcagccagggcct

SEQ ID NO: 2367 - DNA, 140 bp, Artificial Sequence
  Synthetic
aggccctggctgctgatatgaccacaaagatcatcataagcacatcaatggcagtgctggtagctatgatcctgggaggattttcaatgagtgacctggctaagcttgcaattttgatgggaccttttgggacagcggtg

SEQ ID NO: 2368 - DNA, 140 bp, Artificial Sequence
  Synthetic
caccgctgtcccaaaaggtcccatcaaaattgcaagcttagccaggtcactcattgaaaatcctcccaggatcatagctaccagcactgccattgatgtgcttatgatgatctttgtggtcatatcagcagccagggcct

SEQ ID NO: 2369 - DNA, 140 bp, Artificial Sequence
  Synthetic
aggccctggctgctgatatggggtttatgctcctctctctgaagggaaaaggcagtgtgaagaagaacttaccatttgtcatggccctgggactaaccgctgtgaggctggtcgaccccagaccttttgggacagcggtg

SEQ ID NO: 2370 - DNA, 140 bp, Artificial Sequence
  Synthetic
caccgctgtcccaaaaggtctggggtcgaccagcctcacagcggttagtcccagggccatgacaaatggtaagttcttcttcacactgccttttcccttcagagagaggagcataaaccccatatcagcagccagggcct

SEQ ID NO: 2371 - DNA, 140 bp, Artificial Sequence
  Synthetic
aggccctggctgctgatatgccgcgctgagaagcggtgaagggagacttgatccatactggggagatgtcaagcaggatctggtgtcatactgtggtccatggaagctagatgccgcctggaccttttgggacagcggtg

SEQ ID NO: 2372 - DNA, 140 bp, Artificial Sequence
  Synthetic
caccgctgtcccaaaaggtccaggcggcatctagcttccatggaccacagtatgacaccagatcctgcttgacatctccccagtatggatcaagtctcccttcaccgcttctcagcgcggcatatcagcagccagggcct

SEQ ID NO: 2373 - DNA, 140 bp, Artificial Sequence
  Synthetic
aggccctggctgctgatatggctccaaccagggttgtcgctgctgaaatggaggaggcccttagagggcttccagtgcgttatatgacaacagcagtcaatgtcacccactctggaacaggaccttttgggacagcggtg

SEQ ID NO: 2374 - DNA, 140 bp, Artificial Sequence
  Synthetic
caccgctgtcccaaaaggtcctgttccagagtgggtgacattgactgctgttgtcatataacgcactggaagccctctaagggcctcctccatttcagcagcgacaaccctggttggagccatatcagcagccagggcct

SEQ ID NO: 2375 - DNA, 140 bp, Artificial Sequence
  Synthetic
atacgccatgctgggtctcctccagtgcgttatatgacaacagcagtcaatgtcacccactctggaacagaaatcgtcgacttaatgtgccatgccaccttcacttcacgtctactacagcgtacttgggagtcggccat

SEQ ID NO: 2376 - DNA, 140 bp, Artificial Sequence
  Synthetic
atggccgactcccaagtacgctgtagtagacgtgaagtgaaggtggcatggcacattaagtcgacgatttctgttccagagtgggtgacattgactgctgttgtcatataacgcactggaggagacccagcatggcgtat

SEQ ID NO: 2377 - DNA, 140 bp, Artificial Sequence
  Synthetic
atacgccatgctgggtctcctcgtgacaactgacatttcagagatgggcgccaactttaaagctgaccgtgtcatagattccaggagatgcctaaagccggtcatacttgatggcgagagcgtacttgggagtcggccat

SEQ ID NO: 2378 - DNA, 140 bp, Artificial Sequence
  Synthetic
atggccgactcccaagtacgctctcgccatcaagtatgaccggctttaggcatctcctggaatctatgacacggtcagctttaaagttggcgcccatctctgaaatgtcagttgtcacgaggagacccagcatggcgtat

SEQ ID NO: 2379 - DNA, 140 bp, Artificial Sequence
  Synthetic
atacgccatgctgggtctccgaagacagtgtgccggcagaggtgtggaccagacacggagagaaaagagtgctcaaaccgaggtggatggacgccagagtttgttcagatcatgcggccccgtacttgggagtcggccat

SEQ ID NO: 2380 - DNA, 140 bp, Artificial Sequence
  Synthetic
atggccgactcccaagtacggggccgcatgatctgaacaaactctggcgtccatccacctcggtttgagcactcttttctctccgtgtctggtccacacctctgccggcacactgtcttcggagacccagcatggcgtat

SEQ ID NO: 2381 - DNA, 140 bp, Artificial Sequence
  Synthetic
atacgccatgctgggtctccgtgatggaagccctgggaacactgccaggacacatgacagagagattccaggaagccattgacaacctcgctgtgctcatgcgggcagagactggaagcacgtacttgggagtcggccat

SEQ ID NO: 2382 - DNA, 140 bp, Artificial Sequence
  Synthetic
atggccgactcccaagtacgtgcttccagtctctgcccgcatgagcacagcgaggttgtcaatggcttcctggaatctctctgtcatgtgtcctggcagtgttcccagggcttccatcacggagacccagcatggcgtat

SEQ ID NO: 2383 - DNA, 140 bp, Artificial Sequence
  Synthetic
atacgccatgctgggtctccatgcttttggggttgctgggaacagtctcgctgggaatcttcttcgtcttgatgaggaacaagggcatagggaagatgggctttggaatggtgactcttgcgtacttgggagtcggccat

SEQ ID NO: 2384 - DNA, 140 bp, Artificial Sequence
  Synthetic
atggccgactcccaagtacgcaagagtcaccattccaaagcccatcttccctatgcccttgttcctcatcaagacgaagaagattcccagcgagactgttcccagcaaccccaaaagcatggagacccagcatggcgtat

SEQ ID NO: 2385 - DNA, 140 bp, Artificial Sequence
  Synthetic
aggccctggctgctgatatgtggtagcagtaggtcttctgggcttgattaccgccaatgaactcggatggttggagagaacaaagagtgacctaagccatctaatgggaaggagagaggagaccttttgggacagcggtg

SEQ ID NO: 2386 - DNA, 140 bp, Artificial Sequence
  Synthetic
caccgctgtcccaaaaggtctcctctctccttcccattagatggcttaggtcactctttgttctctccaaccatccgagttcattggcggtaatcaagcccagaagacctactgctaccacatatcagcagccagggcct

SEQ ID NO: 2387 - DNA, 140 bp, Artificial Sequence
  Synthetic
aggccctggctgctgatatggggactttggagtcccgctgctaatgataggttgctactcacaattaacacccctgaccctaatagtggccatcattttgctcgtggcgcactacatgtagaccttttgggacagcggtg

SEQ ID NO: 2388 - DNA, 140 bp, Artificial Sequence
  Synthetic
caccgctgtcccaaaaggtctacatgtagtgcgccacgagcaaaatgatggccactattagggtcaggggtgttaattgtgagtagcaacctatcattagcagcgggactccaaagtccccatatcagcagccagggcct

SEQ ID NO: 2389 - DNA, 140 bp, Artificial Sequence
  Synthetic
atacgccatgctgggtctccggtctctggagcgaaaagcaacaccataaaaagtgtgtccaccacgagccagctcctcttggggcgcatggacgggcctaggaggccagtgaaatatgagcgtacttgggagtcggccat

SEQ ID NO: 2390 - DNA, 140 bp, Artificial Sequence
  Synthetic
atggccgactcccaagtacgctcatatttcactggcctcctaggcccgtccatgcgccccaagaggagctggctcgtggtggacacactttttatggtgttgcttttcgctccagagaccggagacccagcatggcgtat

SEQ ID NO: 2391 - DNA, 140 bp, Artificial Sequence
  Synthetic
aggccctggctgctgatatgtcgtcaggttatgagcatggtctcttcctggttgtggaaagagctaggcaaacacaaacggccacgagtctgtaccaaagaagagttcatcaacaaggttgaccttttgggacagcggtg

SEQ ID NO: 2392 - DNA, 140 bp, Artificial Sequence
  Synthetic
caccgctgtcccaaaaggtcaaccttgttgatgaactcttctttggtacagactcgtggccgtttgtgtttgcctagctctttccacaaccaggaagagaccatgctcataacctgacgacatatcagcagccagggcct

SEQ ID NO: 2393 - DNA, 140 bp, Artificial Sequence
  Synthetic
aggccctggctgctgatatgaacacaaacggccacgagtctgtaccaaagaagagttcatcaacaaggttcgtagcaatgcagcattaggggcaatatttgaagaggaaaaagagtggaagaccttttgggacagcggtg

SEQ ID NO: 2394 - DNA, 140 bp, Artificial Sequence
  Synthetic
caccgctgtcccaaaaggtcttccactctttttcctcttcaaatattgcccctaatgctgcattgctacgaaccttgttgatgaactcttctttggtacagactcgtggccgtttgtgttcatatcagcagccagggcct

SEQ ID NO: 2395 - DNA, 140 bp, Artificial Sequence
  Synthetic
atacgccatgctgggtctcccagccgcgccatctggtatatgtggctaggggctagatttctagagttcgaagcccttggattcttgaacgaggatcactggatggggagagagaactcacgtacttgggagtcggccat

SEQ ID NO: 2396 - DNA, 140 bp, Artificial Sequence
  Synthetic
atggccgactcccaagtacgtgagttctctctccccatccagtgatcctcgttcaagaatccaagggcttcgaactctagaaatctagcccctagccacatataccagatggcgcggctgggagacccagcatggcgtat

SEQ ID NO: 2397 - DNA, 140 bp, Artificial Sequence
  Synthetic
aggccctggctgctgatatgaagcccttggattcttgaacgaggatcactggatggggagagagaactcaggaggtggtgttgaagggctgggattacaaagactcggatatgtcctagagaccttttgggacagcggtg

SEQ ID NO: 2398 - DNA, 140 bp, Artificial Sequence
  Synthetic
caccgctgtcccaaaaggtctctaggacatatccgagtctttgtaatcccagcccttcaacaccacctcctgagttctctctccccatccagtgatcctcgttcaagaatccaagggcttcatatcagcagccagggcct

SEQ ID NO: 2399 - DNA, 140 bp, Artificial Sequence
  Synthetic
atacgccatgctgggtctccaattgatgataggtttgcacatgccctcaggttcttgaatgatatgggaaaagttaggaaggacacacaagagtggaaaccctcaactggatgggacaaccgtacttgggagtcggccat

SEQ ID NO: 2400 - DNA, 140 bp, Artificial Sequence
  Synthetic
atggccgactcccaagtacggttgtcccatccagttgagggtttccactcttgtgtgtccttcctaacttttcccatatcattcaagaacctgagggcatgtgcaaacctatcatcaattggagacccagcatggcgtat

SEQ ID NO: 2401 - DNA, 140 bp, Artificial Sequence
  Synthetic
atacgccatgctgggtctcctgggaagaagttccgttttgctcccaccacttcaacaagctccatctcaaggacgggaggtccattgtggttccctgccgccaccaagatgaactgattgcgtacttgggagtcggccat

SEQ ID NO: 2402 - DNA, 140 bp, Artificial Sequence
  Synthetic
atggccgactcccaagtacgcaatcagttcatcttggtggcggcagggaaccacaatggacctcccgtccttgagatggagcttgttgaagtggtgggagcaaaacggaacttcttcccaggagacccagcatggcgtat

SEQ ID NO: 2403 - DNA, 140 bp, Artificial Sequence
  Synthetic
aggccctggctgctgatatgggacgggaggtccattgtggttccctgccgccaccaagatgaactgattggccgggcccgcgtctctccaggggcgggatggagcatccgggagactgctgaccttttgggacagcggtg

SEQ ID NO: 2404 - DNA, 140 bp, Artificial Sequence
  Synthetic
caccgctgtcccaaaaggtcagcagtctcccggatgctccatcccgcccctggagagacgcgggcccggccaatcagttcatcttggtggcggcagggaaccacaatggacctcccgtcccatatcagcagccagggcct

SEQ ID NO: 2405 - DNA, 140 bp, Artificial Sequence
  Synthetic
atacgccatgctgggtctcccccaagttcgctacttgggtgaagaagggtctacacctggagtgctgtaagcaccagtcttaatgttgtcaggcctgctagtcagccacagcttggggaacgtacttgggagtcggccat

SEQ ID NO: 2406 - DNA, 140 bp, Artificial Sequence
  Synthetic
atggccgactcccaagtacgttccccaagctgtggctgactagcaggcctgacaacattaagactggtgcttacagcactccaggtgtagacccttcttcacccaagtagcgaacttgggggagacccagcatggcgtat

SEQ ID NO: 2407 - DNA, 140 bp, Artificial Sequence
  Synthetic
atacgccatgctgggtctccagttgttgatctgtgtgaatcagactgcgacagttcgagtttgaagcgaaagctagcaacagtatcaacaggttttattttggatttggaaacgagagttcgtacttgggagtcggccat

SEQ ID NO: 2408 - DNA, 140 bp, Artificial Sequence
  Synthetic
atggccgactcccaagtacgaactctcgtttccaaatccaaaataaaacctgttgatactgttgctagctttcgcttcaaactcgaactgtcgcagtctgattcacacagatcaacaactggagacccagcatggcgtat

SEQ ID NO: 2409 - DNA, 140 bp, Artificial Sequence
  Synthetic
aggccctggctgctgatatgtagggactttgtggaaggtatgtcaggtgggacttgggttgatgttgtcttggaacatggaggttgtgtcaccgtaatggcacaggacaaaccgactgtcgaccttttgggacagcggtg

SEQ ID NO: 2410 - DNA, 140 bp, Artificial Sequence
  Synthetic
caccgctgtcccaaaaggtcgacagtcggtttgtcctgtgccattacggtgacacaacctccatgttccaagacaacatcaacccaagtcccacctgacataccttccacaaagtccctacatatcagcagccagggcct

SEQ ID NO: 2411 - DNA, 140 bp, Artificial Sequence
  Synthetic
aggccctggctgctgatatgccgaggacaggccttgacttttcagatttgtattacttgactatgaataacaagcactggttggtccacaaggagtggttccacgacattccattaccttgaccttttgggacagcggtg

SEQ ID NO: 2412 - DNA, 140 bp, Artificial Sequence
  Synthetic
caccgctgtcccaaaaggtcaaggtaatggaatgtcgtggaaccactccttgtggaccaaccagtgcttgttattcatagtcaagtaatacaaatctgaaaagtcaaggcctgtcctcggcatatcagcagccagggcct

SEQ ID NO: 2413 - DNA, 140 bp, Artificial Sequence
  Synthetic
atacgccatgctgggtctccggcaagggcatccatcaaatttttggagcagctttcaaatcattgtttggaggaatgtcctggttctcacaaatcctcattggaacgttgctgatgtggtcgtacttgggagtcggccat

SEQ ID NO: 2414 - DNA, 140 bp, Artificial Sequence
  Synthetic
atggccgactcccaagtacgaccacatcagcaacgttccaatgaggatttgtgagaaccaggacattcctccaaacaatgatttgaaagctgctccaaaaatttgatggatgcccttgccggagacccagcatggcgtat

SEQ ID NO: 2415 - DNA, 140 bp, Artificial Sequence
  Synthetic
aggccctggctgctgatatgctcggtggacttctcaaagaaggagacgagatgcggtacaggggtgttcgtctataacgacgttgaagcctggagggacaggtacaagtaccatcctgacgaccttttgggacagcggtg

SEQ ID NO: 2416 - DNA, 140 bp, Artificial Sequence
  Synthetic
caccgctgtcccaaaaggtcgtcaggatggtacttgtacctgtccctccaggcttcaacgtcgttatagacgaacacccctgtaccgcatctcgtctccttctttgagaagtccaccgagcatatcagcagccagggcct

SEQ ID NO: 2417 - DNA, 140 bp, Artificial Sequence
  Synthetic
aggccctggctgctgatatgctgcgggatctcctctgtttcaagaatggagaacatcatgtggagatcagtagaaggggagctcaacgcaatcttggaagagaatggagttcaactgacggaccttttgggacagcggtg

SEQ ID NO: 2418 - DNA, 140 bp, Artificial Sequence
  Synthetic
caccgctgtcccaaaaggtccgtcagttgaactccattctcttccaagattgcgttgagctccccttctactgatctccacatgatgttctccattcttgaaacagaggagatcccgcagcatatcagcagccagggcct

SEQ ID NO: 2419 - DNA, 140 bp, Artificial Sequence
  Synthetic
atacgccatgctgggtctcccgtacttcgtcagagcagcaaagacaaataacagctttgtcgtggatggtgacacactgaaggaatgcccactcgaacatagagcatggaacagctttctcgtacttgggagtcggccat

SEQ ID NO: 2420 - DNA, 140 bp, Artificial Sequence
  Synthetic
atggccgactcccaagtacgagaaagctgttccatgctctatgttcgagtgggcattccttcagtgtgtcaccatccacgacaaagctgttatttgtctttgctgctctgacgaagtacgggagacccagcatggcgtat

SEQ ID NO: 2421 - DNA, 140 bp, Artificial Sequence
  Synthetic
aggccctggctgctgatatggttaaggggaaggaggctgtacacagtgatctaggctactggattgagagtgagaagaatgacacatggaggctgaagagggcccatctaatcgagatgagaccttttgggacagcggtg

SEQ ID NO: 2422 - DNA, 140 bp, Artificial Sequence
  Synthetic
caccgctgtcccaaaaggtctcatctcgattagatgggccctcttcagcctccatgtgtcattcttctcactctcaatccagtagcctagatcactgtgtacagcctccttccccttaaccatatcagcagccagggcct

SEQ ID NO: 2423 - DNA, 140 bp, Artificial Sequence
  Synthetic
atacgccatgctgggtctccaaacatgtgaatggccaaagtcccacacattgtgggcagatggaatagaagagagtgatctgatcattcccaagtctttagctgggccactcagccatcacgtacttgggagtcggccat

SEQ ID NO: 2424 - DNA, 140 bp, Artificial Sequence
  Synthetic
atggccgactcccaagtacgtgatggctgagtggcccagctaaagacttgggaatgatcagatcactctcttctattccatctgcccacaatgtgtgggactttggccattcacatgtttggagacccagcatggcgtat

SEQ ID NO: 2425 - DNA, 140 bp, Artificial Sequence
  Synthetic
atacgccatgctgggtctccaagagcttgaaattcggtttgaggaatgcccgggcactaaggtccacgtggaggaaacatgtggaacaagaggaccatctctgagatcaaccactgcaagcgtacttgggagtcggccat

SEQ ID NO: 2426 - DNA, 140 bp, Artificial Sequence
  Synthetic
atggccgactcccaagtacgcttgcagtggttgatctcagagatggtcctcttgttccacatgtttcctccacgtggaccttagtgcccgggcattcctcaaaccgaatttcaagctcttggagacccagcatggcgtat

SEQ ID NO: 2427 - DNA, 140 bp, Artificial Sequence
  Synthetic
aggccctggctgctgatatgtgtcgttccgggctaaagatggctgttggtatggaatggagataaggcccaggaaagaaccagaaagcaacttagtaaggtcagtggtgactgcaggatcgaccttttgggacagcggtg

SEQ ID NO: 2428 - DNA, 140 bp, Artificial Sequence
  Synthetic
caccgctgtcccaaaaggtcgatcctgcagtcaccactgaccttactaagttgctttctggttctttcctgggccttatctccattccataccaacagccatctttagcccggaacgacacatatcagcagccagggcct

SEQ ID NO: 2429 - DNA, 140 bp, Artificial Sequence
  Synthetic
atacgccatgctgggtctccaactgatcacatggatcacttctcccttggagtgcttgtgattctgctcatggtgcaggaagggctgaagaagagaatgaccacaaagatcatcataagccgtacttgggagtcggccat

SEQ ID NO: 2430 - DNA, 140 bp, Artificial Sequence
  Synthetic
atggccgactcccaagtacggcttatgatgatctttgtggtcattctcttcttcagcccttcctgcaccatgagcagaatcacaagcactccaagggagaagtgatccatgtgatcagttggagacccagcatggcgtat

SEQ ID NO: 2431 - DNA, 140 bp, Artificial Sequence
  Synthetic
atacgccatgctgggtctcctgacctggctaagcttgcaattttgatgggcgccaccttcgcggaaatgaacactggaggagatgtagctcatctggcgctgatagcggcattcaaagtccgtacttgggagtcggccat

SEQ ID NO: 2432 - DNA, 140 bp, Artificial Sequence
  Synthetic
atggccgactcccaagtacggactttgaatgccgctatcagcgccagatgagctacatctcctccagtgttcatttccgcgaaggtggcgcccatcaaaattgcaagcttagccaggtcaggagacccagcatggcgtat

SEQ ID NO: 2433 - DNA, 140 bp, Artificial Sequence
  Synthetic
atacgccatgctgggtctccagaccagcgttgctggtatctttcatcttcagagctaattggacaccccgtgaaagcatgctgctggccttggcctcgtgtcttttgcaaactgcgatctcgtacttgggagtcggccat

SEQ ID NO: 2434 - DNA, 140 bp, Artificial Sequence
  Synthetic
atggccgactcccaagtacgagatcgcagtttgcaaaagacacgaggccaaggccagcagcatgctttcacggggtgtccaattagctctgaagatgaaagataccagcaacgctggtctggagacccagcatggcgtat

SEQ ID NO: 2435 - DNA, 140 bp, Artificial Sequence
  Synthetic
aggccctggctgctgatatggtgccatcacccaagggaggagggaggaagagactcctgttgagtgcttcgagccttcgatgctgaagaagaagcagctaactgtcttagacttgcatccgaccttttgggacagcggtg

SEQ ID NO: 2436 - DNA, 140 bp, Artificial Sequence
  Synthetic
caccgctgtcccaaaaggtcggatgcaagtctaagacagttagctgcttcttcttcagcatcgaaggctcgaagcactcaacaggagtctcttcctccctcctcccttgggtgatggcaccatatcagcagccagggcct

SEQ ID NO: 2437 - DNA, 140 bp, Artificial Sequence
  Synthetic
aggccctggctgctgatatgctaaagccggtcatacttgatggcgagagagtcattttggctggacccatgcctgtcacacatgccagcgctgcccagaggagggggcgcataggcaggagaccttttgggacagcggtg

SEQ ID NO: 2438 - DNA, 140 bp, Artificial Sequence
  Synthetic
caccgctgtcccaaaaggtctcctgcctatgcgccccctcctctgggcagcgctggcatgtgtgacaggcatgggtccagccaaaatgactctctcgccatcaagtatgaccggctttagcatatcagcagccagggcct

SEQ ID NO: 2439 - DNA, 140 bp, Artificial Sequence
  Synthetic
aggccctggctgctgatatgaccctgttgtggatggaatagtggtgactgacattgacacaatgacaattgacccccaagtggagaaaaagatgggacaggtgctactcatagcagtagcgaccttttgggacagcggtg

SEQ ID NO: 2440 - DNA, 140 bp, Artificial Sequence
  Synthetic
caccgctgtcccaaaaggtcgctactgctatgagtagcacctgtcccatctttttctccacttgggggtcaattgtcattgtgtcaatgtcagtcaccactattccatccacaacagggtcatatcagcagccagggcct

SEQ ID NO: 2441 - DNA, 140 bp, Artificial Sequence
  Synthetic
atacgccatgctgggtctccgacccccaagtggagaaaaagatgggacaggtgctactcatagcagtagcagtctccagcgccatactgtcgcggaccgcctgggggtggggggaggctgcgtacttgggagtcggccat

SEQ ID NO: 2442 - DNA, 140 bp, Artificial Sequence
  Synthetic
atggccgactcccaagtacgcagcctccccccacccccaggcggtccgcgacagtatggcgctggagactgctactgctatgagtagcacctgtcccatctttttctccacttgggggtcggagacccagcatggcgtat

SEQ ID NO: 2443 - DNA, 140 bp, Artificial Sequence
  Synthetic
aggccctggctgctgatatgaagttacttggctggagcttctctaatctacatagtaacaagaaacgctggcttggtcaagagacgtgggggtggaacaggagagaccctgggagagaaagaccttttgggacagcggtg

SEQ ID NO: 2444 - DNA, 140 bp, Artificial Sequence
  Synthetic
caccgctgtcccaaaaggtctttctctcccagggtctctcctgttccacccccacgtctcttgaccaagccagcgtttcttgttactatgtagattagagaagctccagccaagtaacttcatatcagcagccagggcct

SEQ ID NO: 2445 - DNA, 140 bp, Artificial Sequence
  Synthetic
aggccctggctgctgatatgaaagtcaggcatcaccgaggtgtgcagagaagaggcccgccgcgccctcaaggatggtgtggcaacgggaggccatgctgtgtcccgaggaagtgcaaaggaccttttgggacagcggtg

SEQ ID NO: 2446 - DNA, 140 bp, Artificial Sequence
  Synthetic
caccgctgtcccaaaaggtcctttgcacttcctcgggacacagcatggcctcccgttgccacaccatccttgagggcgcggcgggcctcttctctgcacacctcggtgatgcctgactttcatatcagcagccagggcct

SEQ ID NO: 2447 - DNA, 140 bp, Artificial Sequence
  Synthetic
atacgccatgctgggtctccgcaatatttgaagaggaaaaagagtggaagactgcagtggaagctgtgaacgatccaaggttctgggctctagtggacaaggaaagagagcaccacctgacgtacttgggagtcggccat

SEQ ID NO: 2448 - DNA, 140 bp, Artificial Sequence
  Synthetic
atggccgactcccaagtacgtcaggtggtgctctctttccttgtccactagagcccagaaccttggatcgttcacagcttccactgcagtcttccactctttttcctcttcaaatattgcggagacccagcatggcgtat

SEQ ID NO: 2449 - DNA, 140 bp, Artificial Sequence
  Synthetic
aggccctggctgctgatatgaggatcactggatggggagagagaactcaggaggtggtgttgaagggctgggattacaaagactcggatatgtcctagaagagatgagtcgcataccagggaccttttgggacagcggtg

SEQ ID NO: 2450 - DNA, 140 bp, Artificial Sequence
  Synthetic
caccgctgtcccaaaaggtccctggtatgcgactcatctcttctaggacatatccgagtctttgtaatcccagcccttcaacaccacctcctgagttctctctccccatccagtgatcctcatatcagcagccagggcct

SEQ ID NO: 2451 - DNA, 140 bp, Artificial Sequence
  Synthetic
atacgccatgctgggtctccggttcgatctggagaatgaagctctaatcaccaaccaaatggagaaagggcatagggccttggcattggccataatcaagtacacataccaaaacaaagtcgtacttgggagtcggccat

SEQ ID NO: 2452 - DNA, 140 bp, Artificial Sequence
  Synthetic
atggccgactcccaagtacgactttgttttggtatgtgtacttgattatggccaatgccaaggccctatgccctttctccatttggttggtgattagagcttcattctccagatcgaaccggagacccagcatggcgtat

SEQ ID NO: 2453 - DNA, 140 bp, Artificial Sequence
  Synthetic
atacgccatgctgggtctccggcctgctagtcagccacagcttggggaaagctgtgcagcctgtgacccccccaggagaagctgggaaaccaagcctatagtcaggccgagaacgccatgcgtacttgggagtcggccat

SEQ ID NO: 2454 - DNA, 140 bp, Artificial Sequence
  Synthetic
atggccgactcccaagtacgcatggcgttctcggcctgactataggcttggtttcccagcttctcctgggggggtcacaggctgcacagctttccccaagctgtggctgactagcaggccggagacccagcatggcgtat

SEQ ID NO: 2455 - DNA, 140 bp, Artificial Sequence
  Synthetic
atacgccatgctgggtctccgcacggaagaagccatgctgcctgtgagcccctcagaggacactgagtcaaaaaaccccatgcgcttggaggcgcaggatgggaaaagaaggtggcgacccgtacttgggagtcggccat

SEQ ID NO: 2456 - DNA, 140 bp, Artificial Sequence
  Synthetic
atggccgactcccaagtacgggtcgccaccttcttttcccatcctgcgcctccaagcgcatggggttttttgactcagtgtcctctgaggggctcacaggcagcatggcttcttccgtgcggagacccagcatggcgtat

SEQ ID NO: 2457 - DNA, 140 bp, Artificial Sequence
  Synthetic
aggccctggctgctgatatgcgctgggaaagaccagagactccatgagtttccaccacgctggccgccaggcacagatcgccgaatagcggcggccggtgtggggaaatccatgggtcttgaccttttgggacagcggtg

SEQ ID NO: 2458 - DNA, 140 bp, Artificial Sequence
  Synthetic
caccgctgtcccaaaaggtcaagacccatggatttccccacaccggccgccgctattcggcgatctgtgcctggcggccagcgtggtggaaactcatggagtctctggtctttcccagcgcatatcagcagccagggcct

SEQ ID NO: 2459 - DNA, 140 bp, Artificial Sequence
  Synthetic
atacgccatgctgggtctccatgaaaaacccaaagaagaaatccggaagattccggattgtcaatatgctaaaacgcggagtagcccgtgtaaaccccttgggaggtttgaagaggttgccgtacttgggagtcggccat

SEQ ID NO: 2460 - DNA, 140 bp, Artificial Sequence
  Synthetic
atggccgactcccaagtacggcaacctcttcaaacctcccaaggggtttacacgggctactccgcgttttagcatattgacaatccggaatcttccggatttcttctttgggtttttcatggagacccagcatggcgtat

SEQ ID NO: 2461 - DNA, 140 bp, Artificial Sequence
  Synthetic
atacgccatgctgggtctccggaacctgtcatcacaaaaaaggtgagacacggcgatctagaagatctgtgtcgctccgttatcactatacaaggaagttgcaaacgcggtcgcagacatcgtacttgggagtcggccat

SEQ ID NO: 2462 - DNA, 140 bp, Artificial Sequence
  Synthetic
atggccgactcccaagtacgatgtctgcgaccgcgtttgcaacttccttgtatagtgataacggagcgacacagatcttctagatcgccgtgtctcaccttttttgtgatgacaggttccggagacccagcatggcgtat

SEQ ID NO: 2463 - DNA, 140 bp, Artificial Sequence
  Synthetic
atacgccatgctgggtctccggttagaatcaagagaatacaagaagcacttgatcatggtcgaaaactggatattcaggaaccccgggtttgccatagtgtccgttgccattacctggctcgtacttgggagtcggccat

SEQ ID NO: 2464 - DNA, 140 bp, Artificial Sequence
  Synthetic
atggccgactcccaagtacgagccaggtaatggcaacggacactatggcaaacccggggttcctgaatatccagttttcgaccatgatcaagtgcttcttgtattctcttgattctaaccggagacccagcatggcgtat

SEQ ID NO: 2465 - DNA, 140 bp, Artificial Sequence
  Synthetic
atacgccatgctgggtctccgatgggaagcttgacgagccaaaaagtcatatacttggtcatgatagtgttgattgtcccggcatacagtatcagctgcattggagtcagcaatagagaccgtacttgggagtcggccat

SEQ ID NO: 2466 - DNA, 140 bp, Artificial Sequence
  Synthetic
atggccgactcccaagtacggtctctattgctgactccaatgcagctgatactgtatgccgggacaatcaacactatcatgaccaagtatatgactttttggctcgtcaagcttcccatcggagacccagcatggcgtat

SEQ ID NO: 2467 - DNA, 140 bp, Artificial Sequence
  Synthetic
atacgccatgctgggtctccttagtggagggcatgtcaggtgggacctgggttgatgttgtcttggaacatggagggtgcgttaccgagatggcacaggacaagccaacagttgacatagcgtacttgggagtcggccat

SEQ ID NO: 2468 - DNA, 140 bp, Artificial Sequence
  Synthetic
atggccgactcccaagtacgctatgtcaactgttggcttgtcctgtgccatctcggtaacgcaccctccatgttccaagacaacatcaacccaggtcccacctgacatgccctccactaaggagacccagcatggcgtat

SEQ ID NO: 2469 - DNA, 140 bp, Artificial Sequence
  Synthetic
atacgccatgctgggtctccagttggtcacgatgacggttagtaacatggccgaggtaagatcctattgctacgaggcatcgttatccgacatggcttcggccagtcgttgcccaacacacgtacttgggagtcggccat

SEQ ID NO: 2470 - DNA, 140 bp, Artificial Sequence
  Synthetic
atggccgactcccaagtacgtgtgttgggcaacgactggccgaagccatgtcggataacgatgcctcgtagcaataggatcttacctcggccatgttactaaccgtcatcgtgaccaactggagacccagcatggcgtat

SEQ ID NO: 2471 - DNA, 140 bp, Artificial Sequence
  Synthetic
atacgccatgctgggtctccaggcgaaccctccctcgacaagcaatcagacactcaatctgtatgcaaaagaacattaggagacagaggttggggaaatggttgtgggatttttggcaaacgtacttgggagtcggccat

SEQ ID NO: 2472 - DNA, 140 bp, Artificial Sequence
  Synthetic
atggccgactcccaagtacgtttgccaaaaatcccacaaccatttccccaacctctgtctcctaatgttcttttgcatacagattgagtgtctgattgcttgtcgagggagggttcgcctggagacccagcatggcgtat

SEQ ID NO: 2473 - DNA, 140 bp, Artificial Sequence
  Synthetic
atacgccatgctgggtctccgggagcttggtgacatgttccaagttcacgtgttgtaagaagatgcccgggaagagcattcaaccggaaaatctggagtatcggataatgctcccagtgccgtacttgggagtcggccat

SEQ ID NO: 2474 - DNA, 140 bp, Artificial Sequence
  Synthetic
atggccgactcccaagtacggcactgggagcattatccgatactccagattttccggttgaatgctcttcccgggcatcttcttacaacacgtgaacttggaacatgtcaccaagctcccggagacccagcatggcgtat

SEQ ID NO: 2475 - DNA, 140 bp, Artificial Sequence
  Synthetic
atacgccatgctgggtctccatggctcccagcatagcgggatgattgtgaatgacataggacatgaaactgacgaaaacagagcgaaagtcgaggtcacacccaattcaccaagagcagacgtacttgggagtcggccat

SEQ ID NO: 2476 - DNA, 140 bp, Artificial Sequence
  Synthetic
atggccgactcccaagtacgtctgctcttggtgaattgggtgtgacctcgactttcgctctgttttcgtcagtttcatgtcctatgtcattcacaatcatcccgctatgctgggagccatggagacccagcatggcgtat

SEQ ID NO: 2477 - DNA, 140 bp, Artificial Sequence
  Synthetic
atacgccatgctgggtctccagtggaggtgcagtctgcagggacagatggaccctgcaaggtcccagcccagatggcggtggacatgcagaccctgaccccagttggaaggctgataacccgtacttgggagtcggccat

SEQ ID NO: 2478 - DNA, 140 bp, Artificial Sequence
  Synthetic
atggccgactcccaagtacgggttatcagccttccaactggggtcagggtctgcatgtccaccgccatctgggctgggaccttgcagggtccatctgtccctgcagactgcacctccactggagacccagcatggcgtat

SEQ ID NO: 2479 - DNA, 140 bp, Artificial Sequence
  Synthetic
atacgccatgctgggtctcctgatgatcttcctctccacggctgtttctgctgacgtggggtgctcagtggacttctcaaaaaaggaaacgagatgtggcacgggggtattcatctataacgtacttgggagtcggccat

SEQ ID NO: 2480 - DNA, 140 bp, Artificial Sequence
  Synthetic
atggccgactcccaagtacgttatagatgaatacccccgtgccacatctcgtttccttttttgagaagtccactgagcaccccacgtcagcagaaacagccgtggagaggaagatcatcaggagacccagcatggcgtat

SEQ ID NO: 2481 - DNA, 140 bp, Artificial Sequence
  Synthetic
atacgccatgctgggtctcctgggatctgtaaaaaaccccatgtggagaggtccacaaagattgccagtgcctgtgaatgagctgccccatggctggaaagcctgggggaaatcgtatttcgtacttgggagtcggccat

SEQ ID NO: 2482 - DNA, 140 bp, Artificial Sequence
  Synthetic
atggccgactcccaagtacgaaatacgatttcccccaggctttccagccatggggcagctcattcacaggcactggcaatctttgtggacctctccacatggggttttttacagatcccaggagacccagcatggcgtat

SEQ ID NO: 2483 - DNA, 140 bp, Artificial Sequence
  Synthetic
atacgccatgctgggtctcctgggatctgtaaaaaaccccatgtggagaggtccacaaagattgccagtgcctgtgaatgtgctgccccatggctggaaagcctgggggaaatcgtatttcgtacttgggagtcggccat

SEQ ID NO: 2484 - DNA, 140 bp, Artificial Sequence
  Synthetic
atggccgactcccaagtacgaaatacgatttcccccaggctttccagccatggggcagcacattcacaggcactggcaatctttgtggacctctccacatggggttttttacagatcccaggagacccagcatggcgtat

SEQ ID NO: 2485 - DNA, 140 bp, Artificial Sequence
  Synthetic
atacgccatgctgggtctcctgggatctgtaaaaaaccccatgtggagaggtccacaaagattgccagtgcctgtgaatgcgctgccccatggctggaaagcctgggggaaatcgtatttcgtacttgggagtcggccat

SEQ ID NO: 2486 - DNA, 140 bp, Artificial Sequence
  Synthetic
atggccgactcccaagtacgaaatacgatttcccccaggctttccagccatggggcagcgcattcacaggcactggcaatctttgtggacctctccacatggggttttttacagatcccaggagacccagcatggcgtat

SEQ ID NO: 2487 - DNA, 140 bp, Artificial Sequence; identical to SEQ ID NO: 1311
  Synthetic

SEQ ID NO: 2488 - DNA, 140 bp, Artificial Sequence; identical to SEQ ID NO: 1312
  Synthetic

SEQ ID NO: 2489 - DNA, 140 bp, Artificial Sequence
  Synthetic
atacgccatgctgggtctccggaaaaaccaggagagttcttcctgaaatagtccgtgaagccataaaaaagagactccggacagtgatcttggcaccaactccagttgagagatcatactcgtacttgggagtcggccat

SEQ ID NO: 2490 - DNA, 140 bp, Artificial Sequence
  Synthetic
atggccgactcccaagtacgagtatgatctctcaactggagttggtgccaagatcactgtccggagtctcttttttatggcttcacggactatttcaggaagaactctcctggtttttccggagacccagcatggcgtat

SEQ ID NO: 2491 - DNA, 140 bp, Artificial Sequence
  Synthetic
aggccctggctgctgatatggagactccggacagtgatcttggcaccaactccagttgagagatcatactcaaggtggtccttgtggccatctgtggcacgtacccagacaacagcagtcgaccttttgggacagcggtg

SEQ ID NO: 2492 - DNA, 140 bp, Artificial Sequence
  Synthetic
caccgctgtcccaaaaggtcgactgctgttgtctgggtacgtgccacagatggccacaaggaccaccttgagtatgatctctcaactggagttggtgccaagatcactgtccggagtctccatatcagcagccagggcct

SEQ ID NO: 2493 - DNA, 140 bp, Artificial Sequence
  Synthetic
atacgccatgctgggtctcctttgattgggtgacagaccattctgggaaaacagtttggttcgttccaagcgtgagatctggagaagaaagcgcagcctgtctgacaaaggctggaaagccgtacttgggagtcggccat

SEQ ID NO: 2494 - DNA, 140 bp, Artificial Sequence
  Synthetic
atggccgactcccaagtacggctttccagcctttgtcagacaggctgcgctttcttctccagatctcacgcttggaacgaaccaaactgttttcccagaatggtctgtcacccaatcaaaggagacccagcatggcgtat

SEQ ID NO: 2495 - DNA, 140 bp, Artificial Sequence
  Synthetic
aggccctggctgctgatatgaaaaatcaagagtgggactttgtcataacaactgacatctcagagatgggcgccaacttcaaggctgaccgggtcatagactctaggagatgcctaaagcgaccttttgggacagcggtg

SEQ ID NO: 2496 - DNA, 140 bp, Artificial Sequence
  Synthetic
caccgctgtcccaaaaggtcgctttaggcatctcctagagtctatgacccggtcagccttgaagttggcgcccatctctgagatgtcagttgttatgacaaagtcccactcttgatttttcatatcagcagccagggcct

SEQ ID NO: 2497 - DNA, 140 bp, Artificial Sequence
  Synthetic
atacgccatgctgggtctcccaaacctggagatgagtacatgtatggaggtgggtgtgcagagactgatgaagaccatgcacactggcttgaagcaagaatgcttcttgacaacatctaccgtacttgggagtcggccat

SEQ ID NO: 2498 - DNA, 140 bp, Artificial Sequence
  Synthetic
atggccgactcccaagtacggtagatgttgtcaagaagcattcttgcttcaagccagtgtgcatggtcttcatcagtctctgcacacccacctccatacatgtactcatctccaggtttgggagacccagcatggcgtat

SEQ ID NO: 2499 - DNA, 140 bp, Artificial Sequence
  Synthetic
aggccctggctgctgatatgcgcattgagagaatccgcaatgaacatgcagaaacatggtttcttgatgaaaaccacccatacaggacatgggcctaccatgggagatacgaagcccccagaccttttgggacagcggtg

SEQ ID NO: 2500 - DNA, 140 bp, Artificial Sequence
  Synthetic
caccgctgtcccaaaaggtctgggggcttcgtatctcccatggtaggcccatgtcctgtatgggtggttttcatcaagaaaccatgtttctgcatgttcattgcggattctctcaatgcgcatatcagcagccagggcct

SEQ ID NO: 2501 - DNA, 140 bp, Artificial Sequence
  Synthetic
aggccctggctgctgatatgcgcattgagagaatccgcaatgaacatgcagaaacatggtttcttgatgaaaaccacccatacaggacatgggcctaccatgggagttacgaagcccccagaccttttgggacagcggtg

SEQ ID NO: 2502 - DNA, 140 bp, Artificial Sequence
  Synthetic
caccgctgtcccaaaaggtctgggggcttcgtaactcccatggtaggcccatgtcctgtatgggtggttttcatcaagaaaccatgtttctgcatgttcattgcggattctctcaatgcgcatatcagcagccagggcct

SEQ ID NO: 2503 - DNA, 140 bp, Artificial Sequence; identical to SEQ ID NO: 1423
  Synthetic

SEQ ID NO: 2504 - DNA, 140 bp, Artificial Sequence; identical to SEQ ID NO: 1424
  Synthetic

SEQ ID NO: 2505 - DNA, 140 bp, Artificial Sequence
  Synthetic
aggccctggctgctgatatgcgcattgagagaatccgcaatgaacatgcagaaacatggtttcttgatgaaaaccacccatacaggacatgggcctaccatgggaggtacgaagcccccagaccttttgggacagcggtg

SEQ ID NO: 2506 - DNA, 140 bp, Artificial Sequence
  Synthetic
caccgctgtcccaaaaggtctgggggcttcgtacctcccatggtaggcccatgtcctgtatgggtggttttcatcaagaaaccatgtttctgcatgttcattgcggattctctcaatgcgcatatcagcagccagggcct

SEQ ID NO: 2507 - DNA, 140 bp, Artificial Sequence
  Synthetic
aggccctggctgctgatatgggaactcctctacagccacttcactgtgtaacatttttaggggaagttatttggctggagcttctctaatctacacagtaacaagaaacgctggcttggtgaccttttgggacagcggtg

SEQ ID NO: 2508 - DNA, 140 bp, Artificial Sequence
  Synthetic
caccgctgtcccaaaaggtcaccaagccagcgtttcttgttactgtgtagattagagaagctccagccaaataacttcccctaaaaatgttacacagtgaagtggctgtagaggagttcccatatcagcagccagggcct

SEQ ID NO: 2509 - DNA, 140 bp, Artificial Sequence
  Synthetic
aggccctggctgctgatatgcagagtgtggattgaggagaacgaccacatggaagacaagaccccagttacgaaatggacagacattccctatttgggaaaaagggaagacttgtggtgtgaccttttgggacagcggtg

SEQ ID NO: 2510 - DNA, 140 bp, Artificial Sequence
  Synthetic
caccgctgtcccaaaaggtcacaccacaagtcttccctttttcccaaatagggaatgtctgtccatttcgtaactggggtcttgtcttccatgtggtcgttctcctcaatccacactctgcatatcagcagccagggcct

SEQ ID NO: 2511 - DNA, 140 bp, Artificial Sequence
  Synthetic
aggccctggctgctgatatgcgaaatggacagacattccctatttgggaaaaagggaagacttgtggtgtggatctctcatagggcacagaccgcgcaccacctgggctgagaacattaagaccttttgggacagcggtg

SEQ ID NO: 2512 - DNA, 140 bp, Artificial Sequence
  Synthetic
caccgctgtcccaaaaggtcttaatgttctcagcccaggtggtgcgcggtctgtgccctatgagagatccacaccacaagtcttccctttttcccaaatagggaatgtctgtccatttcgcatatcagcagccagggcct

SEQ ID NO: 2513 - DNA, 140 bp, Artificial Sequence
  Synthetic
atacgccatgctgggtctcctgaagcccttggattcttgaacgaggatcactggatggggagagagaactcaggaggtggtgttgaagggctgggattacaaagactcggatatgtcctacgtacttgggagtcggccat

SEQ ID NO: 2514 - DNA, 140 bp, Artificial Sequence
  Synthetic
atggccgactcccaagtacgtaggacatatccgagtctttgtaatcccagcccttcaacaccacctcctgagttctctctccccatccagtgatcctcgttcaagaatccaagggcttcaggagacccagcatggcgtat

SEQ ID NO: 2515 - DNA, 140 bp, Artificial Sequence
  Synthetic
atacgccatgctgggtctccaagtacacataccaaaacaaagtggtaaaggtccttagaccagctgaaaaagggaaaacagtaatggacattatttcgagacaagaccaaagggggagcgcgtacttgggagtcggccat

SEQ ID NO: 2516 - DNA, 140 bp, Artificial Sequence
  Synthetic
atggccgactcccaagtacgcgctccccctttggtcttgtctcgaaataatgtccattactgttttccctttttcagctggtctaaggacctttaccactttgttttggtatgtgtacttggagacccagcatggcgtat

SEQ ID NO: 2517 - DNA, 140 bp, Artificial Sequence
  Synthetic
atacgccatgctgggtctccaagtacacataccaaaacaaagtggtaaaggtccttagaccagctgaaaaagggaaaacagttatggacattatttcgagacaagaccaaagggggagcgcgtacttgggagtcggccat

SEQ ID NO: 2518 - DNA, 140 bp, Artificial Sequence
  Synthetic
atggccgactcccaagtacgcgctccccctttggtcttgtctcgaaataatgtccataactgttttccctttttcagctggtctaaggacctttaccactttgttttggtatgtgtacttggagacccagcatggcgtat

SEQ ID NO: 2519 - DNA, 140 bp, Artificial Sequence
  Synthetic
atacgccatgctgggtctccaagtacacataccaaaacaaagtggtaaaggtccttagaccagctgaaaaagggaaaacagtcatggacattatttcgagacaagaccaaagggggagcgcgtacttgggagtcggccat

SEQ ID NO: 2520 - DNA, 140 bp, Artificial Sequence
  Synthetic
atggccgactcccaagtacgcgctccccctttggtcttgtctcgaaataatgtccatgactgttttccctttttcagctggtctaaggacctttaccactttgttttggtatgtgtacttggagacccagcatggcgtat

SEQ ID NO: 2521 - DNA, 140 bp, Artificial Sequence
  Synthetic
atacgccatgctgggtctccaagtacacataccaaaacaaagtggtaaaggtccttagaccagctgaaaaagggaaaacagtgatggacattatttcgagacaagaccaaagggggagcgcgtacttgggagtcggccat

SEQ ID NO: 2522 - DNA, 140 bp, Artificial Sequence
  Synthetic
atggccgactcccaagtacgcgctccccctttggtcttgtctcgaaataatgtccatcactgttttccctttttcagctggtctaaggacctttaccactttgttttggtatgtgtacttggagacccagcatggcgtat

SEQ ID NO: 2523 - DNA, 140 bp, Artificial Sequence
  Synthetic
aggccctggctgctgatatggatatgggaaaagttaggaaggacacacaagagtggaaaccctcaactggatgggacaactgggaagaagttccgttttgctcccaccacttcaacaagcgaccttttgggacagcggtg

SEQ ID NO: 2524 - DNA, 140 bp, Artificial Sequence
  Synthetic
caccgctgtcccaaaaggtcgcttgttgaagtggtgggagcaaaacggaacttcttcccagttgtcccatccagttgagggtttccactcttgtgtgtccttcctaacttttcccatatccatatcagcagccagggcct

SEQ ID NO: 2525 - DNA, 140 bp, Artificial Sequence
  Synthetic
aggccctggctgctgatatgcttgaacgaggatcactggatggggagagagaactcaggaggtggtgttgaagggctgggattacaaagactcggatatgtcctagaagagatgagtcgcgaccttttgggacagcggtg

SEQ ID NO: 2526 - DNA, 140 bp, Artificial Sequence
  Synthetic
caccgctgtcccaaaaggtcgcgactcatctcttctaggacatatccgagtctttgtaatcccagcccttcaacaccacctcctgagttctctctccccatccagtgatcctcgttcaagcatatcagcagccagggcct

SEQ ID NO: 2527 - DNA, 140 bp, Artificial Sequence
  Synthetic
aggccctggctgctgatatgaagggctgggattacaaagactcggatatgtcctagaagagatgagtcgcataccaggaggaaggatgtatgcagatgacactgctggctgggacacccggaccttttgggacagcggtg

SEQ ID NO: 2528 - DNA, 140 bp, Artificial Sequence
  Synthetic
caccgctgtcccaaaaggtccgggtgtcccagccagcagtgtcatctgcatacatccttcctcctggtatgcgactcatctcttctaggacatatccgagtctttgtaatcccagcccttcatatcagcagccagggcct

SEQ ID NO: 2529 - DNA, 140 bp, Artificial Sequence
  Synthetic
aggccctggctgctgatatgataccaggaggaaggatgtatgcagatgacactgctggctgggacacccgcatcagcaggtttgatctggagaatgaagctctaatcaccaaccaaatgggaccttttgggacagcggtg

SEQ ID NO: 2530 - DNA, 140 bp, Artificial Sequence
  Synthetic
caccgctgtcccaaaaggtcccatttggttggtgattagagcttcattctccagatcaaacctgctgatgcgggtgtcccagccagcagtgtcatctgcatacatccttcctcctggtatcatatcagcagccagggcct

SEQ ID NO: 2531 - DNA, 140 bp, Artificial Sequence
  Synthetic
aggccctggctgctgatatgcctcaggttcttgaatgatatgggaaaagttaggaaggacacacaagagtggaaaccctcaactggatgggacaactgggaagaagttccgttttgctccgaccttttgggacagcggtg

SEQ ID NO: 2532 - DNA, 140 bp, Artificial Sequence
  Synthetic
caccgctgtcccaaaaggtcggagcaaaacggaacttcttcccagttgtcccatccagttgagggtttccactcttgtgtgtccttcctaacttttcccatatcattcaagaacctgaggcatatcagcagccagggcct

SEQ ID NO: 2533 - DNA, 140 bp, Artificial Sequence
  Synthetic
aggccctggctgctgatatgccttggattcttgaacgaggatcactggatggggagagagaactcaggaggtggtgttgaagggctgggattacaaagactcggatatgtcctagaagaggaccttttgggacagcggtg

SEQ ID NO: 2534 - DNA, 140 bp, Artificial Sequence
  Synthetic
caccgctgtcccaaaaggtcctcttctaggacatatccgagtctttgtaatcccagcccttcaacaccacctcctgagttctctctccccatccagtgatcctcgttcaagaatccaaggcatatcagcagccagggcct

SEQ ID NO: 2535 - DNA, 140 bp, Artificial Sequence
  Synthetic
aggccctggctgctgatatgaccaaatggagaaagggcacagggccttggcattggccataatcaagtacacataccaaaacaaagtggtaaaggtccttagaccagctgaaaaagggaagaccttttgggacagcggtg

SEQ ID NO: 2536 - DNA, 140 bp, Artificial Sequence
  Synthetic
caccgctgtcccaaaaggtcttccctttttcagctggtctaaggacctttaccactttgttttggtatgtgtacttgattatggccaatgccaaggccctgtgccctttctccatttggtcatatcagcagccagggcct

SEQ ID NO: 2537 - DNA, 140 bp, Artificial Sequence
  Synthetic
aggccctggctgctgatatgtcttgaatgatatgggaaaagttaggaaggacacacaagagtggaaaccctcaactggatgggacaactgggaagaagttccgttttgctcccaccatttgaccttttgggacagcggtg

SEQ ID NO: 2538 - DNA, 140 bp, Artificial Sequence
  Synthetic
caccgctgtcccaaaaggtcaaatggtgggagcaaaacggaacttcttcccagttgtcccatccagttgagggtttccactcttgtgtgtccttcctaacttttcccatatcattcaagacatatcagcagccagggcct

SEQ ID NO: 2539 - DNA, 140 bp, Artificial Sequence; identical to SEQ ID NO: 2519
  Synthetic

SEQ ID NO: 2540 - DNA, 140 bp, Artificial Sequence; identical to SEQ ID NO: 2520
  Synthetic

SEQ ID NO: 2541 - DNA, 140 bp, Artificial Sequence
  Synthetic
aggccctggctgctgatatgatatgggaaaagttaggaaggacacacaagagtggaaaccctcaactggatgggacaactgggaagaggttccgttttgctcccaccatttcaacaagcagaccttttgggacagcggtg

SEQ ID NO: 2542 - DNA, 140 bp, Artificial Sequence
  Synthetic
caccgctgtcccaaaaggtctgcttgttgaaatggtgggagcaaaacggaacctcttcccagttgtcccatccagttgagggtttccactcttgtgtgtccttcctaacttttcccatatcatatcagcagccagggcct

SEQ ID NO: 2543 - DNA, 140 bp, Artificial Sequence
  Synthetic
aggccctggctgctgatatgttggattcttgaacgaggatcactggatggggagagagaactcaggaggtggtgttgaagggctgggattacaaagactcggatatgtcctagaagagatgaccttttgggacagcggtg

SEQ ID NO: 2544 - DNA, 140 bp, Artificial Sequence
  Synthetic
caccgctgtcccaaaaggtcatctcttctaggacatatccgagtctttgtaatcccagcccttcaacaccacctcctgagttctctctccccatccagtgatcctcgttcaagaatccaacatatcagcagccagggcct

SEQ ID NO: 2545 - DNA, 140 bp, Artificial Sequence
  Synthetic
atacgccatgctgggtctcccagttatggacattatttcgagacaagaccaaagggggagcggacaagttgtcacttacgctcttaacacatttaccaacctagtggtgcaactcattcgcgtacttgggagtcggccat

SEQ ID NO: 2546 - DNA, 140 bp, Artificial Sequence
  Synthetic
atggccgactcccaagtacgcgaatgagttgcaccactaggttggtaaatgtgttaagagcgtaagtgacaacttgtccgctccccctttggtcttgtctcgaaataatgtccataactgggagacccagcatggcgtat

SEQ ID NO: 2547 - DNA, 140 bp, Artificial Sequence
  Synthetic
aggccctggctgctgatatgggattcttgaacgaggatcactggatggggagagagaactcaggaggtggtgttgaagggctgggattacaaagactcggatatgtcctagaagagatgagaccttttgggacagcggtg

SEQ ID NO: 2548 - DNA, 140 bp, Artificial Sequence
  Synthetic
caccgctgtcccaaaaggtctcatctcttctaggacatatccgagtctttgtaatcccagcccttcaacaccacctcctgagttctctctccccatccagtgatcctcgttcaagaatcccatatcagcagccagggcct

SEQ ID NO: 2549 - DNA, 140 bp, Artificial Sequence
  Synthetic
aggccctggctgctgatatggttcttgaatgatatgggaaaagttaggaaggacacacaagagtggaaaccctcaactggatgggacaactgggaagaagttccgttttgctcccaccatgaccttttgggacagcggtg

SEQ ID NO: 2550 - DNA, 140 bp, Artificial Sequence
  Synthetic
caccgctgtcccaaaaggtcatggtgggagcaaaacggaacttcttcccagttgtcccatccagttgagggtttccactcttgtgtgtccttcctaacttttcccatatcattcaagaaccatatcagcagccagggcct

SEQ ID NO: 2551 - DNA, 140 bp, Artificial Sequence
  Synthetic
aggccctggctgctgatatgggttcttgaatgatatgggaaaagttaggaaggacacacaagagtggaaaccctcaactggatgggacaactgggaagaagttccgttttgctcccaccagaccttttgggacagcggtg

SEQ ID NO: 2552 - DNA, 140 bp, Artificial Sequence
  Synthetic
caccgctgtcccaaaaggtctggtgggagcaaaacggaacttcttcccagttgtcccatccagttgagggtttccactcttgtgtgtccttcctaacttttcccatatcattcaagaacccatatcagcagccagggcct

SEQ ID NO: 2553 - DNA, 140 bp, Artificial Sequence
  Synthetic
aggccctggctgctgatatgcccttggattcttgaacgaggatcactggatggggagagagaactcaggaggtggtgttgaagggctgggattacaaagactcggatatgtcctagaagagaccttttgggacagcggtg

SEQ ID NO: 2554 - DNA, 140 bp, Artificial Sequence
  Synthetic
caccgctgtcccaaaaggtctcttctaggacatatccgagtctttgtaatcccagcccttcaacaccacctcctgagttctctctccccatccagtgatcctcgttcaagaatccaagggcatatcagcagccagggcct

SEQ ID NO: 2555 - DNA, 140 bp, Artificial Sequence
  Synthetic
atacgccatgctgggtctccgggacacccgcatcagcaggtttgatctggagaatgaagccctaatcaccaaccaaatggagaaagggcacagggccttggcattggccataatcaagtacgtacttgggagtcggccat

SEQ ID NO: 2556 - DNA, 140 bp, Artificial Sequence
  Synthetic
atggccgactcccaagtacgtacttgattatggccaatgccaaggccctgtgccctttctccatttggttggtgattagggcttcattctccagatcaaacctgctgatgcgggtgtcccggagacccagcatggcgtat

SEQ ID NO: 2557 - DNA, 140 bp, Artificial Sequence
  Synthetic
atacgccatgctgggtctccttgaagcccttggattcttgaacgaggatcactggatggggagagagaactcaggaggtggtgttgaagggctgggattacaaagactcggatatgtcctcgtacttgggagtcggccat

SEQ ID NO: 2558 - DNA, 140 bp, Artificial Sequence
  Synthetic
atggccgactcccaagtacgaggacatatccgagtctttgtaatcccagcccttcaacaccacctcctgagttctctctccccatccagtgatcctcgttcaagaatccaagggcttcaaggagacccagcatggcgtat

SEQ ID NO: 2559 - DNA, 140 bp, Artificial Sequence
  Synthetic
aggccctggctgctgatatgtgggataggctcaaacgaatggcagtcagtggagatgattgcgtcgtgaagccaattgatgataggtttgcacatgccctcaggttcttgaatgatatgggaccttttgggacagcggtg

SEQ ID NO: 2560 - DNA, 140 bp, Artificial Sequence
  Synthetic
caccgctgtcccaaaaggtcccatatcattcaagaacctgagggcatgtgcaaacctatcatcaattggcttcacgacgcaatcatctccactgactgccattcgtttgagcctatcccacatatcagcagccagggcct

SEQ ID NO: 2561 - DNA, 140 bp, Artificial Sequence
  Synthetic
atacgccatgctgggtctccttcttgaacgaggatcactggatgggaagagagaactcaggaggtggtgttgaagggctgggattacaaaaactcggatatgtcctagaagagatgagtccgtacttgggagtcggccat

SEQ ID NO: 2562 - DNA, 140 bp, Artificial Sequence
  Synthetic
atggccgactcccaagtacggactcatctcttctaggacatatccgagtttttgtaatcccagcccttcaacaccacctcctgagttctctcttcccatccagtgatcctcgttcaagaaggagacccagcatggcgtat

SEQ ID NO: 2563 - DNA, 140 bp, Artificial Sequence
  Synthetic
atacgccatgctgggtctccgcataccaggaggaaggatgtatgcagatgacactgctggctgggacacccgcatcagcaggtttgatctggagaatgaagctctagtcaccaaccaaatcgtacttgggagtcggccat

SEQ ID NO: 2564 - DNA, 140 bp, Artificial Sequence
  Synthetic
atggccgactcccaagtacgatttggttggtgactagagcttcattctccagatcaaacctgctgatgcgggtgtcccagccagcagtgtcatctgcatacatccttcctcctggtatgcggagacccagcatggcgtat

SEQ ID NO: 2565 - DNA, 140 bp, Artificial Sequence
  Synthetic
aggccctggctgctgatatgatggacattatttcgagacaagaccaaagggggagcggacaagttgtcacttacgctcttaacacatttaccaacctagtggtgcaactcattcggaatagaccttttgggacagcggtg

SEQ ID NO: 2566 - DNA, 140 bp, Artificial Sequence
  Synthetic
caccgctgtcccaaaaggtctattccgaatgagttgcaccactaggttggtaaatgtgttaagagcgtaagtgacaacttgtccgctccccctttggtcttgtctcgaaataatgtccatcatatcagcagccagggcct

SEQ ID NO: 2567 - DNA, 140 bp, Artificial Sequence
  Synthetic
aggccctggctgctgatatgatatgggaaaagttaggaaggacacacaagagtggaaaccctcaactggatgggacaactgggaagaagttccgttttgctcccaccatttcaacaagcagaccttttgggacagcggtg

SEQ ID NO: 2568 - DNA, 140 bp, Artificial Sequence
  Synthetic
caccgctgtcccaaaaggtctgcttgttgaaatggtgggagcaaaacggaacttcttcccagttgtcccatccagttgagggtttccactcttgtgtgtccttcctaacttttcccatatcatatcagcagccagggcct

SEQ ID NO: 2569 - DNA, 140 bp, Artificial Sequence
  Synthetic
aggccctggctgctgatatgtcttgaacgaggatcactggatggggagagagaactcaggaggtggtgttgaagggctgggattacaaagactcggatatgtcctagaagagatgagtcggaccttttgggacagcggtg

SEQ ID NO: 2570 - DNA, 140 bp, Artificial Sequence
  Synthetic
caccgctgtcccaaaaggtccgactcatctcttctaggacatatccgagtctttgtaatcccagcccttcaacaccacctcctgagttctctctccccatccagtgatcctcgttcaagacatatcagcagccagggcct

SEQ ID NO: 2571 - DNA, 140 bp, Artificial Sequence
  Synthetic
aggccctggctgctgatatgctcaggttcttgaatgatatgggaaaagttaggaaggacacacaagagtggaaaccctcaactggatgggacaactgggaagaagttccgttttgctcccgaccttttgggacagcggtg

SEQ ID NO: 2572 - DNA, 140 bp, Artificial Sequence
  Synthetic
caccgctgtcccaaaaggtcgggagcaaaacggaacttcttcccagttgtcccatccagttgagggtttccactcttgtgtgtccttcctaacttttcccatatcattcaagaacctgagcatatcagcagccagggcct

SEQ ID NO: 2573 - DNA, 140 bp, Artificial Sequence
  Synthetic
aggccctggctgctgatatgcaggttcttgaatgatatgggaaaagttaggaaggacacacaagagtggaaaccctcaactggatgggacaactgggaagaagttccgttttgctcccacgaccttttgggacagcggtg

SEQ ID NO: 2574 - DNA, 140 bp, Artificial Sequence
  Synthetic
caccgctgtcccaaaaggtcgtgggagcaaaacggaacttcttcccagttgtcccatccagttgagggtttccactcttgtgtgtccttcctaacttttcccatatcattcaagaacctgcatatcagcagccagggcct

SEQ ID NO: 2575 - DNA, 140 bp, Artificial Sequence
  Synthetic
atacgccatgctgggtctccctgttgctgcttcagactgcgacagttcgagtttgaagcgaaagctagcaacagtatcaacaggttttatttggatttggaaacgagagtttctggtcatcgtacttgggagtcggccat

SEQ ID NO: 2576 - DNA, 140 bp, Artificial Sequence
  Synthetic
atggccgactcccaagtacgatgaccagaaactctcgtttccaaatccaaataaaacctgttgatactgttgctagctttcgcttcaaactcgaactgtcgcagtctgaagcagcaacagggagacccagcatggcgtat

SEQ ID NO: 2577 - DNA, 140 bp, Artificial Sequence
  Synthetic
aggccctggctgctgatatgctggttacaacaacagtcagcaacatggcggaggtaagatcctactgctatgaggcatcaatatcagacatggcttcgcccagccgctgcccaacacaaggaccttttgggacagcggtg

SEQ ID NO: 2578 - DNA, 140 bp, Artificial Sequence
  Synthetic
caccgctgtcccaaaaggtccttgtgttgggcagcggctgggcgaagccatgtctgatattgatgcctcatagcagtaggatcttacctccgccatgttgctgactgttgttgtaaccagcatatcagcagccagggcct

SEQ ID NO: 2579 - DNA, 140 bp, Artificial Sequence
  Synthetic
atacgccatgctgggtctcctcgcccagccgctgcccaacacaagccgctgcctaccttgacaagcaatcagacactcaatatgtctgcaaaagaacgttagtggacagcgactggggttcgtacttgggagtcggccat

SEQ ID NO: 2580 - DNA, 140 bp, Artificial Sequence
  Synthetic
atggccgactcccaagtacgaaccccagtcgctgtccactaacgttcttttgcagacatattgagtgtctgattgcttgtcaaggtaggcagcggcttgtgttgggcagcggctgggcgaggagacccagcatggcgtat

SEQ ID NO: 2581 - DNA, 140 bp, Artificial Sequence
  Synthetic
aggccctggctgctgatatgaaaacgcggagtagcccgtgtgagcccctttgggggcttgaagaggctgccagccggacttctgctgggccatgggcccatcaggatggtcttggcgatagaccttttgggacagcggtg

SEQ ID NO: 2582 - DNA, 140 bp, Artificial Sequence
  Synthetic
caccgctgtcccaaaaggtctatcgccaagaccatcctgatgggcccatggcccagcagaagtccggctggcagcctcttcaagcccccaaaggggctcacacgggctactccgcgttttcatatcagcagccagggcct

SEQ ID NO: 2583 - DNA, 140 bp, Artificial Sequence
  Synthetic
atacgccatgctgggtctcctcaagaaagatctggctgccatgctgagaataatcaatgctaggaaggagaagaagagacgaggcgcagatactagcgtcggaattgttggcctcctcctcgtacttgggagtcggccat

SEQ ID NO: 2584 - DNA, 140 bp, Artificial Sequence
  Synthetic
atggccgactcccaagtacgaggaggaggccaacaattccgacgctagtatctgcgcctcgtctcttcttctccttcctagcattgattattctcagcatggcagccagatctttcttgaggagacccagcatggcgtat

SEQ ID NO: 2585 - DNA, 140 bp, Artificial Sequence
  Synthetic
atacgccatgctgggtctccgaccacagccatggcagtagaggtcactagacgtgggagtgcatactatatgtacttggacagaagcgatgctggggaggccatatcttttccaaccacacgtacttgggagtcggccat

SEQ ID NO: 2586 - DNA, 140 bp, Artificial Sequence
  Synthetic
atggccgactcccaagtacgtgtggttggaaaagatatggcctccccagcatcgcttctgtccaagtacatatagtatgcactcccacgtctagtgacctctactgccatggctgtggtcggagacccagcatggcgtat

SEQ ID NO: 2587 - DNA, 140 bp, Artificial Sequence
  Synthetic
atacgccatgctgggtctccctggggatgaataagtgttacatacaaatcatggatcttggacacatgtgtgatgccaccatgagctatgaatgccctatgttggatgagggggtagaaccgtacttgggagtcggccat

SEQ ID NO: 2588 - DNA, 140 bp, Artificial Sequence
  Synthetic
atggccgactcccaagtacggttctaccccctcatccaacatagggcattcatagctcatggtggcatcacacatgtgtccaagatccatgatttgtatgtaacacttattcatccccagggagacccagcatggcgtat

SEQ ID NO: 2589 - DNA, 140 bp, Artificial Sequence
  Synthetic
aggccctggctgctgatatgtgatgccaccatgagctatgaatgccctatgttggatgagggggtagaaccagatgacgtcgattgctggtgcaacacgacatcaacttgggttgtgtatgaccttttgggacagcggtg

SEQ ID NO: 2590 - DNA, 140 bp, Artificial Sequence
  Synthetic
caccgctgtcccaaaaggtcatacacaacccaagttgatgtcgtgttgcaccagcaatcgacgtcatctggttctaccccctcatccaacatagggcattcatagctcatggtggcatcacatatcagcagccagggcct

SEQ ID NO: 2591 - DNA, 140 bp, Artificial Sequence
  Synthetic
atacgccatgctgggtctccggttggaatcaagagaatacacaaagcacctgattagagttgaaaattggatattcaggaaccctggcttcgcgttagcagcagctgtcatcgcttggctcgtacttgggagtcggccat

SEQ ID NO: 2592 - DNA, 140 bp, Artificial Sequence
  Synthetic
atggccgactcccaagtacgagccaagcgatgacagctgctgctaacgcgaagccagggttcctgaatatccaattttcaactctaatcaggtgctttgtgtattctcttgattccaaccggagacccagcatggcgtat

SEQ ID NO: 2593 - DNA, 140 bp, Artificial Sequence
  Synthetic
atacgccatgctgggtctcctttgggaagttcaacgagccaaaaagtcatatatctggtcatgatactgctgattgccccggcatacagcatcaggtgcataggagtcagcaatagggaccgtacttgggagtcggccat

SEQ ID NO: 2594 - DNA, 140 bp, Artificial Sequence
  Synthetic
atggccgactcccaagtacggtccctattgctgactcctatgcacctgatgctgtatgccggggcaatcagcagtatcatgaccagatatatgactttttggctcgttgaacttcccaaaggagacccagcatggcgtat

SEQ ID NO: 2595 - DNA, 140 bp, Artificial Sequence
  Synthetic
aggccctggctgctgatatgtttgtggaaggtatgtcaggtgggacttgggttgatgttgtcttggaacatggaggttgtgttaccgtaatggcacaggacaaaccgactgtcgacataggaccttttgggacagcggtg

SEQ ID NO: 2596 - DNA, 140 bp, Artificial Sequence
  Synthetic
caccgctgtcccaaaaggtcctatgtcgacagtcggtttgtcctgtgccattacggtaacacaacctccatgttccaagacaacatcaacccaagtcccacctgacataccttccacaaacatatcagcagccagggcct

SEQ ID NO: 2597 - DNA, 140 bp, Artificial Sequence
  Synthetic
atacgccatgctgggtctcctatgaggcatcaatatcggatatggcttcggacagccgctgcccaacacaaggtgaggcctaccttgacaagcagtcagacactcaatatgtctgcaaaacgtacttgggagtcggccat

SEQ ID NO: 2598 - DNA, 140 bp, Artificial Sequence
  Synthetic
atggccgactcccaagtacgttttgcagacatattgagtgtctgactgcttgtcaaggtaggcctcaccttgtgttgggcagcggctgtccgaagccatatccgatattgatgcctcataggagacccagcatggcgtat

SEQ ID NO: 2599 - DNA, 140 bp, Artificial Sequence
  Synthetic
atacgccatgctgggtctccagccaccctggggggttttgggagcctaggacttgattgtgaaccgaggacaggccttgacttttcagatttgtattacctgactatgaataacaagcaccgtacttgggagtcggccat

SEQ ID NO: 2600 - DNA, 140 bp, Artificial Sequence
  Synthetic
atggccgactcccaagtacggtgcttgttattcatagtcaggtaatacaaatctgaaaagtcaaggcctgtcctcggttcacaatcaagtcctaggctcccaaaaccccccagggtggctggagacccagcatggcgtat

SEQ ID NO: 2601 - DNA, 140 bp, Artificial Sequence
  Synthetic
atacgccatgctgggtctcctggttggttcacaaggagtggttccacgacattccattaccttggcatgctggggcagacactggaactccacattggaacaacaaagaagcactggtagcgtacttgggagtcggccat

SEQ ID NO: 2602 - DNA, 140 bp, Artificial Sequence
  Synthetic
atggccgactcccaagtacgctaccagtgcttctttgttgttccaatgtggagttccagtgtctgccccagcatgccaaggtaatggaatgtcgtggaaccactccttgtgaaccaaccaggagacccagcatggcgtat

SEQ ID NO: 2603 - DNA, 140 bp, Artificial Sequence
  Synthetic
atacgccatgctgggtctccagttcaaggacgcacatgcaaaaaggcaaactgtcgtggttctagggagtcaagaaggagcagttcacacggcccttgctggagctctggaggctgagatcgtacttgggagtcggccat

SEQ ID NO: 2604 - DNA, 140 bp, Artificial Sequence
  Synthetic
atggccgactcccaagtacgatctcagcctccagagctccagcaagggccgtgtgaactgctccttcttgactccctagaaccacgacagtttgcctttttgcatgtgcgtccttgaactggagacccagcatggcgtat

SEQ ID NO: 2605 - DNA, 140 bp, Artificial Sequence
  Synthetic
atacgccatgctgggtctccggatggagccaagggaaggctgtcctctggccacttgaaatgtcgcctgaaaatggataaacttagattgaagggcgtgtcatactccttgtgcactgcacgtacttgggagtcggccat

SEQ ID NO: 2606 - DNA, 140 bp, Artificial Sequence
  Synthetic
atggccgactcccaagtacgtgcagtgcacaaggagtatgacacgcccttcaatctaagtttatccattttcaggcgacatttcaagtggccagaggacagccttcccttggctccatccggagacccagcatggcgtat

SEQ ID NO: 2607 - DNA, 140 bp, Artificial Sequence
  Synthetic
aggccctggctgctgatatgagatggcggtggatatgcaaactctgaccccagttgggaggttgataaccgctaaccctgtaatcactgaaagcaccgagaactctaagatgatgctggagaccttttgggacagcggtg

SEQ ID NO: 2608 - DNA, 140 bp, Artificial Sequence
  Synthetic
caccgctgtcccaaaaggtctccagcatcatcttagagttctcggtgctttcagtgattacagggttagcggttatcaacctcccaactggggtcagagtttgcatatccaccgccatctcatatcagcagccagggcct

SEQ ID NO: 2609 - DNA, 140 bp, Artificial Sequence
  Synthetic
atacgccatgctgggtctccagcctgggactttggatcagttgggggtgctctcaactcattgggcaagggcatccatcaaatttttggagcagctttcaaatcattgttcggaggaatgcgtacttgggagtcggccat

SEQ ID NO: 2610 - DNA, 140 bp, Artificial Sequence
  Synthetic
atggccgactcccaagtacgcattcctccgaacaatgatttgaaagctgctccaaaaatttgatggatgcccttgcccaatgagttgagagcacccccaactgatccaaagtcccaggctggagacccagcatggcgtat

SEQ ID NO: 2611 - DNA, 140 bp, Artificial Sequence
  Synthetic
aggccctggctgctgatatggaatacaaagaatggatctatttcccttacgtgcttggccttagggggagtgttgatcttcttatccacagccgtttctgctgatgtggggtgctcggtggaccttttgggacagcggtg

SEQ ID NO: 2612 - DNA, 140 bp, Artificial Sequence
  Synthetic
caccgctgtcccaaaaggtccaccgagcaccccacatcagcagaaacggctgtggataagaagatcaacactccccctaaggccaagcacgtaagggaaatagatccattctttgtattccatatcagcagccagggcct

SEQ ID NO: 2613 - DNA, 140 bp, Artificial Sequence
  Synthetic
atacgccatgctgggtctccgacttctcaaagaaggaaacgagatgcggtacaggggtgttcgtctataacgacgttgaagcctggagggacaggtacaagtaccatcctgactcccctccgtacttgggagtcggccat

SEQ ID NO: 2614 - DNA, 140 bp, Artificial Sequence
  Synthetic
atggccgactcccaagtacggaggggagtcaggatggtacttgtacctgtccctccaggcttcaacgtcgttatagacgaacacccctgtaccgcatctcgtttccttctttgagaagtcggagacccagcatggcgtat

SEQ ID NO: 2615 - DNA, 140 bp, Artificial Sequence
  Synthetic
atacgccatgctgggtctccgtagattggcagcagcagtcaagcaagcctgggaagatgggatctgtgggatctcctctgtctcaagaatggaaaacatcatgtggagatcagtagaaggcgtacttgggagtcggccat

SEQ ID NO: 2616 - DNA, 140 bp, Artificial Sequence
  Synthetic
atggccgactcccaagtacgccttctactgatctccacatgatgttttccattcttgagacagaggagatcccacagatcccatcttcccaggcttgcttgactgctgctgccaatctacggagacccagcatggcgtat

SEQ ID NO: 2617 - DNA, 140 bp, Artificial Sequence
  Synthetic
aggccctggctgctgatatgtgaaggaatgcccactcaaacatagagcatggaacagctttcttgtggaggatcatgggtttggggtatttcacactagtgtctggctcaaggttagagagaccttttgggacagcggtg

SEQ ID NO: 2618 - DNA, 140 bp, Artificial Sequence
  Synthetic
caccgctgtcccaaaaggtctctctaaccttgagccagacactagtgtgaaataccccaaacccatgatcctccacaagaaagctgttccatgctctatgtttgagtgggcattccttcacatatcagcagccagggcct

SEQ ID NO: 2619 - DNA, 140 bp, Artificial Sequence
  Synthetic
atacgccatgctgggtctccagattattcattagagtgtgatccagccgtcattggaacagctgctaagggaaaggaggctgtgcacagcgatctaggctactggattgagagtgagaagcgtacttgggagtcggccat

SEQ ID NO: 2620 - DNA, 140 bp, Artificial Sequence
  Synthetic
atggccgactcccaagtacgcttctcactctcaatccagtagcctagatcgctgtgcacagcctcctttcccttagcagctgttccaatgacggctggatcacactctaatgaataatctggagacccagcatggcgtat

SEQ ID NO: 2621 - DNA, 140 bp, Artificial Sequence
  Synthetic
atacgccatgctgggtctccaacgacacatggaggctgaagagggcccacctgatcgagatgaaaacatgtgaatggccaaagtcccacacattgtggacagatggagtagaagaaagtgcgtacttgggagtcggccat

SEQ ID NO: 2622 - DNA, 140 bp, Artificial Sequence
  Synthetic
atggccgactcccaagtacgcactttcttctactccatctgtccacaatgtgtgggactttggccattcacatgttttcatctcgatcaggtgggccctcttcagcctccatgtgtcgttggagacccagcatggcgtat

SEQ ID NO: 2623 - DNA, 140 bp, Artificial Sequence
  Synthetic
atacgccatgctgggtctcctgaaattcggtttgaggaatgcccaggcactaaggtccacgtggaggaaacatgtgggacaagaggaccatccctgagatcaaccactgcaagcggaaggcgtacttgggagtcggccat

SEQ ID NO: 2624 - DNA, 140 bp, Artificial Sequence
  Synthetic
atggccgactcccaagtacgccttccgcttgcagtggttgatctcagggatggtcctcttgtcccacatgtttcctccacgtggaccttagtgcctgggcattcctcaaaccgaatttcaggagacccagcatggcgtat

SEQ ID NO: 2625 - DNA, 140 bp, Artificial Sequence
  Synthetic
atacgccatgctgggtctccgtgatcgaggaatggtgctgcagggaatgcacaatgcccccactgtcgttccgagctaaagatggctgttggtatggaatggagataaggcccaggaaagcgtacttgggagtcggccat

SEQ ID NO: 2626 - DNA, 140 bp, Artificial Sequence
  Synthetic
atggccgactcccaagtacgctttcctgggccttatctccattccataccaacagccatctttagctcggaacgacagtgggggcattgtgcattccctgcagcaccattcctcgatcacggagacccagcatggcgtat

SEQ ID NO: 2627 - DNA, 140 bp, Artificial Sequence
  Synthetic
atacgccatgctgggtctccaaccagaaagtaacttagtaaggtcaatggtgactgcaggatcaactgatcacatggatcacttctctcttggagtgcttgtgattttgctcatggtgcacgtacttgggagtcggccat

SEQ ID NO: 2628 - DNA, 140 bp, Artificial Sequence
  Synthetic
atggccgactcccaagtacgtgcaccatgagcaaaatcacaagcactccaagagagaagtgatccatgtgatcagttgatcctgcagtcaccattgaccttactaagttactttctggttggagacccagcatggcgtat

SEQ ID NO: 2629 - DNA, 140 bp, Artificial Sequence
  Synthetic
atacgccatgctgggtctccggaagggctgaagaagagaatgaccacaaagatcatcataagcacatcaatggcagtgctggtagccatgatcctgggaggattttcaatgagtgacctgcgtacttgggagtcggccat

SEQ ID NO: 2630 - DNA, 140 bp, Artificial Sequence
  Synthetic
atggccgactcccaagtacgcaggtcactcattgaaaatcctcccaggatcatggctaccagcactgccattgatgtgcttatgatgatctttgtggtcattctcttcttcagcccttccggagacccagcatggcgtat

SEQ ID NO: 2631 - DNA, 140 bp, Artificial Sequence
  Synthetic
atacgccatgctgggtctccgctaagcttgcaattttgatgggtgccaccttcgcggaaatgaacactggaggagatgtagctcatttggcgctgatagcggcattcaaagtcagacctgcgtacttgggagtcggccat

SEQ ID NO: 2632 - DNA, 140 bp, Artificial Sequence
  Synthetic
atggccgactcccaagtacgcaggtctgactttgaatgccgctatcagcgccaaatgagctacatctcctccagtgttcatttccgcgaaggtggcacccatcaaaattgcaagcttagcggagacccagcatggcgtat

SEQ ID NO: 2633 - DNA, 140 bp, Artificial Sequence
  Synthetic
atacgccatgctgggtctcccgttgctggtatctttcatcttcagagctaattggacaccccgtgagagcatgctgctggccttggcctcgtgtcttctgcaaactgcgatctccgccttcgtacttgggagtcggccat

SEQ ID NO: 2634 - DNA, 140 bp, Artificial Sequence
  Synthetic
atggccgactcccaagtacgaaggcggagatcgcagtttgcagaagacacgaggccaaggccagcagcatgctctcacggggtgtccaattagctctgaagatgaaagataccagcaacgggagacccagcatggcgtat

SEQ ID NO: 2635 - DNA, 140 bp, Artificial Sequence
  Synthetic
atacgccatgctgggtctccctggctgctctgacaccactggcccggggcacactgcttgtggcgtggagagcaggccttgctacttgcggggggttcatgctcctctctctgaaggggacgtacttgggagtcggccat

SEQ ID NO: 2636 - DNA, 140 bp, Artificial Sequence
  Synthetic
atggccgactcccaagtacgtccccttcagagagaggagcatgaaccccccgcaagtagcaaggcctgctctccacgccacaagcagtgtgccccgggccagtggtgtcagagcagccagggagacccagcatggcgtat

SEQ ID NO: 2637 - DNA, 140 bp, Artificial Sequence
  Synthetic
aggccctggctgctgatatgagcaggccttgctacttgcggggggttcatgctcctctctctgaaggggaaaggcagtgtgaagaagaacctaccatttgtcatggccttgggactaactgaccttttgggacagcggtg

SEQ ID NO: 2638 - DNA, 140 bp, Artificial Sequence
  Synthetic
caccgctgtcccaaaaggtcagttagtcccaaggccatgacaaatggtaggttcttcttcacactgcctttccccttcagagagaggagcatgaaccccccgcaagtagcaaggcctgctcatatcagcagccagggcct

SEQ ID NO: 2639 - DNA, 140 bp, Artificial Sequence
  Synthetic
atacgccatgctgggtctccgcctgatatgcgcattggctggagggttcgccaaggcggatatagagatggctgggcccatggccgcggtcggtctgctaattgtcagttacgtggtctccgtacttgggagtcggccat

SEQ ID NO: 2640 - DNA, 140 bp, Artificial Sequence
  Synthetic
atggccgactcccaagtacggagaccacgtaactgacaattagcagaccgaccgcggccatgggcccagccatctctatatccgccttggcgaaccctccagccaatgcgcatatcaggcggagacccagcatggcgtat

SEQ ID NO: 2641 - DNA, 140 bp, Artificial Sequence
  Synthetic
atacgccatgctgggtctccaaaaagatgcggaaatcactggaaacagtccccggctcgatgtggcactagatgagagtggtgatttctccctagtggaggatgatggtccacccatgagcgtacttgggagtcggccat

SEQ ID NO: 2642 - DNA, 140 bp, Artificial Sequence
  Synthetic
atggccgactcccaagtacgctcatgggtggaccatcatcctccactagggagaaatcaccactctcatctagtgccacatcgagccggggactgtttccagtgatttccgcatctttttggagacccagcatggcgtat

SEQ ID NO: 2643 - DNA, 140 bp, Artificial Sequence
  Synthetic
aggccctggctgctgatatggatgagagtggtgatttctccctagtggaggatgatggtccacccatgagagagatcatactcaaagtggtcctgatgaccatctgcggcatgaacccaagaccttttgggacagcggtg

SEQ ID NO: 2644 - DNA, 140 bp, Artificial Sequence
  Synthetic
caccgctgtcccaaaaggtcttgggttcatgccgcagatggtcatcaggaccactttgagtatgatctctctcatgggtggaccatcatcctccactagggagaaatcaccactctcatccatatcagcagccagggcct

SEQ ID NO: 2645 - DNA, 140 bp, Artificial Sequence
  Synthetic
aggccctggctgctgatatgatgtggcacgtcacaaaaggatccgcgctgagaagcggtgaagggagacttgatccatactggggagatgtcaagcaggatctggtgtcatactgtggtcgaccttttgggacagcggtg

SEQ ID NO: 2646 - DNA, 140 bp, Artificial Sequence
  Synthetic
caccgctgtcccaaaaggtcgaccacagtatgacaccagatcctgcttgacatctccccagtatggatcaagtctcccttcaccgcttctcagcgcggatccttttgtgacgtgccacatcatatcagcagccagggcct

SEQ ID NO: 2647 - DNA, 140 bp, Artificial Sequence
  Synthetic
atacgccatgctgggtctcccgtggaagctagacgccgcctgggacgggcacagcgaggtgcagctcttggccgtgccccccggagagagagcgaggaacatccagactctgcccggaaccgtacttgggagtcggccat

SEQ ID NO: 2648 - DNA, 140 bp, Artificial Sequence
  Synthetic
atggccgactcccaagtacggttccgggcagagtctggatgttcctcgctctctctccggggggcacggccaagagctgcacctcgctgtgcccgtcccaggcggcgtctagcttccacgggagacccagcatggcgtat

SEQ ID NO: 2649 - DNA, 140 bp, Artificial Sequence
  Synthetic
aggccctggctgctgatatggccgtgccccccggagagagagcgaggaacatccagactctgcccggaacatttaagacaaaggatggggacattggagcagttgcgctggactacccaggaccttttgggacagcggtg

SEQ ID NO: 2650 - DNA, 140 bp, Artificial Sequence
  Synthetic
caccgctgtcccaaaaggtcctgggtagtccagcgcaactgctccaatgtccccatcctttgtcttaaatgttccgggcagagtctggatgttcctcgctctctctccggggggcacggccatatcagcagccagggcct

SEQ ID NO: 2651 - DNA, 140 bp, Artificial Sequence
  Synthetic
atacgccatgctgggtctcccgatgctgaagaagaagcagctaactgtcttagacctgcatcctggagccgggaaaaccaggagagttcttcctgaaatagtccgtgaagccataaaaaccgtacttgggagtcggccat

SEQ ID NO: 2652 - DNA, 140 bp, Artificial Sequence
  Synthetic
atggccgactcccaagtacggtttttatggcttcacggactatttcaggaagaactctcctggttttcccggctccaggatgcaggtctaagacagttagctgcttcttcttcagcatcgggagacccagcatggcgtat

SEQ ID NO: 2653 - DNA, 140 bp, Artificial Sequence
  Synthetic
atacgccatgctgggtctccaagactccgtactgtgatcttagctccaaccagggtcgtcgctgctgaaatggaggaagcccttagagggcttccagttcgttatatgacaacagcagtccgtacttgggagtcggccat

SEQ ID NO: 2654 - DNA, 140 bp, Artificial Sequence
  Synthetic
atggccgactcccaagtacggactgctgttgtcatataacgaactggaagccctctaagggcttcctccatttcagcagcgacgaccctggttggagctaagatcacagtacggagtcttggagacccagcatggcgtat

SEQ ID NO: 2655 - DNA, 140 bp, Artificial Sequence
  Synthetic
atacgccatgctgggtctccaatgtcacccattctgggacagaaatcgttgacttaatgtgccatgctaccttcacttcacgcctactacaaccaatcagagtccccaactataatttgtcgtacttgggagtcggccat

SEQ ID NO: 2656 - DNA, 140 bp, Artificial Sequence
  Synthetic
atggccgactcccaagtacgacaaattatagttggggactctgattggttgtagtaggcgtgaagtgaaggtagcatggcacattaagtcaacgatttctgtcccagaatgggtgacattggagacccagcatggcgtat

SEQ ID NO: 2657 - DNA, 140 bp, Artificial Sequence
  Synthetic
atacgccatgctgggtctccgaccgccacgccaccaggaacccgtgacgcattcccggactccaactcaccaattatggacaccgaggtggaagtcccagagagagcctggagcacaggccgtacttgggagtcggccat

SEQ ID NO: 2658 - DNA, 140 bp, Artificial Sequence
  Synthetic
atggccgactcccaagtacggcctgtgctccaggctctctctgggacttccacctcggtgtccataattggtgagttggagtccgggaatgcgtcacgggttcctggtggcgtggcggtcggagacccagcatggcgtat

SEQ ID NO: 2659 - DNA, 140 bp, Artificial Sequence
  Synthetic
aggccctggctgctgatatgcaattatggacaccgaggtggaagtcccagagagagcctggagcacaggctttgattgggtgacggatcattctgggaaaacagtctggtttgttccaaggaccttttgggacagcggtg

SEQ ID NO: 2660 - DNA, 140 bp, Artificial Sequence
  Synthetic
caccgctgtcccaaaaggtccttggaacaaaccagactgttttcccagaatgatccgtcacccaatcaaagcctgtgctccaggctctctctgggacttccacctcggtgtccataattgcatatcagcagccagggcct

SEQ ID NO: 2661 - DNA, 140 bp, Artificial Sequence
  Synthetic
aggccctggctgctgatatgcgtgaggaacggcaatgagatcgcagcttgtctgacaaaggctggaaaacgggtcatacagctcagcagaaagacttttgagacagagttccagaaaacggaccttttgggacagcggtg

SEQ ID NO: 2662 - DNA, 140 bp, Artificial Sequence
  Synthetic
caccgctgtcccaaaaggtccgttttctggaactctgtctcaaaagtctttctgctgagctgtatgacccgttttccagcctttgtcagacaagctgcgatctcattgccgttcctcacgcatatcagcagccagggcct

SEQ ID NO: 2663 - DNA, 140 bp, Artificial Sequence
  Synthetic
atacgccatgctgggtctccaaaaatcaagagtgggacttcgtcgtgacaaccgacatttcagagatgggcgccaactttaaagctgaccgtgtcatagattccaggagatgcttaaagccgtacttgggagtcggccat

SEQ ID NO: 2664 - DNA, 140 bp, Artificial Sequence
  Synthetic
atggccgactcccaagtacggctttaagcatctcctggaatctatgacacggtcagctttaaagttggcgcccatctctgaaatgtcggttgtcacgacgaagtcccactcttgatttttggagacccagcatggcgtat

SEQ ID NO: 2665 - DNA, 140 bp, Artificial Sequence
  Synthetic
atacgccatgctgggtctcccggtcatacttgatggcgagagagtcattttggctggacccatgcctgtcacacatgccagcgctgctcagaggagggggcgcataggcaggaatcccaacgtacttgggagtcggccat

SEQ ID NO: 2666 - DNA, 140 bp, Artificial Sequence
  Synthetic
atggccgactcccaagtacgttgggattcctgcctatgcgccccctcctctgagcagcgctggcatgtgtgacaggcatgggtccagccaaaatgactctctcgccatcaagtatgaccgggagacccagcatggcgtat

SEQ ID NO: 2667 - DNA, 140 bp, Artificial Sequence
  Synthetic
atacgccatgctgggtctcccaaacctggagatgagtatctgtatggaggtgggtgcgcagagactgatgaagatcacgcacactggcttgaagcaagaatgcttcttgacaacatttaccgtacttgggagtcggccat

SEQ ID NO: 2668 - DNA, 140 bp, Artificial Sequence
  Synthetic
atggccgactcccaagtacggtaaatgttgtcaagaagcattcttgcttcaagccagtgtgcgtgatcttcatcagtctctgcgcacccacctccatacagatactcatctccaggtttgggagacccagcatggcgtat

SEQ ID NO: 2669 - DNA, 140 bp, Artificial Sequence
  Synthetic
atacgccatgctgggtctccctccaagatggcctcatagcttcgctctatcgacctgaggccgacaaagtagcagctattgagggagagttcaagcttaggacggagcaaaggaagacctcgtacttgggagtcggccat

SEQ ID NO: 2670 - DNA, 140 bp, Artificial Sequence
  Synthetic
atggccgactcccaagtacgaggtcttcctttgctccgtcctaagcttgaactctccctcaatagctgctactttgtcggcctcaggtcgatagagcgaagctatgaggccatcttggagggagacccagcatggcgtat

SEQ ID NO: 2671 - DNA, 140 bp, Artificial Sequence
  Synthetic
aggccctggctgctgatatgagcagctattgagggagagttcaagcttaggacggagcaaaggaagacctttgtggaactcatgaaaagaggagatcttccggtttggttggcctatcaggaccttttgggacagcggtg

SEQ ID NO: 2672 - DNA, 140 bp, Artificial Sequence
  Synthetic
caccgctgtcccaaaaggtcctgataggccaaccaaaccggaagatctcctcttttcatgagttccacaaaggtcttcctttgctccgtcctaagcttgaactctccctcaatagctgctcatatcagcagccagggcct

SEQ ID NO: 2673 - DNA, 140 bp, Artificial Sequence
  Synthetic
aggccctggctgctgatatggttgcatctgccggaataacctacacagatagaagatggtgctttgatggcatgaccaacaacaccataatggaagacagtgtgccggcagaggtgtggagaccttttgggacagcggtg

SEQ ID NO: 2674 - DNA, 140 bp, Artificial Sequence
  Synthetic
caccgctgtcccaaaaggtctccacacctctgccggcacactgtcttccattatggtgttgttggtcatgccatcaaagcaccatcttctatctgtgtaggttattccggcagatgcaaccatatcagcagccagggcct

SEQ ID NO: 2675 - DNA, 140 bp, Artificial Sequence
  Synthetic
aggccctggctgctgatatgccagatacggagagaaaagagtgctcaaaccgaggtggatggacgccagagtttgttcagatcatgcggccctgaagtcattcaaagagtttgccgctgggaccttttgggacagcggtg

SEQ ID NO: 2676 - DNA, 140 bp, Artificial Sequence
  Synthetic
caccgctgtcccaaaaggtcccagcggcaaactctttgaatgacttcagggccgcatgatctgaacaaactctggcgtccatccacctcggtttgagcactcttttctctccgtatctggcatatcagcagccagggcct

SEQ ID NO: 2677 - DNA, 140 bp, Artificial Sequence
  Synthetic
aggccctggctgctgatatggtttgttcagatcatgcggccctgaagtcattcaaagagtttgccgctgggaaaagaggagcggcctttggagtgatagaagccctgggaacactgccaggaccttttgggacagcggtg

SEQ ID NO: 2678 - DNA, 140 bp, Artificial Sequence
  Synthetic
caccgctgtcccaaaaggtcctggcagtgttcccagggcttctatcactccaaaggccgctcctcttttcccagcggcaaactctttgaatgacttcagggccgcatgatctgaacaaaccatatcagcagccagggcct

SEQ ID NO: 2679 - DNA, 140 bp, Artificial Sequence
  Synthetic
atacgccatgctgggtctccgccggagaccctagagaccattatgcttttggggttgctgggaacagtctcgctgggaatctttttcgtcttgatgcggaacaagggcatggggaagatgcgtacttgggagtcggccat

SEQ ID NO: 2680 - DNA, 140 bp, Artificial Sequence
  Synthetic
atggccgactcccaagtacgcatcttccccatgcccttgttccgcatcaagacgaaaaagattcccagcgagactgttcccagcaaccccaaaagcataatggtctctagggtctccggcggagacccagcatggcgtat

SEQ ID NO: 2681 - DNA, 140 bp, Artificial Sequence
  Synthetic
atacgccatgctgggtctccggctttggaatggtgactcttggggccagcgcatggcttatgtggctctcggaaattgagccagccagaattgcatgtgtcctcattgtcgtgttcctatcgtacttgggagtcggccat

SEQ ID NO: 2682 - DNA, 140 bp, Artificial Sequence
  Synthetic
atggccgactcccaagtacgataggaacacgacaatgaggacacatgcaattctggctggctcaatttccgagagccacataagccatgcgctggccccaagagtcaccattccaaagccggagacccagcatggcgtat

SEQ ID NO: 2683 - DNA, 140 bp, Artificial Sequence
  Synthetic
atacgccatgctgggtctcctgctggtggtgctcatacctgagccagaaaagcaaagatctcctcaggacaaccaaatggcaatcatcatcatggtagcagtgggtcttctgggcttgatcgtacttgggagtcggccat

SEQ ID NO: 2684 - DNA, 140 bp, Artificial Sequence
  Synthetic
atggccgactcccaagtacgatcaagcccagaagacccactgctaccatgatgatgattgccatttggttgtcctgaggagatctttgcttttctggctcaggtatgagcaccaccagcaggagacccagcatggcgtat

SEQ ID NO: 2685 - DNA, 140 bp, Artificial Sequence
  Synthetic
atacgccatgctgggtctcctaccgccaatgaactcggatggttggagagaacaaaaagtgacctaagccatctaatgggaaggagagaggagggggcaaccacaggattctcaatggaccgtacttgggagtcggccat

SEQ ID NO: 2686 - DNA, 140 bp, Artificial Sequence
  Synthetic
atggccgactcccaagtacggtccattgagaatcctgtggttgccccctcctctctccttcccattagatggcttaggtcactttttgttctctccaaccatccgagttcattggcggtaggagacccagcatggcgtat

SEQ ID NO: 2687 - DNA, 140 bp, Artificial Sequence
  Synthetic
atacgccatgctgggtctccactccttaatggcgatggccacgcaagctggggtgttgtttggtatgggcaaagggatgccattctacgcatgggactttggagtcccgctgctaatgatcgtacttgggagtcggccat

SEQ ID NO: 2688 - DNA, 140 bp, Artificial Sequence
  Synthetic
atggccgactcccaagtacgatcattagcagcgggactccaaagtcccatgcgtagaatggcatccctttgcccataccaaacaacaccccagcttgcgtggccatcgccattaaggagtggagacccagcatggcgtat

SEQ ID NO: 2689 - DNA, 140 bp, Artificial Sequence
  Synthetic
atacgccatgctgggtctccgggttgctactcacaattaacacctctgaccctaatagtggccatcattttgctcgtggcgcactacatgtacttgatcccagggctgcaggcagcagctcgtacttgggagtcggccat

SEQ ID NO: 2690 - DNA, 140 bp, Artificial Sequence
  Synthetic
atggccgactcccaagtacgagctgctgcctgcagccctgggatcaagtacatgtagtgcgccacgagcaaaatgatggccactattagggtcagaggtgttaattgtgagtagcaacccggagacccagcatggcgtat

SEQ ID NO: 2691 - DNA, 140 bp, Artificial Sequence
  Synthetic
aggccctggctgctgatatgtgctcgtggcgcactacatgtacttgatcccagggctgcaggcagcagctgcgcgggctgcccagaagagaacggcagctggcatcatgaagaaccctgtgaccttttgggacagcggtg

SEQ ID NO: 2692 - DNA, 140 bp, Artificial Sequence
  Synthetic
caccgctgtcccaaaaggtcacagggttcttcatgatgccagctgccgttctcttctgggcagcccgcgcagctgctgcctgcagccctgggatcaagtacatgtagtgcgccacgagcacatatcagcagccagggcct

SEQ ID NO: 2693 - DNA, 140 bp, Artificial Sequence
  Synthetic
aggccctggctgctgatatgtgtggatggaatagtggtgactgacattgacacaatgacaattgacccccaagtggaaaaaaagatggggcaggtgctactcatagcagtagccgtctccgaccttttgggacagcggtg

SEQ ID NO: 2694 - DNA, 140 bp, Artificial Sequence
  Synthetic
caccgctgtcccaaaaggtcggagacggctactgctatgagtagcacctgccccatctttttttccacttgggggtcaattgtcattgtgtcaatgtcagtcaccactattccatccacacatatcagcagccagggcct

SEQ ID NO: 2695 - DNA, 140 bp, Artificial Sequence
  Synthetic
atacgccatgctgggtctccagcgccatactgtcgcggaccgcctgggggtggggggaggctggggccctgatcacagctgcaacttccaccttgtgggaaggctctccgaacaagtactcgtacttgggagtcggccat

SEQ ID NO: 2696 - DNA, 140 bp, Artificial Sequence
  Synthetic
atggccgactcccaagtacgagtacttgttcggagagccttcccacaaggtggaagttgcagctgtgatcagggccccagcctccccccacccccaggcggtccgcgacagtatggcgctggagacccagcatggcgtat

SEQ ID NO: 2697 - DNA, 140 bp, Artificial Sequence
  Synthetic
aggccctggctgctgatatgcaagagacgtgggggtggaacgggagagaccctgggagagaaatggaaggcccgcctgaaccagatgtcggccctggagttctactcctacaaaaagtcagaccttttgggacagcggtg

SEQ ID NO: 2698 - DNA, 140 bp, Artificial Sequence
  Synthetic
caccgctgtcccaaaaggtctgactttttgtaggagtagaactccagggccgacatctggttcaggcgggccttccatttctctcccagggtctctcccgttccacccccacgtctcttgcatatcagcagccagggcct

SEQ ID NO: 2699 - DNA, 140 bp, Artificial Sequence
  Synthetic
aggccctggctgctgatatgcccgcctgaaccagatgtcggccctggagttctactcctacaaaaagtcaggcatcaccgaggtgtgcagagaagaggcccgccgtgccctcaaggacgggaccttttgggacagcggtg

SEQ ID NO: 2700 - DNA, 140 bp, Artificial Sequence
  Synthetic
caccgctgtcccaaaaggtcccgtccttgagggcacggcgggcctcttctctgcacacctcggtgatgcctgactttttgtaggagtagaactccagggccgacatctggttcaggcgggcatatcagcagccagggcct

SEQ ID NO: 2701 - DNA, 140 bp, Artificial Sequence
  Synthetic
atacgccatgctgggtctcctgtggcaacaggaggccatgctgtgtcccgaggaagtgcaaagcttagatggctggtggagagaggatacctgcagccctatggaaaggtcattgatcttcgtacttgggagtcggccat

SEQ ID NO: 2702 - DNA, 140 bp, Artificial Sequence
  Synthetic
atggccgactcccaagtacgaagatcaatgacctttccatagggctgcaggtatcctctctccaccagccatctaagctttgcacttcctcgggacacagcatggcctcctgttgccacaggagacccagcatggcgtat

SEQ ID NO: 2703 - DNA, 140 bp, Artificial Sequence
  Synthetic
atacgccatgctgggtctccggatgtggcagagggggctggagttactatgccgccaccatccgcaaagttcaggaagtgaaaggatacacaaaaggaggccctggtcatgaagaacccacgtacttgggagtcggccat

SEQ ID NO: 2704 - DNA, 140 bp, Artificial Sequence
  Synthetic
atggccgactcccaagtacgtgggttcttcatgaccagggcctccttttgtgtatcctttcacttcctgaactttgcggatggtggcggcatagtaactccagccccctctgccacatccggagacccagcatggcgtat

SEQ ID NO: 2705 - DNA, 140 bp, Artificial Sequence
  Synthetic
atacgccatgctgggtctcctgttggtgcaaagctatgggtggaacatagtccgtcttaagagtggggtggacgtctttcacatggcggctgagccgtgtgacactttgctgtgtgatatcgtacttgggagtcggccat

SEQ ID NO: 2706 - DNA, 140 bp, Artificial Sequence
  Synthetic
atggccgactcccaagtacgatatcacacagcaaagtgtcacacggctcagccgccatgtgaaagacgtccaccccactcttaagacggactatgttccacccatagctttgcaccaacaggagacccagcatggcgtat

SEQ ID NO: 2707 - DNA, 140 bp, Artificial Sequence
  Synthetic
atacgccatgctgggtctccaggtgagtcatcatctagtcctgaagtggaagaagcacggacgctcagagtcctctccatggtgggggattggcttgaaaaaagaccaggagccttttgtcgtacttgggagtcggccat

SEQ ID NO: 2708 - DNA, 140 bp, Artificial Sequence
  Synthetic
atggccgactcccaagtacgacaaaaggctcctggtcttttttcaagccaatcccccaccatggagaggactctgagcgtccgtgcttcttccacttcaggactagatgatgactcacctggagacccagcatggcgtat

SEQ ID NO: 2709 - DNA, 140 bp, Artificial Sequence
  Synthetic
atacgccatgctgggtctccataaaagtgttgtgcccatacaccagcactatgatggaaaccctggagcgactgcagcgtaggtatgggggaggactggtcagggtgccactctcccgcacgtacttgggagtcggccat

SEQ ID NO: 2710 - DNA, 140 bp, Artificial Sequence
  Synthetic
atggccgactcccaagtacgtgcgggagagtggcaccctgaccagtcctcccccatacctacgctgcagtcgctccagggtttccatcatagtgctggtgtatgggcacaacacttttatggagacccagcatggcgtat

SEQ ID NO: 2711 - DNA, 140 bp, Artificial Sequence
  Synthetic
atacgccatgctgggtctccaaaccctgggatgtggtgactggagtcacaggaatagccatgactgacaccacaccgtatggtcagcaaagagttttcaaggaaaaagtggacactagggcgtacttgggagtcggccat

SEQ ID NO: 2712 - DNA, 140 bp, Artificial Sequence
  Synthetic
atggccgactcccaagtacgccctagtgtccactttttccttgaaaactctttgctgaccatacggtgtggtgtcagtcatggctattcctgtgactccagtcaccacatcccagggtttggagacccagcatggcgtat

SEQ ID NO: 2713 - DNA, 140 bp, Artificial Sequence
  Synthetic
atacgccatgctgggtctcctgccagacccccaagaaggcactcgtcaggttatgagcatggtctcttcctggttatggaaggagctaggcaaacacaaacggccacgagtctgtaccaacgtacttgggagtcggccat

SEQ ID NO: 2714 - DNA, 140 bp, Artificial Sequence
  Synthetic
atggccgactcccaagtacgttggtacagactcgtggccgtttgtgtttgcctagctccttccataaccaggaagagaccatgctcataacctgacgagtgccttcttgggggtctggcaggagacccagcatggcgtat

SEQ ID NO: 2715 - DNA, 140 bp, Artificial Sequence
  Synthetic
atacgccatgctgggtctccttgaagaggaaaaagagtggaagactgcagtggaagctgtgaatgatccaaggttctgggctctagtggacaaggaaagagagcatcacctgagaggagacgtacttgggagtcggccat

SEQ ID NO: 2716 - DNA, 140 bp, Artificial Sequence
  Synthetic
atggccgactcccaagtacgtctcctctcaggtgatgctctctttccttgtccactagagcccagaaccttggatcattcacagcttccactgcagtcttccactctttttcctcttcaaggagacccagcatggcgtat

SEQ ID NO: 2717 - DNA, 140 bp, Artificial Sequence
  Synthetic
atacgccatgctgggtctccggggctagattcctagagttcgaagcccttggattcttgaatgaggatcattggatggggagagagaattcaggaggtggtgttgaaggactgggattaccgtacttgggagtcggccat

SEQ ID NO: 2718 - DNA, 140 bp, Artificial Sequence
  Synthetic
atggccgactcccaagtacggtaatcccagtccttcaacaccacctcctgaattctctctccccatccaatgatcctcattcaagaatccaagggcttcgaactctaggaatctagccccggagacccagcatggcgtat

SEQ ID NO: 2719 - DNA, 140 bp, Artificial Sequence
  Synthetic
atacgccatgctgggtctccatgtatgcagatgatactgctggctgggacacccgcatcagcaggtttgatctggagaatgaagctctaatcaccaaccaaatggagaaagggcacagggcgtacttgggagtcggccat

SEQ ID NO: 2720 - DNA, 140 bp, Artificial Sequence
  Synthetic
atggccgactcccaagtacgccctgtgccctttctccatttggttggtgattagagcttcattctccagatcaaacctgctgatgcgggtgtcccagccagcagtatcatctgcatacatggagacccagcatggcgtat

SEQ ID NO: 2721 - DNA, 140 bp, Artificial Sequence
  Synthetic
aggccctggctgctgatatggtccttagaccagctgaaaaagggaagacagttatggacattatttcaagacaagaccaaagggggagcggacaagttgtcacttacgctcttaatacatgaccttttgggacagcggtg

SEQ ID NO: 2722 - DNA, 140 bp, Artificial Sequence
  Synthetic
caccgctgtcccaaaaggtcatgtattaagagcgtaagtgacaacttgtccgctccccctttggtcttgtcttgaaataatgtccataactgtcttccctttttcagctggtctaaggaccatatcagcagccagggcct

SEQ ID NO: 2723 - DNA, 140 bp, Artificial Sequence
  Synthetic
atacgccatgctgggtctccacttcaacaaactccatcttaaggacgggaggtccattgtggttccctgccgccaccaagatgaactgattggccgagcccgcgtatcaccaggggcgggcgtacttgggagtcggccat

SEQ ID NO: 2724 - DNA, 140 bp, Artificial Sequence
  Synthetic
atggccgactcccaagtacgcccgcccctggtgatacgcgggctcggccaatcagttcatcttggtggcggcagggaaccacaatggacctcccgtccttaagatggagtttgttgaagtggagacccagcatggcgtat

SEQ ID NO: 2725 - DNA, 140 bp, Artificial Sequence
  Synthetic
aggccctggctgctgatatgatttgttcatctgtgccagttgattgggttccaactgggagaactacctggtcaatccatggaaagggagaatggatgaccactgaagacatgcttgtgggaccttttgggacagcggtg

SEQ ID NO: 2726 - DNA, 140 bp, Artificial Sequence
  Synthetic
caccgctgtcccaaaaggtcccacaagcatgtcttcagtggtcatccattctccctttccatggattgaccaggtagttctcccagttggaacccaatcaactggcacagatgaacaaatcatatcagcagccagggcct

SEQ ID NO: 2727 - DNA, 140 bp, Artificial Sequence
  Synthetic
atacgccatgctgggtctcctatggaacagagtgtggattgaggaaaacgaccacatggaagacaagaccccagttacaaaatggacagacattccctatttgggaaaaagagaagacttcgtacttgggagtcggccat

SEQ ID NO: 2728 - DNA, 140 bp, Artificial Sequence
  Synthetic
atggccgactcccaagtacgaagtcttctctttttcccaaatagggaatgtctgtccattttgtaactggggtcttgtcttccatgtggtcgttttcctcaatccacactctgttccataggagacccagcatggcgtat

SEQ ID NO: 2729 - DNA, 140 bp, Artificial Sequence
  Synthetic
atacgccatgctgggtctccgtggtgtggatctctcatagggcacagaccgcgtactacctgggctgagaacatcaaaaatacagtcaacatgatgcgcaggatcataggtgatgaagaacgtacttgggagtcggccat

SEQ ID NO: 2730 - DNA, 140 bp, Artificial Sequence
  Synthetic
atggccgactcccaagtacgttcttcatcacctatgatcctgcgcatcatgttgactgtatttttgatgttctcagcccaggtagtacgcggtctgtgccctatgagagatccacaccacggagacccagcatggcgtat

SEQ ID NO: 2731 - DNA, 140 bp, Artificial Sequence
  Synthetic
aggccctggctgctgatatgcatgatgcgcaggatcataggtgatgaagaaaagtacatggactacctatccacccaggttcgctacttgggtgaagaagggtccacacctggagtgctggaccttttgggacagcggtg

SEQ ID NO: 2732 - DNA, 140 bp, Artificial Sequence
  Synthetic
caccgctgtcccaaaaggtccagcactccaggtgtggacccttcttcacccaagtagcgaacctgggtggataggtagtccatgtacttttcttcatcacctatgatcctgcgcatcatgcatatcagcagccagggcct

SEQ ID NO: 2733 - DNA, 140 bp, Artificial Sequence
  Synthetic
aggccctggctgctgatatgctagcctttttgagattcacggcaatcaagccatcactgggtctcatcaatagatggggttcagtgggaaaaaaagaggctatggaaataataaagaagtgaccttttgggacagcggtg

SEQ ID NO: 2734 - DNA, 140 bp, Artificial Sequence
  Synthetic
caccgctgtcccaaaaggtcacttctttattatttccatagcctctttttttcccactgaaccccatctattgatgagacccagtgatggcttgattgccgtgaatctcaaaaaggctagcatatcagcagccagggcct

SEQ ID NO: 2735 - DNA, 140 bp, Artificial Sequence
  Synthetic
aggccctggctgctgatatgaagaagagacgaggcacagatactagtgtcggaattgttggcctcctgctgaccacagctatggcagcggaggtcactagacgtgggagtgcatactatagaccttttgggacagcggtg

SEQ ID NO: 2736 - DNA, 140 bp, Artificial Sequence
  Synthetic
caccgctgtcccaaaaggtctatagtatgcactcccacgtctagtgacctccgctgccatagctgtggtcagcaggaggccaacaattccgacactagtatctgtgcctcgtctcttcttcatatcagcagccagggcct

SEQ ID NO: 2737 - DNA, 140 bp, Artificial Sequence
  Synthetic
aggccctggctgctgatatgtgtacttggacagaagcgatgctggggaggccatatcttttccaaccacactggggatgaataagtgttatatacagatcatggatcttggacacatgtggaccttttgggacagcggtg

SEQ ID NO: 2738 - DNA, 140 bp, Artificial Sequence
  Synthetic
caccgctgtcccaaaaggtccacatgtgtccaagatccatgatctgtatataacacttattcatccccagtgtggttggaaaagatatggcctccccagcatcgcttctgtccaagtacacatatcagcagccagggcct

SEQ ID NO: 2739 - DNA, 140 bp, Artificial Sequence
  Synthetic
atacgccatgctgggtctcctgatgccaccatgagctatgaatgccctatgctggatgagggggtagaaccagatgacgtcgattgttggtgcaacacgacgtcaacttgggttgtgtaccgtacttgggagtcggccat

SEQ ID NO: 2740 - DNA, 140 bp, Artificial Sequence
  Synthetic
atggccgactcccaagtacggtacacaacccaagttgacgtcgtgttgcaccaacaatcgacgtcatctggttctaccccctcatccagcatagggcattcatagctcatggtggcatcaggagacccagcatggcgtat

SEQ ID NO: 2741 - DNA, 140 bp, Artificial Sequence
  Synthetic
atacgccatgctgggtctccggaacctgccatcacaaaaaaggtgaagcacggagatccagaagagctgtgacgctcccctcccattccactaggaagctgcaaacgcggtcgcagacctcgtacttgggagtcggccat

SEQ ID NO: 2742 - DNA, 140 bp, Artificial Sequence
  Synthetic
atggccgactcccaagtacgaggtctgcgaccgcgtttgcagcttcctagtggaatgggaggggagcgtcacagctcttctggatctccgtgcttcaccttttttgtgatggcaggttccggagacccagcatggcgtat

SEQ ID NO: 2743 - DNA, 140 bp, Artificial Sequence
  Synthetic
atacgccatgctgggtctcctttgggaagctcaacgagccaaaaagtcatatacttggtcatgatactgctgattgccccggcatacagcatcaggtgcataggagtcagtaatagggaccgtacttgggagtcggccat

SEQ ID NO: 2744 - DNA, 140 bp, Artificial Sequence
  Synthetic
atggccgactcccaagtacggtccctattactgactcctatgcacctgatgctgtatgccggggcaatcagcagtatcatgaccaagtatatgactttttggctcgttgagcttcccaaaggagacccagcatggcgtat

SEQ ID NO: 2745 - DNA, 140 bp, Artificial Sequence
  Synthetic
atacgccatgctgggtctcccaggccttgacttttcagatttgtattacttgactatgaacaacaagcactggttggttcacaaggagtggttccacgacattccattaccttggcacaccgtacttgggagtcggccat

SEQ ID NO: 2746 - DNA, 140 bp, Artificial Sequence
  Synthetic
atggccgactcccaagtacggtgtgccaaggtaatggaatgtcgtggaaccactccttgtgaaccaaccagtgcttgttgttcatagtcaagtaatacaaatctgaaaagtcaaggcctgggagacccagcatggcgtat

SEQ ID NO: 2747 - DNA, 140 bp, Artificial Sequence
  Synthetic
aggccctggctgctgatatgtggggcagacaccggaactccacactggaacaacaaagaagcactggtagagttcaaggacgcacatgccaaaaggcaaactgtcgtggttctagggagtgaccttttgggacagcggtg

SEQ ID NO: 2748 - DNA, 140 bp, Artificial Sequence
  Synthetic
caccgctgtcccaaaaggtcactccctagaaccacgacagtttgccttttggcatgtgcgtccttgaactctaccagtgcttctttgttgttccagtgtggagttccggtgtctgccccacatatcagcagccagggcct

SEQ ID NO: 2749 - DNA, 140 bp, Artificial Sequence
  Synthetic
atacgccatgctgggtctccagatggcggtggacatgcaaactctgaccccagttgggaggttgataaccgctaaccccgtaatcactgaaggcactgagaactctaagatgatgctggacgtacttgggagtcggccat

SEQ ID NO: 2750 - DNA, 140 bp, Artificial Sequence
  Synthetic
atggccgactcccaagtacgtccagcatcatcttagagttctcagtgccttcagtgattacggggttagcggttatcaacctcccaactggggtcagagtttgcatgtccaccgccatctggagacccagcatggcgtat

SEQ ID NO: 2751 - DNA, 140 bp, Artificial Sequence
  Synthetic
aggccctggctgctgatatgtttgaagccactgtgagaggtgccaagagaatggcagtcttgggagacacagcctgggactttggatcagttggaggcgttcttaactcattgggcaagggaccttttgggacagcggtg

SEQ ID NO: 2752 - DNA, 140 bp, Artificial Sequence
  Synthetic
caccgctgtcccaaaaggtcccttgcccaatgagttaagaacgcctccaactgatccaaagtcccaggctgtgtctcccaagactgccattctcttggcacctctcacagtggcttcaaacatatcagcagccagggcct

SEQ ID NO: 2753 - DNA, 140 bp, Artificial Sequence
  Synthetic
atacgccatgctgggtctccgaatacaaagaatggatctatttcccttatgtgcttggccttagggggagtgttgatcttcttatccacagccgtctccgctgatgtggggtgctcggtgcgtacttgggagtcggccat

SEQ ID NO: 2754 - DNA, 140 bp, Artificial Sequence
  Synthetic
atggccgactcccaagtacgcaccgagcaccccacatcagcggagacggctgtggataagaagatcaacactccccctaaggccaagcacataagggaaatagatccattctttgtattcggagacccagcatggcgtat

SEQ ID NO: 2755 - DNA, 140 bp, Artificial Sequence
  Synthetic
aggccctggctgctgatatgcgacgttgaagcctggagggacaggtacaagtaccatcctgactcccctcgtagattggcagcagtagtcaagcaagcctgggaagatggtatctgtggggaccttttgggacagcggtg

SEQ ID NO: 2756 - DNA, 140 bp, Artificial Sequence
  Synthetic
caccgctgtcccaaaaggtccccacagataccatcttcccaggcttgcttgactactgctgccaatctacgaggggagtcaggatggtacttgtacctgtccctccaggcttcaacgtcgcatatcagcagccagggcct

SEQ ID NO: 2757 - DNA, 140 bp, Artificial Sequence
  Synthetic
aggccctggctgctgatatggatcatgggttcggggtatttcacactagtgtctggctcaaggttagagaagattattcactagagtgtgatccagccgtcattggaacagctgttaagggaccttttgggacagcggtg

SEQ ID NO: 2758 - DNA, 140 bp, Artificial Sequence
  Synthetic
caccgctgtcccaaaaggtcccttaacagctgttccaatgacggctggatcacactctagtgaataatcttctctaaccttgagccagacactagtgtgaaataccccgaacccatgatccatatcagcagccagggcct

SEQ ID NO: 2759 - DNA, 140 bp, Artificial Sequence
  Synthetic
aggccctggctgctgatatggaaaggaggctgtacacagtgatctaggctactggattgagagtgagaagaacgacacatggaggctgaggagggcccacctgatcgagatgaaaacatggaccttttgggacagcggtg

SEQ ID NO: 2760 - DNA, 140 bp, Artificial Sequence
  Synthetic
caccgctgtcccaaaaggtccatgttttcatctcgatcaggtgggccctcctcagcctccatgtgtcgttcttctcactctcaatccagtagcctagatcactgtgtacagcctcctttccatatcagcagccagggcct

SEQ ID NO: 2761 - DNA, 140 bp, Artificial Sequence
  Synthetic
aggccctggctgctgatatgatctgatcatacccaagtctttagctgggccactcagccatcacaacaccagagagggctacaggacccaaatgaaagggccatggcacagtgaagagctgaccttttgggacagcggtg

SEQ ID NO: 2762 - DNA, 140 bp, Artificial Sequence
  Synthetic
caccgctgtcccaaaaggtcagctcttcactgtgccatggccctttcatttgggtcctgtagccctctctggtgttgtgatggctgagtggcccagctaaagacttgggtatgatcagatcatatcagcagccagggcct

SEQ ID NO: 2763 - DNA, 140 bp, Artificial Sequence
  Synthetic
atacgccatgctgggtctccaaccagaaagtaacttagtaaggtcaatggtgactgcaggatcaactgatcacatggatcacttttcccttggagtgcttgtgattctgctcatggtgcacgtacttgggagtcggccat

SEQ ID NO: 2764 - DNA, 140 bp, Artificial Sequence
  Synthetic
atggccgactcccaagtacgtgcaccatgagcagaatcacaagcactccaagggaaaagtgatccatgtgatcagttgatcctgcagtcaccattgaccttactaagttactttctggttggagacccagcatggcgtat

SEQ ID NO: 2765 - DNA, 140 bp, Artificial Sequence
  Synthetic
atacgccatgctgggtctccggaagggctgaagaagagaatgaccacaaagatcatcataagcacatcaatggcagtgctggtagctatgatcctgggaggattttcaatgagtgatctgcgtacttgggagtcggccat

SEQ ID NO: 2766 - DNA, 140 bp, Artificial Sequence
  Synthetic
atggccgactcccaagtacgcagatcactcattgaaaatcctcccaggatcatagctaccagcactgccattgatgtgcttatgatgatctttgtggtcattctcttcttcagcccttccggagacccagcatggcgtat

SEQ ID NO: 2767 - DNA, 140 bp, Artificial Sequence
  Synthetic
atacgccatgctgggtctccgctaagcttgcaattttgatgggtgccacctttgcggaaatgaacactggaggagatgtagctcatctggcgctggtagcggcattcaaagtcagaccagcgtacttgggagtcggccat

SEQ ID NO: 2768 - DNA, 140 bp, Artificial Sequence
  Synthetic
atggccgactcccaagtacgctggtctgactttgaatgccgctaccagcgccagatgagctacatctcctccagtgttcatttccgcaaaggtggcacccatcaaaattgcaagcttagcggagacccagcatggcgtat

SEQ ID NO: 2769 - DNA, 140 bp, Artificial Sequence
  Synthetic
aggccctggctgctgatatgggaaggcgacctgatggttctcatcaatggttttgctttggcctggttggcaatacgagcgatggttgttccacgcactgacaatatcaccttggcaatcgaccttttgggacagcggtg

SEQ ID NO: 2770 - DNA, 140 bp, Artificial Sequence
  Synthetic
caccgctgtcccaaaaggtcgattgccaaggtgatattgtcagtgcgtggaacaaccatcgctcgtattgccaaccaggccaaagcaaaaccattgatgagaaccatcaggtcgccttcccatatcagcagccagggcct

SEQ ID NO: 2771 - DNA, 140 bp, Artificial Sequence
  Synthetic
atacgccatgctgggtctccaaaaagatgcggaagttactggaaacagtccccggctcgatgtggcactagatgagagtggtgatttctccctggtggaggatgacggtccccccatgagcgtacttgggagtcggccat

SEQ ID NO: 2772 - DNA, 140 bp, Artificial Sequence
  Synthetic
atggccgactcccaagtacgctcatggggggaccgtcatcctccaccagggagaaatcaccactctcatctagtgccacatcgagccggggactgtttccagtaacttccgcatctttttggagacccagcatggcgtat

SEQ ID NO: 2773 - DNA, 140 bp, Artificial Sequence
  Synthetic
atacgccatgctgggtctccagagatcatactcaaagtggtcctgatgaccatctgtggcatgaacccaatagccataccctttgcagctggagcgtggtacgtatacgtgaaaactggacgtacttgggagtcggccat

SEQ ID NO: 2774 - DNA, 140 bp, Artificial Sequence
  Synthetic
atggccgactcccaagtacgtccagttttcacgtatacgtaccacgctccagctgcaaagggtatggctattgggttcatgccacagatggtcatcaggaccactttgagtatgatctctggagacccagcatggcgtat

SEQ ID NO: 2775 - DNA, 140 bp, Artificial Sequence
  Synthetic
aggccctggctgctgatatggttcaacacaagttggagtgggagttatgcaagagggggtctttcacactatgtggcatgtcacaaaaggatccgcgctgagaagcggtgaagggagactgaccttttgggacagcggtg

SEQ ID NO: 2776 - DNA, 140 bp, Artificial Sequence
  Synthetic
caccgctgtcccaaaaggtcagtctcccttcaccgcttctcagcgcggatccttttgtgacatgccacatagtgtgaaagaccccctcttgcataactcccactccaacttgtgttgaaccatatcagcagccagggcct

SEQ ID NO: 2777 - DNA, 140 bp, Artificial Sequence
  Synthetic
atacgccatgctgggtctccatttaagacaaaggatggggacattggagcggttgcgctggactatccagcaggaacttcaggatctccaatcctagacaagtgtgggagagtgataggacgtacttgggagtcggccat

SEQ ID NO: 2778 - DNA, 140 bp, Artificial Sequence
  Synthetic
atggccgactcccaagtacgtcctatcactctcccacacttgtctaggattggagatcctgaagttcctgctggatagtccagcgcaaccgctccaatgtccccatcctttgtcttaaatggagacccagcatggcgtat

SEQ ID NO: 2779 - DNA, 140 bp, Artificial Sequence
  Synthetic
aggccctggctgctgatatgcaggaacttcaggatctccaatcctagacaagtgtgggagagtgataggactctatggcaatggggtcgtgatcaagaatgggagttatgtcagtgccatgaccttttgggacagcggtg

SEQ ID NO: 2780 - DNA, 140 bp, Artificial Sequence
  Synthetic
caccgctgtcccaaaaggtcatggcactgacataactcccattcttgatcacgaccccattgccatagagtcctatcactctcccacacttgtctaggattggagatcctgaagttcctgcatatcagcagccagggcct

SEQ ID NO: 2781 - DNA, 140 bp, Artificial Sequence
  Synthetic
aggccctggctgctgatatgcgatgctgaagaagaagcagctaactgtcttagacttgcatcctggagctgggaaaaccaggagagttcttcctgaaatagtccgtgaagccataaaaacgaccttttgggacagcggtg

SEQ ID NO: 2782 - DNA, 140 bp, Artificial Sequence
  Synthetic
caccgctgtcccaaaaggtcgtttttatggcttcacggactatttcaggaagaactctcctggttttcccagctccaggatgcaagtctaagacagttagctgcttcttcttcagcatcgcatatcagcagccagggcct

SEQ ID NO: 2783 - DNA, 140 bp, Artificial Sequence
  Synthetic
atacgccatgctgggtctccgggaaaaccaggagagttcttcctgaaatagtccgtgaagccataaaaacgagactccgtactgtgatcttagctccaaccagggttgtcgctgctgaaacgtacttgggagtcggccat

SEQ ID NO: 2784 - DNA, 140 bp, Artificial Sequence
  Synthetic
atggccgactcccaagtacgtttcagcagcgacaaccctggttggagctaagatcacagtacggagtctcgtttttatggcttcacggactatttcaggaagaactctcctggttttcccggagacccagcatggcgtat

SEQ ID NO: 2785 - DNA, 140 bp, Artificial Sequence
  Synthetic
atacgccatgctgggtctccaatgtcacccattctgggacagaaatcgttgacttaatgtgccatgccaccttcacttcacgtctactacagccaatcagagtccccaactataatctgtcgtacttgggagtcggccat

SEQ ID NO: 2786 - DNA, 140 bp, Artificial Sequence
  Synthetic
atggccgactcccaagtacgacagattatagttggggactctgattggctgtagtagacgtgaagtgaaggtggcatggcacattaagtcaacgatttctgtcccagaatgggtgacattggagacccagcatggcgtat

SEQ ID NO: 2787 - DNA, 140 bp, Artificial Sequence
  Synthetic
atacgccatgctgggtctccggatacatttcaacaagggttgagatgggcgaggcagctgccatcttcatgaccgccacgccaccaggaacccgtgacgcattcccggactccaactcaccgtacttgggagtcggccat

SEQ ID NO: 2788 - DNA, 140 bp, Artificial Sequence
  Synthetic
atggccgactcccaagtacggtgagttggagtccgggaatgcgtcacgggttcctggtggcgtggcggtcatgaagatggcagctgcctcgcccatctcaacccttgttgaaatgtatccggagacccagcatggcgtat

SEQ ID NO: 2789 - DNA, 140 bp, Artificial Sequence
  Synthetic
atacgccatgctgggtctcccaattatggacaccgaagtggaagtcccagagagagcctggagctcaggctttgattgggtgacggatcattctggaaaaacagtttggtttgtcccaagcgtacttgggagtcggccat

SEQ ID NO: 2790 - DNA, 140 bp, Artificial Sequence
  Synthetic
atggccgactcccaagtacgcttgggacaaaccaaactgtttttccagaatgatccgtcacccaatcaaagcctgagctccaggctctctctgggacttccacttcggtgtccataattgggagacccagcatggcgtat

SEQ ID NO: 2791 - DNA, 140 bp, Artificial Sequence
  Synthetic
atacgccatgctgggtctccgggtcatacagctcagcagaaagacttttgagacagagttccagaaaacaaaacatcaagagtgggacttcgtcgtgacaactgacatttcagagatgggcgtacttgggagtcggccat

SEQ ID NO: 2792 - DNA, 140 bp, Artificial Sequence
  Synthetic
atggccgactcccaagtacgcccatctctgaaatgtcagttgtcacgacgaagtcccactcttgatgttttgttttctggaactctgtctcaaaagtctttctgctgagctgtatgacccggagacccagcatggcgtat

SEQ ID NO: 2793 - DNA, 140 bp, Artificial Sequence
  Synthetic
atacgccatgctgggtctcccaaacctggagatgagtatctgtatggaggtgggtgcgcagagactgatgaagaccatgcacactggcttgaagcaagaatgctccttgacaatatttaccgtacttgggagtcggccat

SEQ ID NO: 2794 - DNA, 140 bp, Artificial Sequence
  Synthetic
atggccgactcccaagtacggtaaatattgtcaaggagcattcttgcttcaagccagtgtgcatggtcttcatcagtctctgcgcacccacctccatacagatactcatctccaggtttgggagacccagcatggcgtat

SEQ ID NO: 2795 - DNA, 140 bp, Artificial Sequence
  Synthetic
atacgccatgctgggtctccgaaaagaggagcggcttttggagtgatggaagccctgggaacactgccaggacacatgacggagagattccaggaagccattgacaacctcgctgtgctccgtacttgggagtcggccat

SEQ ID NO: 2796 - DNA, 140 bp, Artificial Sequence
  Synthetic
atggccgactcccaagtacggagcacagcgaggttgtcaatggcttcctggaatctctccgtcatgtgtcctggcagtgttcccagggcttccatcactccaaaagccgctcctcttttcggagacccagcatggcgtat

SEQ ID NO: 2797 - DNA, 140 bp, Artificial Sequence
  Synthetic
aggccctggctgctgatatgggaaattgagccagccagaattgcatgcgtcctcattgttgtgttcctattgctggtggtgctcatacctgagccagaaaagcaaagatccccccaggacgaccttttgggacagcggtg

SEQ ID NO: 2798 - DNA, 140 bp, Artificial Sequence
  Synthetic
caccgctgtcccaaaaggtcgtcctggggggatctttgcttttctggctcaggtatgagcaccaccagcaataggaacacaacaatgaggacgcatgcaattctggctggctcaatttcccatatcagcagccagggcct

SEQ ID NO: 2799 - DNA, 140 bp, Artificial Sequence
  Synthetic
atacgccatgctgggtctccatctaatgggaaggagagaggagggggcaaccataggattctcaatggacattgacctgcggccagcctcggcctgggccatctatgctgccctgacaaccgtacttgggagtcggccat

SEQ ID NO: 2800 - DNA, 140 bp, Artificial Sequence
  Synthetic
atggccgactcccaagtacggttgtcagggcagcatagatggcccaggccgaggctggccgcaggtcaatgtccattgagaatcctatggttgccccctcctctctccttcccattagatggagacccagcatggcgtat

SEQ ID NO: 2801 - DNA, 140 bp, Artificial Sequence
  Synthetic
aggccctggctgctgatatgaaagggatgccattctacgcatgggactttggagtcccgctgctaatgataggttgctactcacaattaacacccctgaccctaatagtggctatcatttgaccttttgggacagcggtg

SEQ ID NO: 2802 - DNA, 140 bp, Artificial Sequence
  Synthetic
caccgctgtcccaaaaggtcaaatgatagccactattagggtcaggggtgttaattgtgagtagcaacctatcattagcagcgggactccaaagtcccatgcgtagaatggcatccctttcatatcagcagccagggcct

SEQ ID NO: 2803 - DNA, 140 bp, Artificial Sequence
  Synthetic
atacgccatgctgggtctcctgtggatggaatagtggtgactgacattgacacaatgactattgacccccaagtggagaaaaagatgggacaggtgctactcatagcagtagccgtctcccgtacttgggagtcggccat

SEQ ID NO: 2804 - DNA, 140 bp, Artificial Sequence
  Synthetic
atggccgactcccaagtacgggagacggctactgctatgagtagcacctgtcccatctttttctccacttgggggtcaatagtcattgtgtcaatgtcagtcaccactattccatccacaggagacccagcatggcgtat

SEQ ID NO: 2805 - DNA, 140 bp, Artificial Sequence
  Synthetic
atacgccatgctgggtctccagcgccatactgtcgcggaccgcctgggggtggggggaagctggggccctgatcacagctgcaacttccactttgtgggaaggctctccgaacaagtactcgtacttgggagtcggccat

SEQ ID NO: 2806 - DNA, 140 bp, Artificial Sequence
  Synthetic
atggccgactcccaagtacgagtacttgttcggagagccttcccacaaagtggaagttgcagctgtgatcagggccccagcttccccccacccccaggcggtccgcgacagtatggcgctggagacccagcatggcgtat

SEQ ID NO: 2807 - DNA, 140 bp, Artificial Sequence
  Synthetic
atacgccatgctgggtctccggaactcctctacagccacttcactgtgcaacatttttaggggaagttacttggctggagcttctctaatctacacagtaacaagaaacgctggcttggtcgtacttgggagtcggccat

SEQ ID NO: 2808 - DNA, 140 bp, Artificial Sequence
  Synthetic
atggccgactcccaagtacgaccaagccagcgtttcttgttactgtgtagattagagaagctccagccaagtaacttcccctaaaaatgttgcacagtgaagtggctgtagaggagttccggagacccagcatggcgtat

SEQ ID NO: 2809 - DNA, 140 bp, Artificial Sequence
  Synthetic
aggccctggctgctgatatgtcctctccatggtgggggattggcttgaaaaaagaccaggagccttttgtgtaaaagtgttgtgcccatacaccagcactatgatggaaaccctggagcggaccttttgggacagcggtg

SEQ ID NO: 2810 - DNA, 140 bp, Artificial Sequence
  Synthetic
caccgctgtcccaaaaggtccgctccagggtttccatcatagtgctggtgtatgggcacaacacttttacacaaaaggctcctggtcttttttcaagccaatcccccaccatggagaggacatatcagcagccagggcct

SEQ ID NO: 2811 - DNA, 140 bp, Artificial Sequence
  Synthetic
aggccctggctgctgatatgcacaccgtatggtcagcaaagagttttcaaggaaaaagtggacaccagggtgccagacccccaagaaggcactcgtcaggttatgagcatggtctcttccgaccttttgggacagcggtg

SEQ ID NO: 2812 - DNA, 140 bp, Artificial Sequence
  Synthetic
caccgctgtcccaaaaggtcggaagagaccatgctcataacctgacgagtgccttcttgggggtctggcaccctggtgtccactttttccttgaaaactctttgctgaccatacggtgtgcatatcagcagccagggcct

SEQ ID NO: 2813 - DNA, 140 bp, Artificial Sequence
  Synthetic
aggccctggctgctgatatgagaagagttcatcaacaaggttcgtagcaatgcagcattaggggcaatatttgaagaggaaaaagagtggaagaccgcagtggaagctgtgaacgatccagaccttttgggacagcggtg

SEQ ID NO: 2814 - DNA, 140 bp, Artificial Sequence
  Synthetic
caccgctgtcccaaaaggtctggatcgttcacagcttccactgcggtcttccactctttttcctcttcaaatattgcccctaatgctgcattgctacgaaccttgttgatgaactcttctcatatcagcagccagggcct

SEQ ID NO: 2815 - DNA, 140 bp, Artificial Sequence
  Synthetic
aggccctggctgctgatatgaggttctgggctctagtggacaaggaaagagagcaccacctgagaggagagtgccagagctgtgtgtacaacatgatgggaaaaagagaaaagaaacaaggaccttttgggacagcggtg

SEQ ID NO: 2816 - DNA, 140 bp, Artificial Sequence
  Synthetic
caccgctgtcccaaaaggtccttgtttcttttctctttttcccatcatgttgtacacacagctctggcactctcctctcaggtggtgctctctttccttgtccactagagcccagaacctcatatcagcagccagggcct

SEQ ID NO: 2817 - DNA, 140 bp, Artificial Sequence
  Synthetic
atacgccatgctgggtctccgggaatttggaaaggccaagggcagccgcgccatctggtatatgtggctaggggctagatttctagagttcgaagcccttggattcttaaatgaggatcacgtacttgggagtcggccat

SEQ ID NO: 2818 - DNA, 140 bp, Artificial Sequence
  Synthetic
atggccgactcccaagtacgtgatcctcatttaagaatccaagggcttcgaactctagaaatctagcccctagccacatataccagatggcgcggctgcccttggcctttccaaattcccggagacccagcatggcgtat

SEQ ID NO: 2819 - DNA, 140 bp, Artificial Sequence
  Synthetic
aggccctggctgctgatatgaggttcttgaatgatatgggaaaagttaggaaggacacacaagagtggaaaccctcaactggatgggacaactgggaagaagttccgttttgttcccaccgaccttttgggacagcggtg

SEQ ID NO: 2820 - DNA, 140 bp, Artificial Sequence
  Synthetic
caccgctgtcccaaaaggtcggtgggaacaaaacggaacttcttcccagttgtcccatccagttgagggtttccactcttgtgtgtccttcctaacttttcccatatcattcaagaacctcatatcagcagccagggcct

SEQ ID NO: 2821 - DNA, 140 bp, Artificial Sequence
  Synthetic
atacgccatgctgggtctccacttcaacaagctccatctcaaggacgggaggtccattgtggttccctgccgccaccaagatgaactgattggccgggcccgtgtctctccaggggcgggcgtacttgggagtcggccat

SEQ ID NO: 2822 - DNA, 140 bp, Artificial Sequence
  Synthetic
atggccgactcccaagtacgcccgcccctggagagacacgggcccggccaatcagttcatcttggtggcggcagggaaccacaatggacctcccgtccttgagatggagcttgttgaagtggagacccagcatggcgtat

SEQ ID NO: 2823 - DNA, 140 bp, Artificial Sequence
  Synthetic
atacgccatgctgggtctccatggagcatccgggagactgcttgcctagcaaagtcatatgcgcaaatgtggcagctcctttatttccacagaagggacctccgactgatggccaatgcccgtacttgggagtcggccat

SEQ ID NO: 2824 - DNA, 140 bp, Artificial Sequence
  Synthetic
atggccgactcccaagtacgggcattggccatcagtcggaggtcccttctgtggaaataaaggagctgccacatttgcgcatatgactttgctaggcaagcagtctcccggatgctccatggagacccagcatggcgtat

SEQ ID NO: 2825 - DNA, 140 bp, Artificial Sequence
  Synthetic
aggccctggctgctgatatgtgtggaacagagtgtggattgaggagaacgaccacatggaagacaagaccccagttacgaaatggacagacattccctatctgggaaaaagggaagacttgaccttttgggacagcggtg

SEQ ID NO: 2826 - DNA, 140 bp, Artificial Sequence
  Synthetic
caccgctgtcccaaaaggtcaagtcttccctttttcccagatagggaatgtctgtccatttcgtaactggggtcttgtcttccatgtggtcgttctcctcaatccacactctgttccacacatatcagcagccagggcct

SEQ ID NO: 2827 - DNA, 140 bp, Artificial Sequence
  Synthetic
aggccctggctgctgatatgcatggtgcgcaggatcataggtgatgaagaaaagtacatggactacctatccacccaagttcgctacttgggtgaagaagggtctacacctggagtgctagaccttttgggacagcggtg

SEQ ID NO: 2828 - DNA, 140 bp, Artificial Sequence
  Synthetic
caccgctgtcccaaaaggtctagcactccaggtgtagacccttcttcacccaagtagcgaacttgggtggataggtagtccatgtacttttcttcatcacctatgatcctgcgcaccatgcatatcagcagccagggcct

SEQ ID NO: 2829 - DNA, 140 bp, Artificial Sequence
  Synthetic
aggccctggctgctgatatgttcgaagcccttggattcttgaacgaggatcactggatggggagagagaactcaggaggtggtgttgaagggctgggattacaaagactcggatatgtccgaccttttgggacagcggtg

SEQ ID NO: 2830 - DNA, 140 bp, Artificial Sequence
  Synthetic
caccgctgtcccaaaaggtcggacatatccgagtctttgtaatcccagcccttcaacaccacctcctgagttctctctccccatccagtgatcctcgttcaagaatccaagggcttcgaacatatcagcagccagggcct

SEQ ID NO: 2831 - DNA, 140 bp, Artificial Sequence
  Synthetic
aggccctggctgctgatatggctggctgggacacccgcatcagcaggtttgatctggagaatgaagctctaatcaccaaccaaatggagaaagggcacagggccttggcattggccataagaccttttgggacagcggtg

SEQ ID NO: 2832 - DNA, 140 bp, Artificial Sequence
  Synthetic
caccgctgtcccaaaaggtcttatggccaatgccaaggccctgtgccctttctccatttggttggtgattagagcttcattctccagatcaaacctgctgatgcgggtgtcccagccagccatatcagcagccagggcct

SEQ ID NO: 2833 - DNA, 140 bp, Artificial Sequence
  Synthetic
aggccctggctgctgatatgacaactgggaagaagttccgttttgctcccaccacttcaacaagctccatctcaaggacgggaggtccattgtggttccctgccgccaccaagatgaactgaccttttgggacagcggtg

SEQ ID NO: 2834 - DNA, 140 bp, Artificial Sequence
  Synthetic
caccgctgtcccaaaaggtcagttcatcttggtggcggcagggaaccacaatggacctcccgtccttgagatggagcttgttgaagtggtgggagcaaaacggaacttcttcccagttgtcatatcagcagccagggcct

SEQ ID NO: 2835 - DNA, 140 bp, Artificial Sequence
  Synthetic
aggccctggctgctgatatgatcaggtgcataggagtcagcaatagggactttgtggaaggtatgtcaggtgggacttgggttgatgttgtcttggaacatggaggttgtgtcaccgtaagaccttttgggacagcggtg

SEQ ID NO: 2836 - DNA, 140 bp, Artificial Sequence
  Synthetic
caccgctgtcccaaaaggtcttacggtgacacaacctccatgttccaagacaacatcaacccaagtcccacctgacataccttccacaaagtccctattgctgactcctatgcacctgatcatatcagcagccagggcct

SEQ ID NO: 2837 - DNA, 140 bp, Artificial Sequence
  Synthetic
aggccctggctgctgatatgagcaatcagacactcaatatgtctgcaaaagaacgttagtggacagaggctggggaaatggatgtggactttttggcaaagggagcctggtgacatgcgcgaccttttgggacagcggtg

SEQ ID NO: 2838 - DNA, 140 bp, Artificial Sequence
  Synthetic
caccgctgtcccaaaaggtcgcgcatgtcaccaggctccctttgccaaaaagtccacatccatttccccagcctctgtccactaacgttcttttgcagacatattgagtgtctgattgctcatatcagcagccagggcct

SEQ ID NO: 2839 - DNA, 140 bp, Artificial Sequence
  Synthetic
aggccctggctgctgatatgtgagataacgcccaattcaccaagagccgaagccaccctggggggttttggaagcctaggacttgattgtgaaccgaggacaggccttgacttttcagatgaccttttgggacagcggtg

SEQ ID NO: 2840 - DNA, 140 bp, Artificial Sequence
  Synthetic
caccgctgtcccaaaaggtcatctgaaaagtcaaggcctgtcctcggttcacaatcaagtcctaggcttccaaaaccccccagggtggcttcggctcttggtgaattgggcgttatctcacatatcagcagccagggcct

SEQ ID NO: 2841 - DNA, 140 bp, Artificial Sequence
  Synthetic
atacgccatgctgggtctccaagggcgtgtcatactccttgtgtaccgcagcgttcacattcaccaagatcccggctgaaacactgcacgggacagtcacagtggaggtacagtacgcagcgtacttgggagtcggccat

SEQ ID NO: 2842 - DNA, 140 bp, Artificial Sequence
  Synthetic
atggccgactcccaagtacgctgcgtactgtacctccactgtgactgtcccgtgcagtgtttcagccgggatcttggtgaatgtgaacgctgcggtacacaaggagtatgacacgcccttggagacccagcatggcgtat

SEQ ID NO: 2843 - DNA, 140 bp, Artificial Sequence
  Synthetic
aggccctggctgctgatatgaagagaatggagttcaactgacggtcgttgtgggatctgtaaaaaaccccatgtggagaggtccacagagattgcccgtgcctgtgaacgagctgccccagaccttttgggacagcggtg

SEQ ID NO: 2844 - DNA, 140 bp, Artificial Sequence
  Synthetic
caccgctgtcccaaaaggtctggggcagctcgttcacaggcacgggcaatctctgtggacctctccacatggggttttttacagatcccacaacgaccgtcagttgaactccattctcttcatatcagcagccagggcct

SEQ ID NO: 2845 - DNA, 140 bp, Artificial Sequence
  Synthetic
aggccctggctgctgatatgcggctggaaggcttgggggaaatcgtacttcgtcagagcagcaaagacaaataacagctttgtcgtggacggtgacacactgaaggaatgcccactcaaagaccttttgggacagcggtg

SEQ ID NO: 2846 - DNA, 140 bp, Artificial Sequence
  Synthetic
caccgctgtcccaaaaggtctttgagtgggcattccttcagtgtgtcaccgtccacgacaaagctgttatttgtctttgctgctctgacgaagtacgatttcccccaagccttccagccgcatatcagcagccagggcct

SEQ ID NO: 2847 - DNA, 140 bp, Artificial Sequence
  Synthetic
aggccctggctgctgatatggtatggaatggagataaggcccaggaaagaaccagaaagcaacttagtaaggtcaatggtgactgcaggatcaactgatcacatggatcacttctcccttgaccttttgggacagcggtg

SEQ ID NO: 2848 - DNA, 140 bp, Artificial Sequence
  Synthetic
caccgctgtcccaaaaggtcaagggagaagtgatccatgtgatcagttgatcctgcagtcaccattgaccttactaagttgctttctggttctttcctgggccttatctccattccataccatatcagcagccagggcct

SEQ ID NO: 2849 - DNA, 140 bp, Artificial Sequence
  Synthetic
atacgccatgctgggtctccatcaggtgcataggagtcagcaatagggactttgtggaaggtatgtcaggtgggacttgggttgatgtcgtcttggaacatggaggttgtgtcaccgtaacgtacttgggagtcggccat

SEQ ID NO: 2850 - DNA, 140 bp, Artificial Sequence
  Synthetic
atggccgactcccaagtacgttacggtgacacaacctccatgttccaagacgacatcaacccaagtcccacctgacataccttccacaaagtccctattgctgactcctatgcacctgatggagacccagcatggcgtat

SEQ ID NO: 2851 - DNA, 140 bp, Artificial Sequence
  Synthetic
aggccctggctgctgatatgcacactggaacaacaaagaagcactggtagagttcaaggacgcacatgccaaaaggcaaactgtcgtggttctagggagtcaggaaggagcagttcacacgaccttttgggacagcggtg

SEQ ID NO: 2852 - DNA, 140 bp, Artificial Sequence
  Synthetic
caccgctgtcccaaaaggtcgtgtgaactgctccttcctgactccctagaaccacgacagtttgccttttggcatgtgcgtccttgaactctaccagtgcttctttgttgttccagtgtgcatatcagcagccagggcct

SEQ ID NO: 2853 - DNA, 140 bp, Artificial Sequence
  Synthetic
aggccctggctgctgatatgggcccttgctggagctctggaggctgagatggatggtgcaaagggaaggctgtcctctggccacttgaaatgtcgcctgaaaatggacaaacttagattggaccttttgggacagcggtg

SEQ ID NO: 2854 - DNA, 140 bp, Artificial Sequence
  Synthetic
caccgctgtcccaaaaggtccaatctaagtttgtccattttcaggcgacatttcaagtggccagaggacagccttccctttgcaccatccatctcagcctccagagctccagcaagggcccatatcagcagccagggcct

SEQ ID NO: 2855 - DNA, 140 bp, Artificial Sequence
  Synthetic
aggccctggctgctgatatgaacaccataaaaagtgtgtccaccacgagccagctcctcttggggcgcatggacgggcctaggaggccagtgaaatatgaggaggatgtgaatctcggctgaccttttgggacagcggtg

SEQ ID NO: 2856 - DNA, 140 bp, Artificial Sequence
  Synthetic
caccgctgtcccaaaaggtcagccgagattcacatcctcctcatatttcactggcctcctaggcccgtccatgcgccccaagaggagctggctcgtggtggacacactttttatggtgttcatatcagcagccagggcct

SEQ ID NO: 2857 - DNA, 140 bp, Artificial Sequence
  Synthetic
atacgccatgctgggtctccctggcacgcgggctgtggtaagctgcgctgaagctcccaacatgaagatcattggtaaccgcattgaaaggatccgcagtgagcacgccgcaacgtggttcgtacttgggagtcggccat

SEQ ID NO: 2858 - DNA, 140 bp, Artificial Sequence
  Synthetic
atggccgactcccaagtacgaaccacgttgcggcgtgctcactgcggatcctttcaatgcggttaccaatgatcttcatgttgggagcttcagcgcagcttaccacagcccgcgtgccagggagacccagcatggcgtat

SEQ ID NO: 2859 - DNA, 140 bp, Artificial Sequence
  Synthetic
atacgccatgctgggtctccctttgacgagaaccacccatataggacatgggcttaccatggaagctatgaggcccccacacaagggtcagcatcctctctaataaacggggttgtcaggcgtacttgggagtcggccat

SEQ ID NO: 2860 - DNA, 140 bp, Artificial Sequence
  Synthetic
atggccgactcccaagtacgcctgacaaccccgtttattagagaggatgctgacccttgtgtgggggcctcatagcttccatggtaagcccatgtcctatatgggtggttctcgtcaaagggagacccagcatggcgtat

SEQ ID NO: 2861 - DNA, 140 bp, Artificial Sequence
  Synthetic
atacgccatgctgggtctccctcctgtcaaaaccctgggatgtggtgactggagtcacaggaatagccatgaccgacaccacaccgtatggtcaggaaagagttttcaaggaaaaagtggcgtacttgggagtcggccat

SEQ ID NO: 2862 - DNA, 140 bp, Artificial Sequence
  Synthetic
atggccgactcccaagtacgccactttttccttgaaaactctttcctgaccatacggtgtggtgtcggtcatggctattcctgtgactccagtcaccacatcccagggttttgacaggagggagacccagcatggcgtat

SEQ ID NO: 2863 - DNA, 140 bp, Artificial Sequence
  Synthetic
aggccctggctgctgatatggaccgacaccacaccgtatggtcaggaaagagttttcaaggaaaaagtggacactagggtgcctgacccccaagaaggcactcgtcaggttatgagcatggaccttttgggacagcggtg

SEQ ID NO: 2864 - DNA, 140 bp, Artificial Sequence
  Synthetic
caccgctgtcccaaaaggtccatgctcataacctgacgagtgccttcttgggggtcaggcaccctagtgtccactttttccttgaaaactctttcctgaccatacggtgtggtgtcggtccatatcagcagccagggcct

SEQ ID NO: 2865 - DNA, 140 bp, Artificial Sequence
  Synthetic
atacgccatgctgggtctccgggcaatatttgaagaggaaaaggagtggaagactgcagtggaagctgtgaacgatccaaggttctgggctctagtggacaaggaaagagagcaccacctcgtacttgggagtcggccat

SEQ ID NO: 2866 - DNA, 140 bp, Artificial Sequence
  Synthetic
atggccgactcccaagtacgaggtggtgctctctttccttgtccactagagcccagaaccttggatcgttcacagcttccactgcagtcttccactccttttcctcttcaaatattgcccggagacccagcatggcgtat

SEQ ID NO: 2867 - DNA, 140 bp, Artificial Sequence
  Synthetic
aggccctggctgctgatatgtccaaggttctgggctctagtggacaaggaaagagagcaccacctgagaggagagtgccagagttgtgtgtacaacatgatgggaaaaagagaaaagaaagaccttttgggacagcggtg

SEQ ID NO: 2868 - DNA, 140 bp, Artificial Sequence
  Synthetic
caccgctgtcccaaaaggtctttcttttctctttttcccatcatgttgtacacacaactctggcactctcctctcaggtggtgctctctttccttgtccactagagcccagaaccttggacatatcagcagccagggcct

SEQ ID NO: 2869 - DNA, 140 bp, Artificial Sequence
  Synthetic
atacgccatgctgggtctcccccggcatacagcatcaggtgcataggagtcagcaatagggactttgtggaaggtatgtcaggtgggacttgggttgatgttgtcttggaacatggaggtcgtacttgggagtcggccat

SEQ ID NO: 2870 - DNA, 140 bp, Artificial Sequence
  Synthetic
atggccgactcccaagtacgacctccatgttccaagacaacatcaacccaagtcccacctgacataccttccacaaagtccctattgctgactcctatgcacctgatgctgtatgccgggggagacccagcatggcgtat

SEQ ID NO: 2871 - DNA, 140 bp, Artificial Sequence
  Synthetic
aggccctggctgctgatatgctggggggttttggaagcctaggacttgattgtgaaccgaggacaggccttgacttttcagatttgtactacttgactatgaataacaagcactggttgggaccttttgggacagcggtg

SEQ ID NO: 2872 - DNA, 140 bp, Artificial Sequence
  Synthetic
caccgctgtcccaaaaggtcccaaccagtgcttgttattcatagtcaagtagtacaaatctgaaaagtcaaggcctgtcctcggttcacaatcaagtcctaggcttccaaaaccccccagcatatcagcagccagggcct

SEQ ID NO: 2873 - DNA, 140 bp, Artificial Sequence
  Synthetic
aggccctggctgctgatatgggtccacagagattgcccgtgcctgtgaacgagctgccccacggctggaaggcttgggggaaatcgtacttcgtcagagcagcaaagacaaataacagctgaccttttgggacagcggtg

SEQ ID NO: 2874 - DNA, 140 bp, Artificial Sequence
  Synthetic
caccgctgtcccaaaaggtcagctgttatttgtctttgctgctctgacgaagtacgatttcccccaagccttccagccgtggggcagctcgttcacaggcacgggcaatctctgtggacccatatcagcagccagggcct

SEQ ID NO: 2875 - DNA, 140 bp, Artificial Sequence
  Synthetic
aggccctggctgctgatatggtatcaacaggttttattttggatttggaaacgagagtttctggtcatgaaaaacccaaaaaagaaatccggaggattccggattgtcaatatgctaaaagaccttttgggacagcggtg

SEQ ID NO: 2876 - DNA, 140 bp, Artificial Sequence
  Synthetic
caccgctgtcccaaaaggtcttttagcatattgacaatccggaatcctccggatttcttttttgggtttttcatgaccagaaactctcgtttccaaatccaaaataaaacctgttgataccatatcagcagccagggcct

SEQ ID NO: 2877 - DNA, 140 bp, Artificial Sequence
  Synthetic
atacgccatgctgggtctccgaagcctaccttgacaagcaatcagacactcaatatgtctgcaaaagaacgttagtggacagaggctggggaaatggatgtggactttttggcaaagggacgtacttgggagtcggccat

SEQ ID NO: 2878 - DNA, 140 bp, Artificial Sequence
  Synthetic
atggccgactcccaagtacgtccctttgccaaaaagtccacatccatttccccagcctctgtccactaacgttcttttgcagacatattgagtgtctgattgcttgtcaaggtaggcttcggagacccagcatggcgtat

SEQ ID NO: 2879 - DNA, 140 bp, Artificial Sequence
  Synthetic
aggccctggctgctgatatgtcacattcaccaagatcccggctgaaacactgcacgggacagtcacagtggaggtacagtacgcagggacagatggaccttgcaaggttctagctcagatgaccttttgggacagcggtg

SEQ ID NO: 2880 - DNA, 140 bp, Artificial Sequence
  Synthetic
caccgctgtcccaaaaggtcatctgagctagaaccttgcaaggtccatctgtccctgcgtactgtacctccactgtgactgtcccgtgcagtgtttcagccgggatcttggtgaatgtgacatatcagcagccagggcct

SEQ ID NO: 2881 - DNA, 140 bp, Artificial Sequence
  Synthetic
atacgccatgctgggtctccacaaagaatggatctatttcccttatgtgcttggccttagggggagtgttgatcttcttatccacagccgtctctgctgatgtggggtgctcggtggactcgtacttgggagtcggccat

SEQ ID NO: 2882 - DNA, 140 bp, Artificial Sequence
  Synthetic
atggccgactcccaagtacgagtccaccgagcaccccacatcagcagagacggctgtggataagaagatcaacactccccctaaggccaagcacataagggaaatagatccattctttgtggagacccagcatggcgtat

SEQ ID NO: 2883 - DNA, 140 bp, Artificial Sequence
  Synthetic
aggccctggctgctgatatgaagagacgaggcgcagatactagtgtcggaattgttggcctcctgctgaccacagctatggcagcggaagtcactagacgtgggagtgcatactatatgtgaccttttgggacagcggtg

SEQ ID NO: 2884 - DNA, 140 bp, Artificial Sequence
  Synthetic
caccgctgtcccaaaaggtcacatatagtatgcactcccacgtctagtgacttccgctgccatagctgtggtcagcaggaggccaacaattccgacactagtatctgcgcctcgtctcttcatatcagcagccagggcct

SEQ ID NO: 2885 - DNA, 140 bp, Artificial Sequence
  Synthetic
aggccctggctgctgatatgacctgccatcacaaaaaaggtgaagcacggagatctagaagagctgtgacgctcccctcccattccattaggaagctgcaaacgcggtcgcaaacctggtgaccttttgggacagcggtg

SEQ ID NO: 2886 - DNA, 140 bp, Artificial Sequence
  Synthetic
caccgctgtcccaaaaggtcaccaggtttgcgaccgcgtttgcagcttcctaatggaatgggaggggagcgtcacagctcttctagatctccgtgcttcaccttttttgtgatggcaggtcatatcagcagccagggcct

SEQ ID NO: 2887 - DNA, 140 bp, Artificial Sequence
  Synthetic
aggccctggctgctgatatgtggataaacttagattgaagggcgtgtcatactccttgtgtactgcagcgttcacattcaccaagatcccggctgaaacactgcatgggacagtcacagtgaccttttgggacagcggtg

SEQ ID NO: 2888 - DNA, 140 bp, Artificial Sequence
  Synthetic
caccgctgtcccaaaaggtcactgtgactgtcccatgcagtgtttcagccgggatcttggtgaatgtgaacgctgcagtacacaaggagtatgacacgcccttcaatctaagtttatccacatatcagcagccagggcct

SEQ ID NO: 2889 - DNA, 140 bp, Artificial Sequence
  Synthetic
atacgccatgctgggtctccgcgcgccaggaggtggcgggtctcttagattgaagggcgtgtcatactccttgtgtaccgcagcgttcacattcaccaagatcccggctgaaacactgcacgtacttgggagtcggccat

SEQ ID NO: 2890 - DNA, 140 bp, Artificial Sequence
  Synthetic
atggccgactcccaagtacgtgcagtgtttcagccgggatcttggtgaatgtgaacgctgcggtacacaaggagtatgacacgcccttcaatctaagagacccgccacctcctggcgcgcggagacccagcatggcgtat

SEQ ID NO: 2891 - DNA, 140 bp, Artificial Sequence
  Synthetic
aggccctggctgctgatatgtaggagtcggggagaagaagatcacccatcactggcacaggagtggcagcaccattggaaaaggaggtggccatcaccatcaccatcactgatgaccggtgaccttttgggacagcggtg

SEQ ID NO: 2892 - DNA, 140 bp, Artificial Sequence
  Synthetic
caccgctgtcccaaaaggtcaccggtcatcagtgatggtgatggtgatggccacctccttttccaatggtgctgccactcctgtgccagtgatgggtgatcttcttctccccgactcctacatatcagcagccagggcct

SEQ ID NO: 2893 - DNA, 140 bp, Artificial Sequence
  Synthetic
aggccctggctgctgatatggtggcagctcctttatttccacagaagggacctccgactgatggccaatgccatttgttcatctgtgccagttgactgggttccaactgggagaactaccgaccttttgggacagcggtg

SEQ ID NO: 2894 - DNA, 140 bp, Artificial Sequence
  Synthetic
caccgctgtcccaaaaggtcggtagttctcccagttggaacccagtcaactggcacagatgaacaaatggcattggccatcagtcggaggtcccttctgtggaaataaaggagctgccaccatatcagcagccagggcct

SEQ ID NO: 2895 - DNA, 140 bp, Artificial Sequence
  Synthetic
aggccctggctgctgatatgcaagttgtcacttacgctcttaacacatttaccaacctagtggtgcaactcattcggaacatggaggctgaggaagttctagagatgcaagacttgtggcgaccttttgggacagcggtg

SEQ ID NO: 2896 - DNA, 140 bp, Artificial Sequence
  Synthetic
caccgctgtcccaaaaggtcgccacaagtcttgcatctctagaacttcctcagcctccatgttccgaatgagttgcaccactaggttggtaaatgtgttaagagcgtaagtgacaacttgcatatcagcagccagggcct

SEQ ID NO: 2897 - DNA, 140 bp, Artificial Sequence
  Synthetic
aggccctggctgctgatatggtacacataccaaaacaaagtggtaaaggtccttagaccagctgaaaaagggaagacagttatggacattatttcgagacaagaccaaagggggagtggagaccttttgggacagcggtg

SEQ ID NO: 2898 - DNA, 140 bp, Artificial Sequence
  Synthetic
caccgctgtcccaaaaggtctccactccccctttggtcttgtctcgaaataatgtccataactgtcttccctttttcagctggtctaaggacctttaccactttgttttggtatgtgtaccatatcagcagccagggcct

SEQ ID NO: 2899 - DNA, 140 bp, Artificial Sequence
  Synthetic
aggccctggctgctgatatgagagatgagtcgcataccaggaggaaggatgtatgcagatgacactgctggctgggacacccgcatcagcaggtttgatctggagaatgaagctctaatcgaccttttgggacagcggtg

SEQ ID NO: 2900 - DNA, 140 bp, Artificial Sequence
  Synthetic
caccgctgtcccaaaaggtcgattagagcttcattctccagatcaaacctgctgatgcgggtgtcccagccagcagtgtcatctgcatacatccttcctcctggtatgcgactcatctctcatatcagcagccagggcct

SEQ ID NO: 2901 - DNA, 140 bp, Artificial Sequence
  Synthetic
aggccctggctgctgatatgagagatgagtcgcataccaggaggaaggatgtatgcagatgacactgctggctgggacacccgcatcagctggtttgatctggagaatgaagctctaatcgaccttttgggacagcggtg

SEQ ID NO: 2902 - DNA, 140 bp, Artificial Sequence
  Synthetic
caccgctgtcccaaaaggtcgattagagcttcattctccagatcaaaccagctgatgcgggtgtcccagccagcagtgtcatctgcatacatccttcctcctggtatgcgactcatctctcatatcagcagccagggcct

SEQ ID NO: 2903 - DNA, 140 bp, Artificial Sequence
  Synthetic
aggccctggctgctgatatgagagatgagtcgcataccaggaggaaggatgtatgcagatgacactgctggctgggacacccgcatcagccggtttgatctggagaatgaagctctaatcgaccttttgggacagcggtg

SEQ ID NO: 2904 - DNA, 140 bp, Artificial Sequence
  Synthetic
caccgctgtcccaaaaggtcgattagagcttcattctccagatcaaaccggctgatgcgggtgtcccagccagcagtgtcatctgcatacatccttcctcctggtatgcgactcatctctcatatcagcagccagggcct

SEQ ID NO: 2905 - DNA, 140 bp, Artificial Sequence
  Synthetic
aggccctggctgctgatatgagagatgagtcgcataccaggaggaaggatgtatgcagatgacactgctggctgggacacccgcatcagcgggtttgatctggagaatgaagctctaatcgaccttttgggacagcggtg

SEQ ID NO: 2906 - DNA, 140 bp, Artificial Sequence
  Synthetic
caccgctgtcccaaaaggtcgattagagcttcattctccagatcaaacccgctgatgcgggtgtcccagccagcagtgtcatctgcatacatccttcctcctggtatgcgactcatctctcatatcagcagccagggcct

SEQ ID NO: 2907 - DNA, 140 bp, Artificial Sequence
  Synthetic
aggccctggctgctgatatggtacacataccaaaacaaagtggtaaaggtccttagaccagctaaaaaagggaagacagttatggacattatttcgagacaagaccaaagggggagcggagaccttttgggacagcggtg

SEQ ID NO: 2908 - DNA, 140 bp, Artificial Sequence
  Synthetic
caccgctgtcccaaaaggtctccgctccccctttggtcttgtctcgaaataatgtccataactgtcttcccttttttagctggtctaaggacctttaccactttgttttggtatgtgtaccatatcagcagccagggcct

SEQ ID NO: 2909 - DNA, 140 bp, Artificial Sequence
  Synthetic
aggccctggctgctgatatggtacacataccaaaacaaagtggtaaaggtccttagaccagcttaaaaagggaagacagttatggacattatttcgagacaagaccaaagggggagcggagaccttttgggacagcggtg

SEQ ID NO: 2910 - DNA, 140 bp, Artificial Sequence
  Synthetic
caccgctgtcccaaaaggtctccgctccccctttggtcttgtctcgaaataatgtccataactgtcttccctttttaagctggtctaaggacctttaccactttgttttggtatgtgtaccatatcagcagccagggcct

SEQ ID NO: 2911 - DNA, 140 bp, Artificial Sequence
  Synthetic
aggccctggctgctgatatggtacacataccaaaacaaagtggtaaaggtccttagaccagctcaaaaagggaagacagttatggacattatttcgagacaagaccaaagggggagcggagaccttttgggacagcggtg

SEQ ID NO: 2912 - DNA, 140 bp, Artificial Sequence
  Synthetic
caccgctgtcccaaaaggtctccgctccccctttggtcttgtctcgaaataatgtccataactgtcttccctttttgagctggtctaaggacctttaccactttgttttggtatgtgtaccatatcagcagccagggcct

SEQ ID NO: 2913 - DNA, 140 bp, Artificial Sequence
  Synthetic
aggccctggctgctgatatggtacacataccaaaacaaagtggtaaaggtccttagaccagctgaaaaagggaagacagttatggacattatttcgagacaagaccaaagggggagcggagaccttttgggacagcggtg

SEQ ID NO: 2914 - DNA, 140 bp, Artificial Sequence
  Synthetic
caccgctgtcccaaaaggtctccgctccccctttggtcttgtctcgaaataatgtccataactgtcttccctttttcagctggtctaaggacctttaccactttgttttggtatgtgtaccatatcagcagccagggcct

SEQ ID NO: 2915 - DNA, 140 bp, Artificial Sequence
  Synthetic
atacgccatgctgggtctccaccaaccaaatggagaaagggcacagggccttggcattggccataatcaagaacacataccaaaacaaagtggtaaaggtccttagaccagctgaaaaagcgtacttgggagtcggccat

SEQ ID NO: 2916 - DNA, 140 bp, Artificial Sequence
  Synthetic
atggccgactcccaagtacgctttttcagctggtctaaggacctttaccactttgttttggtatgtgttcttgattatggccaatgccaaggccctgtgccctttctccatttggttggtggagacccagcatggcgtat

SEQ ID NO: 2917 - DNA, 140 bp, Artificial Sequence
  Synthetic
atacgccatgctgggtctccaccaaccaaatggagaaagggcacagggccttggcattggccataatcaagtacacataccaaaacaaagtggtaaaggtccttagaccagctgaaaaagcgtacttgggagtcggccat

SEQ ID NO: 2918 - DNA, 140 bp, Artificial Sequence
  Synthetic
atggccgactcccaagtacgctttttcagctggtctaaggacctttaccactttgttttggtatgtgtacttgattatggccaatgccaaggccctgtgccctttctccatttggttggtggagacccagcatggcgtat

SEQ ID NO: 2919 - DNA, 140 bp, Artificial Sequence
  Synthetic
atacgccatgctgggtctccaccaaccaaatggagaaagggcacagggccttggcattggccataatcaagcacacataccaaaacaaagtggtaaaggtccttagaccagctgaaaaagcgtacttgggagtcggccat

SEQ ID NO: 2920 - DNA, 140 bp, Artificial Sequence
  Synthetic
atggccgactcccaagtacgctttttcagctggtctaaggacctttaccactttgttttggtatgtgtgcttgattatggccaatgccaaggccctgtgccctttctccatttggttggtggagacccagcatggcgtat

SEQ ID NO: 2921 - DNA, 140 bp, Artificial Sequence
  Synthetic
atacgccatgctgggtctccaccaaccaaatggagaaagggcacagggccttggcattggccataatcaaggacacataccaaaacaaagtggtaaaggtccttagaccagctgaaaaagcgtacttgggagtcggccat

SEQ ID NO: 2922 - DNA, 140 bp, Artificial Sequence
  Synthetic
atggccgactcccaagtacgctttttcagctggtctaaggacctttaccactttgttttggtatgtgtccttgattatggccaatgccaaggccctgtgccctttctccatttggttggtggagacccagcatggcgtat

SEQ ID NO: 2923 - DNA, 140 bp, Artificial Sequence
  Synthetic
atacgccatgctgggtctccaccaaccaaatggagaaagggcacagggccttggcattagccataattaagtacacataccaaaacaaagtggtaaaggtccttagaccagctgaaaaagcgtacttgggagtcggccat

SEQ ID NO: 2924 - DNA, 140 bp, Artificial Sequence
  Synthetic
atggccgactcccaagtacgctttttcagctggtctaaggacctttaccactttgttttggtatgtgtacttaattatggctaatgccaaggccctgtgccctttctccatttggttggtggagacccagcatggcgtat

SEQ ID NO: 2925 - DNA, 140 bp, Artificial Sequence
  Synthetic
atacgccatgctgggtctccaccaaccaaatggagaaagggcacagggccttggcatttgccataattaagtacacataccaaaacaaagtggtaaaggtccttagaccagctgaaaaagcgtacttgggagtcggccat

SEQ ID NO: 2926 - DNA, 140 bp, Artificial Sequence
  Synthetic
atggccgactcccaagtacgctttttcagctggtctaaggacctttaccactttgttttggtatgtgtacttaattatggcaaatgccaaggccctgtgccctttctccatttggttggtggagacccagcatggcgtat

SEQ ID NO: 2927 - DNA, 140 bp, Artificial Sequence
  Synthetic
atacgccatgctgggtctccaccaaccaaatggagaaagggcacagggccttggcattcgccataattaagtacacataccaaaacaaagtggtaaaggtccttagaccagctgaaaaagcgtacttgggagtcggccat

SEQ ID NO: 2928 - DNA, 140 bp, Artificial Sequence
  Synthetic
atggccgactcccaagtacgctttttcagctggtctaaggacctttaccactttgttttggtatgtgtacttaattatggcgaatgccaaggccctgtgccctttctccatttggttggtggagacccagcatggcgtat

SEQ ID NO: 2929 - DNA, 140 bp, Artificial Sequence
  Synthetic
atacgccatgctgggtctccaccaaccaaatggagaaagggcacagggccttggcattggccataattaagtacacataccaaaacaaagtggtaaaggtccttagaccagctgaaaaagcgtacttgggagtcggccat

SEQ ID NO: 2930 - DNA, 140 bp, Artificial Sequence
  Synthetic
atggccgactcccaagtacgctttttcagctggtctaaggacctttaccactttgttttggtatgtgtacttaattatggccaatgccaaggccctgtgccctttctccatttggttggtggagacccagcatggcgtat

SEQ ID NO: 2931 - DNA, 140 bp, Artificial Sequence
  Synthetic
aggccctggctgctgatatgagatcctactgctatgaggcatcaatatcggacatggcttcggacagccgctgcccaacacaaggtgaagcctaccttgacaagcaatcagacactcaatgaccttttgggacagcggtg

SEQ ID NO: 2932 - DNA, 140 bp, Artificial Sequence
  Synthetic
caccgctgtcccaaaaggtcattgagtgtctgattgcttgtcaaggtaggcttcaccttgtgttgggcagcggctgtccgaagccatgtccgatattgatgcctcatagcagtaggatctcatatcagcagccagggcct

SEQ ID NO: 2933 - DNA, 140 bp, Artificial Sequence
  Synthetic
aggccctggctgctgatatggacgcacatgccaaaaggcaaactgtcgtggttctagggagtcaagaaggagcagttcacacggcccttgctggagctctggaggctgagatggatggtggaccttttgggacagcggtg

SEQ ID NO: 2934 - DNA, 140 bp, Artificial Sequence
  Synthetic
caccgctgtcccaaaaggtccaccatccatctcagcctccagagctccagcaagggccgtgtgaactgctccttcttgactccctagaaccacgacagtttgccttttggcatgtgcgtccatatcagcagccagggcct

SEQ ID NO: 2935 - DNA, 140 bp, Artificial Sequence
  Synthetic
aggccctggctgctgatatgattcaccaagatcccggctgaaacactgcacgggacagtcacagtggaggtacagtacgcagggacagatggaccttgcaaggttccagcccaaatggcggaccttttgggacagcggtg

SEQ ID NO: 2936 - DNA, 140 bp, Artificial Sequence
  Synthetic
caccgctgtcccaaaaggtccgccatttgggctggaaccttgcaaggtccatctgtccctgcgtactgtacctccactgtgactgtcccgtgcagtgtttcagccgggatcttggtgaatcatatcagcagccagggcct

SEQ ID NO: 2937 - DNA, 140 bp, Artificial Sequence
  Synthetic
aggccctggctgctgatatgatcccggctgaaacactgcacgggacagtcacagtggaggtacagtacgcagggacagatggaccttgcaaggttccagcccaaatggcggtggacaaaagaccttttgggacagcggtg

SEQ ID NO: 2938 - DNA, 140 bp, Artificial Sequence
  Synthetic
caccgctgtcccaaaaggtcttttgtccaccgccatttgggctggaaccttgcaaggtccatctgtccctgcgtactgtacctccactgtgactgtcccgtgcagtgtttcagccgggatcatatcagcagccagggcct

SEQ ID NO: 2939 - DNA, 140 bp, Artificial Sequence
  Synthetic
atacgccatgctgggtctccgacgcacatgccaaaaggcaaactgtcgtggttctagggagccaagaaggagcagttcacacggcccttgctggagctctggaggctgagatggatggtgcgtacttgggagtcggccat

SEQ ID NO: 2940 - DNA, 140 bp, Artificial Sequence
  Synthetic
atggccgactcccaagtacgcaccatccatctcagcctccagagctccagcaagggccgtgtgaactgctccttcttggctccctagaaccacgacagtttgccttttggcatgtgcgtcggagacccagcatggcgtat

SEQ ID NO: 2941 - DNA, 140 bp, Artificial Sequence
  Synthetic
aggccctggctgctgatatggatcccggctgaaacactgcacgggacagtcacagtggaggtacagtacgcagggacagatggaccttgcaaggttccagcccaaatggcggtggacaaagaccttttgggacagcggtg

SEQ ID NO: 2942 - DNA, 140 bp, Artificial Sequence
  Synthetic
caccgctgtcccaaaaggtctttgtccaccgccatttgggctggaaccttgcaaggtccatctgtccctgcgtactgtacctccactgtgactgtcccgtgcagtgtttcagccgggatccatatcagcagccagggcct

SEQ ID NO: 2943 - DNA, 140 bp, Artificial Sequence
  Synthetic
aggccctggctgctgatatgatcccggctgaaacactgcacgggacagtcacagtggaggtacagtacgcagggacagatggaccttgcaaggttccagcccaaatggcggtggaccaaagaccttttgggacagcggtg

SEQ ID NO: 2944 - DNA, 140 bp, Artificial Sequence
  Synthetic
caccgctgtcccaaaaggtctttggtccaccgccatttgggctggaaccttgcaaggtccatctgtccctgcgtactgtacctccactgtgactgtcccgtgcagtgtttcagccgggatcatatcagcagccagggcct

SEQ ID NO: 2945 - DNA, 140 bp, Artificial Sequence
  Synthetic
atacgccatgctgggtctcccgcatcagcaggtttgatctggagaatgaagctttaatcaccaaccaaatggagaaagggcacagggccttagcattggccataatcaagtacacatacccgtacttgggagtcggccat

SEQ ID NO: 2946 - DNA, 140 bp, Artificial Sequence
  Synthetic
atggccgactcccaagtacgggtatgtgtacttgattatggccaatgctaaggccctgtgccctttctccatttggttggtgattaaagcttcattctccagatcaaacctgctgatgcgggagacccagcatggcgtat

SEQ ID NO: 2947 - DNA, 140 bp, Artificial Sequence
  Synthetic
atacgccatgctgggtctccaaaacaaagtggtaaaggtccttagaccagctgaaaaagggaagacagttatggacattatttcaagacaagaccaaagggggagcggacaagttgtcaccgtacttgggagtcggccat

SEQ ID NO: 2948 - DNA, 140 bp, Artificial Sequence
  Synthetic
atggccgactcccaagtacggtgacaacttgtccgctccccctttggtcttgtcttgaaataatgtccataactgtcttccctttttcagctggtctaaggacctttaccactttgttttggagacccagcatggcgtat

SEQ ID NO: 2949 - DNA, 140 bp, Artificial Sequence
  Synthetic
aggccctggctgctgatatgaagggacctccgactgatggccaatgccatctgttcatctgtgccagttgactgggttccaactgggagaactacctggtcaatccatggaaagggagaagaccttttgggacagcggtg

SEQ ID NO: 2950 - DNA, 140 bp, Artificial Sequence
  Synthetic
caccgctgtcccaaaaggtcttctccctttccatggattgaccaggtagttctcccagttggaacccagtcaactggcacagatgaacagatggcattggccatcagtcggaggtcccttcatatcagcagccagggcct

SEQ ID NO: 2951 - DNA, 140 bp, Artificial Sequence
  Synthetic
atacgccatgctgggtctccactgggactccacactggaacaacaaagaagcactggtagagttcaaggacgcacatgccaaaaggcaaactgtcgtggttctagggagtcaagaaggagcgtacttgggagtcggccat

SEQ ID NO: 2952 - DNA, 140 bp, Artificial Sequence
  Synthetic
atggccgactcccaagtacgctccttcttgactccctagaaccacgacagtttgccttttggcatgtgcgtccttgaactctaccagtgcttctttgttgttccagtgtggagtcccagtggagacccagcatggcgtat

SEQ ID NO: 2953 - DNA, 140 bp, Artificial Sequence
  Synthetic
aggccctggctgctgatatggtgtaccgcagcgttcacattcaccaagatcccggctgaaacactgcacgggacagtcacagtggaggtacagtacgcagggacagatggaccttgcaaggaccttttgggacagcggtg

SEQ ID NO: 2954 - DNA, 140 bp, Artificial Sequence
  Synthetic
caccgctgtcccaaaaggtccttgcaaggtccatctgtccctgcgtactgtacctccactgtgactgtcccgtgcagtgtttcagccgggatcttggtgaatgtgaacgctgcggtacaccatatcagcagccagggcct

SEQ ID NO: 2955 - DNA, 140 bp, Artificial Sequence
  Synthetic
atacgccatgctgggtctcccgcatcagcaggtttgatctggagaatgaagctctaatcaccaaccaaatggagaaagggcacagggccttggcattggccataatcaagtacacatacccgtacttgggagtcggccat

SEQ ID NO: 2956 - DNA, 140 bp, Artificial Sequence
  Synthetic
atggccgactcccaagtacgggtatgtgtacttgattatggccaatgccaaggccctgtgccctttctccatttggttggtgattagagcttcattctccagatcaaacctgctgatgcgggagacccagcatggcgtat

SEQ ID NO: 2957 - DNA, 140 bp, Artificial Sequence
  Synthetic
atacgccatgctgggtctccttacgctcttaatacattcaccaacctggtggtgcagctcattcggaatatggaggctgaggaagttctagagatgcaagacttgtggctgctgcggaggcgtacttgggagtcggccat

SEQ ID NO: 2958 - DNA, 140 bp, Artificial Sequence
  Synthetic
atggccgactcccaagtacgcctccgcagcagccacaagtcttgcatctctagaacttcctcagcctccatattccgaatgagctgcaccaccaggttggtgaatgtattaagagcgtaaggagacccagcatggcgtat

SEQ ID NO: 2959 - DNA, 140 bp, Artificial Sequence
  Synthetic
atacgccatgctgggtctccccagagaaagtgaccaactggttgcaaagcaacggatgggataggctcaaaagaatggcagtcagtggagatgattgcgttgtgaaaccaattgatgatacgtacttgggagtcggccat

SEQ ID NO: 2960 - DNA, 140 bp, Artificial Sequence
  Synthetic
atggccgactcccaagtacgtatcatcaattggtttcacaacgcaatcatctccactgactgccattcttttgagcctatcccatccgttgctttgcaaccagttggtcactttctctggggagacccagcatggcgtat

SEQ ID NO: 2961 - DNA, 140 bp, Artificial Sequence
  Synthetic
atacgccatgctgggtctccaagggacctccgactgatggccaatgccatttgttcatctgtgccagttgattgggttccaactgggagaactacctggtcaatccatggaaagggagaacgtacttgggagtcggccat

SEQ ID NO: 2962 - DNA, 140 bp, Artificial Sequence
  Synthetic
atggccgactcccaagtacgttctccctttccatggattgaccaggtagttctcccagttggaacccaatcaactggcacagatgaacaaatggcattggccatcagtcggaggtcccttggagacccagcatggcgtat

SEQ ID NO: 2963 - DNA, 140 bp, Artificial Sequence
  Synthetic
aggccctggctgctgatatgagatcctactgctatgaggcatcaatatcagacatggcttcggacagccgctgcccaacacaaggtgaagcctaccttgacaagcaatcagacactcaatgaccttttgggacagcggtg

SEQ ID NO: 2964 - DNA, 140 bp, Artificial Sequence
  Synthetic
caccgctgtcccaaaaggtcattgagtgtctgattgcttgtcaaggtaggcttcaccttgtgttgggcagcggctgtccgaagccatgtctgatattgatgcctcatagcagtaggatctcatatcagcagccagggcct

SEQ ID NO: 2965 - DNA, 140 bp, Artificial Sequence
  Synthetic
aggccctggctgctgatatgctgctatgaggcatcaatatcggacatggcttcggacagccgctgcccaacacaaggtgaagcctaccttgacaagcaatcagacactcaatatgtctgcgaccttttgggacagcggtg

SEQ ID NO: 2966 - DNA, 140 bp, Artificial Sequence
  Synthetic
caccgctgtcccaaaaggtcgcagacatattgagtgtctgattgcttgtcaaggtaggcttcaccttgtgttgggcagcggctgtccgaagccatgtccgatattgatgcctcatagcagcatatcagcagccagggcct

SEQ ID NO: 2967 - DNA, 140 bp, Artificial Sequence
  Synthetic
aggccctggctgctgatatgctgctatgaggcatcaatatcagacatggcttcggacagccgctgcccaacacaaggtgaagcctaccttgacaagcaatcagacactcaatatgtctgcgaccttttgggacagcggtg

SEQ ID NO: 2968 - DNA, 140 bp, Artificial Sequence
  Synthetic
caccgctgtcccaaaaggtcgcagacatattgagtgtctgattgcttgtcaaggtaggcttcaccttgtgttgggcagcggctgtccgaagccatgtctgatattgatgcctcatagcagcatatcagcagccagggcct

SEQ ID NO: 2969 - DNA, 140 bp, Artificial Sequence
  Synthetic
atacgccatgctgggtctcctggaggttgtgtcaccgtaatggcacaggacaaaccgactgtcgacatggagctggttacaacaacagtcagcaacatggcggaggtaagatcctactgccgtacttgggagtcggccat

SEQ ID NO: 2970 - DNA, 140 bp, Artificial Sequence
  Synthetic
atggccgactcccaagtacggcagtaggatcttacctccgccatgttgctgactgttgttgtaaccagctccatgtcgacagtcggtttgtcctgtgccattacggtgacacaacctccaggagacccagcatggcgtat

SEQ ID NO: 2971 - DNA, 140 bp, Artificial Sequence
  Synthetic
atacgccatgctgggtctcctgattgccccggcatacagcatcaggtgcataggagtcagcaatagggactttgtggaaggtatgtcgggtgggacttgggttgatgttgtcttggaacacgtacttgggagtcggccat

SEQ ID NO: 2972 - DNA, 140 bp, Artificial Sequence
  Synthetic
atggccgactcccaagtacgtgttccaagacaacatcaacccaagtcccacccgacataccttccacaaagtccctattgctgactcctatgcacctgatgctgtatgccggggcaatcaggagacccagcatggcgtat

SEQ ID NO: 2973 - DNA, 140 bp, Artificial Sequence
  Synthetic
atacgccatgctgggtctccgaccccagttacgaaatggacagacattccctatttgggaaaaagggaagacttgtggtgtggatctctcatagggcacagaccgcgcaccacctgggctcgtacttgggagtcggccat

SEQ ID NO: 2974 - DNA, 140 bp, Artificial Sequence
  Synthetic
atggccgactcccaagtacgagcccaggtggtgcgcggtctgtgccctatgagagatccacaccacaagtcttccctttttcccaaatagggaatgtctgtccatttcgtaactggggtcggagacccagcatggcgtat

SEQ ID NO: 2975 - DNA, 140 bp, Artificial Sequence
  Synthetic
atacgccatgctgggtctccgtgttgaagggctgggattacaaagactcggatatgtcctagaagagatgagtcgcataccaggaggaaggatgtatgcagatgacactgctggctgggacgtacttgggagtcggccat

SEQ ID NO: 2976 - DNA, 140 bp, Artificial Sequence
  Synthetic
atggccgactcccaagtacgtcccagccagcagtgtcatctgcatacatccttcctcctggtatgcgactcatctcttctaggacatatccgagtctttgtaatcccagcccttcaacacggagacccagcatggcgtat

SEQ ID NO: 2977 - DNA, 140 bp, Artificial Sequence
  Synthetic
aggccctggctgctgatatgtaccaaaacaaagtggtaaaggtccttagaccagctgaaaaagggaagacagttatggacattatttcgagacaagaccaaagggggagcggacaagttggaccttttgggacagcggtg

SEQ ID NO: 2978 - DNA, 140 bp, Artificial Sequence
  Synthetic
caccgctgtcccaaaaggtccaacttgtccgctccccctttggtcttgtctcgaaataatgtccataactgtcttccctttttcagctggtctaaggacctttaccactttgttttggtacatatcagcagccagggcct

SEQ ID NO: 2979 - DNA, 140 bp, Artificial Sequence
  Synthetic
aggccctggctgctgatatgggccgggcccgcgtctctccaggggcgggatggagcatccgggagactgcttgcctagcaaaatcatatgcgcaaatgtggcagctcctttatttccacagaccttttgggacagcggtg

SEQ ID NO: 2980 - DNA, 140 bp, Artificial Sequence
  Synthetic
caccgctgtcccaaaaggtctgtggaaataaaggagctgccacatttgcgcatatgattttgctaggcaagcagtctcccggatgctccatcccgcccctggagagacgcgggcccggcccatatcagcagccagggcct

SEQ ID NO: 2981 - DNA, 140 bp, Artificial Sequence
  Synthetic
aggccctggctgctgatatggcaaaatcatatgcgcaaatgtggcagctcctttatttccacagaagggacctccgactgatggccaatgccatttgttcatctgtgccagttgactggggaccttttgggacagcggtg

SEQ ID NO: 2982 - DNA, 140 bp, Artificial Sequence
  Synthetic
caccgctgtcccaaaaggtccccagtcaactggcacagatgaacaaatggcattggccatcagtcggaggtcccttctgtggaaataaaggagctgccacatttgcgcatatgattttgccatatcagcagccagggcct

SEQ ID NO: 2983 - DNA, 140 bp, Artificial Sequence
  Synthetic
atacgccatgctgggtctccctgctgggtcatgggcccatcaggatggtcttggcgattctagcctttttgagattcacggcaatcaagccatcactgggtctcatcaatagatggggttcgtacttgggagtcggccat

SEQ ID NO: 2984 - DNA, 140 bp, Artificial Sequence
  Synthetic
atggccgactcccaagtacgaaccccatctattgatgagacccagtgatggcttgattgccgtgaatctcaaaaaggctagaatcgccaagaccatcctgatgggcccatgacccagcagggagacccagcatggcgtat

SEQ ID NO: 2985 - DNA, 140 bp, Artificial Sequence
  Synthetic
atacgccatgctgggtctccctggctgccatgctgagaataatcaatgccaggaaggagaagaagagacgaggcacagacactagtgtcggaattgttggcctcctgctgaccacagccacgtacttgggagtcggccat

SEQ ID NO: 2986 - DNA, 140 bp, Artificial Sequence
  Synthetic
atggccgactcccaagtacgtggctgtggtcagcaggaggccaacaattccgacactagtgtctgtgcctcgtctcttcttctccttcctggcattgattattctcagcatggcagccagggagacccagcatggcgtat

SEQ ID NO: 2987 - DNA, 140 bp, Artificial Sequence
  Synthetic
atacgccatgctgggtctcctggcagcggaggtcactagacgtgggagtgcatactatatgtacttggacagaagcgatgctggggaggccatatcttttccaaccacactggggatgaacgtacttgggagtcggccat

SEQ ID NO: 2988 - DNA, 140 bp, Artificial Sequence
  Synthetic
atggccgactcccaagtacgttcatccccagtgtggttggaaaagatatggcctccccagcatcgcttctgtccaagtacatatagtatgcactcccacgtctagtgacctccgctgccaggagacccagcatggcgtat

SEQ ID NO: 2989 - DNA, 140 bp, Artificial Sequence
  Synthetic
aggccctggctgctgatatgtgagctatgaatgccctatgctggatgagggggtagaaccagatgacgtcgattgttggtgcaacacgacgtcaacttgggttgtgtacggaacctgccagaccttttgggacagcggtg

SEQ ID NO: 2990 - DNA, 140 bp, Artificial Sequence
  Synthetic
caccgctgtcccaaaaggtctggcaggttccgtacacaacccaagttgacgtcgtgttgcaccaacaatcgacgtcatctggttctaccccctcatccagcatagggcattcatagctcacatatcagcagccagggcct

SEQ ID NO: 2991 - DNA, 140 bp, Artificial Sequence
  Synthetic
atacgccatgctgggtctccccacaaaaaaggtgaagcacggagatctagaagagctgtgacgctcccctcccactccactaggaagctgcaaacgcggtcgcagacctggttggaatcacgtacttgggagtcggccat

SEQ ID NO: 2992 - DNA, 140 bp, Artificial Sequence
  Synthetic
atggccgactcccaagtacgtgattccaaccaggtctgcgaccgcgtttgcagcttcctagtggagtgggaggggagcgtcacagctcttctagatctccgtgcttcaccttttttgtggggagacccagcatggcgtat

SEQ ID NO: 2993 - DNA, 140 bp, Artificial Sequence
  Synthetic
atacgccatgctgggtctccagagaatacacaaagcacttgattagagtcgaaaattggatattcaggaaccctggcttcgcgttagcagcagctgccatcgcttggctcttgggaagctcgtacttgggagtcggccat

SEQ ID NO: 2994 - DNA, 140 bp, Artificial Sequence
  Synthetic
atggccgactcccaagtacgagcttcccaagagccaagcgatggcagctgctgctaacgcgaagccagggttcctgaatatccaattttcgactctaatcaagtgctttgtgtattctctggagacccagcatggcgtat

SEQ ID NO: 2995 - DNA, 140 bp, Artificial Sequence
  Synthetic
atacgccatgctgggtctcccaacgagccaaaaagtcatatacttggtcatgatactgctgattgctccggcatatagcatcaggtgcataggagtcagcaatagggactttgtggaaggcgtacttgggagtcggccat

SEQ ID NO: 2996 - DNA, 140 bp, Artificial Sequence
  Synthetic
atggccgactcccaagtacgccttccacaaagtccctattgctgactcctatgcacctgatgctatatgccggagcaatcagcagtatcatgaccaagtatatgactttttggctcgttgggagacccagcatggcgtat

SEQ ID NO: 2997 - DNA, 140 bp, Artificial Sequence
  Synthetic
aggccctggctgctgatatgacaacagtcagcaacatggcggaggtaagatcctactgctatgaggcatcaatatcggacatggcttcggacagccgctgcccaacacaaggcgaagcctgaccttttgggacagcggtg

SEQ ID NO: 2998 - DNA, 140 bp, Artificial Sequence
  Synthetic
caccgctgtcccaaaaggtcaggcttcgccttgtgttgggcagcggctgtccgaagccatgtccgatattgatgcctcatagcagtaggatcttacctccgccatgttgctgactgttgtcatatcagcagccagggcct

SEQ ID NO: 2999 - DNA, 140 bp, Artificial Sequence
  Synthetic
atacgccatgctgggtctccgacatgcgccaagtttgcatgctccaagaaaatgaccgggaagagcatccagccagagaatctggagtaccgaataatgctgtcagttcatggctcccagcgtacttgggagtcggccat

SEQ ID NO: 3000 - DNA, 140 bp, Artificial Sequence
  Synthetic
atggccgactcccaagtacgctgggagccatgaactgacagcattattcggtactccagattctctggctggatgctcttcccggtcattttcttggagcatgcaaacttggcgcatgtcggagacccagcatggcgtat

SEQ ID NO: 3001 - DNA, 140 bp, Artificial Sequence
  Synthetic
aggccctggctgctgatatgagcgaaggttgagataacgcccaattcaccaagagccgaagccaccctgggaggttttggaagcctaggacttgattgtgaaccgaggacaggccttgacgaccttttgggacagcggtg

SEQ ID NO: 3002 - DNA, 140 bp, Artificial Sequence
  Synthetic
caccgctgtcccaaaaggtcgtcaaggcctgtcctcggttcacaatcaagtcctaggcttccaaaacctcccagggtggcttcggctcttggtgaattgggcgttatctcaaccttcgctcatatcagcagccagggcct

SEQ ID NO: 3003 - DNA, 140 bp, Artificial Sequence
  Synthetic
aggccctggctgctgatatgccggaactccacactggaacaacaaagaagcactggtagaattcaaggatgcacatgccaaaaggcaaactgtcgtggttctagggagtcaagagggagcgaccttttgggacagcggtg

SEQ ID NO: 3004 - DNA, 140 bp, Artificial Sequence
  Synthetic
caccgctgtcccaaaaggtcgctccctcttgactccctagaaccacgacagtttgccttttggcatgtgcatccttgaattctaccagtgcttctttgttgttccagtgtggagttccggcatatcagcagccagggcct

SEQ ID NO: 3005 - DNA, 140 bp, Artificial Sequence
  Synthetic
aggccctggctgctgatatgagggaaggctgtcctctggccacttgaaatgtcgcctgaaaatggataaacttagattgaagggcgtgtcatactccctgtgtaccgcagcgttcacattgaccttttgggacagcggtg

SEQ ID NO: 3006 - DNA, 140 bp, Artificial Sequence
  Synthetic
caccgctgtcccaaaaggtcaatgtgaacgctgcggtacacagggagtatgacacgcccttcaatctaagtttatccattttcaggcgacatttcaagtggccagaggacagccttccctcatatcagcagccagggcct

SEQ ID NO: 3007 - DNA, 140 bp, Artificial Sequence
  Synthetic
aggccctggctgctgatatgtgtgagaggtgccaagagaatggcagtcttgggagacacagcctgggactttggatcagttggaggcgctctcaactcattgggcaagggcatccatcaagaccttttgggacagcggtg

SEQ ID NO: 3008 - DNA, 140 bp, Artificial Sequence
  Synthetic
caccgctgtcccaaaaggtcttgatggatgcccttgcccaatgagttgagagcgcctccaactgatccaaagtcccaggctgtgtctcccaagactgccattctcttggcacctctcacacatatcagcagccagggcct

SEQ ID NO: 3009 - DNA, 140 bp, Artificial Sequence
  Synthetic
aggccctggctgctgatatgatggatctatttcccttatgtgcttggccttagggggagtgttgatcttcttatccacagccgtctctgctgatgtggggtgctcggtggacttctcaaagaccttttgggacagcggtg

SEQ ID NO: 3010 - DNA, 140 bp, Artificial Sequence
  Synthetic
caccgctgtcccaaaaggtctttgagaagtccaccgagcaccccacatcagcagagacggctgtggataagaagatcaacactccccctaaggccaagcacataagggaaatagatccatcatatcagcagccagggcct

SEQ ID NO: 3011 - DNA, 140 bp, Artificial Sequence
  Synthetic
atacgccatgctgggtctccaaaagaaacgagatgcggcacaggggtgttcgtctataacgacgttgaagcctggagagacaggtacaagtaccatcctgactcccctcgtagattggcacgtacttgggagtcggccat

SEQ ID NO: 3012 - DNA, 140 bp, Artificial Sequence
  Synthetic
atggccgactcccaagtacgtgccaatctacgaggggagtcaggatggtacttgtacctgtctctccaggcttcaacgtcgttatagacgaacacccctgtgccgcatctcgtttcttttggagacccagcatggcgtat

SEQ ID NO: 3013 - DNA, 140 bp, Artificial Sequence
  Synthetic
aggccctggctgctgatatgcctggagagacaggtacaagtaccatcctgactcccctcgtagattggcagcagcagtcaagcaagcctgggaagatgggatctgcgggatctcctctgtgaccttttgggacagcggtg

SEQ ID NO: 3014 - DNA, 140 bp, Artificial Sequence
  Synthetic
caccgctgtcccaaaaggtcacagaggagatcccgcagatcccatcttcccaggcttgcttgactgctgctgccaatctacgaggggagtcaggatggtacttgtacctgtctctccaggcatatcagcagccagggcct

SEQ ID NO: 3015 - DNA, 140 bp, Artificial Sequence
  Synthetic
atacgccatgctgggtctccaaaaaccccatgtggagaggtccacagagattgcccgtgcctgtgaacgagctgccccacggctggaaggcttggggaaaatcgtacttcgtcagagcagcgtacttgggagtcggccat

SEQ ID NO: 3016 - DNA, 140 bp, Artificial Sequence
  Synthetic
atggccgactcccaagtacgctgctctgacgaagtacgattttccccaagccttccagccgtggggcagctcgttcacaggcacgggcaatctctgtggacctctccacatggggtttttggagacccagcatggcgtat

SEQ ID NO: 3017 - DNA, 140 bp, Artificial Sequence
  Synthetic
aggccctggctgctgatatgccactcaaacatagagcatggaacagctttcttgtggaggatcatgggttcggggtatttcacactagtgtctggctcaaggttagagaggattactcatgaccttttgggacagcggtg

SEQ ID NO: 3018 - DNA, 140 bp, Artificial Sequence
  Synthetic
caccgctgtcccaaaaggtcatgagtaatcctctctaaccttgagccagacactagtgtgaaataccccgaacccatgatcctccacaagaaagctgttccatgctctatgtttgagtggcatatcagcagccagggcct

SEQ ID NO: 3019 - DNA, 140 bp, Artificial Sequence
  Synthetic
atacgccatgctgggtctcctagagtgtgatccagccgtcattggaacagctgttaagggaaaggaggctgtacacagtgatctaggctactggattgagagtgagaagaacgacacatgcgtacttgggagtcggccat

SEQ ID NO: 3020 - DNA, 140 bp, Artificial Sequence
  Synthetic
atggccgactcccaagtacgcatgtgtcgttcttctcactctcaatccagtagcctagatcactgtgtacagcctcctttcccttaacagctgttccaatgacggctggatcacactctaggagacccagcatggcgtat

SEQ ID NO: 3021 - DNA, 140 bp, Artificial Sequence
  Synthetic
atacgccatgctgggtctccgaggctgaagagggcccacctgatcgagatgaaaacatgtgaatggccaaagtcccacacattgtggacagatggaatagaagaaagtgatctgatcatacgtacttgggagtcggccat

SEQ ID NO: 3022 - DNA, 140 bp, Artificial Sequence
  Synthetic
atggccgactcccaagtacgtatgatcagatcactttcttctattccatctgtccacaatgtgtgggactttggccattcacatgttttcatctcgatcaggtgggccctcttcagcctcggagacccagcatggcgtat

SEQ ID NO: 3023 - DNA, 140 bp, Artificial Sequence
  Synthetic
aggccctggctgctgatatgagtcccacacattgtggacagatggaatagaagaaagtgatctgatcatacccaagtctttagctgggccactcagccatcacaacaccagagagggttagaccttttgggacagcggtg

SEQ ID NO: 3024 - DNA, 140 bp, Artificial Sequence
  Synthetic
caccgctgtcccaaaaggtctaaccctctctggtgttgtgatggctgagtggcccagctaaagacttgggtatgatcagatcactttcttctattccatctgtccacaatgtgtgggactcatatcagcagccagggcct

SEQ ID NO: 3025 - DNA, 140 bp, Artificial Sequence
  Synthetic
atacgccatgctgggtctccaattttgatgggtgctaccttcgcggaaatgaacactggaggagatgtagcacatctggcgctgatagcggcattcaaagtcagaccagcgttgctggtacgtacttgggagtcggccat

SEQ ID NO: 3026 - DNA, 140 bp, Artificial Sequence
  Synthetic
atggccgactcccaagtacgtaccagcaacgctggtctgactttgaatgccgctatcagcgccagatgtgctacatctcctccagtgttcatttccgcgaaggtagcacccatcaaaattggagacccagcatggcgtat

SEQ ID NO: 3027 - DNA, 140 bp, Artificial Sequence
  Synthetic
atacgccatgctgggtctcctctttcatcttcagagctaattggacaccccgtgaaagcatgctgctggccctggcctcgtgtcttctgcaaactgcgatctccgccttggaaggcgacccgtacttgggagtcggccat

SEQ ID NO: 3028 - DNA, 140 bp, Artificial Sequence
  Synthetic
atggccgactcccaagtacgggtcgccttccaaggcggagatcgcagtttgcagaagacacgaggccagggccagcagcatgctttcacggggtgtccaattagctctgaagatgaaagaggagacccagcatggcgtat

SEQ ID NO: 3029 - DNA, 140 bp, Artificial Sequence
  Synthetic
aggccctggctgctgatatgatggttgttccacgcactgacaacatcaccttggcaatcctggctgctctgacaccactggcccggggcacactgcttgtggcgtggagagcaggccttggaccttttgggacagcggtg

SEQ ID NO: 3030 - DNA, 140 bp, Artificial Sequence
  Synthetic
caccgctgtcccaaaaggtccaaggcctgctctccacgccacaagcagtgtgccccgggccagtggtgtcagagcagccaggattgccaaggtgatgttgtcagtgcgtggaacaaccatcatatcagcagccagggcct

SEQ ID NO: 3031 - DNA, 140 bp, Artificial Sequence
  Synthetic
aggccctggctgctgatatggacaccactggcccggggcacactgcttgtggcgtggagagcaggccttgctacttgtggggggttcatgctcctctctctgaaggggaaaggcagtgtggaccttttgggacagcggtg

SEQ ID NO: 3032 - DNA, 140 bp, Artificial Sequence
  Synthetic
caccgctgtcccaaaaggtccacactgcctttccccttcagagagaggagcatgaaccccccacaagtagcaaggcctgctctccacgccacaagcagtgtgccccgggccagtggtgtccatatcagcagccagggcct

SEQ ID NO: 3033 - DNA, 140 bp, Artificial Sequence
  Synthetic
aggccctggctgctgatatgggtcgaccccatcaacgtggtgggactgctgttgctcacaaggagtgggaagcggagctggccccctagtgaagtgctcacagctgttggcctgatatgcgaccttttgggacagcggtg

SEQ ID NO: 3034 - DNA, 140 bp, Artificial Sequence
  Synthetic
caccgctgtcccaaaaggtcgcatatcaggccaacagctgtgagcacttcactagggggccagctccgcttcccactccttgtgagcaacagcagtcccaccacgttgatggggtcgacccatatcagcagccagggcct

SEQ ID NO: 3035 - DNA, 140 bp, Artificial Sequence
  Synthetic
aggccctggctgctgatatgggccgcggtcggtctgctaattgtcagttacgtggtctcaggaaagagtgtggacatgtacattgaaagagcaggtgacatcacgtgggaaaaagatgcggaccttttgggacagcggtg

SEQ ID NO: 3036 - DNA, 140 bp, Artificial Sequence
  Synthetic
caccgctgtcccaaaaggtccgcatctttttcccacgtgatgtcacctgctctttcaatgtacatgtccacactctttcctgagaccacgtaactgacaattagcagaccgaccgcggcccatatcagcagccagggcct

SEQ ID NO: 3037 - DNA, 140 bp, Artificial Sequence
  Synthetic
atacgccatgctgggtctccgaagtcactggaaacagtccccggctcgatgtggcactagatgagagtggtgatttctccctggtggaggatgatggtccccccatgagagagatcataccgtacttgggagtcggccat

SEQ ID NO: 3038 - DNA, 140 bp, Artificial Sequence
  Synthetic
atggccgactcccaagtacggtatgatctctctcatggggggaccatcatcctccaccagggagaaatcaccactctcatctagtgccacatcgagccggggactgtttccagtgacttcggagacccagcatggcgtat

SEQ ID NO: 3039 - DNA, 140 bp, Artificial Sequence
  Synthetic
atacgccatgctgggtctcctcaaagtggtcctgatgaccatctgtggcatgaacccaatagccataccctttgcagctggagcgtggtacgtatatgtgaagactggaaaaaggagtggcgtacttgggagtcggccat

SEQ ID NO: 3040 - DNA, 140 bp, Artificial Sequence
  Synthetic
atggccgactcccaagtacgccactcctttttccagtcttcacatatacgtaccacgctccagctgcaaagggtatggctattgggttcatgccacagatggtcatcaggaccactttgaggagacccagcatggcgtat

SEQ ID NO: 3041 - DNA, 140 bp, Artificial Sequence
  Synthetic
atacgccatgctgggtctcccagatggagtgtacagagtaatgactcgtagactgctaggttcaacacaagttggagtgggagtcatgcaagagggggtctttcacactatgtggcacgtcgtacttgggagtcggccat

SEQ ID NO: 3042 - DNA, 140 bp, Artificial Sequence
  Synthetic
atggccgactcccaagtacgacgtgccacatagtgtgaaagaccccctcttgcatgactcccactccaacttgtgttgaacctagcagtctacgagtcattactctgtacactccatctgggagacccagcatggcgtat

SEQ ID NO: 3043 - DNA, 140 bp, Artificial Sequence
  Synthetic
aggccctggctgctgatatgggggagatgtcaagcaggatctggtgtcatactgtggtccatggaagctagatgccgcctgggacggacacagcgaggtgcagctcttggccgtgcccccgaccttttgggacagcggtg

SEQ ID NO: 3044 - DNA, 140 bp, Artificial Sequence
  Synthetic
caccgctgtcccaaaaggtcgggggcacggccaagagctgcacctcgctgtgtccgtcccaggcggcatctagcttccatggaccacagtatgacaccagatcctgcttgacatctcccccatatcagcagccagggcct

SEQ ID NO: 3045 - DNA, 140 bp, Artificial Sequence
  Synthetic
atacgccatgctgggtctcccggagagagagcgaggaacatccagactctgcccggaatatttaagacaaaggatggggacattggagcggttgcactggactacccagcaggaacttcacgtacttgggagtcggccat

SEQ ID NO: 3046 - DNA, 140 bp, Artificial Sequence
  Synthetic
atggccgactcccaagtacgtgaagttcctgctgggtagtccagtgcaaccgctccaatgtccccatcctttgtcttaaatattccgggcagagtctggatgttcctcgctctctctccgggagacccagcatggcgtat

SEQ ID NO: 3047 - DNA, 140 bp, Artificial Sequence
  Synthetic
aggccctggctgctgatatgaggatggggacattggagcggttgcactggactacccagcaggaacttcaggatctccaatcctagacaagtgtgggagagtgataggactctatggcaagaccttttgggacagcggtg

SEQ ID NO: 3048 - DNA, 140 bp, Artificial Sequence
  Synthetic
caccgctgtcccaaaaggtcttgccatagagtcctatcactctcccacacttgtctaggattggagatcctgaagttcctgctgggtagtccagtgcaaccgctccaatgtccccatcctcatatcagcagccagggcct

SEQ ID NO: 3049 - DNA, 140 bp, Artificial Sequence
  Synthetic
aggccctggctgctgatatgctgtgatcttagctccaaccagggttgtcgctgctgaaatggaggaagcccttagagggcttccagtgcgttatatgacaacagcagtcaatgtcacccagaccttttgggacagcggtg

SEQ ID NO: 3050 - DNA, 140 bp, Artificial Sequence
  Synthetic
caccgctgtcccaaaaggtctgggtgacattgactgctgttgtcatataacgcactggaagccctctaagggcttcctccatttcagcagcgacaaccctggttggagctaagatcacagcatatcagcagccagggcct

SEQ ID NO: 3051 - DNA, 140 bp, Artificial Sequence
  Synthetic
aggccctggctgctgatatggaggcccacttcacagatccctcaagtatagcagcaagaggatacatttcaacaagggttgagatgggcgaggcggccgccatcttcatgaccgccacgcgaccttttgggacagcggtg

SEQ ID NO: 3052 - DNA, 140 bp, Artificial Sequence
  Synthetic
caccgctgtcccaaaaggtcgcgtggcggtcatgaagatggcggccgcctcgcccatctcaacccttgttgaaatgtatcctcttgctgctatacttgagggatctgtgaagtgggcctccatatcagcagccagggcct

SEQ ID NO: 3053 - DNA, 140 bp, Artificial Sequence
  Synthetic
aggccctggctgctgatatgcaccaggaacccgtgacgcattcccggactccaactcaccaattatggacaccgaagtggaagtcccagagagagcctggagctcaggctttgattgggtgaccttttgggacagcggtg

SEQ ID NO: 3054 - DNA, 140 bp, Artificial Sequence
  Synthetic
caccgctgtcccaaaaggtcacccaatcaaagcctgagctccaggctctctctgggacttccacttcggtgtccataattggtgagttggagtccgggaatgcgtcacgggttcctggtgcatatcagcagccagggcct

SEQ ID NO: 3055 - DNA, 140 bp, Artificial Sequence
  Synthetic
atacgccatgctgggtctccgacggatcattctggaaaaacagtttggtttgttccaagcgtgaggaacggcaatgagatcgcagcttgtctgacgaaggctggaaaacgggtcatacagcgtacttgggagtcggccat

SEQ ID NO: 3056 - DNA, 140 bp, Artificial Sequence
  Synthetic
atggccgactcccaagtacgctgtatgacccgttttccagccttcgtcagacaagctgcgatctcattgccgttcctcacgcttggaacaaaccaaactgtttttccagaatgatccgtcggagacccagcatggcgtat

SEQ ID NO: 3057 - DNA, 140 bp, Artificial Sequence
  Synthetic
aggccctggctgctgatatggatggcgagagagtcattctggctggacccatgcctgtcacacatgccagcgctgcccagaggagggggcgcataggcaggaatcccaataaacctggaggaccttttgggacagcggtg

SEQ ID NO: 3058 - DNA, 140 bp, Artificial Sequence
  Synthetic
caccgctgtcccaaaaggtcctccaggtttattgggattcctgcctatgcgccccctcctctgggcagcgctggcatgtgtgacaggcatgggtccagccagaatgactctctcgccatccatatcagcagccagggcct

SEQ ID NO: 3059 - DNA, 140 bp, Artificial Sequence
  Synthetic
atacgccatgctgggtctccatgagtatctgtatggaggtgggtgcgcagagactgatgaagaccatgctcactggcttgaagcaagaatgctccttgacaacatttacctccaagatggcgtacttgggagtcggccat

SEQ ID NO: 3060 - DNA, 140 bp, Artificial Sequence
  Synthetic
atggccgactcccaagtacgccatcttggaggtaaatgttgtcaaggagcattcttgcttcaagccagtgagcatggtcttcatcagtctctgcgcacccacctccatacagatactcatggagacccagcatggcgtat

SEQ ID NO: 3061 - DNA, 140 bp, Artificial Sequence
  Synthetic
aggccctggctgctgatatgcactggcttgaagcaagaatgctccttgacaacatttacctccaagatggcctcatagcctcgctctatcgacctgaggccgacaaggtagcagctattggaccttttgggacagcggtg

SEQ ID NO: 3062 - DNA, 140 bp, Artificial Sequence
  Synthetic
caccgctgtcccaaaaggtccaatagctgctaccttgtcggcctcaggtcgatagagcgaggctatgaggccatcttggaggtaaatgttgtcaaggagcattcttgcttcaagccagtgcatatcagcagccagggcct

SEQ ID NO: 3063 - DNA, 140 bp, Artificial Sequence
  Synthetic
aggccctggctgctgatatgatgaaaagaggagatcttcctgtttggctggcctatcaggttgcatctgccggaattacctacacagatagaagatggtgctttgatggcacgaccaacagaccttttgggacagcggtg

SEQ ID NO: 3064 - DNA, 140 bp, Artificial Sequence
  Synthetic
caccgctgtcccaaaaggtctgttggtcgtgccatcaaagcaccatcttctatctgtgtaggtaattccggcagatgcaacctgataggccagccaaacaggaagatctcctcttttcatcatatcagcagccagggcct

SEQ ID NO: 3065 - DNA, 140 bp, Artificial Sequence
  Synthetic
atacgccatgctgggtctccacaccataatggaagacagtgtgccggcagaggtgtggaccagatacggagagaaaagagtgctcaaaccgaggtggatggacgccagagtttgttcagacgtacttgggagtcggccat

SEQ ID NO: 3066 - DNA, 140 bp, Artificial Sequence
  Synthetic
atggccgactcccaagtacgtctgaacaaactctggcgtccatccacctcggtttgagcactcttttctctccgtatctggtccacacctctgccggcacactgtcttccattatggtgtggagacccagcatggcgtat

SEQ ID NO: 3067 - DNA, 140 bp, Artificial Sequence
  Synthetic
atacgccatgctgggtctcctcatgcggccctgaagtcattcaaggagtttgccgctgggaaaagaggagcggcatttggagtgatggaagccctgggaacactgccaggacacatgacacgtacttgggagtcggccat

SEQ ID NO: 3068 - DNA, 140 bp, Artificial Sequence
  Synthetic
atggccgactcccaagtacgtgtcatgtgtcctggcagtgttcccagggcttccatcactccaaatgccgctcctcttttcccagcggcaaactccttgaatgacttcagggccgcatgaggagacccagcatggcgtat

SEQ ID NO: 3069 - DNA, 140 bp, Artificial Sequence
  Synthetic
aggccctggctgctgatatggagagattccaggaagccattgacaacctcgctgtgctcatgcgggcagagactggaagcaggccttacaaagccgcggcggcccaattgccggagacccgaccttttgggacagcggtg

SEQ ID NO: 3070 - DNA, 140 bp, Artificial Sequence
  Synthetic
caccgctgtcccaaaaggtcgggtctccggcaattgggccgccgcggctttgtaaggcctgcttccagtctctgcccgcatgagcacagcgaggttgtcaatggcttcctggaatctctccatatcagcagccagggcct

SEQ ID NO: 3071 - DNA, 140 bp, Artificial Sequence
  Synthetic
aggccctggctgctgatatggactggaagcaggccttacaaagccgcggcggcccaattgccggagaccctagagaccattatgcttttggggttgctgggaacagtctcgctgggaatcgaccttttgggacagcggtg

SEQ ID NO: 3072 - DNA, 140 bp, Artificial Sequence
  Synthetic
caccgctgtcccaaaaggtcgattcccagcgagactgttcccagcaaccccaaaagcataatggtctctagggtctccggcaattgggccgccgcggctttgtaaggcctgcttccagtccatatcagcagccagggcct

SEQ ID NO: 3073 - DNA, 140 bp, Artificial Sequence
  Synthetic
atacgccatgctgggtctcctttttcgtcttgatgcggaacaagggcatagggaagatgggctttggaatggtgactcttggggccagcgcatggctcatgtggctctcggaaattgagccgtacttgggagtcggccat

SEQ ID NO: 3074 - DNA, 140 bp, Artificial Sequence
  Synthetic
atggccgactcccaagtacggctcaatttccgagagccacatgagccatgcgctggccccaagagtcaccattccaaagcccatcttccctatgcccttgttccgcatcaagacgaaaaaggagacccagcatggcgtat

SEQ ID NO: 3075 - DNA, 140 bp, Artificial Sequence
  Synthetic
aggccctggctgctgatatgggtgactcttggggccagcgcatggctcatgtggctctcggaaattgagccagccagaattgcatgtgtcctcattgttgtgttcctactgctggtggtggaccttttgggacagcggtg

SEQ ID NO: 3076 - DNA, 140 bp, Artificial Sequence
  Synthetic
caccgctgtcccaaaaggtccaccaccagcagtaggaacacaacaatgaggacacatgcaattctggctggctcaatttccgagagccacatgagccatgcgctggccccaagagtcacccatatcagcagccagggcct

SEQ ID NO: 3077 - DNA, 140 bp, Artificial Sequence
  Synthetic
atacgccatgctgggtctccctcatacctgagccagagaagcaaagatctcctcaggacaaccaaatggcaatcatcatcatggtagcagtgggtcttctgggcttgattactgccaatgcgtacttgggagtcggccat

SEQ ID NO: 3078 - DNA, 140 bp, Artificial Sequence
  Synthetic
atggccgactcccaagtacgcattggcagtaatcaagcccagaagacccactgctaccatgatgatgattgccatttggttgtcctgaggagatctttgcttctctggctcaggtatgagggagacccagcatggcgtat

SEQ ID NO: 3079 - DNA, 140 bp, Artificial Sequence
  Synthetic
atacgccatgctgggtctccaactcggatggttggaaagaacaaagagtgacctaagccatctaatgggaaggagagaggagggggcaaccataggattctcaatggacattgacctgcgcgtacttgggagtcggccat

SEQ ID NO: 3080 - DNA, 140 bp, Artificial Sequence
  Synthetic
atggccgactcccaagtacgcgcaggtcaatgtccattgagaatcctatggttgccccctcctctctccttcccattagatggcttaggtcactctttgttctttccaaccatccgagttggagacccagcatggcgtat

SEQ ID NO: 3081 - DNA, 140 bp, Artificial Sequence
  Synthetic
atacgccatgctgggtctccgccagcctcagcttgggctatctacgctgctttgacaactttcattaccccagccgtccagcatgcagtgaccacttcatacaacaactactccttaatgcgtacttgggagtcggccat

SEQ ID NO: 3082 - DNA, 140 bp, Artificial Sequence
  Synthetic
atggccgactcccaagtacgcattaaggagtagttgttgtatgaagtggtcactgcatgctggacggctggggtaatgaaagttgtcaaagcagcgtagatagcccaagctgaggctggcggagacccagcatggcgtat

SEQ ID NO: 3083 - DNA, 140 bp, Artificial Sequence
  Synthetic
atacgccatgctgggtctccgcgatggccacgcaagccggagtgttgtttggtatgggcaaagggatgccattctacgcatgggactttggagtcccgctgctaatgataggttgctactcgtacttgggagtcggccat

SEQ ID NO: 3084 - DNA, 140 bp, Artificial Sequence
  Synthetic
atggccgactcccaagtacgagtagcaacctatcattagcagcgggactccaaagtcccatgcgtagaatggcatccctttgcccataccaaacaacactccggcttgcgtggccatcgcggagacccagcatggcgtat

SEQ ID NO: 3085 - DNA, 140 bp, Artificial Sequence
  Synthetic
aggccctggctgctgatatgccagaagagaacggcagctggcatcatgaagaaccctgtcgtggatggaatagtggtgactgacattgacacaatgacaattgacccccaagtggagaaagaccttttgggacagcggtg

SEQ ID NO: 3086 - DNA, 140 bp, Artificial Sequence
  Synthetic
caccgctgtcccaaaaggtctttctccacttgggggtcaattgtcattgtgtcaatgtcagtcaccactattccatccacgacagggttcttcatgatgccagctgccgttctcttctggcatatcagcagccagggcct

SEQ ID NO: 3087 - DNA, 140 bp, Artificial Sequence
  Synthetic
aggccctggctgctgatatgacagccacttcactgtgtaacatttttaggggaagttacttggctggagcttctctaatctacacagtaacaagaaacgctggcttggtcaagagacgtggaccttttgggacagcggtg

SEQ ID NO: 3088 - DNA, 140 bp, Artificial Sequence
  Synthetic
caccgctgtcccaaaaggtccacgtctcttgaccaagccagcgtttcttgttactgtgtagattagagaagctccagccaagtaacttcccctaaaaatgttacacagtgaagtggctgtcatatcagcagccagggcct

SEQ ID NO: 3089 - DNA, 140 bp, Artificial Sequence
  Synthetic
aggccctggctgctgatatgcagatgtcggccctggagttctactcctacaaaaagtcaggcatcaccgaggtgtgcagagaagaggcccgccgcgccctcaaggacggtgtggcaacgggaccttttgggacagcggtg

SEQ ID NO: 3090 - DNA, 140 bp, Artificial Sequence
  Synthetic
caccgctgtcccaaaaggtcccgttgccacaccgtccttgagggcgcggcgggcctcttctctgcacacctcggtgatgcctgactttttgtaggagtagaactccagggccgacatctgcatatcagcagccagggcct

SEQ ID NO: 3091 - DNA, 140 bp, Artificial Sequence
  Synthetic
atacgccatgctgggtctccggtgtgcagagaagaggcccgccgcgccctcaaggacggtgtggcaacgggaggccatgctgtgtcccgaggaagtgcgaagctgagatggttggtggagcgtacttgggagtcggccat

SEQ ID NO: 3092 - DNA, 140 bp, Artificial Sequence
  Synthetic
atggccgactcccaagtacgctccaccaaccatctcagcttcgcacttcctcgggacacagcatggcctcccgttgccacaccgtccttgagggcgcggcgggcctcttctctgcacaccggagacccagcatggcgtat

SEQ ID NO: 3093 - DNA, 140 bp, Artificial Sequence
  Synthetic
atacgccatgctgggtctcccggggatacctgcagccctatggaaaggtcattgatcttggatgtggcagagggggctggagttactacgccgccaccatccgcaaagttcaagaggtgacgtacttgggagtcggccat

SEQ ID NO: 3094 - DNA, 140 bp, Artificial Sequence
  Synthetic
atggccgactcccaagtacgtcacctcttgaactttgcggatggtggcggcgtagtaactccagccccctctgccacatccaagatcaatgacctttccatagggctgcaggtatccccgggagacccagcatggcgtat

SEQ ID NO: 3095 - DNA, 140 bp, Artificial Sequence
  Synthetic
aggccctggctgctgatatgaaggatacacaaaaggaggccctggtcatgaagaacccatgttggtgcaaagctatgggtggaacatagtccgtcttaagagtggggtggacgtctttcagaccttttgggacagcggtg

SEQ ID NO: 3096 - DNA, 140 bp, Artificial Sequence
  Synthetic
caccgctgtcccaaaaggtctgaaagacgtccaccccactcttaagacggactatgttccacccatagctttgcaccaacatgggttcttcatgaccagggcctccttttgtgtatccttcatatcagcagccagggcct

SEQ ID NO: 3097 - DNA, 140 bp, Artificial Sequence
  Synthetic
aggccctggctgctgatatgagctatgggtggaacatagtccgtcttaagagtggggtggacgtctttcatatggcggctgagccgtgtgacacgttgctgtgtgatataggtgagtcatgaccttttgggacagcggtg

SEQ ID NO: 3098 - DNA, 140 bp, Artificial Sequence
  Synthetic
caccgctgtcccaaaaggtcatgactcacctatatcacacagcaacgtgtcacacggctcagccgccatatgaaagacgtccaccccactcttaagacggactatgttccacccatagctcatatcagcagccagggcct

SEQ ID NO: 3099 - DNA, 140 bp, Artificial Sequence
  Synthetic
atacgccatgctgggtctccgtcagcaaagagttttcaaggaaaaagtggacactagggtgccagacccccaagaaggcactcgtcagattatgagcatggtctcttcctggttgtggaacgtacttgggagtcggccat

SEQ ID NO: 3100 - DNA, 140 bp, Artificial Sequence
  Synthetic
atggccgactcccaagtacgttccacaaccaggaagagaccatgctcataatctgacgagtgccttcttgggggtctggcaccctagtgtccactttttccttgaaaactctttgctgacggagacccagcatggcgtat

SEQ ID NO: 3101 - DNA, 140 bp, Artificial Sequence
  Synthetic
aggccctggctgctgatatgtatgtcctagaagagatgagtcgcataccaggaggaaggatgtatgcagatgacactgctggctgggacacccgcatcagcaggtttgatctggagaatggaccttttgggacagcggtg

SEQ ID NO: 3102 - DNA, 140 bp, Artificial Sequence
  Synthetic
caccgctgtcccaaaaggtccattctccagatcaaacctgctgatgcgggtgtcccagccagcagtgtcatctgcatacatccttcctcctggtatgcgactcatctcttctaggacatacatatcagcagccagggcct

SEQ ID NO: 3103 - DNA, 140 bp, Artificial Sequence
  Synthetic
aggccctggctgctgatatgagctgaaaaagggaagacagttatggacattatttcaagacaagaccaaagggggagcggacaagttgtcacctacgctcttaatacatttaccaacctagaccttttgggacagcggtg

SEQ ID NO: 3104 - DNA, 140 bp, Artificial Sequence
  Synthetic
caccgctgtcccaaaaggtctaggttggtaaatgtattaagagcgtaggtgacaacttgtccgctccccctttggtcttgtcttgaaataatgtccataactgtcttccctttttcagctcatatcagcagccagggcct

SEQ ID NO: 3105 - DNA, 140 bp, Artificial Sequence
  Synthetic
aggccctggctgctgatatggatgggacaactgggaagaagttccgttttgctcccaccacttcaacaagcttcatctcaaggacgggaggtccattgtggttccctgccgccaccaagagaccttttgggacagcggtg

SEQ ID NO: 3106 - DNA, 140 bp, Artificial Sequence
  Synthetic
caccgctgtcccaaaaggtctcttggtggcggcagggaaccacaatggacctcccgtccttgagatgaagcttgttgaagtggtgggagcaaaacggaacttcttcccagttgtcccatccatatcagcagccagggcct

SEQ ID NO: 3107 - DNA, 140 bp, Artificial Sequence
  Synthetic
aggccctggctgctgatatgtgaactgattggccgggcccgcgtctctccaggggcgggatggagcatccgggagactgcttgcctggcaaaatcatatgcgcaaatgtggcagctccttgaccttttgggacagcggtg

SEQ ID NO: 3108 - DNA, 140 bp, Artificial Sequence
  Synthetic
caccgctgtcccaaaaggtcaaggagctgccacatttgcgcatatgattttgccaggcaagcagtctcccggatgctccatcccgcccctggagagacgcgggcccggccaatcagttcacatatcagcagccagggcct

SEQ ID NO: 3109 - DNA, 140 bp, Artificial Sequence
  Synthetic
aggccctggctgctgatatgtgtgccagttgactgggttccaactgggagaactacctggtcaatccatggaaagggagaatggatgaccactgaagacatgcttgtggtgtggaacagagaccttttgggacagcggtg

SEQ ID NO: 3110 - DNA, 140 bp, Artificial Sequence
  Synthetic
caccgctgtcccaaaaggtctctgttccacaccacaagcatgtcttcagtggtcatccattctccctttccatggattgaccaggtagttctcccagttggaacccagtcaactggcacacatatcagcagccagggcct

SEQ ID NO: 3111 - DNA, 140 bp, Artificial Sequence
  Synthetic
atacgccatgctgggtctccgtgtggatcgaggagaacgaccacatggaagacaagaccccagtaacgaaatggacagacattccctatttgggaaaaagggaagacttgtggtgtggatcgtacttgggagtcggccat

SEQ ID NO: 3112 - DNA, 140 bp, Artificial Sequence
  Synthetic
atggccgactcccaagtacgatccacaccacaagtcttccctttttcccaaatagggaatgtctgtccatttcgttactggggtcttgtcttccatgtggtcgttctcctcgatccacacggagacccagcatggcgtat

SEQ ID NO: 3113 - DNA, 140 bp, Artificial Sequence
  Synthetic
atacgccatgctgggtctccctctcatagggcacagaccgcgcaccacctgggctgagaacatcaaaaacacagtcaacatggtgcgcaggatcataggtgatgaagaaaagtacatggacgtacttgggagtcggccat

SEQ ID NO: 3114 - DNA, 140 bp, Artificial Sequence
  Synthetic
atggccgactcccaagtacgtccatgtacttttcttcatcacctatgatcctgcgcaccatgttgactgtgtttttgatgttctcagcccaggtggtgcgcggtctgtgccctatgagagggagacccagcatggcgtat

SEQ ID NO: 3115 - DNA, 140 bp, Artificial Sequence
  Synthetic
aggccctggctgctgatatgatcaaaaacacagtcaacatggtgcgcaggatcataggtgatgaagaaaagtacatggactacctatccacccaagttcgctacttgggcgaagaagggtgaccttttgggacagcggtg

SEQ ID NO: 3116 - DNA, 140 bp, Artificial Sequence
  Synthetic
caccgctgtcccaaaaggtcacccttcttcgcccaagtagcgaacttgggtggataggtagtccatgtacttttcttcatcacctatgatcctgcgcaccatgttgactgtgtttttgatcatatcagcagccagggcct

SEQ ID NO: 3117 - DNA, 140 bp, Artificial Sequence
  Synthetic
atacgccatgctgggtctccgggcagagactgatgaagaccatgcacactggcttgaagcaagaatgcttcttgataacatttacctccaagatggcctcatagcctcgctctatcgacccgtacttgggagtcggccat

SEQ ID NO: 3118 - DNA, 140 bp, Artificial Sequence
  Synthetic
atggccgactcccaagtacgggtcgatagagcgaggctatgaggccatcttggaggtaaatgttatcaagaagcattcttgcttcaagccagtgtgcatggtcttcatcagtctctgcccggagacccagcatggcgtat

SEQ ID NO: 3119 - DNA, 140 bp, Artificial Sequence
  Synthetic
aggccctggctgctgatatggaggccgataaggtagcagccattgagggagagttcaagcttaggacggagcaaaggaagacctttgtggaactcatgaaaagaggagatcttcctgtttgaccttttgggacagcggtg

SEQ ID NO: 3120 - DNA, 140 bp, Artificial Sequence
  Synthetic
caccgctgtcccaaaaggtcaaacaggaagatctcctcttttcatgagttccacaaaggtcttcctttgctccgtcctaagcttgaactctccctcaatggctgctaccttatcggcctccatatcagcagccagggcct

SEQ ID NO: 3121 - DNA, 140 bp, Artificial Sequence
  Synthetic
atacgccatgctgggtctcctggcacaggacaaaccgactgtcgacatagagctggttacaacaacagtcagcaacatggcggaggtaagatcctactgctatgaggcatcaatatcggacgtacttgggagtcggccat

SEQ ID NO: 3122 - DNA, 140 bp, Artificial Sequence
  Synthetic
atggccgactcccaagtacgtccgatattgatgcctcatagcagtaggatcttacctccgccatgttgctgactgttgttgtaaccagctctatgtcgacagtcggtttgtcctgtgccaggagacccagcatggcgtat

SEQ ID NO: 3123 - DNA, 140 bp, Artificial Sequence
  Synthetic
aggccctggctgctgatatggaagcctaggacttgattgtgaaccgaggacaggccttgacttttcagatttgtattacttgactatgaataacaagcactggttagttcacaaggagtggaccttttgggacagcggtg

SEQ ID NO: 3124 - DNA, 140 bp, Artificial Sequence
  Synthetic
caccgctgtcccaaaaggtccactccttgtgaactaaccagtgcttgttattcatagtcaagtaatacaaatctgaaaagtcaaggcctgtcctcggttcacaatcaagtcctaggcttccatatcagcagccagggcct

SEQ ID NO: 3125 - DNA, 140 bp, Artificial Sequence
  Synthetic
atacgccatgctgggtctccgttccacgacattccattaccttggcatgctggggcagacaccggaactccacactggaacaacaaagaagcactggtagagttcaaggacgcacatgcccgtacttgggagtcggccat

SEQ ID NO: 3126 - DNA, 140 bp, Artificial Sequence
  Synthetic
atggccgactcccaagtacgggcatgtgcgtccttgaactctaccagtgcttctttgttgttccagtgtggagttccggtgtctgccccagcatgccaaggtaatggaatgtcgtggaacggagacccagcatggcgtat

SEQ ID NO: 3127 - DNA, 140 bp, Artificial Sequence
  Synthetic
atacgccatgctgggtctccaagggcgtgtcatactccttgtgtaccgcagcgttcacattcaccaaaatcccggctgaaacactgcacgggacagtcacagtggaggtacagtacgcagcgtacttgggagtcggccat

SEQ ID NO: 3128 - DNA, 140 bp, Artificial Sequence
  Synthetic
atggccgactcccaagtacgctgcgtactgtacctccactgtgactgtcccgtgcagtgtttcagccgggattttggtgaatgtgaacgctgcggtacacaaggagtatgacacgcccttggagacccagcatggcgtat

SEQ ID NO: 3129 - DNA, 140 bp, Artificial Sequence
  Synthetic
aggccctggctgctgatatggctgatgtggttgggtctgaacacaaagaatggatctatttctcttatgtgcttggccttagggggagtgttgatcttcttatccacagccgtctctgctgaccttttgggacagcggtg

SEQ ID NO: 3130 - DNA, 140 bp, Artificial Sequence
  Synthetic
caccgctgtcccaaaaggtcagcagagacggctgtggataagaagatcaacactccccctaaggccaagcacataagagaaatagatccattctttgtgttcagacccaaccacatcagccatatcagcagccagggcct

SEQ ID NO: 3131 - DNA, 140 bp, Artificial Sequence
  Synthetic
aggccctggctgctgatatgtcgactgatggctaatgccatttgctcggctgtaccagttgactgggtaccaactgggagaaccacctggtcaatccatggaaagggagaatggatgaccgaccttttgggacagcggtg

SEQ ID NO: 3132 - DNA, 140 bp, Artificial Sequence
  Synthetic
caccgctgtcccaaaaggtcggtcatccattctccctttccatggattgaccaggtggttctcccagttggtacccagtcaactggtacagccgagcaaatggcattagccatcagtcgacatatcagcagccagggcct

SEQ ID NO: 3133 - DNA, 140 bp, Artificial Sequence
  Synthetic
atacgccatgctgggtctcccagccggacttctgctgggtcatggacccattagaatggttttggcgatactagccttcttgcggttcacagcgctaaaaccctcactgggccttatcaacgtacttgggagtcggccat

SEQ ID NO: 3134 - DNA, 140 bp, Artificial Sequence
  Synthetic
atggccgactcccaagtacgttgataaggcccagtgagggttttagcgctgtgaaccgcaagaaggctagtatcgccaaaaccattctaatgggtccatgacccagcagaagtccggctgggagacccagcatggcgtat

SEQ ID NO: 3135 - DNA, 140 bp, Artificial Sequence
  Synthetic
atacgccatgctgggtctcctgtacttggataggagcgatgccgggaaggccatttcgtttgctaccacaatgggagtgaacaagtgccacgtacagatcatggacctcgggcacatgtgcgtacttgggagtcggccat

SEQ ID NO: 3136 - DNA, 140 bp, Artificial Sequence
  Synthetic
atggccgactcccaagtacgcacatgtgcccgaggtccatgatctgtacgtggcacttgttcactcccattgtggtagcaaacgaaatggccttcccggcatcgctcctatccaagtacaggagacccagcatggcgtat

SEQ ID NO: 3137 - DNA, 140 bp, Artificial Sequence
  Synthetic
atacgccatgctgggtctccggaacctgtcatcacaaaaaaggtgaggcacggccctcaagaagagctgtcacgcttccttcccattccacaagaaagttacagacacggtcacaaacctcgtacttgggagtcggccat

SEQ ID NO: 3138 - DNA, 140 bp, Artificial Sequence
  Synthetic
atggccgactcccaagtacgaggtttgtgaccgtgtctgtaactttcttgtggaatgggaaggaagcgtgacagctcttcttgagggccgtgcctcaccttttttgtgatgacaggttccggagacccagcatggcgtat

SEQ ID NO: 3139 - DNA, 140 bp, Artificial Sequence
  Synthetic
atacgccatgctgggtctccggcttgaatcacgggagtacacgaagcacctgatcaaagttgagaactggatactccggaatccagggttcacagttgctgctctagcaatggcctggctcgtacttgggagtcggccat

SEQ ID NO: 3140 - DNA, 140 bp, Artificial Sequence
  Synthetic
atggccgactcccaagtacgagccaggccattgctagagcagcaactgtgaaccctggattccggagtatccagttctcaactttgatcaggtgcttcgtgtactcccgtgattcaagccggagacccagcatggcgtat

SEQ ID NO: 3141 - DNA, 140 bp, Artificial Sequence
  Synthetic
aggccctggctgctgatatgatactccggaatccagggttcacagttgctgctctagcaatggcctggctcttgggaaattccacgagccagcgagtgatctatctggtgatgatcctgtgaccttttgggacagcggtg

SEQ ID NO: 3142 - DNA, 140 bp, Artificial Sequence
  Synthetic
caccgctgtcccaaaaggtcacaggatcatcaccagatagatcactcgctggctcgtggaatttcccaagagccaggccattgctagagcagcaactgtgaaccctggattccggagtatcatatcagcagccagggcct

SEQ ID NO: 3143 - DNA, 140 bp, Artificial Sequence
  Synthetic
atacgccatgctgggtctccgggagcttggtgacatgtgccaagtttacgtgttctaagaagatgaccgggaagagcattcaaccggagaatttggagtacagaattatgctgtcagtgccgtacttgggagtcggccat

SEQ ID NO: 3144 - DNA, 140 bp, Artificial Sequence
  Synthetic
atggccgactcccaagtacggcactgacagcataattctgtactccaaattctccggttgaatgctcttcccggtcatcttcttagaacacgtaaacttggcacatgtcaccaagctcccggagacccagcatggcgtat

SEQ ID NO: 3145 - DNA, 140 bp, Artificial Sequence
  Synthetic
aggccctggctgctgatatgacggctcccaacacagcgggatgattgtgaatgacataggacatgagaccgatgaaaacagagcaaaagtggaggtcacaccaaactcaccaagagctgagaccttttgggacagcggtg

SEQ ID NO: 3146 - DNA, 140 bp, Artificial Sequence
  Synthetic
caccgctgtcccaaaaggtctcagctcttggtgagtttggtgtgacctccacttttgctctgttttcatcggtctcatgtcctatgtcattcacaatcatcccgctgtgttgggagccgtcatatcagcagccagggcct

SEQ ID NO: 3147 - DNA, 140 bp, Artificial Sequence
  Synthetic
aggccctggctgctgatatggatgaaaacagagcaaaagtggaggtcacaccaaactcaccaagagctgaagcgaccctagggggcttcgggagtttgggactcgattgtgagccaaggagaccttttgggacagcggtg

SEQ ID NO: 3148 - DNA, 140 bp, Artificial Sequence
  Synthetic
caccgctgtcccaaaaggtctccttggctcacaatcgagtcccaaactcccgaagccccctagggtcgcttcagctcttggtgagtttggtgtgacctccacttttgctctgttttcatccatatcagcagccagggcct

SEQ ID NO: 3149 - DNA, 140 bp, Artificial Sequence
  Synthetic
aggccctggctgctgatatgccggtttagatttctccgacctgtactatttaaccatgaacaacaagcattggttggtgcacaaggagtggttccacgacattccattgccatggcacgcgaccttttgggacagcggtg

SEQ ID NO: 3150 - DNA, 140 bp, Artificial Sequence
  Synthetic
caccgctgtcccaaaaggtcgcgtgccatggcaatggaatgtcgtggaaccactccttgtgcaccaaccaatgcttgttgttcatggttaaatagtacaggtcggagaaatctaaaccggcatatcagcagccagggcct

SEQ ID NO: 3151 - DNA, 140 bp, Artificial Sequence
  Synthetic
atacgccatgctgggtctcctggagcggacacagggactccccattggaacaacaaagaggcattggttgagttcaaggatgcccacgccaaaagacagactgttgtcgtgttgggaagtcgtacttgggagtcggccat

SEQ ID NO: 3152 - DNA, 140 bp, Artificial Sequence
  Synthetic
atggccgactcccaagtacgacttcccaacacgacaacagtctgtcttttggcgtgggcatccttgaactcaaccaatgcctctttgttgttccaatggggagtccctgtgtccgctccaggagacccagcatggcgtat

SEQ ID NO: 3153 - DNA, 140 bp, Artificial Sequence
  Synthetic
atacgccatgctgggtctcccaggagggtgccgtccacacagccctggcaggagctttggaagcggagatggatggagccaaaggaaggctgttctcaggtcatttgaagtgccggataacgtacttgggagtcggccat

SEQ ID NO: 3154 - DNA, 140 bp, Artificial Sequence
  Synthetic
atggccgactcccaagtacgttatccggcacttcaaatgacctgagaacagccttcctttggctccatccatctccgcttccaaagctcctgccagggctgtgtggacggcaccctcctgggagacccagcatggcgtat

SEQ ID NO: 3155 - DNA, 140 bp, Artificial Sequence
  Synthetic
atacgccatgctgggtctccagatggacaagcttaggttgaagggtgtctcatactcattgtgcactgccgccttcacattctcaaaggttccggctgaaacgctgcatgggacagtcaccgtacttgggagtcggccat

SEQ ID NO: 3156 - DNA, 140 bp, Artificial Sequence
  Synthetic
atggccgactcccaagtacggtgactgtcccatgcagcgtttcagccggaacctttgagaatgtgaaggcggcagtgcacaatgagtatgagacacccttcaacctaagcttgtccatctggagacccagcatggcgtat

SEQ ID NO: 3157 - DNA, 140 bp, Artificial Sequence
  Synthetic
atacgccatgctgggtctccagttgaggtgcagtatgcgggcagagatggaccttgcaaggtgccagcccaaatggcagtggatatgcagactcttaccccagtgggaaggttgataacgcgtacttgggagtcggccat

SEQ ID NO: 3158 - DNA, 140 bp, Artificial Sequence
  Synthetic
atggccgactcccaagtacgcgttatcaaccttcccactggggtaagagtctgcatatccactgccatttgggctggcaccttgcaaggtccatctctgcccgcatactgcacctcaactggagacccagcatggcgtat

SEQ ID NO: 3159 - DNA, 140 bp, Artificial Sequence
  Synthetic
atacgccatgctgggtctccgcaaatcccatcataactgagagcactgaaaactcgagaatgatgttggagctggacccaccctttggagactcttacattgtcattggggttggagatacgtacttgggagtcggccat

SEQ ID NO: 3160 - DNA, 140 bp, Artificial Sequence
  Synthetic
atggccgactcccaagtacgtatctccaaccccaatgacaatgtaagagtctccaaagggtgggtccagctccaacatcattctcgagttttcagtgctctcagttatgatgggatttgcggagacccagcatggcgtat

SEQ ID NO: 3161 - DNA, 140 bp, Artificial Sequence
  Synthetic
atacgccatgctgggtctccagaaaattacccatcattggcacagaagtggaagcacgattgggaaggcatttgaggccactgtgagaggtgcaaaaaggatggcagtcctgggagataccgtacttgggagtcggccat

SEQ ID NO: 3162 - DNA, 140 bp, Artificial Sequence
  Synthetic
atggccgactcccaagtacggtatctcccaggactgccatcctttttgcacctctcacagtggcctcaaatgccttcccaatcgtgcttccacttctgtgccaatgatgggtaattttctggagacccagcatggcgtat

SEQ ID NO: 3163 - DNA, 140 bp, Artificial Sequence
  Synthetic
atacgccatgctgggtctcccgcctgggattttggttctgttggaggcgtgttcaattctctgggcaagggagttcatcaggtcttcggagcagcctttaaatccttatttggcggaatgcgtacttgggagtcggccat

SEQ ID NO: 3164 - DNA, 140 bp, Artificial Sequence
  Synthetic
atggccgactcccaagtacgcattccgccaaataaggatttaaaggctgctccgaagacctgatgaactcccttgcccagagaattgaacacgcctccaacagaaccaaaatcccaggcgggagacccagcatggcgtat

SEQ ID NO: 3165 - DNA, 140 bp, Artificial Sequence
  Synthetic
atacgccatgctgggtctcctcctggttttcacaaattcttattggcacacttttagtgtggttgggcttgaatacaaaaaatggatccatttcccttgcatgtctggcgcttggaggggcgtacttgggagtcggccat

SEQ ID NO: 3166 - DNA, 140 bp, Artificial Sequence
  Synthetic
atggccgactcccaagtacgcccctccaagcgccagacatgcaagggaaatggatccattttttgtattcaagcccaaccacactaaaagtgtgccaataagaatttgtgaaaaccaggaggagacccagcatggcgtat

SEQ ID NO: 3167 - DNA, 140 bp, Artificial Sequence
  Synthetic
atacgccatgctgggtctcccgatgatctttctctccacggccgtctcggcagacgtggggtgctcagttgacttcgctagaaaagagacaagatgtggcacaggagttttcgtctacaacgtacttgggagtcggccat

SEQ ID NO: 3168 - DNA, 140 bp, Artificial Sequence
  Synthetic
atggccgactcccaagtacgttgtagacgaaaactcctgtgccacatcttgtctcttttctagcgaagtcaactgagcaccccacgtctgccgagacggccgtggagagaaagatcatcgggagacccagcatggcgtat

SEQ ID NO: 3169 - DNA, 140 bp, Artificial Sequence
  Synthetic
atacgccatgctgggtctcccgacgttgatgcctggagggacagatacaagtaccatccagactctccacgtagactggcggcggctgttaagcaagcttgggaagatggaatctgcgggcgtacttgggagtcggccat

SEQ ID NO: 3170 - DNA, 140 bp, Artificial Sequence
  Synthetic
atggccgactcccaagtacgcccgcagattccatcttcccaagcttgcttaacagccgccgccagtctacgtggagagtctggatggtacttgtatctgtccctccaggcatcaacgtcgggagacccagcatggcgtat

SEQ ID NO: 3171 - DNA, 140 bp, Artificial Sequence
  Synthetic
atacgccatgctgggtctccatttcctccgtctcaaggatggaaaacatcatgtggaagtcggtggagggagagctcaatgctatactcgaagagaacggagtgcagctcacagttgttgcgtacttgggagtcggccat

SEQ ID NO: 3172 - DNA, 140 bp, Artificial Sequence
  Synthetic
atggccgactcccaagtacgcaacaactgtgagctgcactccgttctcttcgagtatagcattgagctctccctccaccgacttccacatgatgttttccatccttgagacggaggaaatggagacccagcatggcgtat

SEQ ID NO: 3173 - DNA, 140 bp, Artificial Sequence
  Synthetic
atacgccatgctgggtctcctaggacctgtaaaaaatcctatgtggagagcaccacaacggctaccggtgcctgtgaatgagcttcctcatggatggaaagcctggggcaaatcatacttcgtacttgggagtcggccat

SEQ ID NO: 3174 - DNA, 140 bp, Artificial Sequence
  Synthetic
atggccgactcccaagtacgaagtatgatttgccccaggctttccatccatgaggaagctcattcacaggcaccggtagccgttgtggtgctctccacataggattttttacaggtcctaggagacccagcatggcgtat

SEQ ID NO: 3175 - DNA, 140 bp, Artificial Sequence
  Synthetic
atacgccatgctgggtctcccatcaaagcagcaaagaccaacaatagctttgtggtcgatggcgacaccttgaaagagtgtccactcaaacagagggcctggaacagcttccttgtggagcgtacttgggagtcggccat

SEQ ID NO: 3176 - DNA, 140 bp, Artificial Sequence
  Synthetic
atggccgactcccaagtacgctccacaaggaagctgttccaggccctctgtttgagtggacactctttcaaggtgtcgccatcgaccacaaagctattgttggtctttgctgctttgatgggagacccagcatggcgtat

SEQ ID NO: 3177 - DNA, 140 bp, Artificial Sequence
  Synthetic
atacgccatgctgggtctccgaccatgggtttggagttttccacactagtgtgtggctcaaagtcagggaggattactcattagagtgtgatccagccgtgattggaacagccatcaaagcgtacttgggagtcggccat

SEQ ID NO: 3178 - DNA, 140 bp, Artificial Sequence
  Synthetic
atggccgactcccaagtacgctttgatggctgttccaatcacggctggatcacactctaatgagtaatcctccctgactttgagccacacactagtgtggaaaactccaaacccatggtcggagacccagcatggcgtat

SEQ ID NO: 3179 - DNA, 140 bp, Artificial Sequence
  Synthetic
atacgccatgctgggtctccggaaggaagctgctcacagtgatcttggttattggattgagagcgagaagaacgacacctggagactgaagagggctcacatgatcgagatgaagacgtgcgtacttgggagtcggccat

SEQ ID NO: 3180 - DNA, 140 bp, Artificial Sequence
  Synthetic
atggccgactcccaagtacgcacgtcttcatctcgatcatgtgagccctcttcagtctccaggtgtcgttcttctcgctctcaatccaataaccaagatcactgtgagcagcttccttccggagacccagcatggcgtat

SEQ ID NO: 3181 - DNA, 140 bp, Artificial Sequence
  Synthetic
atacgccatgctgggtctcctgagtggccaagatctcacaccctatggacagatggagtagaaggagagtgattgatcatacccaagtccttagctggtccactcagtcaccacaacacccgtacttgggagtcggccat

SEQ ID NO: 3182 - DNA, 140 bp, Artificial Sequence
  Synthetic
atggccgactcccaagtacgggtgttgtggtgactgagtggaccagctaaggacttgggtatgatcaatcactctccttctactccatctgtccatagggtgtgagatcttggccactcaggagacccagcatggcgtat

SEQ ID NO: 3183 - DNA, 140 bp, Artificial Sequence
  Synthetic
aggccctggctgctgatatgtggcagtgctggtagccatggtcttgggaggattctcaatgagtgacctggctaagcttgtgatcctgatgggtgccactttcgcagaaatgaacacagggaccttttgggacagcggtg

SEQ ID NO: 3184 - DNA, 140 bp, Artificial Sequence
  Synthetic
caccgctgtcccaaaaggtccctgtgttcatttctgcgaaagtggcacccatcaggatcacaagcttagccaggtcactcattgagaatcctcccaagaccatggctaccagcactgccacatatcagcagccagggcct

SEQ ID NO: 3185 - DNA, 140 bp, Artificial Sequence
  Synthetic
atacgccatgctgggtctccaggagatgtggctcacttggcattggtagcggcatttaaagtcagaccagccttgttggtttccttcatcttcagagccaactggacaccccgtgagagccgtacttgggagtcggccat

SEQ ID NO: 3186 - DNA, 140 bp, Artificial Sequence
  Synthetic
atggccgactcccaagtacggctctcacggggtgtccagttggctctgaagatgaaggaaaccaacaaggctggtctgactttaaatgccgctaccaatgccaagtgagccacatctcctggagacccagcatggcgtat

SEQ ID NO: 3187 - DNA, 140 bp, Artificial Sequence
  Synthetic
aggccctggctgctgatatgtgaaggcgagctgatggtcctcgttaatggatttgctttggcctggttggcaatacgagcgatggccgtgccacgcactgacaatatcgctctagcaattgaccttttgggacagcggtg

SEQ ID NO: 3188 - DNA, 140 bp, Artificial Sequence
  Synthetic
caccgctgtcccaaaaggtcaattgctagagcgatattgtcagtgcgtggcacggccatcgctcgtattgccaaccaggccaaagcaaatccattaacgaggaccatcagctcgccttcacatatcagcagccagggcct

SEQ ID NO: 3189 - DNA, 140 bp, Artificial Sequence
  Synthetic
atacgccatgctgggtctccaaggagtggaaaacggagctggccccctagtgaagtgcttacagctgttggcctgatatgtgcactggctggagggtttgccaaggcagacatagagatgcgtacttgggagtcggccat

SEQ ID NO: 3190 - DNA, 140 bp, Artificial Sequence
  Synthetic
atggccgactcccaagtacgcatctctatgtctgccttggcaaaccctccagccagtgcacatatcaggccaacagctgtaagcacttcactagggggccagctccgttttccactccttggagacccagcatggcgtat

SEQ ID NO: 3191 - DNA, 140 bp, Artificial Sequence
  Synthetic
atacgccatgctgggtctccgctgggcccatggctgcagtaggcctgctaattgtcagctatgtggtctcgggaaagagtgtggacatgtacatcgaaagagcaggtgacatcacatgggcgtacttgggagtcggccat

SEQ ID NO: 3192 - DNA, 140 bp, Artificial Sequence
  Synthetic
atggccgactcccaagtacgcccatgtgatgtcacctgctctttcgatgtacatgtccacactctttcccgagaccacatagctgacaattagcaggcctactgcagccatgggcccagcggagacccagcatggcgtat

SEQ ID NO: 3193 - DNA, 140 bp, Artificial Sequence
  Synthetic
atacgccatgctgggtctccaaaaggatgcagaaataactggaaacagtcctaggcttgatgtggcattggatgagagtggtgacttctctttgctggaagacgacggacccccgatgaacgtacttgggagtcggccat

SEQ ID NO: 3194 - DNA, 140 bp, Artificial Sequence
  Synthetic
atggccgactcccaagtacgttcatcgggggtccgtcgtcttccagcaaagagaagtcaccactctcatccaatgccacatcaagcctaggactgtttccagttatttctgcatccttttggagacccagcatggcgtat

SEQ ID NO: 3195 - DNA, 140 bp, Artificial Sequence
  Synthetic
atacgccatgctgggtctccggagatcatactcaaagtggttttgatggccgtgtgcggcgtgagtcccatagccataccctttgcagctggagcttggtatgtgtacatcaagactggccgtacttgggagtcggccat

SEQ ID NO: 3196 - DNA, 140 bp, Artificial Sequence
  Synthetic
atggccgactcccaagtacggccagtcttgatgtacacataccaagctccagctgcaaagggtatggctatgggactcacgccgcacacggccatcaaaaccactttgagtatgatctccggagacccagcatggcgtat

SEQ ID NO: 3197 - DNA, 140 bp, Artificial Sequence
  Synthetic
atacgccatgctgggtctccaaacggagtggagccctctgggacataccggcacccaaggaagtgaagaaaggggaaacaactgatggcgtgtatcgtgttatgacccgcagactgttggcgtacttgggagtcggccat

SEQ ID NO: 3198 - DNA, 140 bp, Artificial Sequence
  Synthetic
atggccgactcccaagtacgccaacagtctgcgggtcataacacgatacacgccatcagttgtttcccctttcttcacttccttgggtgccggtatgtcccagagggctccactccgtttggagacccagcatggcgtat

SEQ ID NO: 3199 - DNA, 140 bp, Artificial Sequence
  Synthetic
atacgccatgctgggtctccgctcaacacaggttggagtgggagtcatgcaggagggggttttccacacaatgtggcacgtcacaaaaggggctgcgctgcggagtggagaagggagactcgtacttgggagtcggccat

SEQ ID NO: 3200 - DNA, 140 bp, Artificial Sequence
  Synthetic
atggccgactcccaagtacgagtctcccttctccactccgcagcgcagccccttttgtgacgtgccacattgtgtggaaaaccccctcctgcatgactcccactccaacctgtgttgagcggagacccagcatggcgtat

SEQ ID NO: 3201 - DNA, 140 bp, Artificial Sequence
  Synthetic
atacgccatgctgggtctccggatccgtactggggtgatgtgaagcaagacctggtgtcatactgcggaccttggaagttggatgccgcttgggacggactcagcgaggtccaactgttgcgtacttgggagtcggccat

SEQ ID NO: 3202 - DNA, 140 bp, Artificial Sequence
  Synthetic
atggccgactcccaagtacgcaacagttggacctcgctgagtccgtcccaagcggcatccaacttccaaggtccgcagtatgacaccaggtcttgcttcacatcaccccagtacggatccggagacccagcatggcgtat

SEQ ID NO: 3203 - DNA, 140 bp, Artificial Sequence
  Synthetic
atacgccatgctgggtctccgctgttcctccaggagaaagagctagaaatgtccaaactctccctggaatcttcaagaccaaagatggggacattggagcagtggccttagactacccagcgtacttgggagtcggccat

SEQ ID NO: 3204 - DNA, 140 bp, Artificial Sequence
  Synthetic
atggccgactcccaagtacgctgggtagtctaaggccactgctccaatgtccccatctttggtcttgaagattccagggagagtttggacatttctagctctttctcctggaggaacagcggagacccagcatggcgtat

SEQ ID NO: 3205 - DNA, 140 bp, Artificial Sequence
  Synthetic
atacgccatgctgggtctcccggggacatctggatccccaatcctggataaaaacggaagagtcataggactctatggcaatggagtggtgatcagaaatgggagctatgtgagcgccatcgtacttgggagtcggccat

SEQ ID NO: 3206 - DNA, 140 bp, Artificial Sequence
  Synthetic
atggccgactcccaagtacgatggcgctcacatagctcccatttctgatcaccactccattgccatagagtcctatgactcttccgtttttatccaggattggggatccagatgtccccgggagacccagcatggcgtat

SEQ ID NO: 3207 - DNA, 140 bp, Artificial Sequence
  Synthetic
atacgccatgctgggtctccaacacaaggaaagagagaggaagaggctccgttggagtgctttgagccatcaatgttgaggaagaagcagttaacagtcctggatttgcaccctggagctcgtacttgggagtcggccat

SEQ ID NO: 3208 - DNA, 140 bp, Artificial Sequence
  Synthetic
atggccgactcccaagtacgagctccagggtgcaaatccaggactgttaactgcttcttcctcaacattgatggctcaaagcactccaacggagcctcttcctctctctttccttgtgttggagacccagcatggcgtat

SEQ ID NO: 3209 - DNA, 140 bp, Artificial Sequence
  Synthetic
atacgccatgctgggtctccggaaagacccggagggtccttccagagatagtacgcgaggcaataaagaggaggctccgcactgtaatcttagcaccaacaagggtagtggcggctgagacgtacttgggagtcggccat

SEQ ID NO: 3210 - DNA, 140 bp, Artificial Sequence
  Synthetic
atggccgactcccaagtacgtctcagccgccactacccttgttggtgctaagattacagtgcggagcctcctctttattgcctcgcgtactatctctggaaggaccctccgggtctttccggagacccagcatggcgtat

SEQ ID NO: 3211 - DNA, 140 bp, Artificial Sequence
  Synthetic
atacgccatgctgggtctcctggaagaggccttaaggggccttccagttcggtatatgacgccagccataaatgtggcccactctgggaccgagattgttgacctgatgtgtcatgccaccgtacttgggagtcggccat

SEQ ID NO: 3212 - DNA, 140 bp, Artificial Sequence
  Synthetic
atggccgactcccaagtacggtggcatgacacatcaggtcaacaatctcggtcccagagtgggccacatttatggctggcgtcatataccgaactggaaggccccttaaggcctcttccaggagacccagcatggcgtat

SEQ ID NO: 3213 - DNA, 140 bp, Artificial Sequence
  Synthetic
atacgccatgctgggtctccattcacctcgcgtctgttgcagcctatcagagtcccaaactacaacttgtacatcatggatgaggcccatttcacggatccatcgagcattgcggcaagacgtacttgggagtcggccat

SEQ ID NO: 3214 - DNA, 140 bp, Artificial Sequence
  Synthetic
atggccgactcccaagtacgtcttgccgcaatgctcgatggatccgtgaaatgggcctcatccatgatgtacaagttgtagtttgggactctgataggctgcaacagacgcgaggtgaatggagacccagcatggcgtat

SEQ ID NO: 3215 - DNA, 140 bp, Artificial Sequence
  Synthetic
atacgccatgctgggtctccggctacatctcgaccagagtggaaatgggggaagcagcagccatcttcatgacagccacgccgccaggcaccagggatgcttttccagattccaactccccgtacttgggagtcggccat

SEQ ID NO: 3216 - DNA, 140 bp, Artificial Sequence
  Synthetic
atggccgactcccaagtacggggagttggaatctggaaaagcatccctggtgcctggcggcgtggctgtcatgaagatggctgctgcttcccccatttccactctggtcgagatgtagccggagacccagcatggcgtat

SEQ ID NO: 3217 - DNA, 140 bp, Artificial Sequence
  Synthetic
atacgccatgctgggtctccctatcatggacacagaaattgaggtcccagaaagagcctggaactcgggtttcgaatgggtgacagatcacgctggcagaacagtgtggtttgttccgagcgtacttgggagtcggccat

SEQ ID NO: 3218 - DNA, 140 bp, Artificial Sequence
  Synthetic
atggccgactcccaagtacgctcggaacaaaccacactgttctgccagcgtgatctgtcacccattcgaaacccgagttccaggctctttctgggacctcaatttctgtgtccatgatagggagacccagcatggcgtat

SEQ ID NO: 3219 - DNA, 140 bp, Artificial Sequence
  Synthetic
aggccctggctgctgatatgttcgaatgggtgacagatcacgctggcagaacagtgtggtttgttccgagtgtgaggaatggaaacgaaatcgcagcctgtctgacaaaggctggaaagcgaccttttgggacagcggtg

SEQ ID NO: 3220 - DNA, 140 bp, Artificial Sequence
  Synthetic
caccgctgtcccaaaaggtcgctttccagcctttgtcagacaggctgcgatttcgtttccattcctcacactcggaacaaaccacactgttctgccagcgtgatctgtcacccattcgaacatatcagcagccagggcct

SEQ ID NO: 3221 - DNA, 140 bp, Artificial Sequence
  Synthetic
atacgccatgctgggtctccgtctgttcggatcatgcggctctgaagtcgttcaaagaatttgccgctgggaagagaggagcggctttgggagtaatggatgccctgggaacattgccagcgtacttgggagtcggccat

SEQ ID NO: 3222 - DNA, 140 bp, Artificial Sequence
  Synthetic
atggccgactcccaagtacgctggcaatgttcccagggcatccattactcccaaagccgctcctctcttcccagcggcaaattctttgaacgacttcagagccgcatgatccgaacagacggagacccagcatggcgtat

SEQ ID NO: 3223 - DNA, 140 bp, Artificial Sequence
  Synthetic
atacgccatgctgggtctccgacacatgacggagaggtttcaggaagccattgacaatctcgttgtgctcatgcgggcagagactggaagtaggccctacaaagcagcggcagcccaactcgtacttgggagtcggccat

SEQ ID NO: 3224 - DNA, 140 bp, Artificial Sequence
  Synthetic
atggccgactcccaagtacgagttgggctgccgctgctttgtagggcctacttccagtctctgcccgcatgagcacaacgagattgtcaatggcttcctgaaacctctccgtcatgtgtcggagacccagcatggcgtat

SEQ ID NO: 3225 - DNA, 140 bp, Artificial Sequence
  Synthetic
atacgccatgctgggtctccgccggagaccctagagaccatcatgctgctgggactgctaggagcggtgtcaatgggagtgttctttgtattgatgaggaacaaaggcattgggaaaatgcgtacttgggagtcggccat

SEQ ID NO: 3226 - DNA, 140 bp, Artificial Sequence
  Synthetic
atggccgactcccaagtacgcattttcccaatgcctttgttcctcatcaatacaaagaacactcccattgacaccgctcctagcagtcccagcagcatgatggtctctagggtctccggcggagacccagcatggcgtat

SEQ ID NO: 3227 - DNA, 140 bp, Artificial Sequence
  Synthetic
atacgccatgctgggtctccggctttggaatggtcactctaggagctagtgcgtggctcatgtggctctcagagatcgaacctgctagaatagcctgcgtcctcattgtggtgtttctgtcgtacttgggagtcggccat

SEQ ID NO: 3228 - DNA, 140 bp, Artificial Sequence
  Synthetic
atggccgactcccaagtacgacagaaacaccacaatgaggacgcaggctattctagcaggttcgatctctgagagccacatgagccacgcactagctcctagagtgaccattccaaagccggagacccagcatggcgtat

SEQ ID NO: 3229 - DNA, 140 bp, Artificial Sequence
  Synthetic
atacgccatgctgggtctcctgttggtcgtgctcatacccgagccggagaaacagcgatccccgcaagacaaccaaatggccatcatcatcatggtcgcggtgggactgctgggcctcatcgtacttgggagtcggccat

SEQ ID NO: 3230 - DNA, 140 bp, Artificial Sequence
  Synthetic
atggccgactcccaagtacgatgaggcccagcagtcccaccgcgaccatgatgatgatggccatttggttgtcttgcggggatcgctgtttctccggctcgggtatgagcacgaccaacaggagacccagcatggcgtat

SEQ ID NO: 3231 - DNA, 140 bp, Artificial Sequence
  Synthetic
atacgccatgctgggtctcctgcggccaacgaacttggctggctggaaagaacaaagagtgacatagctcacctaatgggcaggaaggatgaggagaggatggtggggttctcaattgaccgtacttgggagtcggccat

SEQ ID NO: 3232 - DNA, 140 bp, Artificial Sequence
  Synthetic
atggccgactcccaagtacggtcaattgagaaccccaccatcctctcctcatccttcctgcccattaggtgagctatgtcactctttgttctttccagccagccaagttcgttggccgcaggagacccagcatggcgtat

SEQ ID NO: 3233 - DNA, 140 bp, Artificial Sequence
  Synthetic
atacgccatgctgggtctccatagatctgcggccagcatcggcatgggccatttatgccgcattgacaaccctcatcaccccggccgttcaacatgcagtcaccacctcctacaacaactcgtacttgggagtcggccat

SEQ ID NO: 3234 - DNA, 140 bp, Artificial Sequence
  Synthetic
atggccgactcccaagtacgagttgttgtaggaggtggtgactgcatgttgaacggccggggtgatgagggttgtcaatgcggcataaatggcccatgccgatgctggccgcagatctatggagacccagcatggcgtat

SEQ ID NO: 3235 - DNA, 140 bp, Artificial Sequence
  Synthetic
atacgccatgctgggtctccactcccttatggcgatggcaacccaagcgggtgtgttgttcggcatgggaaaggggatgcctttctacacctgggattttggtgttccactgctgatgatcgtacttgggagtcggccat

SEQ ID NO: 3236 - DNA, 140 bp, Artificial Sequence
  Synthetic
atggccgactcccaagtacgatcatcagcagtggaacaccaaaatcccaggtgtagaaaggcatcccctttcccatgccgaacaacacacccgcttgggttgccatcgccataagggagtggagacccagcatggcgtat

SEQ ID NO: 3237 - DNA, 140 bp, Artificial Sequence
  Synthetic
atacgccatgctgggtctcctgggtgttattctcaattgacacctctcactctcatagtagccatcaccctgctagtggctcattacatgtacttgattccaggcctgcaggcagcagcacgtacttgggagtcggccat

SEQ ID NO: 3238 - DNA, 140 bp, Artificial Sequence
  Synthetic
atggccgactcccaagtacgtgctgctgcctgcaggcctggaatcaagtacatgtaatgagccactagcagggtgatggctactatgagagtgagaggtgtcaattgagaataacacccaggagacccagcatggcgtat

SEQ ID NO: 3239 - DNA, 140 bp, Artificial Sequence
  Synthetic
atacgccatgctgggtctccgatcacagcagcaacctccaccttatggaagggctctccaaacaaatactggaactcctccacggccacatctctgtgtaacatctttaggggcagttaccgtacttgggagtcggccat

SEQ ID NO: 3240 - DNA, 140 bp, Artificial Sequence
  Synthetic
atggccgactcccaagtacggtaactgcccctaaagatgttacacagagatgtggccgtggaggagttccagtatttgtttggagagcccttccataaggtggaggttgctgctgtgatcggagacccagcatggcgtat

SEQ ID NO: 3241 - DNA, 140 bp, Artificial Sequence
  Synthetic
atacgccatgctgggtctccctggctggcgcttcccttatttacactgtgacaaggaacgctggtctagtcaagaggcgcggaggaggaacaggagagaccctcggagaaaagtggaaatcgtacttgggagtcggccat

SEQ ID NO: 3242 - DNA, 140 bp, Artificial Sequence
  Synthetic
atggccgactcccaagtacgatttccacttttctccgagggtctctcctgttcctcctccgcgcctcttgactagaccagcgttccttgtcacagtgtaaataagggaagcgccagccagggagacccagcatggcgtat

SEQ ID NO: 3243 - DNA, 140 bp, Artificial Sequence
  Synthetic
atacgccatgctgggtctccctcgattgaatcagatgtcagccctggagttctactcatacaaaaagtcaggaataactgaagtgtgcagggatgaggctcggagggccttgaaggacggcgtacttgggagtcggccat

SEQ ID NO: 3244 - DNA, 140 bp, Artificial Sequence
  Synthetic
atggccgactcccaagtacgccgtccttcaaggccctccgagcctcatccctgcacacttcagttattcctgactttttgtatgagtagaactccagggctgacatctgattcaatcgagggagacccagcatggcgtat

SEQ ID NO: 3245 - DNA, 140 bp, Artificial Sequence
  Synthetic
atacgccatgctgggtctccagtggctactggaggacacgcagtatcccgaggaagcgcaaagctcagatggcttgtggagagagggtacctgcagccacatgggaaggttgttgacctacgtacttgggagtcggccat

SEQ ID NO: 3246 - DNA, 140 bp, Artificial Sequence
  Synthetic
atggccgactcccaagtacgtaggtcaacaaccttcccatgtggctgcaggtaccctctctccacaagccatctgagctttgcgcttcctcgggatactgcgtgtcctccagtagccactggagacccagcatggcgtat

SEQ ID NO: 3247 - DNA, 140 bp, Artificial Sequence
  Synthetic
atacgccatgctgggtctccggatgtggtaggggaggctggagctactatgcggcaaccatccgcaaagtccaagaggtcagaggatacaccaaaggaggacctggccatgaagagccaacgtacttgggagtcggccat

SEQ ID NO: 3248 - DNA, 140 bp, Artificial Sequence
  Synthetic
atggccgactcccaagtacgttggctcttcatggccaggtcctcctttggtgtatcctctgacctcttggactttgcggatggttgccgcatagtagctccagcctcccctaccacatccggagacccagcatggcgtat

SEQ ID NO: 3249 - DNA, 140 bp, Artificial Sequence
  Synthetic
atacgccatgctgggtctcctgctagtgcagagctatggttggaacatagtccgcctcaagagcggagtggacgtgttccacatggcagctgagccttgcgacaccctcctatgtgacatcgtacttgggagtcggccat

SEQ ID NO: 3250 - DNA, 140 bp, Artificial Sequence
  Synthetic
atggccgactcccaagtacgatgtcacataggagggtgtcgcaaggctcagctgccatgtggaacacgtccactccgctcttgaggcggactatgttccaaccatagctctgcactagcaggagacccagcatggcgtat

SEQ ID NO: 3251 - DNA, 140 bp, Artificial Sequence
  Synthetic
atacgccatgctgggtctcctggagagtcatcatctagtccagaggtggaggaaactagaacactcagagtgctttccatggtgggggattggttggagaagagaccaggagccttttgccgtacttgggagtcggccat

SEQ ID NO: 3252 - DNA, 140 bp, Artificial Sequence
  Synthetic
atggccgactcccaagtacggcaaaaggctcctggtctcttctccaaccaatcccccaccatggaaagcactctgagtgttctagtttcctccacctctggactagatgatgactctccaggagacccagcatggcgtat

SEQ ID NO: 3253 - DNA, 140 bp, Artificial Sequence
  Synthetic
atacgccatgctgggtctccataaaagtcctgtgcccatacacgagcaccatgatggagaccatggagcgtttgcagcgtaggtatggaggtggactggtgagggtgcctctctcccgcacgtacttgggagtcggccat

SEQ ID NO: 3254 - DNA, 140 bp, Artificial Sequence
  Synthetic
atggccgactcccaagtacgtgcgggagagaggcaccctcaccagtccacctccatacctacgctgcaaacgctccatggtctccatcatggtgctcgtgtatgggcacaggacttttatggagacccagcatggcgtat

SEQ ID NO: 3255 - DNA, 140 bp, Artificial Sequence
  Synthetic
atacgccatgctgggtctccattcgacacatgagatgtactgggtctcgggagcaaaaagcaacatcatcaagagtgtttctaccacgagccagcttctgctgggacgaatggatgggcccgtacttgggagtcggccat

SEQ ID NO: 3256 - DNA, 140 bp, Artificial Sequence
  Synthetic
atggccgactcccaagtacgggcccatccattcgtcccagcagaagctggctcgtggtagaaacactcttgatgatgttgctttttgctcccgagacccagtacatctcatgtgtcgaatggagacccagcatggcgtat

SEQ ID NO: 3257 - DNA, 140 bp, Artificial Sequence
  Synthetic
atacgccatgctgggtctcctaggaggccagtgaaatatgaggaggatgtgaacctcggctcaggcacacgagctgtggcaagctgcgctgaggctcccaacttgaagattattggtaggcgtacttgggagtcggccat

SEQ ID NO: 3258 - DNA, 140 bp, Artificial Sequence
  Synthetic
atggccgactcccaagtacgcctaccaataatcttcaagttgggagcctcagcgcagcttgccacagctcgtgtgcctgagccgaggttcacatcctcctcatatttcactggcctcctaggagacccagcatggcgtat

SEQ ID NO: 3259 - DNA, 140 bp, Artificial Sequence
  Synthetic
atacgccatgctgggtctcccgcaggggtcagcgtcatccctcgtgaacggggttgttagactcttgtcaaagccctgggatgtggtgactggagttacaggaatagctatgactgacaccgtacttgggagtcggccat

SEQ ID NO: 3260 - DNA, 140 bp, Artificial Sequence
  Synthetic
atggccgactcccaagtacggtgtcagtcatagctattcctgtaactccagtcaccacatcccagggctttgacaagagtctaacaaccccgttcacgagggatgacgctgacccctgcgggagacccagcatggcgtat

SEQ ID NO: 3261 - DNA, 140 bp, Artificial Sequence
  Synthetic
aggccctggctgctgatatgaagccctgggatgtggtgactggagttacaggaatagctatgactgacaccacgccatacggccaacaaagagtcttcaaggaaaaagttgacactaggggaccttttgggacagcggtg

SEQ ID NO: 3262 - DNA, 140 bp, Artificial Sequence
  Synthetic
caccgctgtcccaaaaggtcccctagtgtcaactttttccttgaagactctttgttggccgtatggcgtggtgtcagtcatagctattcctgtaactccagtcaccacatcccagggcttcatatcagcagccagggcct

SEQ ID NO: 3263 - DNA, 140 bp, Artificial Sequence
  Synthetic
aggccctggctgctgatatgttgaagaggaaaaagaatggaagacagctgtagaagctgtgaatgatccaagattttgggctctagtggacaaggaaagagaacaccacttgagaggagagaccttttgggacagcggtg

SEQ ID NO: 3264 - DNA, 140 bp, Artificial Sequence
  Synthetic
caccgctgtcccaaaaggtctctcctctcaagtggtgttctctttccttgtccactagagcccaaaatcttggatcattcacagcttctacagctgtcttccattctttttcctcttcaacatatcagcagccagggcct

SEQ ID NO: 3265 - DNA, 140 bp, Artificial Sequence
  Synthetic
atacgccatgctgggtctccggaaccaggtttttggagtttgaatcactggggtttctgaacgaagatcactggatgggaagagaaaactctggaggcggagttgaaggactgggactgccgtacttgggagtcggccat

SEQ ID NO: 3266 - DNA, 140 bp, Artificial Sequence
  Synthetic
atggccgactcccaagtacggcagtcccagtccttcaactccgcctccagagttttctcttcccatccagtgatcttcgttcagaaaccccagtgattcaaactccaaaaacctggttccggagacccagcatggcgtat

SEQ ID NO: 3267 - DNA, 140 bp, Artificial Sequence
  Synthetic
atacgccatgctgggtctccggatccaggtttttggagtttgaatcactggggtttctgaacgaagatcactggatgggaagagaaaactctggaggcggagttgaaggactgggactgccgtacttgggagtcggccat

SEQ ID NO: 3268 - DNA, 140 bp, Artificial Sequence
  Synthetic
atggccgactcccaagtacggcagtcccagtccttcaactccgcctccagagttttctcttcccatccagtgatcttcgttcagaaaccccagtgattcaaactccaaaaacctggatccggagacccagcatggcgtat

SEQ ID NO: 3269 - DNA, 140 bp, Artificial Sequence
  Synthetic
atacgccatgctgggtctccggacccaggtttttggagtttgaatcactggggtttctgaacgaagatcactggatgggaagagaaaactctggaggcggagttgaaggactgggactgccgtacttgggagtcggccat

SEQ ID NO: 3270 - DNA, 140 bp, Artificial Sequence
  Synthetic
atggccgactcccaagtacggcagtcccagtccttcaactccgcctccagagttttctcttcccatccagtgatcttcgttcagaaaccccagtgattcaaactccaaaaacctgggtccggagacccagcatggcgtat

SEQ ID NO: 3271 - DNA, 140 bp, Artificial Sequence
  Synthetic
atacgccatgctgggtctccggagccaggtttttggagtttgaatcactggggtttctgaacgaagatcactggatgggaagagaaaactctggaggcggagttgaaggactgggactgccgtacttgggagtcggccat

SEQ ID NO: 3272 - DNA, 140 bp, Artificial Sequence
  Synthetic
atggccgactcccaagtacggcagtcccagtccttcaactccgcctccagagttttctcttcccatccagtgatcttcgttcagaaaccccagtgattcaaactccaaaaacctggctccggagacccagcatggcgtat

SEQ ID NO: 3273 - DNA, 140 bp, Artificial Sequence
  Synthetic
atacgccatgctgggtctccaaagacttggctatatccttgaggagatgagccgggcaccaggaggaaagatgtacgcagatgacactgcgggttgggacaccagaattagcaagtttgacgtacttgggagtcggccat

SEQ ID NO: 3274 - DNA, 140 bp, Artificial Sequence
  Synthetic
atggccgactcccaagtacgtcaaacttgctaattctggtgtcccaacccgcagtgtcatctgcgtacatctttcctcctggtgcccggctcatctcctcaaggatatagccaagtctttggagacccagcatggcgtat

SEQ ID NO: 3275 - DNA, 140 bp, Artificial Sequence
  Synthetic
aggccctggctgctgatatgcttggaaaatgaggccctgatcaccaaccaaatggaagaaaggcacagagccctggctcaggcggtaatcaaatacacataccagaacaaagtggttaaggaccttttgggacagcggtg

SEQ ID NO: 3276 - DNA, 140 bp, Artificial Sequence
  Synthetic
caccgctgtcccaaaaggtccttaaccactttgttctggtatgtgtatttgattaccgcctgagccagggctctgtgcctttcttccatttggttggtgatcagggcctcattttccaagcatatcagcagccagggcct

SEQ ID NO: 3277 - DNA, 140 bp, Artificial Sequence
  Synthetic
atacgccatgctgggtctccgttctcagaccagctgaaggaggaagaacagtaatggacatcatctcaaggcaagaccagagagggagtggacaagtggtcacttacgccctcaatacatcgtacttgggagtcggccat

SEQ ID NO: 3278 - DNA, 140 bp, Artificial Sequence
  Synthetic
atggccgactcccaagtacgatgtattgagggcgtaagtgaccacttgtccactccctctctggtcttgccttgagatgatgtccattactgttcttcctccttcagctggtctgagaacggagacccagcatggcgtat

SEQ ID NO: 3279 - DNA, 140 bp, Artificial Sequence
  Synthetic
atacgccatgctgggtctcctcaccaatctggtggtgcagctcattagatgcatggaagctgaggaggtgctggagacacatgatctgtggacactgaggaaaccagcaaaagtcacccgcgtacttgggagtcggccat

SEQ ID NO: 3280 - DNA, 140 bp, Artificial Sequence
  Synthetic
atggccgactcccaagtacgcgggtgacttttgctggtttcctcagtgtccacagatcatgtgtctccagcacctcctcagcttccatgcatctaatgagctgcaccaccagattggtgaggagacccagcatggcgtat

SEQ ID NO: 3281 - DNA, 140 bp, Artificial Sequence
  Synthetic
aggccctggctgctgatatgctggagacacatgatctgtggacactgaggaaaccagcaaaagtcacccgctggctgggtaacaatggatggcacaagctcaaacggatggcagttagtggaccttttgggacagcggtg

SEQ ID NO: 3282 - DNA, 140 bp, Artificial Sequence
  Synthetic
caccgctgtcccaaaaggtccactaactgccatccgtttgagcttgtgccatccattgttacccagccagcgggtgacttttgctggtttcctcagtgtccacagatcatgtgtctccagcatatcagcagccagggcct

SEQ ID NO: 3283 - DNA, 140 bp, Artificial Sequence
  Synthetic
atacgccatgctgggtctccgagatgactgcgttgtgaaaccaattgatgataggtttgcacatgccctcaggttcttgaatgacatgggaaaggttaggaaagacacacaggaatggaacgtacttgggagtcggccat

SEQ ID NO: 3284 - DNA, 140 bp, Artificial Sequence
  Synthetic
atggccgactcccaagtacgttccattcctgtgtgtctttcctaacctttcccatgtcattcaagaacctgagggcatgtgcaaacctatcatcaattggtttcacaacgcagtcatctcggagacccagcatggcgtat

SEQ ID NO: 3285 - DNA, 140 bp, Artificial Sequence
  Synthetic
atacgccatgctgggtctccatggagcatccgtgagactgcttgtctggagaagtcatacgcgcaaatgtggcctctcctctacttccatataagagatctcaggcttatggcgcacgcacgtacttgggagtcggccat

SEQ ID NO: 3286 - DNA, 140 bp, Artificial Sequence
  Synthetic
atggccgactcccaagtacgtgcgtgcgccataagcctgagatctcttatatggaagtagaggagaggccacatttgcgcgtatgacttctccagacaagcagtctcacggatgctccatggagacccagcatggcgtat

SEQ ID NO: 3287 - DNA, 140 bp, Artificial Sequence
  Synthetic
aggccctggctgctgatatgcaggcttatggcgcacgcaatctgctcatctgtgcctgtcgattgggtcccaacagggaaaacaacctgctcgattcacgggaaaggagagtggatgaccgaccttttgggacagcggtg

SEQ ID NO: 3288 - DNA, 140 bp, Artificial Sequence
  Synthetic
caccgctgtcccaaaaggtcggtcatccactctcctttcccgtgaatcgagcaggttgttttccctgttgggacccaatcgacaggcacagatgagcagattgcgtgcgccataagcctgcatatcagcagccagggcct

SEQ ID NO: 3289 - DNA, 140 bp, Artificial Sequence
  Synthetic
atacgccatgctgggtctccagatttttggagtttgaagctcttggattcttgaacgaggaccattggatggggagagaaaactcaggaggtggcgttgaagggctaggactgcaaaggccgtacttgggagtcggccat

SEQ ID NO: 3290 - DNA, 140 bp, Artificial Sequence
  Synthetic
atggccgactcccaagtacggcctttgcagtcctagcccttcaacgccacctcctgagttttctctccccatccaatggtcctcgttcaagaatccaagagcttcaaactccaaaaatctggagacccagcatggcgtat

SEQ ID NO: 3291 - DNA, 140 bp, Artificial Sequence
  Synthetic
aggccctggctgctgatatgggggagagaaaactcaggaggtggcgttgaagggctaggactgcaaaggcttggatatatcctagaagaaatgaaccgggcaccaggaggaaagatgtatgaccttttgggacagcggtg

SEQ ID NO: 3292 - DNA, 140 bp, Artificial Sequence
  Synthetic
caccgctgtcccaaaaggtcatacatctttcctcctggtgcccggttcatttcttctaggatatatccaagcctttgcagtcctagcccttcaacgccacctcctgagttttctctcccccatatcagcagccagggcct

SEQ ID NO: 3293 - DNA, 140 bp, Artificial Sequence
  Synthetic
atacgccatgctgggtctccgcagatgacaccgctggctgggacacccgcattagcaagtttgatctagagaatgaagccctgatcactaaccagatggaagaagagcacagagctctggcgtacttgggagtcggccat

SEQ ID NO: 3294 - DNA, 140 bp, Artificial Sequence
  Synthetic
atggccgactcccaagtacgccagagctctgtgctcttcttccatctggttagtgatcagggcttcattctctagatcaaacttgctaatgcgggtgtcccagccagcggtgtcatctgcggagacccagcatggcgtat

SEQ ID NO: 3295 - DNA, 140 bp, Artificial Sequence
  Synthetic
aggccctggctgctgatatgcgttggccgtgattaaatacacataccaaaacaaagtggtgaaggttctcagaccagctgaaggagggaaaacagtcatggacatcatctcaagacaagagaccttttgggacagcggtg

SEQ ID NO: 3296 - DNA, 140 bp, Artificial Sequence
  Synthetic
caccgctgtcccaaaaggtctcttgtcttgagatgatgtccatgactgttttccctccttcagctggtctgagaaccttcaccactttgttttggtatgtgtatttaatcacggccaacgcatatcagcagccagggcct

SEQ ID NO: 3297 - DNA, 140 bp, Artificial Sequence
  Synthetic
aggccctggctgctgatatgccagagagggagcggacaagttgttacttatgctctcaacacattcaccaacctggtggtgcagcttatccggaacatggaggctgaggaagtgctagaggaccttttgggacagcggtg

SEQ ID NO: 3298 - DNA, 140 bp, Artificial Sequence
  Synthetic
caccgctgtcccaaaaggtcctctagcacttcctcagcctccatgttccggataagctgcaccaccaggttggtgaatgtgttgagagcataagtaacaacttgtccgctccctctctggcatatcagcagccagggcct

SEQ ID NO: 3299 - DNA, 140 bp, Artificial Sequence
  Synthetic
atacgccatgctgggtctccatgcatgatctgtggttgttgaggaagccagagaaagtgaccagatggttgcagagcaatggatgggacagactcaaacggatggcagttagtggagatgcgtacttgggagtcggccat

SEQ ID NO: 3300 - DNA, 140 bp, Artificial Sequence
  Synthetic
atggccgactcccaagtacgcatctccactaactgccatccgtttgagtctgtcccatccattgctctgcaaccatctggtcactttctctggcttcctcaacaaccacagatcatgcatggagacccagcatggcgtat

SEQ ID NO: 3301 - DNA, 140 bp, Artificial Sequence
  Synthetic
aggccctggctgctgatatggcagagcaatggatgggacagactcaaacggatggcagttagtggagatgactgcgttgtaaagccaattgatgataggtttgcacatgccctcaggttcgaccttttgggacagcggtg

SEQ ID NO: 3302 - DNA, 140 bp, Artificial Sequence
  Synthetic
caccgctgtcccaaaaggtcgaacctgagggcatgtgcaaacctatcatcaattggctttacaacgcagtcatctccactaactgccatccgtttgagtctgtcccatccattgctctgccatatcagcagccagggcct

SEQ ID NO: 3303 - DNA, 140 bp, Artificial Sequence
  Synthetic
aggccctggctgctgatatgcatgggaaaggttaggaaagacacacaggaatggaaaccctcgactggatggagcaattgggaagaggtcccgttctgttctcaccacttcaacaagctggaccttttgggacagcggtg

SEQ ID NO: 3304 - DNA, 140 bp, Artificial Sequence
  Synthetic
caccgctgtcccaaaaggtccagcttgttgaagtggtgagaacagaacgggacctcttcccaattgctccatccagtcgagggtttccattcctgtgtgtctttcctaacctttcccatgcatatcagcagccagggcct

SEQ ID NO: 3305 - DNA, 140 bp, Artificial Sequence
  Synthetic
atacgccatgctgggtctccaggtttctggagtttgaatcactggggtttctgaatgaagatcactggatgggaagagaaaagtcaggaggtggtgttgaagggctaggactgcaaaggccgtacttgggagtcggccat

SEQ ID NO: 3306 - DNA, 140 bp, Artificial Sequence
  Synthetic
atggccgactcccaagtacggcctttgcagtcctagcccttcaacaccacctcctgacttttctcttcccatccagtgatcttcattcagaaaccccagtgattcaaactccagaaacctggagacccagcatggcgtat

SEQ ID NO: 3307 - DNA, 140 bp, Artificial Sequence
  Synthetic
atacgccatgctgggtctccttggatatatcctagaagaaatgaaccgggcaccagagggaaagatgtatgcagatgacaccgctggctgggacacccgttttagtaagtttgatctagacgtacttgggagtcggccat

SEQ ID NO: 3308 - DNA, 140 bp, Artificial Sequence
  Synthetic
atggccgactcccaagtacgtctagatcaaacttactaaaacgggtgtcccagccagcggtgtcatctgcatacatctttccctctggtgcccggttcatttcttctaggatatatccaaggagacccagcatggcgtat

SEQ ID NO: 3309 - DNA, 140 bp, Artificial Sequence
  Synthetic
aggccctggctgctgatatggaatgaagccctgatcactaaccagatggaagaagggcacagagctctggcgttggccgtgattaaatacacataccaaaacaaagtggtgaaggttctcgaccttttgggacagcggtg

SEQ ID NO: 3310 - DNA, 140 bp, Artificial Sequence
  Synthetic
caccgctgtcccaaaaggtcgagaaccttcaccactttgttttggtatgtgtatttaatcacggccaacgccagagctctgtgcccttcttccatctggttagtgatcagggcttcattccatatcagcagccagggcct

SEQ ID NO: 3311 - DNA, 140 bp, Artificial Sequence
  Synthetic
atacgccatgctgggtctccccagagagggagtggacaagttgttacttatgccctcaacacattcaccaatctggtggtgcagcttatccggaacatggaggctgaggaagtgctagagcgtacttgggagtcggccat

SEQ ID NO: 3312 - DNA, 140 bp, Artificial Sequence
  Synthetic
atggccgactcccaagtacgctctagcacttcctcagcctccatgttccggataagctgcaccaccagattggtgaatgtgttgagggcataagtaacaacttgtccactccctctctggggagacccagcatggcgtat

SEQ ID NO: 3313 - DNA, 140 bp, Artificial Sequence
  Synthetic
aggccctggctgctgatatgatctggtggtgcagcttatccggaacatggaggctgaggaagtgctagagatgcatgatctgtggttgttgaggaaaccagagaaagtgaccagatggttgaccttttgggacagcggtg

SEQ ID NO: 3314 - DNA, 140 bp, Artificial Sequence
  Synthetic
caccgctgtcccaaaaggtcaaccatctggtcactttctctggtttcctcaacaaccacagatcatgcatctctagcacttcctcagcctccatgttccggataagctgcaccaccagatcatatcagcagccagggcct

SEQ ID NO: 3315 - DNA, 140 bp, Artificial Sequence
  Synthetic
atacgccatgctgggtctccagatttttggagtttgaagctcttggattcttgaacgaggaccactggatgggaagagaaaactcaggaggtggcgttgaagggctaggactgcaaaggccgtacttgggagtcggccat

SEQ ID NO: 3316 - DNA, 140 bp, Artificial Sequence
  Synthetic
atggccgactcccaagtacggcctttgcagtcctagcccttcaacgccacctcctgagttttctcttcccatccagtggtcctcgttcaagaatccaagagcttcaaactccaaaaatctggagacccagcatggcgtat

SEQ ID NO: 3317 - DNA, 140 bp, Artificial Sequence
  Synthetic
atacgccatgctgggtctccgcagatgacaccgctggctgggacacccgcattagcaagtttgatctggagaatgaagccctgattactaaccagatggaagaagggcatagagctctggcgtacttgggagtcggccat

SEQ ID NO: 3318 - DNA, 140 bp, Artificial Sequence
  Synthetic
atggccgactcccaagtacgccagagctctatgcccttcttccatctggttagtaatcagggcttcattctccagatcaaacttgctaatgcgggtgtcccagccagcggtgtcatctgcggagacccagcatggcgtat

SEQ ID NO: 3319 - DNA, 140 bp, Artificial Sequence
  Synthetic
atacgccatgctgggtctccccaaagagggagcggacaagttgttacttatgctctcaacacattcaccaacctggtggtgcagctcatccggagcatggaggctgaggaagtgctagagcgtacttgggagtcggccat

SEQ ID NO: 3320 - DNA, 140 bp, Artificial Sequence
  Synthetic
atggccgactcccaagtacgctctagcacttcctcagcctccatgctccggatgagctgcaccaccaggttggtgaatgtgttgagagcataagtaacaacttgtccgctccctctttggggagacccagcatggcgtat

SEQ ID NO: 3321 - DNA, 140 bp, Artificial Sequence
  Synthetic
atacgccatgctgggtctccatgcatgatctatggttgttgaggaagccagagaaagtgaccagatggttgcagagtaatggatgggacagactcaaacggatggcagtcagtggagatgcgtacttgggagtcggccat

SEQ ID NO: 3322 - DNA, 140 bp, Artificial Sequence
  Synthetic
atggccgactcccaagtacgcatctccactgactgccatccgtttgagtctgtcccatccattactctgcaaccatctggtcactttctctggcttcctcaacaaccatagatcatgcatggagacccagcatggcgtat

SEQ ID NO: 3323 - DNA, 140 bp, Artificial Sequence
  Synthetic
atacgccatgctgggtctccagatttttggagtttgaagctcttggattcttgaacgaggatcactggatgggaagagaaaactcaggaggtggtgttgaagggctaggactgcaaaggccgtacttgggagtcggccat

SEQ ID NO: 3324 - DNA, 140 bp, Artificial Sequence
  Synthetic
atggccgactcccaagtacggcctttgcagtcctagcccttcaacaccacctcctgagttttctcttcccatccagtgatcctcgttcaagaatccaagagcttcaaactccaaaaatctggagacccagcatggcgtat

SEQ ID NO: 3325 - DNA, 140 bp, Artificial Sequence
  Synthetic
aggccctggctgctgatatgccagagagggagtggacaagttgttacttatgccctcaacacattcaccaacctggtggtgcagcttatccggaacatggaggctgaggaagtgctagaggaccttttgggacagcggtg

SEQ ID NO: 3326 - DNA, 140 bp, Artificial Sequence
  Synthetic
caccgctgtcccaaaaggtcctctagcacttcctcagcctccatgttccggataagctgcaccaccaggttggtgaatgtgttgagggcataagtaacaacttgtccactccctctctggcatatcagcagccagggcct

SEQ ID NO: 3327 - DNA, 140 bp, Artificial Sequence
  Synthetic
aggccctggctgctgatatgatgcatgatctgtggttgttgaggaaaccagagaaagtgaccagatggttgcagagtaatggatgggacagactcaaacggatggcagttagtggagatggaccttttgggacagcggtg

SEQ ID NO: 3328 - DNA, 140 bp, Artificial Sequence
  Synthetic
caccgctgtcccaaaaggtccatctccactaactgccatccgtttgagtctgtcccatccattactctgcaaccatctggtcactttctctggtttcctcaacaaccacagatcatgcatcatatcagcagccagggcct

SEQ ID NO: 3329 - DNA, 140 bp, Artificial Sequence
  Synthetic
aggccctggctgctgatatgcatgggaaaggttaggaaagacacacaggaatggaaaccctcgactggatggagcaattgggaggaggtcccgttctgttctcaccacttcaacaagctggaccttttgggacagcggtg

SEQ ID NO: 3330 - DNA, 140 bp, Artificial Sequence
  Synthetic
caccgctgtcccaaaaggtccagcttgttgaagtggtgagaacagaacgggacctcctcccaattgctccatccagtcgagggtttccattcctgtgtgtctttcctaacctttcccatgcatatcagcagccagggcct

SEQ ID NO: 3331 - DNA, 140 bp, Artificial Sequence
  Synthetic
atacgccatgctgggtctccccaaagagggagcggacaagttgttacttatgctctcaacacattcaccaacctggtggtgcagctcatccggagcatggaggctgaggaagtgctagaacgtacttgggagtcggccat

SEQ ID NO: 3332 - DNA, 140 bp, Artificial Sequence
  Synthetic
atggccgactcccaagtacgttctagcacttcctcagcctccatgctccggatgagctgcaccaccaggttggtgaatgtgttgagagcataagtaacaacttgtccgctccctctttggggagacccagcatggcgtat

SEQ ID NO: 3333 - DNA, 140 bp, Artificial Sequence
  Synthetic
aggccctggctgctgatatgacttggtggtgcagcttatccggaacatggaagctgaggaagtgttagagatgcaagacttatggctgttgaggaagccagagaaagtgaccagatggttgaccttttgggacagcggtg

SEQ ID NO: 3334 - DNA, 140 bp, Artificial Sequence
  Synthetic
caccgctgtcccaaaaggtcaaccatctggtcactttctctggcttcctcaacagccataagtcttgcatctctaacacttcctcagcttccatgttccggataagctgcaccaccaagtcatatcagcagccagggcct

SEQ ID NO: 3335 - DNA, 140 bp, Artificial Sequence
  Synthetic
atacgccatgctgggtctcccatgggaaaagttaggaaagacacacaggagtggaaaccctcgactggatggagcaattgggaagaagtcccgttctgctcccaccacttcaacaagctgcgtacttgggagtcggccat

SEQ ID NO: 3336 - DNA, 140 bp, Artificial Sequence
  Synthetic
atggccgactcccaagtacgcagcttgttgaagtggtgggagcagaacgggacttcttcccaattgctccatccagtcgagggtttccactcctgtgtgtctttcctaacttttcccatgggagacccagcatggcgtat

SEQ ID NO: 3337 - DNA, 140 bp, Artificial Sequence
  Synthetic
aggccctggctgctgatatggcagatgacactgctggctgggacacccgcattagtaagtttgatctggagaatgaagctttgattaccaaccttatggaggaagggcacagaactctgggaccttttgggacagcggtg

SEQ ID NO: 3338 - DNA, 140 bp, Artificial Sequence
  Synthetic
caccgctgtcccaaaaggtcccagagttctgtgcccttcctccataaggttggtaatcaaagcttcattctccagatcaaacttactaatgcgggtgtcccagccagcagtgtcatctgccatatcagcagccagggcct

SEQ ID NO: 3339 - DNA, 140 bp, Artificial Sequence
  Synthetic
atacgccatgctgggtctccatgcaagacttatggctgttgaggaagccagagaaagtgttcagatggttgcagagcaatggatgggatagacctcaacgaatggcggtcagtggagatgcgtacttgggagtcggccat

SEQ ID NO: 3340 - DNA, 140 bp, Artificial Sequence
  Synthetic
atggccgactcccaagtacgcatctccactgaccgccattcgttgaggtctatcccatccattgctctgcaaccatctgaacactttctctggcttcctcaacagccataagtcttgcatggagacccagcatggcgtat

SEQ ID NO: 3341 - DNA, 140 bp, Artificial Sequence
  Synthetic
aggccctggctgctgatatgcatgggaaaggttaggaaagacacacaggaatggaagccctcgactggatggagcaattgggaggaggtcccgttctgttctcaccacttcaacaagctggaccttttgggacagcggtg

SEQ ID NO: 3342 - DNA, 140 bp, Artificial Sequence
  Synthetic
caccgctgtcccaaaaggtccagcttgttgaagtggtgagaacagaacgggacctcctcccaattgctccatccagtcgagggcttccattcctgtgtgtctttcctaacctttcccatgcatatcagcagccagggcct

SEQ ID NO: 3343 - DNA, 140 bp, Artificial Sequence
  Synthetic
aggccctggctgctgatatgcgttggccgtgattaaatacacataccaaaacaaagtggtgaaggttctcagaccagctgaaggagggaaaacagttatggacatcatctcaagacaagagaccttttgggacagcggtg

SEQ ID NO: 3344 - DNA, 140 bp, Artificial Sequence
  Synthetic
caccgctgtcccaaaaggtctcttgtcttgagatgatgtccataactgttttccctccttcagctggtctgagaaccttcaccactttgttttggtatgtgtatttaatcacggccaacgcatatcagcagccagggcct

SEQ ID NO: 3345 - DNA, 140 bp, Artificial Sequence
  Synthetic
aggccctggctgctgatatgcatgggaaaggttaggaaagacacacaggaatggaagccctcggctggatggagcaattgggaggaggtcccgttctgttctcaccacttcaacaagctggaccttttgggacagcggtg

SEQ ID NO: 3346 - DNA, 140 bp, Artificial Sequence
  Synthetic
caccgctgtcccaaaaggtccagcttgttgaagtggtgagaacagaacgggacctcctcccaattgctccatccagccgagggcttccattcctgtgtgtctttcctaacctttcccatgcatatcagcagccagggcct

SEQ ID NO: 3347 - DNA, 140 bp, Artificial Sequence
  Synthetic
atacgccatgctgggtctccactgcgttgtgaaaccaattgatgataggtttgcacatgccctcaggttcttgaatgacatgggaaaggtcaggaaagacacacaggaatggaagccctccgtacttgggagtcggccat

SEQ ID NO: 3348 - DNA, 140 bp, Artificial Sequence
  Synthetic
atggccgactcccaagtacggagggcttccattcctgtgtgtctttcctgacctttcccatgtcattcaagaacctgagggcatgtgcaaacctatcatcaattggtttcacaacgcagtggagacccagcatggcgtat

SEQ ID NO: 3349 - DNA, 140 bp, Artificial Sequence
  Synthetic
aggccctggctgctgatatgcatgggaaaggtcaggaaagacacacaggaatggaagccctcgcctggatggagcaattgggaggaggtcccgttctgttctcaccacttcaacaagctggaccttttgggacagcggtg

SEQ ID NO: 3350 - DNA, 140 bp, Artificial Sequence
  Synthetic
caccgctgtcccaaaaggtccagcttgttgaagtggtgagaacagaacgggacctcctcccaattgctccatccaggcgagggcttccattcctgtgtgtctttcctgacctttcccatgcatatcagcagccagggcct

SEQ ID NO: 3351 - DNA, 140 bp, Artificial Sequence
  Synthetic
aggccctggctgctgatatggcagatgacaccgctggctgggacacccgcattagcaagtttgatctagagaatgaagccctgatcactaaccagatggaagaagggcacatatttctgggaccttttgggacagcggtg

SEQ ID NO: 3352 - DNA, 140 bp, Artificial Sequence
  Synthetic
caccgctgtcccaaaaggtcccagaaatatgtgcccttcttccatctggttagtgatcagggcttcattctctagatcaaacttgctaatgcgggtgtcccagccagcggtgtcatctgccatatcagcagccagggcct

SEQ ID NO: 3353 - DNA, 140 bp, Artificial Sequence
  Synthetic
atacgccatgctgggtctccaggtttctggagtttgaatcactggggtttctgaatgaagatcactggatgggaagagagaactctggaggcggagttgaaggactgggactgcagagaccgtacttgggagtcggccat

SEQ ID NO: 3354 - DNA, 140 bp, Artificial Sequence
  Synthetic
atggccgactcccaagtacggtctctgcagtcccagtccttcaactccgcctccagagttctctcttcccatccagtgatcttcattcagaaaccccagtgattcaaactccagaaacctggagacccagcatggcgtat

SEQ ID NO: 3355 - DNA, 140 bp, Artificial Sequence
  Synthetic
aggccctggctgctgatatggggaagagagaactctggaggcggagttgaaggactgggactgcagagactgggctatgtccttgaggagatgagccaggcaccaggagggaagatgtacgaccttttgggacagcggtg

SEQ ID NO: 3356 - DNA, 140 bp, Artificial Sequence
  Synthetic
caccgctgtcccaaaaggtcgtacatcttccctcctggtgcctggctcatctcctcaaggacatagcccagtctctgcagtcccagtccttcaactccgcctccagagttctctcttccccatatcagcagccagggcct

SEQ ID NO: 3357 - DNA, 140 bp, Artificial Sequence
  Synthetic
atacgccatgctgggtctccgcagatgacactgcgggttgggacaccagaattagcaagtttgacttggaaaatgaggccctgatcaccaaccaaatggaagaaaggcacagagccctggcgtacttgggagtcggccat

SEQ ID NO: 3358 - DNA, 140 bp, Artificial Sequence
  Synthetic
atggccgactcccaagtacgccagggctctgtgcctttcttccatttggttggtgatcagggcctcattttccaagtcaaacttgctaattctggtgtcccaacccgcagtgtcatctgcggagacccagcatggcgtat

SEQ ID NO: 3359 - DNA, 140 bp, Artificial Sequence
  Synthetic
aggccctggctgctgatatgatctggtggtgcagctcattagatgcatggaagctgaggaggtgctggagacacatgatctgtggacactgaggaaaccagcaaaagtcacccgctggctgaccttttgggacagcggtg

SEQ ID NO: 3360 - DNA, 140 bp, Artificial Sequence
  Synthetic
caccgctgtcccaaaaggtcagccagcgggtgacttttgctggtttcctcagtgtccacagatcatgtgtctccagcacctcctcagcttccatgcatctaatgagctgcaccaccagatcatatcagcagccagggcct

SEQ ID NO: 3361 - DNA, 140 bp, Artificial Sequence
  Synthetic
atacgccatgctgggtctccgggtaacaatggatgggacaggctcaagcgaatggcagtcagtggagatgactgtgttgtgaagcctatcgatgataggtttgcacacgctctaagattccgtacttgggagtcggccat

SEQ ID NO: 3362 - DNA, 140 bp, Artificial Sequence
  Synthetic
atggccgactcccaagtacggaatcttagagcgtgtgcaaacctatcatcgataggcttcacaacacagtcatctccactgactgccattcgcttgagcctgtcccatccattgttacccggagacccagcatggcgtat

SEQ ID NO: 3363 - DNA, 140 bp, Artificial Sequence
  Synthetic
atacgccatgctgggtctccctaaatgacatggggaaggtcaggaaagatacacaagagtggaaaccctcaactggatggagcaattgggaagaggtcccgttctgttcccaccattttacgtacttgggagtcggccat

SEQ ID NO: 3364 - DNA, 140 bp, Artificial Sequence
  Synthetic
atggccgactcccaagtacgtaaaatggtgggaacagaacgggacctcttcccaattgctccatccagttgagggtttccactcttgtgtatctttcctgaccttccccatgtcatttagggagacccagcatggcgtat

SEQ ID NO: 3365 - DNA, 140 bp, Artificial Sequence
  Synthetic
aggccctggctgctgatatgcatggggaaggtcaggaaagatacacaagagtggaaaccctcaactggatggagcaattgggaagaggtcccgttctgttcccaccattttaacaagctggaccttttgggacagcggtg

SEQ ID NO: 3366 - DNA, 140 bp, Artificial Sequence
  Synthetic
caccgctgtcccaaaaggtccagcttgttaaaatggtgggaacagaacgggacctcttcccaattgctccatccagttgagggtttccactcttgtgtatctttcctgaccttccccatgcatatcagcagccagggcct

SEQ ID NO: 3367 - DNA, 140 bp, Artificial Sequence
  Synthetic
atacgccatgctgggtctccctaaatgacatggggaaggtcaggaaagatacccaagagtggaaaccctcaactggatggagcaattgggaaaaggttccgttctgttcccaccatttaacgtacttgggagtcggccat

SEQ ID NO: 3368 - DNA, 140 bp, Artificial Sequence
  Synthetic
atggccgactcccaagtacgttaaatggtgggaacagaacggaaccttttcccaattgctccatccagttgagggtttccactcttgggtatctttcctgaccttccccatgtcatttagggagacccagcatggcgtat

SEQ ID NO: 3369 - DNA, 140 bp, Artificial Sequence
  Synthetic
aggccctggctgctgatatgcatggggaaggtcaggaaagatacccaagagtggaaaccctcaactggatggagcaattgggaaaaggttccgttctgttcccaccatttaaacaagctggaccttttgggacagcggtg

SEQ ID NO: 3370 - DNA, 140 bp, Artificial Sequence
  Synthetic
caccgctgtcccaaaaggtccagcttgtttaaatggtgggaacagaacggaaccttttcccaattgctccatccagttgagggtttccactcttgggtatctttcctgaccttccccatgcatatcagcagccagggcct

SEQ ID NO: 3371 - DNA, 140 bp, Artificial Sequence
  Synthetic
atacgccatgctgggtctccgggtaacaatggatgggacaggctcaagcgaatggcagtcagtggagatgactgtgttgtgaagcctatcgatgataggtttgcacaccctctaagattccgtacttgggagtcggccat

SEQ ID NO: 3372 - DNA, 140 bp, Artificial Sequence
  Synthetic
atggccgactcccaagtacggaatcttagagggtgtgcaaacctatcatcgataggcttcacaacacagtcatctccactgactgccattcgcttgagcctgtcccatccattgttacccggagacccagcatggcgtat

SEQ ID NO: 3373 - DNA, 140 bp, Artificial Sequence
  Synthetic
atacgccatgctgggtctccctaaatgacatggggaaggtcaggaaagatacacaagagtggaaaccctcaactggatggagcaattgggaagaggtcccgttctgttcccaccatttcacgtacttgggagtcggccat

SEQ ID NO: 3374 - DNA, 140 bp, Artificial Sequence
  Synthetic
atggccgactcccaagtacgtgaaatggtgggaacagaacgggacctcttcccaattgctccatccagttgagggtttccactcttgtgtatctttcctgaccttccccatgtcatttagggagacccagcatggcgtat

SEQ ID NO: 3375 - DNA, 140 bp, Artificial Sequence
  Synthetic
aggccctggctgctgatatgcatggggaaggtcaggaaagatacacaagagtggaaaccctcaactggatggagcaattgggaagaggtcccgttctgttcccaccatttcaacaagctcgaccttttgggacagcggtg

SEQ ID NO: 3376 - DNA, 140 bp, Artificial Sequence
  Synthetic
caccgctgtcccaaaaggtcgagcttgttgaaatggtgggaacagaacgggacctcttcccaattgctccatccagttgagggtttccactcttgtgtatctttcctgaccttccccatgcatatcagcagccagggcct

SEQ ID NO: 3377 - DNA, 140 bp, Artificial Sequence
  Synthetic
aggccctggctgctgatatgaaatgaggccctgatcaccaaccaaatggaagaaaggcacagagccctggctcaggcggtgattaaatacacataccagaacaaagtggttaaggttctcgaccttttgggacagcggtg

SEQ ID NO: 3378 - DNA, 140 bp, Artificial Sequence
  Synthetic
caccgctgtcccaaaaggtcgagaaccttaaccactttgttctggtatgtgtatttaatcaccgcctgagccagggctctgtgcctttcttccatttggttggtgatcagggcctcatttcatatcagcagccagggcct

SEQ ID NO: 3379 - DNA, 140 bp, Artificial Sequence
  Synthetic
aggccctggctgctgatatgggggagagaaaactcaggaggtggcgttgaagggctaggactgcaaaggcttggatatatcctagaagaaatgaaccaggcaccaggaggaaagatgtatgaccttttgggacagcggtg

SEQ ID NO: 3380 - DNA, 140 bp, Artificial Sequence
  Synthetic
caccgctgtcccaaaaggtcatacatctttcctcctggtgcctggttcatttcttctaggatatatccaagcctttgcagtcctagcccttcaacgccacctcctgagttttctctcccccatatcagcagccagggcct

SEQ ID NO: 3381 - DNA, 140 bp, Artificial Sequence
  Synthetic
atacgccatgctgggtctccccagagagggagcggacaagttgttactcatgctctcaacacattcaccaacctggtggtgcagcttatccggaacatggaggctgaggaagtgctagagcgtacttgggagtcggccat

SEQ ID NO: 3382 - DNA, 140 bp, Artificial Sequence
  Synthetic
atggccgactcccaagtacgctctagcacttcctcagcctccatgttccggataagctgcaccaccaggttggtgaatgtgttgagagcatgagtaacaacttgtccgctccctctctggggagacccagcatggcgtat

SEQ ID NO: 3383 - DNA, 140 bp, Artificial Sequence
  Synthetic
atacgccatgctgggtctccttgaatgacatgggaaaggttaggaaggacacacaggagtggaaaccctcgactggatggagcaattgggaagaggtcccgttctgttctcaccacttcacgtacttgggagtcggccat

SEQ ID NO: 3384 - DNA, 140 bp, Artificial Sequence
  Synthetic
atggccgactcccaagtacgtgaagtggtgagaacagaacgggacctcttcccaattgctccatccagtcgagggtttccactcctgtgtgtccttcctaacctttcccatgtcattcaaggagacccagcatggcgtat

SEQ ID NO: 3385 - DNA, 140 bp, Artificial Sequence
  Synthetic
aggccctggctgctgatatgcatgggaaaggttaggaaggacacacaggagtggaaaccctcgactggatggagcaattgggaagaggtcccgttctgttctcaccacttcaacaagctggaccttttgggacagcggtg

SEQ ID NO: 3386 - DNA, 140 bp, Artificial Sequence
  Synthetic
caccgctgtcccaaaaggtccagcttgttgaagtggtgagaacagaacgggacctcttcccaattgctccatccagtcgagggtttccactcctgtgtgtccttcctaacctttcccatgcatatcagcagccagggcct

SEQ ID NO: 3387 - DNA, 140 bp, Artificial Sequence
  Synthetic
atacgccatgctgggtctccagatttttggagtttgaagctcttggattcttgaacgaggaccattcgatggggagagaaaactcaggaggtggcgttgaagggctaggactgcaaaggccgtacttgggagtcggccat

SEQ ID NO: 3388 - DNA, 140 bp, Artificial Sequence
  Synthetic
atggccgactcccaagtacggcctttgcagtcctagcccttcaacgccacctcctgagttttctctccccatcgaatggtcctcgttcaagaatccaagagcttcaaactccaaaaatctggagacccagcatggcgtat

SEQ ID NO: 3389 - DNA, 140 bp, Artificial Sequence
  Synthetic
atacgccatgctgggtctcccatgggaaaagttaggaaagacacacaggagtggaaaccctcaactggatggagcaattgggaagaggttcccttctgctcccaccacttcaacaagctgcgtacttgggagtcggccat

SEQ ID NO: 3390 - DNA, 140 bp, Artificial Sequence
  Synthetic
atggccgactcccaagtacgcagcttgttgaagtggtgggagcagaagggaacctcttcccaattgctccatccagttgagggtttccactcctgtgtgtctttcctaacttttcccatgggagacccagcatggcgtat

SEQ ID NO: 3391 - DNA, 140 bp, Artificial Sequence
  Synthetic
atacgccatgctgggtctcccatgggaaaggttaggaaagacacacaggaatggaaaccctcgactggatggaacaattgggaagaggtcccgttctgttctcaccacttcaacaagctgcgtacttgggagtcggccat

SEQ ID NO: 3392 - DNA, 140 bp, Artificial Sequence
  Synthetic
atggccgactcccaagtacgcagcttgttgaagtggtgagaacagaacgggacctcttcccaattgttccatccagtcgagggtttccattcctgtgtgtctttcctaacctttcccatgggagacccagcatggcgtat

SEQ ID NO: 3393 - DNA, 140 bp, Artificial Sequence
  Synthetic
atacgccatgctgggtctccaggtttttggagtttgaatctctggggtttctgaacgaagaccactggatgggaagagaaaactcaggaggtggagttgaagggctaggactgcaaaggccgtacttgggagtcggccat

SEQ ID NO: 3394 - DNA, 140 bp, Artificial Sequence
  Synthetic
atggccgactcccaagtacggcctttgcagtcctagcccttcaactccacctcctgagttttctcttcccatccagtggtcttcgttcagaaaccccagagattcaaactccaaaaacctggagacccagcatggcgtat

SEQ ID NO: 3395 - DNA, 140 bp, Artificial Sequence
  Synthetic
atacgccatgctgggtctccgcagatgacaccgctggctgggacacccgcattagcaagtttgatctagagaatgaagccttgatcaccaaccagatggaagaagggcacagagctctggcgtacttgggagtcggccat

SEQ ID NO: 3396 - DNA, 140 bp, Artificial Sequence
  Synthetic
atggccgactcccaagtacgccagagctctgtgcccttcttccatctggttggtgatcaaggcttcattctctagatcaaacttgctaatgcgggtgtcccagccagcggtgtcatctgcggagacccagcatggcgtat

SEQ ID NO: 3397 - DNA, 140 bp, Artificial Sequence
  Synthetic
atacgccatgctgggtctccacgcatgatctgtggttgttgaggaaaccagagaaagtgaccagatggttgcagagtaatggatgggacagactcaaacggatggcagttagtggagatgcgtacttgggagtcggccat

SEQ ID NO: 3398 - DNA, 140 bp, Artificial Sequence
  Synthetic
atggccgactcccaagtacgcatctccactaactgccatccgtttgagtctgtcccatccattactctgcaaccatctggtcactttctctggtttcctcaacaaccacagatcatgcgtggagacccagcatggcgtat

SEQ ID NO: 3399 - DNA, 140 bp, Artificial Sequence
  Synthetic
atacgccatgctgggtctccactgcgttgtgaagccaattgacgataggtttgcacatgccctcaagttcttgaatgacatgggaaaggttaggaaagacacacaggaatggaagccctccgtacttgggagtcggccat

SEQ ID NO: 3400 - DNA, 140 bp, Artificial Sequence
  Synthetic
atggccgactcccaagtacggagggcttccattcctgtgtgtctttcctaacctttcccatgtcattcaagaacttgagggcatgtgcaaacctatcgtcaattggcttcacaacgcagtggagacccagcatggcgtat

SEQ ID NO: 3401 - DNA, 140 bp, Artificial Sequence
  Synthetic
aggccctggctgctgatatgcatgggaaaggttaggaaagacacacaggaatggaagccctcgactggatggagcaattgggaagaggtcccgttctgttctcaccacttcaacaagctggaccttttgggacagcggtg

SEQ ID NO: 3402 - DNA, 140 bp, Artificial Sequence
  Synthetic
caccgctgtcccaaaaggtccagcttgttgaagtggtgagaacagaacgggacctcttcccaattgctccatccagtcgagggcttccattcctgtgtgtctttcctaacctttcccatgcatatcagcagccagggcct

SEQ ID NO: 3403 - DNA, 140 bp, Artificial Sequence
  Synthetic
atacgccatgctgggtctccctcatggtgtggaatagagtgtggattgaggagaacgaccacatggaggacaagacccctgtaacaaaatggacagacattccctatttgggaaaaagggcgtacttgggagtcggccat

SEQ ID NO: 3404 - DNA, 140 bp, Artificial Sequence
  Synthetic
atggccgactcccaagtacgccctttttcccaaatagggaatgtctgtccattttgttacaggggtcttgtcctccatgtggtcgttctcctcaatccacactctattccacaccatgagggagacccagcatggcgtat

SEQ ID NO: 3405 - DNA, 140 bp, Artificial Sequence
  Synthetic
aggccctggctgctgatatgcaagacccctgtaacaaaatggacagacattccctatttgggaaaaagggaggacttatggtgtggatcccttatagggcacagacctcgcaccacttgggaccttttgggacagcggtg

SEQ ID NO: 3406 - DNA, 140 bp, Artificial Sequence
  Synthetic
caccgctgtcccaaaaggtcccaagtggtgcgaggtctgtgccctataagggatccacaccataagtcctccctttttcccaaatagggaatgtctgtccattttgttacaggggtcttgcatatcagcagccagggcct

SEQ ID NO: 3407 - DNA, 140 bp, Artificial Sequence
  Synthetic
atacgccatgctgggtctccaggacttatggtgtggatcccttatagggcacagacctcgcaccacttgggctgagaacatcaaagacacagtcaacatggtgcgtaggatcataggtgacgtacttgggagtcggccat

SEQ ID NO: 3408 - DNA, 140 bp, Artificial Sequence
  Synthetic
atggccgactcccaagtacgtcacctatgatcctacgcaccatgttgactgtgtctttgatgttctcagcccaagtggtgcgaggtctgtgccctataagggatccacaccataagtcctggagacccagcatggcgtat

SEQ ID NO: 3409 - DNA, 140 bp, Artificial Sequence
  Synthetic
atacgccatgctgggtctcctgaagaaaaatacatggactacctatccacccaagtacgctacttgggtgaggaagggtccacacctggagtgctgtaagcaccaatttcaatgttgtcacgtacttgggagtcggccat

SEQ ID NO: 3410 - DNA, 140 bp, Artificial Sequence
  Synthetic
atggccgactcccaagtacgtgacaacattgaaattggtgcttacagcactccaggtgtggacccttcctcacccaagtagcgtacttgggtggataggtagtccatgtatttttcttcaggagacccagcatggcgtat

SEQ ID NO: 3411 - DNA, 140 bp, Artificial Sequence
  Synthetic
aggccctggctgctgatatgaggaagggtccacacctggagtgctgtaagcaccaatttcaatgttgtcaggcctgctagtcagccacagtttggggaaagctgtgcagcctgtaaccccgaccttttgggacagcggtg

SEQ ID NO: 3412 - DNA, 140 bp, Artificial Sequence
  Synthetic
caccgctgtcccaaaaggtcggggttacaggctgcacagctttccccaaactgtggctgactagcaggcctgacaacattgaaattggtgcttacagcactccaggtgtggacccttcctcatatcagcagccagggcct

SEQ ID NO: 3413 - DNA, 140 bp, Artificial Sequence
  Synthetic
atacgccatgctgggtctccggcctgctagtcagccacagtttggggaaagctgtgcagcctgtaacccccccaggagaagctgggaaaccaagctcatggtcaggccgataacgccatgcgtacttgggagtcggccat

SEQ ID NO: 3414 - DNA, 140 bp, Artificial Sequence
  Synthetic
atggccgactcccaagtacgcatggcgttatcggcctgaccatgagcttggtttcccagcttctcctgggggggttacaggctgcacagctttccccaaactgtggctgactagcaggccggagacccagcatggcgtat

SEQ ID NO: 3415 - DNA, 140 bp, Artificial Sequence
  Synthetic
atacgccatgctgggtctccgcacggaaaaagccatgctgcctgtgagcccctcagaggacactgagtcaaaaaaccccacgcgcttggaagcgcaggatgggaaaagaaggtggcgacccgtacttgggagtcggccat

SEQ ID NO: 3416 - DNA, 140 bp, Artificial Sequence
  Synthetic
atggccgactcccaagtacgggtcgccaccttcttttcccatcctgcgcttccaagcgcgtggggttttttgactcagtgtcctctgaggggctcacaggcagcatggctttttccgtgcggagacccagcatggcgtat

SEQ ID NO: 3417 - DNA, 140 bp, Artificial Sequence
  Synthetic
aggccctggctgctgatatgaggacactgagtcaaaaaaccccacgcgcttggaagcgcaggatgggaaaagaaggtggcgaccttccccaccctttaatctggggcctgaactggagatgaccttttgggacagcggtg

SEQ ID NO: 3418 - DNA, 140 bp, Artificial Sequence
  Synthetic
caccgctgtcccaaaaggtcatctccagttcaggccccagattaaagggtggggaaggtcgccaccttcttttcccatcctgcgcttccaagcgcgtggggttttttgactcagtgtcctcatatcagcagccagggcct

SEQ ID NO: 3419 - DNA, 140 bp, Artificial Sequence
  Synthetic
atacgccatgctgggtctccctcatggtgtggaatagggtgtggattgaagaaaatgaccacatggaggacaaaacaccggttacaaagtggacagatattccctacctgggaaagagagcgtacttgggagtcggccat

SEQ ID NO: 3420 - DNA, 140 bp, Artificial Sequence
  Synthetic
atggccgactcccaagtacgctctctttcccaggtagggaatatctgtccactttgtaaccggtgttttgtcctccatgtggtcattttcttcaatccacaccctattccacaccatgagggagacccagcatggcgtat

SEQ ID NO: 3421 - DNA, 140 bp, Artificial Sequence
  Synthetic
atacgccatgctgggtctccaagacctatggtgcggctcactaatagggcacagaccacgcaccacatgggctgaaaacatcaaggataccgtcaacatggtgcgacggatcataggtgacgtacttgggagtcggccat

SEQ ID NO: 3422 - DNA, 140 bp, Artificial Sequence
  Synthetic
atggccgactcccaagtacgtcacctatgatccgtcgcaccatgttgacggtatccttgatgttttcagcccatgtggtgcgtggtctgtgccctattagtgagccgcaccataggtcttggagacccagcatggcgtat

SEQ ID NO: 3423 - DNA, 140 bp, Artificial Sequence
  Synthetic
atacgccatgctgggtctcctgaagagaagtacatggattacttgtccacgcaggtgcgatacctgggtgaacagggttccacacctggagtgctgtaagcacaggaccaaaggatgtcacgtacttgggagtcggccat

SEQ ID NO: 3424 - DNA, 140 bp, Artificial Sequence
  Synthetic
atggccgactcccaagtacgtgacatcctttggtcctgtgcttacagcactccaggtgtggaaccctgttcacccaggtatcgcacctgcgtggacaagtaatccatgtacttctcttcaggagacccagcatggcgtat

SEQ ID NO: 3425 - DNA, 140 bp, Artificial Sequence
  Synthetic
atacgccatgctgggtctccggcctgcttgccagccatggcttgggagagcctatgcagcctgtgtcccccccaggagaagctgggttatcaagctcaaagtcaggccgtcaacgccatgcgtacttgggagtcggccat

SEQ ID NO: 3426 - DNA, 140 bp, Artificial Sequence
  Synthetic
atggccgactcccaagtacgcatggcgttgacggcctgactttgagcttgataacccagcttctcctgggggggacacaggctgcataggctctcccaagccatggctggcaagcaggccggagacccagcatggcgtat

SEQ ID NO: 3427 - DNA, 140 bp, Artificial Sequence
  Synthetic
atacgccatgctgggtctccgcacggaatgagccatgctgcctgtgagcccccggaggaaaccgggtgcaaaaaaccccgtgcgtctggaacgtaggaatgggaaccgaaggtggcgacccgtacttgggagtcggccat

SEQ ID NO: 3428 - DNA, 140 bp, Artificial Sequence
  Synthetic
atggccgactcccaagtacgggtcgccaccttcggttcccattcctacgttccagacgcacggggttttttgcacccggtttcctccgggggctcacaggcagcatggctcattccgtgcggagacccagcatggcgtat

SEQ ID NO: 3429 - DNA, 140 bp, Artificial Sequence
  Synthetic
aggccctggctgctgatatggaaaccgggtgcaaaaaaccccgtgcgtctggaacgtaggaatgggaaccgaaggtggcgaccttccccaccctttaatctggggcctgaactggagattgaccttttgggacagcggtg

SEQ ID NO: 3430 - DNA, 140 bp, Artificial Sequence
  Synthetic
caccgctgtcccaaaaggtcaatctccagttcaggccccagattaaagggtggggaaggtcgccaccttcggttcccattcctacgttccagacgcacggggttttttgcacccggtttccatatcagcagccagggcct

SEQ ID NO: 3431 - DNA, 140 bp, Artificial Sequence
  Synthetic
atacgccatgctgggtctccctcatggtgtggaatagagtgtggattgaggaaaacgaccatatggaggacaagacccctgttacaaaatggacagacattccctatttagggaaaagggcgtacttgggagtcggccat

SEQ ID NO: 3432 - DNA, 140 bp, Artificial Sequence
  Synthetic
atggccgactcccaagtacgcccttttccctaaatagggaatgtctgtccattttgtaacaggggtcttgtcctccatatggtcgttttcctcaatccacactctattccacaccatgagggagacccagcatggcgtat

SEQ ID NO: 3433 - DNA, 140 bp, Artificial Sequence
  Synthetic
atacgccatgctgggtctcctgaagaaaagtacacggactacctatccactcaggtacgctacttgggtgaggaagggtccacacctggagtgctgtaagcaccaattctagtgttgtcacgtacttgggagtcggccat

SEQ ID NO: 3434 - DNA, 140 bp, Artificial Sequence
  Synthetic
atggccgactcccaagtacgtgacaacactagaattggtgcttacagcactccaggtgtggacccttcctcacccaagtagcgtacctgagtggataggtagtccgtgtacttttcttcaggagacccagcatggcgtat

SEQ ID NO: 3435 - DNA, 140 bp, Artificial Sequence
  Synthetic
atacgccatgctgggtctccggcctgctagtcagccacagtttggggaaagctgtgcagcctgtaacccccccaggagaagctgggaaaccaagctcatagtcaggccgataacgccatgcgtacttgggagtcggccat

SEQ ID NO: 3436 - DNA, 140 bp, Artificial Sequence
  Synthetic
atggccgactcccaagtacgcatggcgttatcggcctgactatgagcttggtttcccagcttctcctgggggggttacaggctgcacagctttccccaaactgtggctgactagcaggccggagacccagcatggcgtat

SEQ ID NO: 3437 - DNA, 140 bp, Artificial Sequence
  Synthetic
atacgccatgctgggtctccgcacggaaaaagccatgctgcctgtgagcccctcagaggacactgagtcaaaaaaccccgcgcgcttggaagcgcaggatgggaaaagaaggtggcgacccgtacttgggagtcggccat

SEQ ID NO: 3438 - DNA, 140 bp, Artificial Sequence
  Synthetic
atggccgactcccaagtacgggtcgccaccttcttttcccatcctgcgcttccaagcgcgcggggttttttgactcagtgtcctctgaggggctcacaggcagcatggctttttccgtgcggagacccagcatggcgtat

SEQ ID NO: 3439 - DNA, 140 bp, Artificial Sequence
  Synthetic
aggccctggctgctgatatgggacactgagtcaaaaaaccccgcgcgcttggaagcgcaggatgggaaaagaaggtggcgaccttccccaccctttaatctggggcctgaatggaagattgaccttttgggacagcggtg

SEQ ID NO: 3440 - DNA, 140 bp, Artificial Sequence
  Synthetic
caccgctgtcccaaaaggtcaatcttccattcaggccccagattaaagggtggggaaggtcgccaccttcttttcccatcctgcgcttccaagcgcgcggggttttttgactcagtgtcccatatcagcagccagggcct

SEQ ID NO: 3441 - DNA, 140 bp, Artificial Sequence
  Synthetic
atacgccatgctgggtctccctcatggtgtggaatagagtgtggattgaggaaaacgaccatatggaggacaagacccctgttaaaaaatggacagacattccctatttagggaaaagggcgtacttgggagtcggccat

SEQ ID NO: 3442 - DNA, 140 bp, Artificial Sequence
  Synthetic
atggccgactcccaagtacgcccttttccctaaatagggaatgtctgtccattttttaacaggggtcttgtcctccatatggtcgttttcctcaatccacactctattccacaccatgagggagacccagcatggcgtat

SEQ ID NO: 3443 - DNA, 140 bp, Artificial Sequence
  Synthetic
atacgccatgctgggtctccctcatggtgtggaatagagtgtggattgaggaaaacgaccatatggaggacaagacccctgtaacaaaatggacagacattccctatttagggaaaagggcgtacttgggagtcggccat

SEQ ID NO: 3444 - DNA, 140 bp, Artificial Sequence
  Synthetic
atggccgactcccaagtacgcccttttccctaaatagggaatgtctgtccattttgttacaggggtcttgtcctccatatggtcgttttcctcaatccacactctattccacaccatgagggagacccagcatggcgtat

SEQ ID NO: 3445 - DNA, 140 bp, Artificial Sequence
  Synthetic
aggccctggctgctgatatgggacactgagtcaaaaaaccccgcgcgcttggaagcgcaggatgggaaaagaaggtggcgaccttccccaccctttaatctggggcctgaactggagattgaccttttgggacagcggtg

SEQ ID NO: 3446 - DNA, 140 bp, Artificial Sequence
  Synthetic
caccgctgtcccaaaaggtcaatctccagttcaggccccagattaaagggtggggaaggtcgccaccttcttttcccatcctgcgcttccaagcgcgcggggttttttgactcagtgtcccatatcagcagccagggcct

SEQ ID NO: 3447 - DNA, 140 bp, Artificial Sequence
  Synthetic
atacgccatgctgggtctccctcatggtgtggaatagagtgtggattgaggagaacgaccacatggaggacaagacccctgtaacaaaatggacagacattccctatttggggaaaagggcgtacttgggagtcggccat

SEQ ID NO: 3448 - DNA, 140 bp, Artificial Sequence
  Synthetic
atggccgactcccaagtacgcccttttccccaaatagggaatgtctgtccattttgttacaggggtcttgtcctccatgtggtcgttctcctcaatccacactctattccacaccatgagggagacccagcatggcgtat

SEQ ID NO: 3449 - DNA, 140 bp, Artificial Sequence
  Synthetic
atacgccatgctgggtctcctgaagaaaagtacatggactacctatccacccaagtacgctacttgggtgaggaagggtccacacctggagtgctgtaagcaccaatttcaatgttgtcacgtacttgggagtcggccat

SEQ ID NO: 3450 - DNA, 140 bp, Artificial Sequence
  Synthetic
atggccgactcccaagtacgtgacaacattgaaattggtgcttacagcactccaggtgtggacccttcctcacccaagtagcgtacttgggtggataggtagtccatgtacttttcttcaggagacccagcatggcgtat

SEQ ID NO: 3451 - DNA, 140 bp, Artificial Sequence
  Synthetic
atacgccatgctgggtctccggcctgctagtcagccacagtttggggaaagctgtgcagcctgtaacccccccaggagaagctgggaaatcaagctcatagtcaggccgataacgccatgcgtacttgggagtcggccat

SEQ ID NO: 3452 - DNA, 140 bp, Artificial Sequence
  Synthetic
atggccgactcccaagtacgcatggcgttatcggcctgactatgagcttgatttcccagcttctcctgggggggttacaggctgcacagctttccccaaactgtggctgactagcaggccggagacccagcatggcgtat

SEQ ID NO: 3453 - DNA, 140 bp, Artificial Sequence
  Synthetic
aggccctggctgctgatatgggacactgagtcaaaaaaccccacgcgcttggaagcgcaggatgggaaaagaaggtggcgaccttccccaccctttaatctggggcctgaactggagattgaccttttgggacagcggtg

SEQ ID NO: 3454 - DNA, 140 bp, Artificial Sequence
  Synthetic
caccgctgtcccaaaaggtcaatctccagttcaggccccagattaaagggtggggaaggtcgccaccttcttttcccatcctgcgcttccaagcgcgtggggttttttgactcagtgtcccatatcagcagccagggcct

SEQ ID NO: 3455 - DNA, 140 bp, Artificial Sequence
  Synthetic
atacgccatgctgggtctccctcatggtgtggaatagagtgtggattgaggaaaacgcccatatggaggacaagacccctgttacaaaatggacagacattccctatttagggaaaagggcgtacttgggagtcggccat

SEQ ID NO: 3456 - DNA, 140 bp, Artificial Sequence
  Synthetic
atggccgactcccaagtacgcccttttccctaaatagggaatgtctgtccattttgtaacaggggtcttgtcctccatatgggcgttttcctcaatccacactctattccacaccatgagggagacccagcatggcgtat

SEQ ID NO: 3457 - DNA, 140 bp, Artificial Sequence
  Synthetic
aggccctggctgctgatatgggacactgagtcaaaaaaccccgcgcgcttggaagcgcaggatgggaaaagaaggtggcgaccttccccacccttttatctggggcctgaactggagattgaccttttgggacagcggtg

SEQ ID NO: 3458 - DNA, 140 bp, Artificial Sequence
  Synthetic
caccgctgtcccaaaaggtcaatctccagttcaggccccagataaaagggtggggaaggtcgccaccttcttttcccatcctgcgcttccaagcgcgcggggttttttgactcagtgtcccatatcagcagccagggcct

SEQ ID NO: 3459 - DNA, 140 bp, Artificial Sequence
  Synthetic
atacgccatgctgggtctccctcatggtgtggaatagagtgtggattgaggaaaacgaggatatggaggacaagactcctgtaacaaaatggacagacattccctatttagggaaaagggcgtacttgggagtcggccat

SEQ ID NO: 3460 - DNA, 140 bp, Artificial Sequence
  Synthetic
atggccgactcccaagtacgcccttttccctaaatagggaatgtctgtccattttgttacaggagtcttgtcctccatatcctcgttttcctcaatccacactctattccacaccatgagggagacccagcatggcgtat

SEQ ID NO: 3461 - DNA, 140 bp, Artificial Sequence
  Synthetic
aggccctggctgctgatatgctcatggtgtggaatagagtgtggattgaggagaacgaccatatggaggacaagactcctgtaacaaaatggacagacattccctatctaggaaaaaggggaccttttgggacagcggtg

SEQ ID NO: 3462 - DNA, 140 bp, Artificial Sequence
  Synthetic
caccgctgtcccaaaaggtcccctttttcctagatagggaatgtctgtccattttgttacaggagtcttgtcctccatatggtcgttctcctcaatccacactctattccacaccatgagcatatcagcagccagggcct

SEQ ID NO: 3463 - DNA, 140 bp, Artificial Sequence
  Synthetic
aggccctggctgctgatatgaggaagggtccacacccggagtgttgtaagcaccaattttagtgttgtcaggcctgctagtcagccacagtttggggaaagctgtgcagcctgtgaccccgaccttttgggacagcggtg

SEQ ID NO: 3464 - DNA, 140 bp, Artificial Sequence
  Synthetic
caccgctgtcccaaaaggtcggggtcacaggctgcacagctttccccaaactgtggctgactagcaggcctgacaacactaaaattggtgcttacaacactccgggtgtggacccttcctcatatcagcagccagggcct

SEQ ID NO: 3465 - DNA, 140 bp, Artificial Sequence
  Synthetic
atacgccatgctgggtctccggcctgctagtcagccacagtttggggaaagctgtgcagcctgtgacccccccaggagaagctgggaaaccaagctcatagtcaggccgagaacgccatgcgtacttgggagtcggccat

SEQ ID NO: 3466 - DNA, 140 bp, Artificial Sequence
  Synthetic
atggccgactcccaagtacgcatggcgttctcggcctgactatgagcttggtttcccagcttctcctgggggggtcacaggctgcacagctttccccaaactgtggctgactagcaggccggagacccagcatggcgtat

SEQ ID NO: 3467 - DNA, 140 bp, Artificial Sequence
  Synthetic
aggccctggctgctgatatgggacactgagtcaaaaaaccccacgcgcttggaagcgcaggatgggaaaagaaggtggcgaccttccccacccttcaatctggggcgagaactggggactgaccttttgggacagcggtg

SEQ ID NO: 3468 - DNA, 140 bp, Artificial Sequence
  Synthetic
caccgctgtcccaaaaggtcagtccccagttctcgccccagattgaagggtggggaaggtcgccaccttcttttcccatcctgcgcttccaagcgcgtggggttttttgactcagtgtcccatatcagcagccagggcct

SEQ ID NO: 3469 - DNA, 140 bp, Artificial Sequence
  Synthetic
aggccctggctgctgatatgggacactgagtcaaaaaaccccacgcgcttggaagcgcaggatgggaaaagaaggtggcgaccttccccacccttcaatctggggcgtgaactggggactgaccttttgggacagcggtg

SEQ ID NO: 3470 - DNA, 140 bp, Artificial Sequence
  Synthetic
caccgctgtcccaaaaggtcagtccccagttcacgccccagattgaagggtggggaaggtcgccaccttcttttcccatcctgcgcttccaagcgcgtggggttttttgactcagtgtcccatatcagcagccagggcct

SEQ ID NO: 3471 - DNA, 140 bp, Artificial Sequence
  Synthetic
aggccctggctgctgatatgaggacttatggtgtggatcttttatagggcacagaccccgcaccacttgggctgaaaacatcaaagacacagtcaacatggtgcgcaggatcataggtgagaccttttgggacagcggtg

SEQ ID NO: 3472 - DNA, 140 bp, Artificial Sequence
  Synthetic
caccgctgtcccaaaaggtctcacctatgatcctgcgcaccatgttgactgtgtctttgatgttttcagcccaagtggtgcggggtctgtgccctataaaagatccacaccataagtcctcatatcagcagccagggcct

SEQ ID NO: 3473 - DNA, 140 bp, Artificial Sequence
  Synthetic
aggccctggctgctgatatgggacactgagtcaaaaaaccccacgcgcttggaagcgcaggatgggaaaagaaggtggcgaccttccccacccttcaatctggggcctgaactggggactgaccttttgggacagcggtg

SEQ ID NO: 3474 - DNA, 140 bp, Artificial Sequence
  Synthetic
caccgctgtcccaaaaggtcagtccccagttcaggccccagattgaagggtggggaaggtcgccaccttcttttcccatcctgcgcttccaagcgcgtggggttttttgactcagtgtcccatatcagcagccagggcct

SEQ ID NO: 3475 - DNA, 140 bp, Artificial Sequence
  Synthetic
atacgccatgctgggtctccctcatggtgtggaatagagtgtggattgaggagatcgaccatatggaggacaagactcctgtaacaaaatggacagacattccctatctaggaaaaagggcgtacttgggagtcggccat

SEQ ID NO: 3476 - DNA, 140 bp, Artificial Sequence
  Synthetic
atggccgactcccaagtacgccctttttcctagatagggaatgtctgtccattttgttacaggagtcttgtcctccatatggtcgatctcctcaatccacactctattccacaccatgagggagacccagcatggcgtat

SEQ ID NO: 3477 - DNA, 140 bp, Artificial Sequence
  Synthetic
atacgccatgctgggtctccctcatggtgtggaatagagtgtggattgaggagaacgaccatatggaggacaagactcctgtaacaaagtggactgacattccctacctgggaaaaagggcgtacttgggagtcggccat

SEQ ID NO: 3478 - DNA, 140 bp, Artificial Sequence
  Synthetic
atggccgactcccaagtacgccctttttcccaggtagggaatgtcagtccactttgttacaggagtcttgtcctccatatggtcgttctcctcaatccacactctattccacaccatgagggagacccagcatggcgtat

SEQ ID NO: 3479 - DNA, 140 bp, Artificial Sequence
  Synthetic
aggccctggctgctgatatgaggaagggtccacacctggagtgttgtaagcaccaatttcagtgttgtcaggcctgctagtcagccacagtttggggaaagctgtgcagcctgtagccccgaccttttgggacagcggtg

SEQ ID NO: 3480 - DNA, 140 bp, Artificial Sequence
  Synthetic
caccgctgtcccaaaaggtcggggctacaggctgcacagctttccccaaactgtggctgactagcaggcctgacaacactgaaattggtgcttacaacactccaggtgtggacccttcctcatatcagcagccagggcct

SEQ ID NO: 3481 - DNA, 140 bp, Artificial Sequence
  Synthetic
aggccctggctgctgatatgggcctgctagtcagccacagtttggggaaagctgtgcagcctgtagcccccccaggagaagctgggaaaccaagctcatagtcaggccgagaacgccatggaccttttgggacagcggtg

SEQ ID NO: 3482 - DNA, 140 bp, Artificial Sequence
  Synthetic
caccgctgtcccaaaaggtccatggcgttctcggcctgactatgagcttggtttcccagcttctcctgggggggctacaggctgcacagctttccccaaactgtggctgactagcaggcccatatcagcagccagggcct

SEQ ID NO: 3483 - DNA, 140 bp, Artificial Sequence
  Synthetic
aggccctggctgctgatatgggacactgagttaaaaaaccccacgcgcttggaagcgcaggatgggaaaagaaggtggcgaccttccccaccctttaatctggggcctgaactggagactgaccttttgggacagcggtg

SEQ ID NO: 3484 - DNA, 140 bp, Artificial Sequence
  Synthetic
caccgctgtcccaaaaggtcagtctccagttcaggccccagattaaagggtggggaaggtcgccaccttcttttcccatcctgcgcttccaagcgcgtggggttttttaactcagtgtcccatatcagcagccagggcct

SEQ ID NO: 3485 - DNA, 140 bp, Artificial Sequence
  Synthetic
atacgccatgctgggtctccctcatggtgtggaatagagtgtggattgaggagaacgaccacatggaggacaagacccctgtaaaaaaatggacagacattccctacttggggaaaagggcgtacttgggagtcggccat

SEQ ID NO: 3486 - DNA, 140 bp, Artificial Sequence
  Synthetic
atggccgactcccaagtacgcccttttccccaagtagggaatgtctgtccatttttttacaggggtcttgtcctccatgtggtcgttctcctcaatccacactctattccacaccatgagggagacccagcatggcgtat

SEQ ID NO: 3487 - DNA, 140 bp, Artificial Sequence
  Synthetic
aggccctggctgctgatatgggacactgagtcaaaaaaccccacgcgcttggaagcgcaggatgggaaaagaaggtggcgaccttccccaccctttaatctggggcctgaactccagattgaccttttgggacagcggtg

SEQ ID NO: 3488 - DNA, 140 bp, Artificial Sequence
  Synthetic
caccgctgtcccaaaaggtcaatctggagttcaggccccagattaaagggtggggaaggtcgccaccttcttttcccatcctgcgcttccaagcgcgtggggttttttgactcagtgtcccatatcagcagccagggcct

SEQ ID NO: 3489 - DNA, 140 bp, Artificial Sequence
  Synthetic
aggccctggctgctgatatgggacactgagtcaaaaaaccccacgcgcttggaagcgcaggatgggaaaagaaggtggcgaccttccccacccttttatctggggcctgaacctgaatttgaccttttgggacagcggtg

SEQ ID NO: 3490 - DNA, 140 bp, Artificial Sequence
  Synthetic
caccgctgtcccaaaaggtcaaattcaggttcaggccccagataaaagggtggggaaggtcgccaccttcttttcccatcctgcgcttccaagcgcgtggggttttttgactcagtgtcccatatcagcagccagggcct

SEQ ID NO: 3491 - DNA, 140 bp, Artificial Sequence
  Synthetic
aggccctggctgctgatatgggacactgagtcaaaaaaccccacgcgcttggaagcgcaggatgggaaaagaaggtggcgaccttccccaccctttaatctggggcctgaactgaagattgaccttttgggacagcggtg

SEQ ID NO: 3492 - DNA, 140 bp, Artificial Sequence
  Synthetic
caccgctgtcccaaaaggtcaatcttcagttcaggccccagattaaagggtggggaaggtcgccaccttcttttcccatcctgcgcttccaagcgcgtggggttttttgactcagtgtcccatatcagcagccagggcct

SEQ ID NO: 3493 - DNA, 140 bp, Artificial Sequence
  Synthetic
aggccctggctgctgatatgggacactgagtcaaaaaaccccacgcgcttggaagcgcaggatgggaaaagaaggtggcgaccttccccaccctttaatctggggcgtgaactggagattgaccttttgggacagcggtg

SEQ ID NO: 3494 - DNA, 140 bp, Artificial Sequence
  Synthetic
caccgctgtcccaaaaggtcaatctccagttcacgccccagattaaagggtggggaaggtcgccaccttcttttcccatcctgcgcttccaagcgcgtggggttttttgactcagtgtcccatatcagcagccagggcct

SEQ ID NO: 3495 - DNA, 140 bp, Artificial Sequence
  Synthetic
aggccctggctgctgatatgctcatggtgtggaatagagtgtggattgaggagaacgaccacatggaggacaagacccctgttccaaaatggacagaaattccctacttggggaaaaggggaccttttgggacagcggtg

SEQ ID NO: 3496 - DNA, 140 bp, Artificial Sequence
  Synthetic
caccgctgtcccaaaaggtccccttttccccaagtagggaatttctgtccattttggaacaggggtcttgtcctccatgtggtcgttctcctcaatccacactctattccacaccatgagcatatcagcagccagggcct

SEQ ID NO: 3497 - DNA, 140 bp, Artificial Sequence
  Synthetic
atacgccatgctgggtctccggcctgcttgccagccatggcttggggagagccatgcagcctgtgtcccccccaggagaagctgggttatcaagctcaaagtcaggccgtcaacgccatgcgtacttgggagtcggccat

SEQ ID NO: 3498 - DNA, 140 bp, Artificial Sequence
  Synthetic
atggccgactcccaagtacgcatggcgttgacggcctgactttgagcttgataacccagcttctcctgggggggacacaggctgcatggctctccccaagccatggctggcaagcaggccggagacccagcatggcgtat

SEQ ID NO: 3499 - DNA, 140 bp, Artificial Sequence
  Synthetic
atacgccatgctgggtctccgcacggaatgagccatgctgcctgtgagccccccggaggaaaccgggtgaaaaaaccccgtgcgtctggaaaacgtaggatgggaacgaaggtggcgacccgtacttgggagtcggccat

SEQ ID NO: 3500 - DNA, 140 bp, Artificial Sequence
  Synthetic
atggccgactcccaagtacgggtcgccaccttcgttcccatcctacgttttccagacgcacggggttttttcacccggtttcctccggggggctcacaggcagcatggctcattccgtgcggagacccagcatggcgtat

SEQ ID NO: 3501 - DNA, 140 bp, Artificial Sequence
  Synthetic
aggccctggctgctgatatgggaaaccgggtgaaaaaaccccgtgcgtctggaaaacgtaggatgggaacgaaggtggcgaccttccccaccctttaatctggggcctgaactggggattgaccttttgggacagcggtg

SEQ ID NO: 3502 - DNA, 140 bp, Artificial Sequence
  Synthetic
caccgctgtcccaaaaggtcaatccccagttcaggccccagattaaagggtggggaaggtcgccaccttcgttcccatcctacgttttccagacgcacggggttttttcacccggtttcccatatcagcagccagggcct

SEQ ID NO: 3503 - DNA, 140 bp, Artificial Sequence
  Synthetic
atacgccatgctgggtctccggcctgcttgccagccatggccttggggagagcgtgcagcctgtgtcccccccaggagaagctgggttatcaagctcaaaatcaggccgtcaacgccatgcgtacttgggagtcggccat

SEQ ID NO: 3504 - DNA, 140 bp, Artificial Sequence
  Synthetic
atggccgactcccaagtacgcatggcgttgacggcctgattttgagcttgataacccagcttctcctgggggggacacaggctgcacgctctccccaaggccatggctggcaagcaggccggagacccagcatggcgtat

SEQ ID NO: 3505 - DNA, 140 bp, Artificial Sequence
  Synthetic
atacgccatgctgggtctccgcacggaaaaaagcatgctgcctgtgagccccccggaggaaaccgggtgaaaaaaccccgtgcgtctggaaggaaaaggttgggaacgaaggtggcgacccgtacttgggagtcggccat

SEQ ID NO: 3506 - DNA, 140 bp, Artificial Sequence
  Synthetic
atggccgactcccaagtacgggtcgccaccttcgttcccaaccttttccttccagacgcacggggttttttcacccggtttcctccggggggctcacaggcagcatgcttttttccgtgcggagacccagcatggcgtat

SEQ ID NO: 3507 - DNA, 140 bp, Artificial Sequence
  Synthetic
aggccctggctgctgatatgggaaaccgggtgaaaaaaccccgtgcgtctggaaggaaaaggttgggaacgaaggtggcgaccttccccacccttcaatttggggcctgaactggggattgaccttttgggacagcggtg

SEQ ID NO: 3508 - DNA, 140 bp, Artificial Sequence
  Synthetic
caccgctgtcccaaaaggtcaatccccagttcaggccccaaattgaagggtggggaaggtcgccaccttcgttcccaaccttttccttccagacgcacggggttttttcacccggtttcccatatcagcagccagggcct

SEQ ID NO: 3509 - DNA, 140 bp, Artificial Sequence
  Synthetic
aggccctggctgctgatatggaaaccgggtgcaaaaaaccccgtgcgtctggaacgtaggaatgggaaccgaaggtggcgaccttccccaccctttaatctggggcctgaactgggagttgaccttttgggacagcggtg

SEQ ID NO: 3510 - DNA, 140 bp, Artificial Sequence
  Synthetic
caccgctgtcccaaaaggtcaactcccagttcaggccccagattaaagggtggggaaggtcgccaccttcggttcccattcctacgttccagacgcacggggttttttgcacccggtttccatatcagcagccagggcct

SEQ ID NO: 3511 - DNA, 140 bp, Artificial Sequence
  Synthetic
atacgccatgctgggtctcctgaagaaaagtacatggactacctatccacccaagtacgctacttgggtgaggaagggtccacacctggagtgctgtaagcacttatttcaatgttgtcacgtacttgggagtcggccat

SEQ ID NO: 3512 - DNA, 140 bp, Artificial Sequence
  Synthetic
atggccgactcccaagtacgtgacaacattgaaataagtgcttacagcactccaggtgtggacccttcctcacccaagtagcgtacttgggtggataggtagtccatgtacttttcttcaggagacccagcatggcgtat

SEQ ID NO: 3513 - DNA, 140 bp, Artificial Sequence
  Synthetic
aggccctggctgctgatatggaaaccgggtgcaaaaaaccccgtgcgtctggaacgtaggaatgggaaccgaaggtggcgaccttccccaccctttaatctggggcctgaactggggattgaccttttgggacagcggtg

SEQ ID NO: 3514 - DNA, 140 bp, Artificial Sequence
  Synthetic
caccgctgtcccaaaaggtcaatccccagttcaggccccagattaaagggtggggaaggtcgccaccttcggttcccattcctacgttccagacgcacggggttttttgcacccggtttccatatcagcagccagggcct

SEQ ID NO: 3515 - DNA, 140 bp, Artificial Sequence
  Synthetic
atacgccatgctgggtctccctcatggtgtggaatagagtgtggattgaggagaacgaccacatggaggacaagacccctgtatcaaaatggaaagaaattccctatttgggaaaaagggcgtacttgggagtcggccat

SEQ ID NO: 3516 - DNA, 140 bp, Artificial Sequence
  Synthetic
atggccgactcccaagtacgccctttttcccaaatagggaatttctttccattttgatacaggggtcttgtcctccatgtggtcgttctcctcaatccacactctattccacaccatgagggagacccagcatggcgtat

SEQ ID NO: 3517 - DNA, 140 bp, Artificial Sequence
  Synthetic
atacgccatgctgggtctccattccctatggtgtggatcaattatagggcacagacctcgcaccacttgggctgagaacatcaaagacacagtcaacatggtgtttagccccataggtgacgtacttgggagtcggccat

SEQ ID NO: 3518 - DNA, 140 bp, Artificial Sequence
  Synthetic
atggccgactcccaagtacgtcacctatggggctaaacaccatgttgactgtgtctttgatgttctcagcccaagtggtgcgaggtctgtgccctataattgatccacaccatagggaatggagacccagcatggcgtat

SEQ ID NO: 3519 - DNA, 140 bp, Artificial Sequence
  Synthetic
aggccctggctgctgatatgggacactgagtcaaaaaaccccacgcgcttggaagcgcaggatgggaaaagaaggtggcgaccttccccacccttttttctggggcctgaactggatattgaccttttgggacagcggtg

SEQ ID NO: 3520 - DNA, 140 bp, Artificial Sequence
  Synthetic
caccgctgtcccaaaaggtcaatatccagttcaggccccagaaaaaagggtggggaaggtcgccaccttcttttcccatcctgcgcttccaagcgcgtggggttttttgactcagtgtcccatatcagcagccagggcct

SEQ ID NO: 3521 - DNA, 140 bp, Artificial Sequence
  Synthetic
atacgccatgctgggtctccctcatggtgtggaatagagtgtggattgaggagaacgaccacatggaggacaagacccctgtatcaaaatggacagacattccctatttgggaaaaagggcgtacttgggagtcggccat

SEQ ID NO: 3522 - DNA, 140 bp, Artificial Sequence
  Synthetic
atggccgactcccaagtacgccctttttcccaaatagggaatgtctgtccattttgatacaggggtcttgtcctccatgtggtcgttctcctcaatccacactctattccacaccatgagggagacccagcatggcgtat

SEQ ID NO: 3523 - DNA, 140 bp, Artificial Sequence
  Synthetic
atacgccatgctgggtctccaggccttatggtgtggatcaattatagggcacagacctcgcaccacttgggctgagaacatcaaagacacagtcaacatggtgtttaggatcataggtgacgtacttgggagtcggccat

SEQ ID NO: 3524 - DNA, 140 bp, Artificial Sequence
  Synthetic
atggccgactcccaagtacgtcacctatgatcctaaacaccatgttgactgtgtctttgatgttctcagcccaagtggtgcgaggtctgtgccctataattgatccacaccataaggcctggagacccagcatggcgtat

SEQ ID NO: 3525 - DNA, 140 bp, Artificial Sequence
  Synthetic
aggccctggctgctgatatgggacactgagtcaaaaaaccccacgcgcttggaagcgcaggatgggaaaagaaggtggcgaccttccccaccctttaatctggggcctgaactggatattgaccttttgggacagcggtg

SEQ ID NO: 3526 - DNA, 140 bp, Artificial Sequence
  Synthetic
caccgctgtcccaaaaggtcaatatccagttcaggccccagattaaagggtggggaaggtcgccaccttcttttcccatcctgcgcttccaagcgcgtggggttttttgactcagtgtcccatatcagcagccagggcct

SEQ ID NO: 3527 - DNA, 140 bp, Artificial Sequence
  Synthetic
atacgccatgctgggtctccctcatggtgtggaatagagtgtggattgaggagaacgaccacatggaggacaagacccctgttacaaaatggacagacattccctatttggggaaaagggcgtacttgggagtcggccat

SEQ ID NO: 3528 - DNA, 140 bp, Artificial Sequence
  Synthetic
atggccgactcccaagtacgcccttttccccaaatagggaatgtctgtccattttgtaacaggggtcttgtcctccatgtggtcgttctcctcaatccacactctattccacaccatgagggagacccagcatggcgtat

SEQ ID NO: 3529 - DNA, 140 bp, Artificial Sequence
  Synthetic
atacgccatgctgggtctccagtccttatggtgtggatcccttatagggcacagacctcgcaccacttgggctgagaacatcaaagacacagtcaacatggtgtgtaggatcataggtgacgtacttgggagtcggccat

SEQ ID NO: 3530 - DNA, 140 bp, Artificial Sequence
  Synthetic
atggccgactcccaagtacgtcacctatgatcctacacaccatgttgactgtgtctttgatgttctcagcccaagtggtgcgaggtctgtgccctataagggatccacaccataaggactggagacccagcatggcgtat

SEQ ID NO: 3531 - DNA, 140 bp, Artificial Sequence
  Synthetic
atacgccatgctgggtctccctcatggtgtggaatagagtgtggattgaggagaacgaccacatggaggacaagacccctgtaataaaatggacagacattccctatttggggaaaagggcgtacttgggagtcggccat

SEQ ID NO: 3532 - DNA, 140 bp, Artificial Sequence
  Synthetic
atggccgactcccaagtacgcccttttccccaaatagggaatgtctgtccattttattacaggggtcttgtcctccatgtggtcgttctcctcaatccacactctattccacaccatgagggagacccagcatggcgtat

SEQ ID NO: 3533 - DNA, 140 bp, Artificial Sequence
  Synthetic
atacgccatgctgggtctccaggacttatggtgtggatcccttatagggcacagacctcgcaccacttgggctgagaatatcaaagacacagtcaacatggtgcgtaggatcataggtgacgtacttgggagtcggccat

SEQ ID NO: 3534 - DNA, 140 bp, Artificial Sequence
  Synthetic
atggccgactcccaagtacgtcacctatgatcctacgcaccatgttgactgtgtctttgatattctcagcccaagtggtgcgaggtctgtgccctataagggatccacaccataagtcctggagacccagcatggcgtat

SEQ ID NO: 3535 - DNA, 140 bp, Artificial Sequence
  Synthetic
aggccctggctgctgatatgcccaggagaagctgggaaaccaagctcatagtcaggccgataacgccatggcacggaaaaagccatgctgcctgtgagcccctcaaaggacactgagtcagaccttttgggacagcggtg

SEQ ID NO: 3536 - DNA, 140 bp, Artificial Sequence
  Synthetic
caccgctgtcccaaaaggtctgactcagtgtcctttgaggggctcacaggcagcatggctttttccgtgccatggcgttatcggcctgactatgagcttggtttcccagcttctcctgggcatatcagcagccagggcct

SEQ ID NO: 3537 - DNA, 140 bp, Artificial Sequence
  Synthetic
aggccctggctgctgatatgcccaggagaagctgggaaaccaagctcatagtcaggccgataacgccatggcacggaaaaagccatgctgcctgtgagcccctcataggacactgagtcagaccttttgggacagcggtg

SEQ ID NO: 3538 - DNA, 140 bp, Artificial Sequence
  Synthetic
caccgctgtcccaaaaggtctgactcagtgtcctatgaggggctcacaggcagcatggctttttccgtgccatggcgttatcggcctgactatgagcttggtttcccagcttctcctgggcatatcagcagccagggcct

SEQ ID NO: 3539 - DNA, 140 bp, Artificial Sequence
  Synthetic
aggccctggctgctgatatgcccaggagaagctgggaaaccaagctcatagtcaggccgataacgccatggcacggaaaaagccatgctgcctgtgagcccctcacaggacactgagtcagaccttttgggacagcggtg

SEQ ID NO: 3540 - DNA, 140 bp, Artificial Sequence
  Synthetic
caccgctgtcccaaaaggtctgactcagtgtcctgtgaggggctcacaggcagcatggctttttccgtgccatggcgttatcggcctgactatgagcttggtttcccagcttctcctgggcatatcagcagccagggcct

SEQ ID NO: 3541 - DNA, 140 bp, Artificial Sequence
  Synthetic
aggccctggctgctgatatgcccaggagaagctgggaaaccaagctcatagtcaggccgataacgccatggcacggaaaaagccatgctgcctgtgagcccctcagaggacactgagtcagaccttttgggacagcggtg

SEQ ID NO: 3542 - DNA, 140 bp, Artificial Sequence
  Synthetic
caccgctgtcccaaaaggtctgactcagtgtcctctgaggggctcacaggcagcatggctttttccgtgccatggcgttatcggcctgactatgagcttggtttcccagcttctcctgggcatatcagcagccagggcct

SEQ ID NO: 3543 - DNA, 140 bp, Artificial Sequence
  Synthetic
atacgccatgctgggtctcccagccggagaacttggagtaccggataatgctatcagtgcatggctcccagcatagcgggatgattgttaatgacataggacatgaaactgacgaaaacacgtacttgggagtcggccat

SEQ ID NO: 3544 - DNA, 140 bp, Artificial Sequence
  Synthetic
atggccgactcccaagtacgtgttttcgtcagtttcatgtcctatgtcattaacaatcatcccgctatgctgggagccatgcactgatagcattatccggtactccaagttctccggctgggagacccagcatggcgtat

SEQ ID NO: 3545 - DNA, 140 bp, Artificial Sequence
  Synthetic
atacgccatgctgggtctccgagcgaaagtcgaggttacgcctaattcaccaagagcggaagcaaccttgggaggctttggaagcttaggacttgactgtgaaccaaggacaggccttgacgtacttgggagtcggccat

SEQ ID NO: 3546 - DNA, 140 bp, Artificial Sequence
  Synthetic
atggccgactcccaagtacgtcaaggcctgtccttggttcacagtcaagtcctaagcttccaaagcctcccaaggttgcttccgctcttggtgaattaggcgtaacctcgactttcgctcggagacccagcatggcgtat

SEQ ID NO: 3547 - DNA, 140 bp, Artificial Sequence
  Synthetic
aggccctggctgctgatatgccgttcacacggctctcgctggagctctagaggctgagatggatggtgcaaagggaaggctgttctctggccatttgaaatgccgcctaaaaatggacaagaccttttgggacagcggtg

SEQ ID NO: 3548 - DNA, 140 bp, Artificial Sequence
  Synthetic
caccgctgtcccaaaaggtcttgtccatttttaggcggcatttcaaatggccagagaacagccttccctttgcaccatccatctcagcctctagagctccagcgagagccgtgtgaacggcatatcagcagccagggcct

SEQ ID NO: 3549 - DNA, 140 bp, Artificial Sequence
  Synthetic
atacgccatgctgggtctccaagggaaggctgttctctggccatttgaaatgccgcctaaaaatggacaagcttagattgaagggtgcgttatattccttgtgcactgcggcattcacatcgtacttgggagtcggccat

SEQ ID NO: 3550 - DNA, 140 bp, Artificial Sequence
  Synthetic
atggccgactcccaagtacgatgtgaatgccgcagtgcacaaggaatataacgcacccttcaatctaagcttgtccatttttaggcggcatttcaaatggccagagaacagccttcccttggagacccagcatggcgtat

SEQ ID NO: 3551 - DNA, 140 bp, Artificial Sequence
  Synthetic
aggccctggctgctgatatgtcaccaaggtcccagctgaaacactgcatggaacagtcacagtggaggtgcagtatgcagggacagatggaccctgcaaggtcccagcccagatggcggtgaccttttgggacagcggtg

SEQ ID NO: 3552 - DNA, 140 bp, Artificial Sequence
  Synthetic
caccgctgtcccaaaaggtcaccgccatctgggctgggaccttgcagggtccatctgtccctgcatactgcacctccactgtgactgttccatgcagtgtttcagctgggaccttggtgacatatcagcagccagggcct

SEQ ID NO: 3553 - DNA, 140 bp, Artificial Sequence
  Synthetic
atacgccatgctgggtctccggacatgcagaccctgaccccagttggaaggctgattacggcaaatcccgtgataactgagagcactgaaaactcgagaatgatgttggagctggacccacgtacttgggagtcggccat

SEQ ID NO: 3554 - DNA, 140 bp, Artificial Sequence
  Synthetic
atggccgactcccaagtacgtgggtccagctccaacatcattctcgagttttcagtgctctcagttatcacgggatttgccgtaatcagccttccaactggggtcagggtctgcatgtccggagacccagcatggcgtat

SEQ ID NO: 3555 - DNA, 140 bp, Artificial Sequence
  Synthetic
aggccctggctgctgatatgcatgcagaccctgaccccagttggaaggctgattacggcaaatcccgtgataactgagagcactgaaaactcgagaatgatgttggagctggacccaaccgaccttttgggacagcggtg

SEQ ID NO: 3556 - DNA, 140 bp, Artificial Sequence
  Synthetic
caccgctgtcccaaaaggtcggttgggtccagctccaacatcattctcgagttttcagtgctctcagttatcacgggatttgccgtaatcagccttccaactggggtcagggtctgcatgcatatcagcagccagggcct

SEQ ID NO: 3557 - DNA, 140 bp, Artificial Sequence
  Synthetic
atacgccatgctgggtctcccagccggagaacttggagtaccggataatgctgtcagtgcatggatcccagcacagtgggatgattgtgaatgacataggacatgaaactgacgaaaacacgtacttgggagtcggccat

SEQ ID NO: 3558 - DNA, 140 bp, Artificial Sequence
  Synthetic
atggccgactcccaagtacgtgttttcgtcagtttcatgtcctatgtcattcacaatcatcccactgtgctgggatccatgcactgacagcattatccggtactccaagttctccggctgggagacccagcatggcgtat

SEQ ID NO: 3559 - DNA, 140 bp, Artificial Sequence
  Synthetic
atacgccatgctgggtctccgagcaaaagtcgaggtaacacccaattcaccaagagcagaagcaaccttgggaggttttggaagcttgggacttgactgtgagccaaggacaggtcttgacgtacttgggagtcggccat

SEQ ID NO: 3560 - DNA, 140 bp, Artificial Sequence
  Synthetic
atggccgactcccaagtacgtcaagacctgtccttggctcacagtcaagtcccaagcttccaaaacctcccaaggttgcttctgctcttggtgaattgggtgttacctcgacttttgctcggagacccagcatggcgtat

SEQ ID NO: 3561 - DNA, 140 bp, Artificial Sequence
  Synthetic
aggccctggctgctgatatgggaggttttggaagcttgggacttgactgtgagccaaggacaggtcttgatttctcagatctgtattacctgaccatgaacaataagcattggttggtgcgaccttttgggacagcggtg

SEQ ID NO: 3562 - DNA, 140 bp, Artificial Sequence
  Synthetic
caccgctgtcccaaaaggtcgcaccaaccaatgcttattgttcatggtcaggtaatacagatctgagaaatcaagacctgtccttggctcacagtcaagtcccaagcttccaaaacctcccatatcagcagccagggcct

SEQ ID NO: 3563 - DNA, 140 bp, Artificial Sequence
  Synthetic
atacgccatgctgggtctcctttctcagatctgtattacctgaccatgaacaataagcattggttggtgcacaaagagtggtttcatgacatcccactaccttggcatgctggtgcagaccgtacttgggagtcggccat

SEQ ID NO: 3564 - DNA, 140 bp, Artificial Sequence
  Synthetic
atggccgactcccaagtacggtctgcaccagcatgccaaggtagtgggatgtcatgaaaccactctttgtgcaccaaccaatgcttattgttcatggtcaggtaatacagatctgagaaaggagacccagcatggcgtat

SEQ ID NO: 3565 - DNA, 140 bp, Artificial Sequence
  Synthetic
atacgccatgctgggtctccactggaactccacactggaacaacaaagaggcattggtggagtttaaggatgctcacgccaagaggcaaactgttgtggttctggggagccaagaaggagcgtacttgggagtcggccat

SEQ ID NO: 3566 - DNA, 140 bp, Artificial Sequence
  Synthetic
atggccgactcccaagtacgctccttcttggctccccagaaccacaacagtttgcctcttggcgtgagcatccttaaactccaccaatgcctctttgttgttccagtgtggagttccagtggagacccagcatggcgtat

SEQ ID NO: 3567 - DNA, 140 bp, Artificial Sequence
  Synthetic
atacgccatgctgggtctccctgttcacacggccctcgctggagctctggaggctgagatggatggcgcaaagggaaggctattctctggccatttgaaatgccgtctaaaaatggacaacgtacttgggagtcggccat

SEQ ID NO: 3568 - DNA, 140 bp, Artificial Sequence
  Synthetic
atggccgactcccaagtacgttgtccatttttagacggcatttcaaatggccagagaatagccttccctttgcgccatccatctcagcctccagagctccagcgagggccgtgtgaacagggagacccagcatggcgtat

SEQ ID NO: 3569 - DNA, 140 bp, Artificial Sequence
  Synthetic
aggccctggctgctgatatgaagggaaggctattctctggccatttgaaatgccgtctaaaaatggacaagcttaggctgaagggtgtgtcatattccctgtgtaccgcagcgttcacatgaccttttgggacagcggtg

SEQ ID NO: 3570 - DNA, 140 bp, Artificial Sequence
  Synthetic
caccgctgtcccaaaaggtcatgtgaacgctgcggtacacagggaatatgacacacccttcagcctaagcttgtccatttttagacggcatttcaaatggccagagaatagccttcccttcatatcagcagccagggcct

SEQ ID NO: 3571 - DNA, 140 bp, Artificial Sequence
  Synthetic
aggccctggctgctgatatgtcaccaaggtcccagctgaaacattgcatggaacagtcacagtggaggtgcagtatgcagggacagatggaccctgcaaggtcccagcccagatggcggtgaccttttgggacagcggtg

SEQ ID NO: 3572 - DNA, 140 bp, Artificial Sequence
  Synthetic
caccgctgtcccaaaaggtcaccgccatctgggctgggaccttgcagggtccatctgtccctgcatactgcacctccactgtgactgttccatgcaatgtttcagctgggaccttggtgacatatcagcagccagggcct

SEQ ID NO: 3573 - DNA, 140 bp, Artificial Sequence
  Synthetic
aggccctggctgctgatatgcagtatgcagggacagatggaccctgcaaggtcccagcccagatggcggtggacatgcagaccctgaccccagttggaaggctgataacggcaaatcccagaccttttgggacagcggtg

SEQ ID NO: 3574 - DNA, 140 bp, Artificial Sequence
  Synthetic
caccgctgtcccaaaaggtctgggatttgccgttatcagccttccaactggggtcagggtctgcatgtccaccgccatctgggctgggaccttgcagggtccatctgtccctgcatactgcatatcagcagccagggcct

SEQ ID NO: 3575 - DNA, 140 bp, Artificial Sequence
  Synthetic
atacgccatgctgggtctccggacatgcagaccctgaccccagttggaaggctgataacggcaaatcccatcataactgagagcactgaaaactcgagaatgatgttggagctggacccacgtacttgggagtcggccat

SEQ ID NO: 3576 - DNA, 140 bp, Artificial Sequence
  Synthetic
atggccgactcccaagtacgtgggtccagctccaacatcattctcgagttttcagtgctctcagttatgatgggatttgccgttatcagccttccaactggggtcagggtctgcatgtccggagacccagcatggcgtat

SEQ ID NO: 3577 - DNA, 140 bp, Artificial Sequence
  Synthetic
aggccctggctgctgatatgcatgcagaccctgaccccagttggaaggctgataacggcaaatcccatcataactgagagcactgaaaactcgagaatgatgttggagctggacccaaccgaccttttgggacagcggtg

SEQ ID NO: 3578 - DNA, 140 bp, Artificial Sequence
  Synthetic
caccgctgtcccaaaaggtcggttgggtccagctccaacatcattctcgagttttcagtgctctcagttatgatgggatttgccgttatcagccttccaactggggtcagggtctgcatgcatatcagcagccagggcct

SEQ ID NO: 3579 - DNA, 140 bp, Artificial Sequence
  Synthetic
atacgccatgctgggtctcccagccggagaacttggagtaccggataattctatcagtgcatggatcccagcacagtgggatgattgtgaatgacacaggacatgaaactgacgaaaacacgtacttgggagtcggccat

SEQ ID NO: 3580 - DNA, 140 bp, Artificial Sequence
  Synthetic
atggccgactcccaagtacgtgttttcgtcagtttcatgtcctgtgtcattcacaatcatcccactgtgctgggatccatgcactgatagaattatccggtactccaagttctccggctgggagacccagcatggcgtat

SEQ ID NO: 3581 - DNA, 140 bp, Artificial Sequence
  Synthetic
atacgccatgctgggtctcccagccggagaacttggagtaccggataatgctgtcagtgcatggatcccagcacagtgggatgattgtgaacgacacaggacatgaaactgacgaaaacacgtacttgggagtcggccat

SEQ ID NO: 3582 - DNA, 140 bp, Artificial Sequence
  Synthetic
atggccgactcccaagtacgtgttttcgtcagtttcatgtcctgtgtcgttcacaatcatcccactgtgctgggatccatgcactgacagcattatccggtactccaagttctccggctgggagacccagcatggcgtat

SEQ ID NO: 3583 - DNA, 140 bp, Artificial Sequence
  Synthetic
atacgccatgctgggtctcctttctcagatctgtattacctgaccatgaacaataagcattggttggtgcacttagagtggtttcatgacatcccactaccttggcatgctggtgcagaccgtacttgggagtcggccat

SEQ ID NO: 3584 - DNA, 140 bp, Artificial Sequence
  Synthetic
atggccgactcccaagtacggtctgcaccagcatgccaaggtagtgggatgtcatgaaaccactctaagtgcaccaaccaatgcttattgttcatggtcaggtaatacagatctgagaaaggagacccagcatggcgtat

SEQ ID NO: 3585 - DNA, 140 bp, Artificial Sequence
  Synthetic
atacgccatgctgggtctccggacatgcagaccctgaccccagttggaaggcttataacggcaaatcccatcataactgagagcactgaaaactcgagaatgatgttggagctggacccacgtacttgggagtcggccat

SEQ ID NO: 3586 - DNA, 140 bp, Artificial Sequence
  Synthetic
atggccgactcccaagtacgtgggtccagctccaacatcattctcgagttttcagtgctctcagttatgatgggatttgccgttataagccttccaactggggtcagggtctgcatgtccggagacccagcatggcgtat

SEQ ID NO: 3587 - DNA, 140 bp, Artificial Sequence
  Synthetic
aggccctggctgctgatatgcatgcagaccctgaccccagttggaaggcttataacggcaaatcccatcataactgagagcactgaaaactcgagaatgatgttggagctggacccaaccgaccttttgggacagcggtg

SEQ ID NO: 3588 - DNA, 140 bp, Artificial Sequence
  Synthetic
caccgctgtcccaaaaggtcggttgggtccagctccaacatcattctcgagttttcagtgctctcagttatgatgggatttgccgttataagccttccaactggggtcagggtctgcatgcatatcagcagccagggcct

SEQ ID NO: 3589 - DNA, 140 bp, Artificial Sequence
  Synthetic
aggccctggctgctgatatggcacagtgggatgattgtgaacgacacaggacatgaaactgacgaaaacagagcaaaagtcgaggtaacacccaattcaccaagagctacagcaaccttggaccttttgggacagcggtg

SEQ ID NO: 3590 - DNA, 140 bp, Artificial Sequence
  Synthetic
caccgctgtcccaaaaggtccaaggttgctgtagctcttggtgaattgggtgttacctcgacttttgctctgttttcgtcagtttcatgtcctgtgtcgttcacaatcatcccactgtgccatatcagcagccagggcct

SEQ ID NO: 3591 - DNA, 140 bp, Artificial Sequence
  Synthetic
atacgccatgctgggtctccgagcaaaagtcgaggaaacacccaattcaccaagagcagaagcaaccttgggaggttttggaagcttgggacttgactgtgagccaaggacaggtcttgacgtacttgggagtcggccat

SEQ ID NO: 3592 - DNA, 140 bp, Artificial Sequence
  Synthetic
atggccgactcccaagtacgtcaagacctgtccttggctcacagtcaagtcccaagcttccaaaacctcccaaggttgcttctgctcttggtgaattgggtgtttcctcgacttttgctcggagacccagcatggcgtat

SEQ ID NO: 3593 - DNA, 140 bp, Artificial Sequence; identical to SEQ ID NO: 3559
  Synthetic

SEQ ID NO: 3594 - DNA, 140 bp, Artificial Sequence; identical to SEQ ID NO: 3560
  Synthetic

SEQ ID NO: 3595 - DNA, 140 bp, Artificial Sequence
  Synthetic
atacgccatgctgggtctccgagcaaaagtcgaggcaacacccaattcaccaagagcagaagcaaccttgggaggttttggaagcttgggacttgactgtgagccaaggacaggtcttgacgtacttgggagtcggccat

SEQ ID NO: 3596 - DNA, 140 bp, Artificial Sequence
  Synthetic
atggccgactcccaagtacgtcaagacctgtccttggctcacagtcaagtcccaagcttccaaaacctcccaaggttgcttctgctcttggtgaattgggtgttgcctcgacttttgctcggagacccagcatggcgtat

SEQ ID NO: 3597 - DNA, 140 bp, Artificial Sequence
  Synthetic
atacgccatgctgggtctccgagcaaaagtcgagggaacacccaattcaccaagagcagaagcaaccttgggaggttttggaagcttgggacttgactgtgagccaaggacaggtcttgacgtacttgggagtcggccat

SEQ ID NO: 3598 - DNA, 140 bp, Artificial Sequence
  Synthetic
atggccgactcccaagtacgtcaagacctgtccttggctcacagtcaagtcccaagcttccaaaacctcccaaggttgcttctgctcttggtgaattgggtgttccctcgacttttgctcggagacccagcatggcgtat

SEQ ID NO: 3599 - DNA, 140 bp, Artificial Sequence
  Synthetic
atacgccatgctgggtctccgttctcagatctgtattacctgaccatgaacaataagcattggttggtgcacattgagtggtttcatgacatcccactaccttggcatgctggtgcagaccgtacttgggagtcggccat

SEQ ID NO: 3600 - DNA, 140 bp, Artificial Sequence
  Synthetic
atggccgactcccaagtacggtctgcaccagcatgccaaggtagtgggatgtcatgaaaccactcaatgtgcaccaaccaatgcttattgttcatggtcaggtaatacagatctgagaacggagacccagcatggcgtat

SEQ ID NO: 3601 - DNA, 140 bp, Artificial Sequence
  Synthetic
atacgccatgctgggtctcccctggaactccacactggaacaacaaagaggcattggtggagtttaaggatgctcacgccaagaggcaaactgttgtggttctggggagccaagaaggagcgtacttgggagtcggccat

SEQ ID NO: 3602 - DNA, 140 bp, Artificial Sequence
  Synthetic
atggccgactcccaagtacgctccttcttggctccccagaaccacaacagtttgcctcttggcgtgagcatccttaaactccaccaatgcctctttgttgttccagtgtggagttccaggggagacccagcatggcgtat

SEQ ID NO: 3603 - DNA, 140 bp, Artificial Sequence
  Synthetic
atacgccatgctgggtctccctgttcacacggccctcgctggagctctggaggctgcgatggatggcgcaaacggaaggctatctcctggccatttgaaatgccgtctaaaaatggacaacgtacttgggagtcggccat

SEQ ID NO: 3604 - DNA, 140 bp, Artificial Sequence
  Synthetic
atggccgactcccaagtacgttgtccatttttagacggcatttcaaatggccaggagatagccttccgtttgcgccatccatcgcagcctccagagctccagcgagggccgtgtgaacagggagacccagcatggcgtat

SEQ ID NO: 3605 - DNA, 140 bp, Artificial Sequence
  Synthetic
aggccctggctgctgatatgaacggaaggctatctcctggccatttgaaatgccgtctaaaaatggacaagcttaggctgaagggtgtatcatattccctgtgtgccgcagcgttcacatgaccttttgggacagcggtg

SEQ ID NO: 3606 - DNA, 140 bp, Artificial Sequence
  Synthetic
caccgctgtcccaaaaggtcatgtgaacgctgcggcacacagggaatatgatacacccttcagcctaagcttgtccatttttagacggcatttcaaatggccaggagatagccttccgttcatatcagcagccagggcct

SEQ ID NO: 3607 - DNA, 140 bp, Artificial Sequence
  Synthetic
aggccctggctgctgatatgggaggttttggaagcttgggacttgactgtgaaccaaggacaggccttgacttctcagatctgtattacctgaccatgaacaacaagcattggttggtgcgaccttttgggacagcggtg

SEQ ID NO: 3608 - DNA, 140 bp, Artificial Sequence
  Synthetic
caccgctgtcccaaaaggtcgcaccaaccaatgcttgttgttcatggtcaggtaatacagatctgagaagtcaaggcctgtccttggttcacagtcaagtcccaagcttccaaaacctcccatatcagcagccagggcct

SEQ ID NO: 3609 - DNA, 140 bp, Artificial Sequence
  Synthetic
aggccctggctgctgatatgactggaactccacactggaacaacaaagaggcattggtggagttcaaggacgcccacgccaagaggcaaactgttgtggttctggggagccaagagggaggaccttttgggacagcggtg

SEQ ID NO: 3610 - DNA, 140 bp, Artificial Sequence
  Synthetic
caccgctgtcccaaaaggtcctccctcttggctccccagaaccacaacagtttgcctcttggcgtgggcgtccttgaactccaccaatgcctctttgttgttccagtgtggagttccagtcatatcagcagccagggcct

SEQ ID NO: 3611 - DNA, 140 bp, Artificial Sequence
  Synthetic
atacgccatgctgggtctccgcttaggttgaagggtgtgtcatattccctgtgtactgcagcgttcacattcaccaaggtcccagctgaaacattgcatggaacagttacagtggaggtgcgtacttgggagtcggccat

SEQ ID NO: 3612 - DNA, 140 bp, Artificial Sequence
  Synthetic
atggccgactcccaagtacgcacctccactgtaactgttccatgcaatgtttcagctgggaccttggtgaatgtgaacgctgcagtacacagggaatatgacacacccttcaacctaagcggagacccagcatggcgtat

SEQ ID NO: 3613 - DNA, 140 bp, Artificial Sequence
  Synthetic
atacgccatgctgggtctcccagccggagaacttggagtaccggataatgctgtcagtgcatggctcccagcatagcgggatgattgtcaatgatataggacatgaaactgacgaaaacacgtacttgggagtcggccat

SEQ ID NO: 3614 - DNA, 140 bp, Artificial Sequence
  Synthetic
atggccgactcccaagtacgtgttttcgtcagtttcatgtcctatatcattgacaatcatcccgctatgctgggagccatgcactgacagcattatccggtactccaagttctccggctgggagacccagcatggcgtat

SEQ ID NO: 3615 - DNA, 140 bp, Artificial Sequence
  Synthetic
atacgccatgctgggtctcctcaccggagaatctggagtatcggataatgctatcagtgcatggctcccagcatagcgggatgattgtcaatgatataggacatgaaactgacgaaaacacgtacttgggagtcggccat

SEQ ID NO: 3616 - DNA, 140 bp, Artificial Sequence
  Synthetic
atggccgactcccaagtacgtgttttcgtcagtttcatgtcctatatcattgacaatcatcccgctatgctgggagccatgcactgatagcattatccgatactccagattctccggtgaggagacccagcatggcgtat

SEQ ID NO: 3617 - DNA, 140 bp, Artificial Sequence
  Synthetic
aggccctggctgctgatatgcatgcagaccctgaccccagttggaaggctgataaccgccaaccccgtgattactgaaagcactaagaactcaaagatgatgttggagcttgacccaccagaccttttgggacagcggtg

SEQ ID NO: 3618 - DNA, 140 bp, Artificial Sequence
  Synthetic
caccgctgtcccaaaaggtctggtgggtcaagctccaacatcatctttgagttcttagtgctttcagtaatcacggggttggcggttatcagccttccaactggggtcagggtctgcatgcatatcagcagccagggcct

SEQ ID NO: 3619 - DNA, 140 bp, Artificial Sequence
  Synthetic
atacgccatgctgggtctcctcaccggaaaatctggagtatcggataatgctatcagtgcatggctcccagcatagcgggatgattgtcaatgatataggacatgaaactgacgaaaacacgtacttgggagtcggccat

SEQ ID NO: 3620 - DNA, 140 bp, Artificial Sequence
  Synthetic
atggccgactcccaagtacgtgttttcgtcagtttcatgtcctatatcattgacaatcatcccgctatgctgggagccatgcactgatagcattatccgatactccagattttccggtgaggagacccagcatggcgtat

SEQ ID NO: 3621 - DNA, 140 bp, Artificial Sequence
  Synthetic
aggccctggctgctgatatgcagccggagaacctggagtatcggataatgctatcagtgcatggctcccagcacagtgggatgattgttaatgatgaaaacagagcaaaggtcgaggttagaccttttgggacagcggtg

SEQ ID NO: 3622 - DNA, 140 bp, Artificial Sequence
  Synthetic
caccgctgtcccaaaaggtctaacctcgacctttgctctgttttcatcattaacaatcatcccactgtgctgggagccatgcactgatagcattatccgatactccaggttctccggctgcatatcagcagccagggcct

SEQ ID NO: 3623 - DNA, 140 bp, Artificial Sequence
  Synthetic
atacgccatgctgggtctccctggagctctagaggctgagatggatggtgcaaagggaaggctatcctctggccacttgaaatgtcgcttaaaaatggacaagcttagattggagggcgtcgtacttgggagtcggccat

SEQ ID NO: 3624 - DNA, 140 bp, Artificial Sequence
  Synthetic
atggccgactcccaagtacgacgccctccaatctaagcttgtccatttttaagcgacatttcaagtggccagaggatagccttccctttgcaccatccatctcagcctctagagctccagggagacccagcatggcgtat

SEQ ID NO: 3625 - DNA, 140 bp, Artificial Sequence
  Synthetic
atacgccatgctgggtctccgtcatattccttgtgcaccgcggcattcacattcaccaaggttccggctgaaacactacatggaacagtcacagtggaggtgcagtatgcagggacagatcgtacttgggagtcggccat

SEQ ID NO: 3626 - DNA, 140 bp, Artificial Sequence
  Synthetic
atggccgactcccaagtacgatctgtccctgcatactgcacctccactgtgactgttccatgtagtgtttcagccggaaccttggtgaatgtgaatgccgcggtgcacaaggaatatgacggagacccagcatggcgtat

SEQ ID NO: 3627 - DNA, 140 bp, Artificial Sequence
  Synthetic
atacgccatgctgggtctcccatgcagaccttgaccccagtcggaaggctgataaccgccaaccccgtgattactgaaagcactgagaattcaaagatgatgttggagctcgacccaccacgtacttgggagtcggccat

SEQ ID NO: 3628 - DNA, 140 bp, Artificial Sequence
  Synthetic
atggccgactcccaagtacgtggtgggtcgagctccaacatcatctttgaattctcagtgctttcagtaatcacggggttggcggttatcagccttccgactggggtcaaggtctgcatgggagacccagcatggcgtat

SEQ ID NO: 3629 - DNA, 140 bp, Artificial Sequence
  Synthetic
aggccctggctgctgatatgcagccggagaacttggagtaccggataatgctatcagtgcatggatcccagcacagtgggatgattgtgaatgacacaggacatgagactgacgaaaacagaccttttgggacagcggtg

SEQ ID NO: 3630 - DNA, 140 bp, Artificial Sequence
  Synthetic
caccgctgtcccaaaaggtctgttttcgtcagtctcatgtcctgtgtcattcacaatcatcccactgtgctgggatccatgcactgatagcattatccggtactccaagttctccggctgcatatcagcagccagggcct

SEQ ID NO: 3631 - DNA, 140 bp, Artificial Sequence
  Synthetic
atacgccatgctgggtctcccttctcagatctgtattacctgaccatgaacaataagcattggttggtgcacaaggagtggtttcatgacatcccattaccttggcacgctggtgcagaccgtacttgggagtcggccat

SEQ ID NO: 3632 - DNA, 140 bp, Artificial Sequence
  Synthetic
atggccgactcccaagtacggtctgcaccagcgtgccaaggtaatgggatgtcatgaaaccactccttgtgcaccaaccaatgcttattgttcatggtcaggtaatacagatctgagaagggagacccagcatggcgtat

SEQ ID NO: 3633 - DNA, 140 bp, Artificial Sequence
  Synthetic
aggccctggctgctgatatgactggaactccacactggaacaacaaagaggcattggtggagttcaaggacgcccatgccaagaggcaaactgttgtggttctggggagccaagagggaggaccttttgggacagcggtg

SEQ ID NO: 3634 - DNA, 140 bp, Artificial Sequence
  Synthetic
caccgctgtcccaaaaggtcctccctcttggctccccagaaccacaacagtttgcctcttggcatgggcgtccttgaactccaccaatgcctctttgttgttccagtgtggagttccagtcatatcagcagccagggcct

SEQ ID NO: 3635 - DNA, 140 bp, Artificial Sequence
  Synthetic
atacgccatgctgggtctccgcttaggttgaagggtgtgtcatattccctgtgtaccgcagcgttcacatttaccaaggtcccagctgaaacattgcatggaacagtcacagtggaggtgcgtacttgggagtcggccat

SEQ ID NO: 3636 - DNA, 140 bp, Artificial Sequence
  Synthetic
atggccgactcccaagtacgcacctccactgtgactgttccatgcaatgtttcagctgggaccttggtaaatgtgaacgctgcggtacacagggaatatgacacacccttcaacctaagcggagacccagcatggcgtat

SEQ ID NO: 3637 - DNA, 140 bp, Artificial Sequence
  Synthetic
atacgccatgctgggtctcccatgcagaccctgaccccagttggaaggctgataaccgccaatcctgtgatcactgaaagtactgagaattcaaagatgatgttggagctcgacccaccacgtacttgggagtcggccat

SEQ ID NO: 3638 - DNA, 140 bp, Artificial Sequence
  Synthetic
atggccgactcccaagtacgtggtgggtcgagctccaacatcatctttgaattctcagtactttcagtgatcacaggattggcggttatcagccttccaactggggtcagggtctgcatgggagacccagcatggcgtat

SEQ ID NO: 3639 - DNA, 140 bp, Artificial Sequence
  Synthetic
aggccctggctgctgatatgcagccggagaacttggagtaccggataatgctatcagtgcatggatcccagcacagtgggatgattgtgaatgacataggacatgagactgacgaaaacagaccttttgggacagcggtg

SEQ ID NO: 3640 - DNA, 140 bp, Artificial Sequence
  Synthetic
caccgctgtcccaaaaggtctgttttcgtcagtctcatgtcctatgtcattcacaatcatcccactgtgctgggatccatgcactgatagcattatccggtactccaagttctccggctgcatatcagcagccagggcct

SEQ ID NO: 3641 - DNA, 140 bp, Artificial Sequence
  Synthetic
aggccctggctgctgatatgcagccggagaatttggagtaccggataatgctatcagtgcatggatcccagcacagtgggatgattgtgaatgacacaggacatgagactgacgaaaacagaccttttgggacagcggtg

SEQ ID NO: 3642 - DNA, 140 bp, Artificial Sequence
  Synthetic
caccgctgtcccaaaaggtctgttttcgtcagtctcatgtcctgtgtcattcacaatcatcccactgtgctgggatccatgcactgatagcattatccggtactccaaattctccggctgcatatcagcagccagggcct

SEQ ID NO: 3643 - DNA, 140 bp, Artificial Sequence
  Synthetic
aggccctggctgctgatatgcagccggagaacttggagtaccggataatgctatcagtgcatggatcccagcacagtgggatgattgtgaatgacataggacatgaaactgacgaaaacagaccttttgggacagcggtg

SEQ ID NO: 3644 - DNA, 140 bp, Artificial Sequence
  Synthetic
caccgctgtcccaaaaggtctgttttcgtcagtttcatgtcctatgtcattcacaatcatcccactgtgctgggatccatgcactgatagcattatccggtactccaagttctccggctgcatatcagcagccagggcct

SEQ ID NO: 3645 - DNA, 140 bp, Artificial Sequence
  Synthetic
aggccctggctgctgatatggagcaaaagtcgaggtcacacccaactcaccaagagcagaagcaaccttgggaagttttggaagcttgggacttgactgtgaaccaaggacaggcctcgagaccttttgggacagcggtg

SEQ ID NO: 3646 - DNA, 140 bp, Artificial Sequence
  Synthetic
caccgctgtcccaaaaggtctcgaggcctgtccttggttcacagtcaagtcccaagcttccaaaacttcccaaggttgcttctgctcttggtgagttgggtgtgacctcgacttttgctccatatcagcagccagggcct

SEQ ID NO: 3647 - DNA, 140 bp, Artificial Sequence
  Synthetic
aggccctggctgctgatatgcttctcagatctgtattacctgaccatgaacaataagcattggttggtgcacaaggagtggtttcatgacatcccattaccttggcatgctggcgcagacgaccttttgggacagcggtg

SEQ ID NO: 3648 - DNA, 140 bp, Artificial Sequence
  Synthetic
caccgctgtcccaaaaggtcgtctgcgccagcatgccaaggtaatgggatgtcatgaaaccactccttgtgcaccaaccaatgcttattgttcatggtcaggtaatacagatctgagaagcatatcagcagccagggcct

SEQ ID NO: 3649 - DNA, 140 bp, Artificial Sequence
  Synthetic
aggccctggctgctgatatgactggaactccacactggaacaacaaagaggcattggtggagcttaaggacgcccacgccaagaggcaaactgttgtggttctggggagccaagagggaggaccttttgggacagcggtg

SEQ ID NO: 3650 - DNA, 140 bp, Artificial Sequence
  Synthetic
caccgctgtcccaaaaggtcctccctcttggctccccagaaccacaacagtttgcctcttggcgtgggcgtccttaagctccaccaatgcctctttgttgttccagtgtggagttccagtcatatcagcagccagggcct

SEQ ID NO: 3651 - DNA, 140 bp, Artificial Sequence
  Synthetic
aggccctggctgctgatatgcatgcagaccctgaccccagttggaaggctgataaccgccaaccctgtgatcactgaaagtactgagaattcaaagatgatgttggagctcgacccaccagaccttttgggacagcggtg

SEQ ID NO: 3652 - DNA, 140 bp, Artificial Sequence
  Synthetic
caccgctgtcccaaaaggtctggtgggtcgagctccaacatcatctttgaattctcagtactttcagtgatcacagggttggcggttatcagccttccaactggggtcagggtctgcatgcatatcagcagccagggcct

SEQ ID NO: 3653 - DNA, 140 bp, Artificial Sequence
  Synthetic
atacgccatgctgggtctccgagcaaaggtcgaggtcacacccaattcaccaagagcagaagcaaccttgggaggttttggaagcttgggacttgattgtgaaccaaggacaggccttgacgtacttgggagtcggccat

SEQ ID NO: 3654 - DNA, 140 bp, Artificial Sequence
  Synthetic
atggccgactcccaagtacgtcaaggcctgtccttggttcacaatcaagtcccaagcttccaaaacctcccaaggttgcttctgctcttggtgaattgggtgtgacctcgacctttgctcggagacccagcatggcgtat

SEQ ID NO: 3655 - DNA, 140 bp, Artificial Sequence
  Synthetic
aggccctggctgctgatatgggaggttttggaagcttgggacttgattgtgaaccaaggacaggccttgacttctcagatctatattacctgaccatgaacaataagcattggttggtgcgaccttttgggacagcggtg

SEQ ID NO: 3656 - DNA, 140 bp, Artificial Sequence
  Synthetic
caccgctgtcccaaaaggtcgcaccaaccaatgcttattgttcatggtcaggtaatatagatctgagaagtcaaggcctgtccttggttcacaatcaagtcccaagcttccaaaacctcccatatcagcagccagggcct

SEQ ID NO: 3657 - DNA, 140 bp, Artificial Sequence
  Synthetic
atacgccatgctgggtctccgcttaggttgaagggtgtgtcatattccctgtgtaccgcagcgttcacatttaccaaggtcccagctgaaacactgcatggaacagttacagtggaggtgcgtacttgggagtcggccat

SEQ ID NO: 3658 - DNA, 140 bp, Artificial Sequence
  Synthetic
atggccgactcccaagtacgcacctccactgtaactgttccatgcagtgtttcagctgggaccttggtaaatgtgaacgctgcggtacacagggaatatgacacacccttcaacctaagcggagacccagcatggcgtat

SEQ ID NO: 3659 - DNA, 140 bp, Artificial Sequence
  Synthetic
atacgccatgctgggtctcccatgcagaccctgaccccagttggaaggctgataaccgccaaccctgtgatcactgaaagcactgagaattcaaggatgatgttggaactcgacccaccacgtacttgggagtcggccat

SEQ ID NO: 3660 - DNA, 140 bp, Artificial Sequence
  Synthetic
atggccgactcccaagtacgtggtgggtcgagttccaacatcatccttgaattctcagtgctttcagtgatcacagggttggcggttatcagccttccaactggggtcagggtctgcatgggagacccagcatggcgtat

SEQ ID NO: 3661 - DNA, 140 bp, Artificial Sequence
  Synthetic
atacgccatgctgggtctcccaaccggaaaatctggagtatcggataatgctatcagtgcatggcacccagcatagcgggatgattgtcaatgatataggacatgaaactgacgaaaacacgtacttgggagtcggccat

SEQ ID NO: 3662 - DNA, 140 bp, Artificial Sequence
  Synthetic
atggccgactcccaagtacgtgttttcgtcagtttcatgtcctatatcattgacaatcatcccgctatgctgggtgccatgcactgatagcattatccgatactccagattttccggttgggagacccagcatggcgtat

SEQ ID NO: 3663 - DNA, 140 bp, Artificial Sequence
  Synthetic
atacgccatgctgggtctcccagtatgtagggacagatggaccctgcaaggtcccagcccagatggcggtagacatgcagaccctgaccccagttggaaggctgataaccgccaaccctgcgtacttgggagtcggccat

SEQ ID NO: 3664 - DNA, 140 bp, Artificial Sequence
  Synthetic
atggccgactcccaagtacgcagggttggcggttatcagccttccaactggggtcagggtctgcatgtctaccgccatctgggctgggaccttgcagggtccatctgtccctacatactgggagacccagcatggcgtat

SEQ ID NO: 3665 - DNA, 140 bp, Artificial Sequence
  Synthetic
atacgccatgctgggtctcccagccggagaacttggagtaccggataatgctatcagtgcgtggatcccagcacagtgggatgattgtgaatgacacaggacatgaaactgacgaaaacacgtacttgggagtcggccat

SEQ ID NO: 3666 - DNA, 140 bp, Artificial Sequence
  Synthetic
atggccgactcccaagtacgtgttttcgtcagtttcatgtcctgtgtcattcacaatcatcccactgtgctgggatccacgcactgatagcattatccggtactccaagttctccggctgggagacccagcatggcgtat

SEQ ID NO: 3667 - DNA, 140 bp, Artificial Sequence
  Synthetic
aggccctggctgctgatatgcatgcagactctgaccccagttggaaggctgataaccgccaaccctgtgatcactgaaagtactgagaattcaaagatgatgttggaacttgacccaccagaccttttgggacagcggtg

SEQ ID NO: 3668 - DNA, 140 bp, Artificial Sequence
  Synthetic
caccgctgtcccaaaaggtctggtgggtcaagttccaacatcatctttgaattctcagtactttcagtgatcacagggttggcggttatcagccttccaactggggtcagagtctgcatgcatatcagcagccagggcct

SEQ ID NO: 3669 - DNA, 140 bp, Artificial Sequence
  Synthetic
atacgccatgctgggtctcccagccggagaacttggagtaccggataatgctatcagtgcatggatcccagcacagtgggatgattgtgaatgacacaggacatgaaactgacgaaaacacgtacttgggagtcggccat

SEQ ID NO: 3670 - DNA, 140 bp, Artificial Sequence
  Synthetic
atggccgactcccaagtacgtgttttcgtcagtttcatgtcctgtgtcattcacaatcatcccactgtgctgggatccatgcactgatagcattatccggtactccaagttctccggctgggagacccagcatggcgtat

SEQ ID NO: 3671 - DNA, 140 bp, Artificial Sequence
  Synthetic
atacgccatgctgggtctcctcaccagagaatttggagtacagaattatgctgtcagtgcacggctcccaacacagcgggatgattgtgaatgacataggacatgagaccgatgaaaacacgtacttgggagtcggccat

SEQ ID NO: 3672 - DNA, 140 bp, Artificial Sequence
  Synthetic
atggccgactcccaagtacgtgttttcatcggtctcatgtcctatgtcattcacaatcatcccgctgtgttgggagccgtgcactgacagcataattctgtactccaaattctctggtgaggagacccagcatggcgtat

SEQ ID NO: 3673 - DNA, 140 bp, Artificial Sequence
  Synthetic
atacgccatgctgggtctccgagcaaaagtggaggtcacaccaaactcaccaagagctgaagcgaccctagggggcttcgggagtttgggactcgattgtgagccaaggaccggtttagacgtacttgggagtcggccat

SEQ ID NO: 3674 - DNA, 140 bp, Artificial Sequence
  Synthetic
atggccgactcccaagtacgtctaaaccggtccttggctcacaatcgagtcccaaactcccgaagccccctagggtcgcttcagctcttggtgagtttggtgtgacctccacttttgctcggagacccagcatggcgtat

SEQ ID NO: 3675 - DNA, 140 bp, Artificial Sequence
  Synthetic
aggccctggctgctgatatgggatatgcagactcttaccccagtgggaaggttgataacggcaaatcccatcataactgagagcactgaaaactcgagaatgatgttggagctggacccagaccttttgggacagcggtg

SEQ ID NO: 3676 - DNA, 140 bp, Artificial Sequence
  Synthetic
caccgctgtcccaaaaggtctgggtccagctccaacatcattctcgagttttcagtgctctcagttatgatgggatttgccgttatcaaccttcccactggggtaagagtctgcatatcccatatcagcagccagggcct

SEQ ID NO: 3677 - DNA, 140 bp, Artificial Sequence
  Synthetic
aggccctggctgctgatatgtatgcagactcttaccccagtgggaaggttgataacggcaaatcccatcataactgagagcactgaaaactcgagaatgatgttggagctggacccacccgaccttttgggacagcggtg

SEQ ID NO: 3678 - DNA, 140 bp, Artificial Sequence
  Synthetic
caccgctgtcccaaaaggtcgggtgggtccagctccaacatcattctcgagttttcagtgctctcagttatgatgggatttgccgttatcaaccttcccactggggtaagagtctgcatacatatcagcagccagggcct

SEQ ID NO: 3679 - DNA, 140 bp, Artificial Sequence
  Synthetic
atacgccatgctgggtctcccaaccagagaatttggagtacagaattatgctgtcagtgcacggctcccaacacagcgggatgattgtgaatgacataggacatgagaccgatgaaaacacgtacttgggagtcggccat

SEQ ID NO: 3680 - DNA, 140 bp, Artificial Sequence
  Synthetic
atggccgactcccaagtacgtgttttcatcggtctcatgtcctatgtcattcacaatcatcccgctgtgttgggagccgtgcactgacagcataattctgtactccaaattctctggttgggagacccagcatggcgtat

SEQ ID NO: 3681 - DNA, 140 bp, Artificial Sequence
  Synthetic
atacgccatgctgggtctcctcaccagagaatttggagtacagaattatgctgtcagtgcacggctcccaacacagcgggattattgtgaatgacataggacatgagaccgatgaaaacacgtacttgggagtcggccat

SEQ ID NO: 3682 - DNA, 140 bp, Artificial Sequence
  Synthetic
atggccgactcccaagtacgtgttttcatcggtctcatgtcctatgtcattcacaataatcccgctgtgttgggagccgtgcactgacagcataattctgtactccaaattctctggtgaggagacccagcatggcgtat

SEQ ID NO: 3683 - DNA, 140 bp, Artificial Sequence
  Synthetic
aggccctggctgctgatatgtatgcagactcttaccccagtgggaaggttgataacggcaaatcccgtgataacagagagcactgaaaactcgagaatgactttggagctggacccaaccgaccttttgggacagcggtg

SEQ ID NO: 3684 - DNA, 140 bp, Artificial Sequence
  Synthetic
caccgctgtcccaaaaggtcggttgggtccagctccaaagtcattctcgagttttcagtgctctctgttatcacgggatttgccgttatcaaccttcccactggggtaagagtctgcatacatatcagcagccagggcct

SEQ ID NO: 3685 - DNA, 140 bp, Artificial Sequence
  Synthetic
aggccctggctgctgatatgtatgcagactcttaccccagtgggaaggttgataacggcaaatcccgtgataactgagagcactgaaaactcgagaatgactttggagctggacccaaccgaccttttgggacagcggtg

SEQ ID NO: 3686 - DNA, 140 bp, Artificial Sequence
  Synthetic
caccgctgtcccaaaaggtcggttgggtccagctccaaagtcattctcgagttttcagtgctctcagttatcacgggatttgccgttatcaaccttcccactggggtaagagtctgcatacatatcagcagccagggcct

SEQ ID NO: 3687 - DNA, 140 bp, Artificial Sequence
  Synthetic
aggccctggctgctgatatgtatgcagactcttaccccagtgggaaggttgataacggcaaatcccgtgataaccgagagcactgaaaactcgagaatgactttggagctggacccaaccgaccttttgggacagcggtg

SEQ ID NO: 3688 - DNA, 140 bp, Artificial Sequence
  Synthetic
caccgctgtcccaaaaggtcggttgggtccagctccaaagtcattctcgagttttcagtgctctcggttatcacgggatttgccgttatcaaccttcccactggggtaagagtctgcatacatatcagcagccagggcct

SEQ ID NO: 3689 - DNA, 140 bp, Artificial Sequence
  Synthetic
aggccctggctgctgatatgtatgcagactcttaccccagtgggaaggttgataacggcaaatcccgtgataacggagagcactgaaaactcgagaatgactttggagctggacccaaccgaccttttgggacagcggtg

SEQ ID NO: 3690 - DNA, 140 bp, Artificial Sequence
  Synthetic
caccgctgtcccaaaaggtcggttgggtccagctccaaagtcattctcgagttttcagtgctctccgttatcacgggatttgccgttatcaaccttcccactggggtaagagtctgcatacatatcagcagccagggcct

SEQ ID NO: 3691 - DNA, 140 bp, Artificial Sequence
  Synthetic
atacgccatgctgggtctcccagccggagaacttggagtaccggataatgctgtcagtgcacggctcccaacacagcgggatgattgtgaatgacataggacatgagaccgatgaaaacacgtacttgggagtcggccat

SEQ ID NO: 3692 - DNA, 140 bp, Artificial Sequence
  Synthetic
atggccgactcccaagtacgtgttttcatcggtctcatgtcctatgtcattcacaatcatcccgctgtgttgggagccgtgcactgacagcattatccggtactccaagttctccggctgggagacccagcatggcgtat

SEQ ID NO: 3693 - DNA, 140 bp, Artificial Sequence
  Synthetic
aggccctggctgctgatatgtatgcagactcttaccccagtgggaaggttgataacggcaaatcccgtgataactgagagcactgaaaactcgagaatgatgttggagctggacccaaccgaccttttgggacagcggtg

SEQ ID NO: 3694 - DNA, 140 bp, Artificial Sequence
  Synthetic
caccgctgtcccaaaaggtcggttgggtccagctccaacatcattctcgagttttcagtgctctcagttatcacgggatttgccgttatcaaccttcccactggggtaagagtctgcatacatatcagcagccagggcct

SEQ ID NO: 3695 - DNA, 140 bp, Artificial Sequence
  Synthetic
atacgccatgctgggtctcctttctccgacctgtactatttaaccatgaacaacaagctttggttggtgcacaaggagtggttccacgacattccattcccatggcacgctggagcggaccgtacttgggagtcggccat

SEQ ID NO: 3696 - DNA, 140 bp, Artificial Sequence
  Synthetic
atggccgactcccaagtacggtccgctccagcgtgccatgggaatggaatgtcgtggaaccactccttgtgcaccaaccaaagcttgttgttcatggttaaatagtacaggtcggagaaaggagacccagcatggcgtat

SEQ ID NO: 3697 - DNA, 140 bp, Artificial Sequence
  Synthetic
aggccctggctgctgatatgtatgcagactcttaccccagtgggaaggttgataacggcaaatcccatcataactgagagcactgaaaactcgagaatgatgttggagctggacccaaccgaccttttgggacagcggtg

SEQ ID NO: 3698 - DNA, 140 bp, Artificial Sequence
  Synthetic
caccgctgtcccaaaaggtcggttgggtccagctccaacatcattctcgagttttcagtgctctcagttatgatgggatttgccgttatcaaccttcccactggggtaagagtctgcatacatatcagcagccagggcct

SEQ ID NO: 3699 - DNA, 140 bp, Artificial Sequence
  Synthetic
atacgccatgctgggtctcccaatggagttgtgatcaagaatgggagctatgttagtgccataacccagggaaaaagggaggaggagactccggttgagtgctttgaaccctcaatgctgcgtacttgggagtcggccat

SEQ ID NO: 3700 - DNA, 140 bp, Artificial Sequence
  Synthetic
atggccgactcccaagtacgcagcattgagggttcaaagcactcaaccggagtctcctcctccctttttccctgggttatggcactaacatagctcccattcttgatcacaactccattgggagacccagcatggcgtat

SEQ ID NO: 3701 - DNA, 140 bp, Artificial Sequence
  Synthetic
atacgccatgctgggtctccaggaagaagcagctaacagtcttggatctgcatccaggagccgggaaaaccaggagggttcttcctgaaatagtccgtgaagccataaagaagagactcccgtacttgggagtcggccat

SEQ ID NO: 3702 - DNA, 140 bp, Artificial Sequence
  Synthetic
atggccgactcccaagtacgggagtctcttctttatggcttcacggactatttcaggaagaaccctcctggttttcccggctcctggatgcagatccaagactgttagctgcttcttcctggagacccagcatggcgtat

SEQ ID NO: 3703 - DNA, 140 bp, Artificial Sequence
  Synthetic
atacgccatgctgggtctccgcacagtgatcttagcaccaaccagggttgttgctgctgagatggaggaagccctgagaggacttccggtgcgttacatgacaacagcagtcaacgtcaccgtacttgggagtcggccat

SEQ ID NO: 3704 - DNA, 140 bp, Artificial Sequence
  Synthetic
atggccgactcccaagtacggtgacgttgactgctgttgtcatgtaacgcaccggaagtcctctcagggcttcctccatctcagcagcaacaaccctggttggtgctaagatcactgtgcggagacccagcatggcgtat

SEQ ID NO: 3705 - DNA, 140 bp, Artificial Sequence
  Synthetic
atacgccatgctgggtctccccattctgggacagagatcgtggatttgatgtgccatgccaccttcacctcacgcctactacaacccatcagagtccccaattacaacctttatatcatgcgtacttgggagtcggccat

SEQ ID NO: 3706 - DNA, 140 bp, Artificial Sequence
  Synthetic
atggccgactcccaagtacgcatgatataaaggttgtaattggggactctgatgggttgtagtaggcgtgaggtgaaggtggcatggcacatcaaatccacgatctctgtcccagaatggggagacccagcatggcgtat

SEQ ID NO: 3707 - DNA, 140 bp, Artificial Sequence
  Synthetic
atacgccatgctgggtctccgatgaggctcatttcacagatccttcaagcatagctgcaagaggatatatatcaacaagggttgaaatgggcgaggcagctgctatcttcatgaccgctacgtacttgggagtcggccat

SEQ ID NO: 3708 - DNA, 140 bp, Artificial Sequence
  Synthetic
atggccgactcccaagtacgtagcggtcatgaagatagcagctgcctcgcccatttcaacccttgttgatatatatcctcttgcagctatgcttgaaggatctgtgaaatgagcctcatcggagacccagcatggcgtat

SEQ ID NO: 3709 - DNA, 140 bp, Artificial Sequence
  Synthetic
atacgccatgctgggtctcccaccaccaggaacccgcgacgcgtttccagattccaactcaccaatcatggacacagaagtggaagtcccagagagggcctggagctcaggctttgactgcgtacttgggagtcggccat

SEQ ID NO: 3710 - DNA, 140 bp, Artificial Sequence
  Synthetic
atggccgactcccaagtacgcagtcaaagcctgagctccaggccctctctgggacttccacttctgtgtccatgattggtgagttggaatctggaaacgcgtcgcgggttcctggtggtgggagacccagcatggcgtat

SEQ ID NO: 3711 - DNA, 140 bp, Artificial Sequence
  Synthetic
atacgccatgctgggtctccggtgacggaccattctggaaaaacaatttggtttgttccaagcgtgaggaatggaaatgaaatcgcagcctgtctgacaaaggcgggaaagcgggttatacgtacttgggagtcggccat

SEQ ID NO: 3712 - DNA, 140 bp, Artificial Sequence
  Synthetic
atggccgactcccaagtacgtataacccgctttcccgcctttgtcagacaggctgcgatttcatttccattcctcacgcttggaacaaaccaaattgtttttccagaatggtccgtcaccggagacccagcatggcgtat

SEQ ID NO: 3713 - DNA, 140 bp, Artificial Sequence
  Synthetic
aggccctggctgctgatatgtctgacaaaggcgggaaagcgggttatacagctcagcaggaaaacttttgagacagagtttcagaagacaaaaaatcaagagtgggactttgtcataacagaccttttgggacagcggtg

SEQ ID NO: 3714 - DNA, 140 bp, Artificial Sequence
  Synthetic
caccgctgtcccaaaaggtctgttatgacaaagtcccactcttgattttttgtcttctgaaactctgtctcaaaagttttcctgctgagctgtataacccgctttcccgcctttgtcagacatatcagcagccagggcct

SEQ ID NO: 3715 - DNA, 140 bp, Artificial Sequence
  Synthetic
atacgccatgctgggtctcccacgtgctccaagaaaatgacagggaagagcatccagtcggagaacttggagtaccagataatgctatcagtgcatggatcccagcacagtgggatgattcgtacttgggagtcggccat

SEQ ID NO: 3716 - DNA, 140 bp, Artificial Sequence
  Synthetic
atggccgactcccaagtacgaatcatcccactgtgctgggatccatgcactgatagcattatctggtactccaagttctccgactggatgctcttccctgtcattttcttggagcacgtgggagacccagcatggcgtat

SEQ ID NO: 3717 - DNA, 140 bp, Artificial Sequence
  Synthetic
atacgccatgctgggtctccgtgaatgacacaggacatgaaactgacgaaagcagagcaaaagtcgaggttacacccaattcaccaagagcagaagcaaccttgggaggttttggaagctcgtacttgggagtcggccat

SEQ ID NO: 3718 - DNA, 140 bp, Artificial Sequence
  Synthetic
atggccgactcccaagtacgagcttccaaaacctcccaaggttgcttctgctcttggtgaattgggtgtaacctcgacttttgctctgctttcgtcagtttcatgtcctgtgtcattcacggagacccagcatggcgtat

SEQ ID NO: 3719 - DNA, 140 bp, Artificial Sequence
  Synthetic
atacgccatgctgggtctcctgggacttgattgtgaaccaaggacaggccttgacttttcagatctgtattacctgaccatgaataacaagcattggttggtgcacaaagagtggtttcacgtacttgggagtcggccat

SEQ ID NO: 3720 - DNA, 140 bp, Artificial Sequence
  Synthetic
atggccgactcccaagtacgtgaaaccactctttgtgcaccaaccaatgcttgttattcatggtcaggtaatacagatctgaaaagtcaaggcctgtccttggttcacaatcaagtcccaggagacccagcatggcgtat

SEQ ID NO: 3721 - DNA, 140 bp, Artificial Sequence
  Synthetic
atacgccatgctgggtctcccgacattccattaccttggcatgctggtgcagacactggaactccacactggaacaataaagaggcattggtggagttcaaggacgcccacgctaagaggcgtacttgggagtcggccat

SEQ ID NO: 3722 - DNA, 140 bp, Artificial Sequence
  Synthetic
atggccgactcccaagtacgcctcttagcgtgggcgtccttgaactccaccaatgcctctttattgttccagtgtggagttccagtgtctgcaccagcatgccaaggtaatggaatgtcgggagacccagcatggcgtat

SEQ ID NO: 3723 - DNA, 140 bp, Artificial Sequence
  Synthetic
atacgccatgctgggtctcccagactgttgtggttctggggagccaggaaggagctgttcacacggctctcgctggagctctagaggctgagatggatggtgcaaaaggaaggctattctcgtacttgggagtcggccat

SEQ ID NO: 3724 - DNA, 140 bp, Artificial Sequence
  Synthetic
atggccgactcccaagtacgagaatagccttccttttgcaccatccatctcagcctctagagctccagcgagagccgtgtgaacagctccttcctggctccccagaaccacaacagtctgggagacccagcatggcgtat

SEQ ID NO: 3725 - DNA, 140 bp, Artificial Sequence
  Synthetic
aggccctggctgctgatatgcgctggagctctagaggctgagatggatggtgcaaaaggaaggctattctctggccatttgaaatgccgcctaaaaatggacaagcttagattgaagggtgaccttttgggacagcggtg

SEQ ID NO: 3726 - DNA, 140 bp, Artificial Sequence
  Synthetic
caccgctgtcccaaaaggtcacccttcaatctaagcttgtccatttttaggcggcatttcaaatggccagagaatagccttccttttgcaccatccatctcagcctctagagctccagcgcatatcagcagccagggcct

SEQ ID NO: 3727 - DNA, 140 bp, Artificial Sequence
  Synthetic
atacgccatgctgggtctccgtgtcatattccctgtgtaccgcagcgttcacattcaccaaggtcccagctgaaacattgcatggaacagtcacagtggaggtgcagtatgcagggacagcgtacttgggagtcggccat

SEQ ID NO: 3728 - DNA, 140 bp, Artificial Sequence
  Synthetic
atggccgactcccaagtacgctgtccctgcatactgcacctccactgtgactgttccatgcaatgtttcagctgggaccttggtgaatgtgaacgctgcggtacacagggaatatgacacggagacccagcatggcgtat

SEQ ID NO: 3729 - DNA, 140 bp, Artificial Sequence
  Synthetic
atacgccatgctgggtctccatgggccctgcaaggttccagcccaaatggcggtggacatgcagaccctgaccccagtcggaaggctgatcaccgccaaccccgtgattactgaaagcaccgtacttgggagtcggccat

SEQ ID NO: 3730 - DNA, 140 bp, Artificial Sequence
  Synthetic
atggccgactcccaagtacggtgctttcagtaatcacggggttggcggtgatcagccttccgactggggtcagggtctgcatgtccaccgccatttgggctggaaccttgcagggcccatggagacccagcatggcgtat

SEQ ID NO: 3731 - DNA, 140 bp, Artificial Sequence
  Synthetic
aggccctggctgctgatatgtgaaagcactgagaattcaaagatgatgttggagctcgacccaccatttggggactcttacattgtcataggagttggggacaagaaaatcacccatcacgaccttttgggacagcggtg

SEQ ID NO: 3732 - DNA, 140 bp, Artificial Sequence
  Synthetic
caccgctgtcccaaaaggtcgtgatgggtgattttcttgtccccaactcctatgacaatgtaagagtccccaaatggtgggtcgagctccaacatcatctttgaattctcagtgctttcacatatcagcagccagggcct

SEQ ID NO: 3733 - DNA, 140 bp, Artificial Sequence
  Synthetic
aggccctggctgctgatatgacctggttagaatcaagagaatacacaaagcacttgattagagtcgaaaattggatattcaggaaccctggcttcgcgttagcagcagctgccatcgcttgaccttttgggacagcggtg

SEQ ID NO: 3734 - DNA, 140 bp, Artificial Sequence
  Synthetic
caccgctgtcccaaaaggtcaagcgatggcagctgctgctaacgcgaagccagggttcctgaatatccaattttcgactctaatcaagtgctttgtgtattctcttgattctaaccaggtcatatcagcagccagggcct

SEQ ID NO: 3735 - DNA, 140 bp, Artificial Sequence
  Synthetic
aggccctggctgctgatatgtatcagacatggcttcggacagccgctgcccaacacaaggtgaagcctaccttgacaagcaatcagacactcaatatgtctgcaaaagaacgttagtggagaccttttgggacagcggtg

SEQ ID NO: 3736 - DNA, 140 bp, Artificial Sequence
  Synthetic
caccgctgtcccaaaaggtctccactaacgttcttttgcagacatattgagtgtctgattgcttgtcaaggtaggcttcaccttgtgttgggcagcggctgtccgaagccatgtctgatacatatcagcagccagggcct

SEQ ID NO: 3737 - DNA, 140 bp, Artificial Sequence
  Synthetic
aggccctggctgctgatatggtggctaggggctagattcctagagttcgaagcccttggattcttgaacgaggatcactggatggggagagagaattcagggggtggtgttgaagggctggaccttttgggacagcggtg

SEQ ID NO: 3738 - DNA, 140 bp, Artificial Sequence
  Synthetic
caccgctgtcccaaaaggtccagcccttcaacaccaccccctgaattctctctccccatccagtgatcctcgttcaagaatccaagggcttcgaactctaggaatctagcccctagccaccatatcagcagccagggcct

SEQ ID NO: 3739 - DNA, 140 bp, Artificial Sequence
  Synthetic
aggccctggctgctgatatgggattacaaagactcggatatgtcctagaagagatgagtcgcataccaggaggaaggatgtatgcagatgatactgctggctgggacacccgcatcagcagaccttttgggacagcggtg

SEQ ID NO: 3740 - DNA, 140 bp, Artificial Sequence
  Synthetic
caccgctgtcccaaaaggtctgctgatgcgggtgtcccagccagcagtatcatctgcatacatccttcctcctggtatgcgactcatctcttctaggacatatccgagtctttgtaatcccatatcagcagccagggcct

SEQ ID NO: 3741 - DNA, 140 bp, Artificial Sequence
  Synthetic
aggccctggctgctgatatgattacaaagactcggatatgtcctagaagagatgagtcgcataccaggaggaaggatgtatgcagatgatactgctggctgggacacccgcatcagcagggaccttttgggacagcggtg

SEQ ID NO: 3742 - DNA, 140 bp, Artificial Sequence
  Synthetic
caccgctgtcccaaaaggtccctgctgatgcgggtgtcccagccagcagtatcatctgcatacatccttcctcctggtatgcgactcatctcttctaggacatatccgagtctttgtaatcatatcagcagccagggcct

SEQ ID NO: 3743 - DNA, 140 bp, Artificial Sequence
  Synthetic
atacgccatgctgggtctccatgaaaaacccaaagaagaaatccggaggattccggattgtcaatatgctaaaacgcggagtagcccgtgtgagcccctttgggggcttgaagaggctgccgtacttgggagtcggccat

SEQ ID NO: 3744 - DNA, 140 bp, Artificial Sequence
  Synthetic
atggccgactcccaagtacggcagcctcttcaagcccccaaaggggctcacacgggctactccgcgttttagcatattgacaatccggaatcctccggatttcttctttgggtttttcatggagacccagcatggcgtat

SEQ ID NO: 3745 - DNA, 140 bp, Artificial Sequence
  Synthetic
atacgccatgctgggtctccttaagaaagatctggctgccatgctgagaataatcaatgctaggaaggagaagaagagacgaggcacagatactagtgtcggaattgttggcctcctgctcgtacttgggagtcggccat

SEQ ID NO: 3746 - DNA, 140 bp, Artificial Sequence
  Synthetic
atggccgactcccaagtacgagcaggaggccaacaattccgacactagtatctgtgcctcgtctcttcttctccttcctagcattgattattctcagcatggcagccagatctttcttaaggagacccagcatggcgtat

SEQ ID NO: 3747 - DNA, 140 bp, Artificial Sequence
  Synthetic
atacgccatgctgggtctccgaccacagccatggcagtggaggtcactagacgtgggaatgcatactatatgtacttggacagaagcgatgctggggaggccatatcttttccaaccacacgtacttgggagtcggccat

SEQ ID NO: 3748 - DNA, 140 bp, Artificial Sequence
  Synthetic
atggccgactcccaagtacgtgtggttggaaaagatatggcctccccagcatcgcttctgtccaagtacatatagtatgcattcccacgtctagtgacctccactgccatggctgtggtcggagacccagcatggcgtat

SEQ ID NO: 3749 - DNA, 140 bp, Artificial Sequence
  Synthetic
aggccctggctgctgatatgtgtacttggacagaagcgatgctggggaggccatatcttttccaaccacaatggggatgaataagtgttatatacagatcatggatcttggacacatgtggaccttttgggacagcggtg

SEQ ID NO: 3750 - DNA, 140 bp, Artificial Sequence
  Synthetic
caccgctgtcccaaaaggtccacatgtgtccaagatccatgatctgtatataacacttattcatccccattgtggttggaaaagatatggcctccccagcatcgcttctgtccaagtacacatatcagcagccagggcct

SEQ ID NO: 3751 - DNA, 140 bp, Artificial Sequence
  Synthetic
atacgccatgctgggtctccggttggaatcaagagaatacacaaagcacctgattagagtcgaaaattggatattcaggaaccctggcttcgcgttagcagcagctgccatcgcttggctcgtacttgggagtcggccat

SEQ ID NO: 3752 - DNA, 140 bp, Artificial Sequence
  Synthetic
atggccgactcccaagtacgagccaagcgatggcagctgctgctaacgcgaagccagggttcctgaatatccaattttcgactctaatcaggtgctttgtgtattctcttgattccaaccggagacccagcatggcgtat

SEQ ID NO: 3753 - DNA, 140 bp, Artificial Sequence
  Synthetic
aggccctggctgctgatatggaacgttagtggacagaggctggggaaatggatgtggactttttggcaaagggagcctggtgacatgcgctaagtttgcttgctctaagaaaatgaccgggaccttttgggacagcggtg

SEQ ID NO: 3754 - DNA, 140 bp, Artificial Sequence
  Synthetic
caccgctgtcccaaaaggtcccggtcattttcttagagcaagcaaacttagcgcatgtcaccaggctccctttgccaaaaagtccacatccatttccccagcctctgtccactaacgttccatatcagcagccagggcct

SEQ ID NO: 3755 - DNA, 140 bp, Artificial Sequence
  Synthetic
atacgccatgctgggtctccgaagagcatccagccagagaatctggagtaccggataatgctgtcagttcatggctcccagcacagtgggatgatcgttaatgatacaggacatgaaactcgtacttgggagtcggccat

SEQ ID NO: 3756 - DNA, 140 bp, Artificial Sequence
  Synthetic
atggccgactcccaagtacgagtttcatgtcctgtatcattaacgatcatcccactgtgctgggagccatgaactgacagcattatccggtactccagattctctggctggatgctcttcggagacccagcatggcgtat

SEQ ID NO: 3757 - DNA, 140 bp, Artificial Sequence
  Synthetic
aggccctggctgctgatatgagttcaaggacgcacatgccaaaaggcagactgtcgtggttctagggagtcaagaaggagcagttcacacggcccttgctggagctctggaggctgagatgaccttttgggacagcggtg

SEQ ID NO: 3758 - DNA, 140 bp, Artificial Sequence
  Synthetic
caccgctgtcccaaaaggtcatctcagcctccagagctccagcaagggccgtgtgaactgctccttcttgactccctagaaccacgacagtctgccttttggcatgtgcgtccttgaactcatatcagcagccagggcct

SEQ ID NO: 3759 - DNA, 140 bp, Artificial Sequence
  Synthetic
atacgccatgctgggtctccgcgttcacattcactaagatcccggctgaaacactgcacgggacagtcacagtggaggtacagtacgcagggacagatggaccttgcaaggttccagctccgtacttgggagtcggccat

SEQ ID NO: 3760 - DNA, 140 bp, Artificial Sequence
  Synthetic
atggccgactcccaagtacggagctggaaccttgcaaggtccatctgtccctgcgtactgtacctccactgtgactgtcccgtgcagtgtttcagccgggatcttagtgaatgtgaacgcggagacccagcatggcgtat

SEQ ID NO: 3761 - DNA, 140 bp, Artificial Sequence
  Synthetic
atacgccatgctgggtctccgctaaccctgtaatcactgaaagcactgagaactccaagatgatgctggaactggatccaccatttggggactcttacattgtcataggagtcggggaaacgtacttgggagtcggccat

SEQ ID NO: 3762 - DNA, 140 bp, Artificial Sequence
  Synthetic
atggccgactcccaagtacgtttccccgactcctatgacaatgtaagagtccccaaatggtggatccagttccagcatcatcttggagttctcagtgctttcagtgattacagggttagcggagacccagcatggcgtat

SEQ ID NO: 3763 - DNA, 140 bp, Artificial Sequence
  Synthetic
aggccctggctgctgatatgtttgaagccactgtgagaggtgccaagagaatggcagtcttgggagacacagcctgggactttggatcagttgggggtgctctcaactcactgggcaagggaccttttgggacagcggtg

SEQ ID NO: 3764 - DNA, 140 bp, Artificial Sequence
  Synthetic
caccgctgtcccaaaaggtcccttgcccagtgagttgagagcacccccaactgatccaaagtcccaggctgtgtctcccaagactgccattctcttggcacctctcacagtggcttcaaacatatcagcagccagggcct

SEQ ID NO: 3765 - DNA, 140 bp, Artificial Sequence
  Synthetic
atacgccatgctgggtctccgaatacaaagaatggatctatttcccttatgtgcttggccttagggggagtgttgatcttcttatccacagccgtctctgctgatgtggggtgctcggtgcgtacttgggagtcggccat

SEQ ID NO: 3766 - DNA, 140 bp, Artificial Sequence
  Synthetic
atggccgactcccaagtacgcaccgagcaccccacatcagcagagacggctgtggataagaagatcaacactccccctaaggccaagcacataagggaaatagatccattctttgtattcggagacccagcatggcgtat

SEQ ID NO: 3767 - DNA, 140 bp, Artificial Sequence
  Synthetic
aggccctggctgctgatatgtgttgatcttcttatccacagccgtctctgctgatgtggggtgctcggtggacttctcaaagaaggaaacgagatgcggtacaggggtgttcgtctataagaccttttgggacagcggtg

SEQ ID NO: 3768 - DNA, 140 bp, Artificial Sequence
  Synthetic
caccgctgtcccaaaaggtcttatagacgaacacccctgtaccgcatctcgtttccttctttgagaagtccaccgagcaccccacatcagcagagacggctgtggataagaagatcaacacatatcagcagccagggcct

SEQ ID NO: 3769 - DNA, 140 bp, Artificial Sequence
  Synthetic
atacgccatgctgggtctcccgacgttgaagcttggagggacaggtacaagtaccatcctgactcccctcgtagattggcagcagcagtcaagcaagcctgggaagatgggatctgtgggcgtacttgggagtcggccat

SEQ ID NO: 3770 - DNA, 140 bp, Artificial Sequence
  Synthetic
atggccgactcccaagtacgcccacagatcccatcttcccaggcttgcttgactgctgctgccaatctacgaggggagtcaggatggtacttgtacctgtccctccaagcttcaacgtcgggagacccagcatggcgtat

SEQ ID NO: 3771 - DNA, 140 bp, Artificial Sequence
  Synthetic
atacgccatgctgggtctcccctgtgaacgagctgccccatggctggaaggcttgggggaaatcgtacttcgtcagggcagcaaagacaaataacagctttgtcgtggatggtgacacaccgtacttgggagtcggccat

SEQ ID NO: 3772 - DNA, 140 bp, Artificial Sequence
  Synthetic
atggccgactcccaagtacggtgtgtcaccatccacgacaaagctgttatttgtctttgctgccctgacgaagtacgatttcccccaagccttccagccatggggcagctcgttcacaggggagacccagcatggcgtat

SEQ ID NO: 3773 - DNA, 140 bp, Artificial Sequence
  Synthetic
aggccctggctgctgatatgagattattcattagagtgtgatccagccgtcattggaacagccgctaagggaaaggaggctgtgcacagtgatctaggctactggattgagagtgagaaggaccttttgggacagcggtg

SEQ ID NO: 3774 - DNA, 140 bp, Artificial Sequence
  Synthetic
caccgctgtcccaaaaggtccttctcactctcaatccagtagcctagatcactgtgcacagcctcctttcccttagcggctgttccaatgacggctggatcacactctaatgaataatctcatatcagcagccagggcct

SEQ ID NO: 3775 - DNA, 140 bp, Artificial Sequence
  Synthetic
atacgccatgctgggtctccgaaaggaggctgtgcacagtgatctaggctactggattgagagtgagaagaacgacacatggaggctgaagagggcccacctgatcgagatgaaaacatgcgtacttgggagtcggccat

SEQ ID NO: 3776 - DNA, 140 bp, Artificial Sequence
  Synthetic
atggccgactcccaagtacgcatgttttcatctcgatcaggtgggccctcttcagcctccatgtgtcgttcttctcactctcaatccagtagcctagatcactgtgcacagcctcctttcggagacccagcatggcgtat

SEQ ID NO: 3777 - DNA, 140 bp, Artificial Sequence
  Synthetic
aggccctggctgctgatatgatctgatcatacccaagtctttagctgggccactcagccatcacaacaccagagagggctacaggacccaaatgaaagggccatggcatagtgaagagctgaccttttgggacagcggtg

SEQ ID NO: 3778 - DNA, 140 bp, Artificial Sequence
  Synthetic
caccgctgtcccaaaaggtcagctcttcactatgccatggccctttcatttgggtcctgtagccctctctggtgttgtgatggctgagtggcccagctaaagacttgggtatgatcagatcatatcagcagccagggcct

SEQ ID NO: 3779 - DNA, 140 bp, Artificial Sequence
  Synthetic
atacgccatgctgggtctccccgggctaaagatggttgttggtatggaatggagataaggcccaggaaagaaccagaaagtaacttagtaaggtcaatggtgactgcaggatcaactgatcgtacttgggagtcggccat

SEQ ID NO: 3780 - DNA, 140 bp, Artificial Sequence
  Synthetic
atggccgactcccaagtacgatcagttgatcctgcagtcaccattgaccttactaagttactttctggttctttcctgggccttatctccattccataccaacaaccatctttagcccggggagacccagcatggcgtat

SEQ ID NO: 3781 - DNA, 140 bp, Artificial Sequence
  Synthetic
atacgccatgctgggtctcccacatggatcacttctcccttggagtgcttgtgattctgctcatggtacaggaagggctaaagaagagaatgaccacaaagatcatcataagcacatcaacgtacttgggagtcggccat

SEQ ID NO: 3782 - DNA, 140 bp, Artificial Sequence
  Synthetic
atggccgactcccaagtacgttgatgtgcttatgatgatctttgtggtcattctcttctttagcccttcctgtaccatgagcagaatcacaagcactccaagggagaagtgatccatgtgggagacccagcatggcgtat

SEQ ID NO: 3783 - DNA, 140 bp, Artificial Sequence
  Synthetic
aggccctggctgctgatatggctaagcttgcaattttgatgggtgccaccttcgcggaaatgaacactggaggagatgttgctcatctggcgctgatagcggcattcaaagtcagacctggaccttttgggacagcggtg

SEQ ID NO: 3784 - DNA, 140 bp, Artificial Sequence
  Synthetic
caccgctgtcccaaaaggtccaggtctgactttgaatgccgctatcagcgccagatgagcaacatctcctccagtgttcatttccgcgaaggtggcacccatcaaaattgcaagcttagccatatcagcagccagggcct

SEQ ID NO: 3785 - DNA, 140 bp, Artificial Sequence
  Synthetic
atacgccatgctgggtctcccgttgctggtatctttcattttcagagctaattggacaccccgtgagagcatgctgctggccttggcctcgtgtcttctgcaaactgcgatctccgccttcgtacttgggagtcggccat

SEQ ID NO: 3786 - DNA, 140 bp, Artificial Sequence
  Synthetic
atggccgactcccaagtacgaaggcggagatcgcagtttgcagaagacacgaggccaaggccagcagcatgctctcacggggtgtccaattagctctgaaaatgaaagataccagcaacgggagacccagcatggcgtat

SEQ ID NO: 3787 - DNA, 140 bp, Artificial Sequence
  Synthetic
atacgccatgctgggtctccggaaggcgacctgatggttcccatcaatggttttgctttggcctggttggcaatacgagcgatggttgttccacgcactgacaacatcaccttggcaatccgtacttgggagtcggccat

SEQ ID NO: 3788 - DNA, 140 bp, Artificial Sequence
  Synthetic
atggccgactcccaagtacggattgccaaggtgatgttgtcagtgcgtggaacaaccatcgctcgtattgccaaccaggccaaagcaaaaccattgatgggaaccatcaggtcgccttccggagacccagcatggcgtat

SEQ ID NO: 3789 - DNA, 140 bp, Artificial Sequence
  Synthetic
atacgccatgctgggtctccctggctgctctgacaccactggcccggggcacactgcttgtggcgtggagagcaggccttgctacttgcggggggttcatgctcctttctctgaaggggacgtacttgggagtcggccat

SEQ ID NO: 3790 - DNA, 140 bp, Artificial Sequence
  Synthetic
atggccgactcccaagtacgtccccttcagagaaaggagcatgaaccccccgcaagtagcaaggcctgctctccacgccacaagcagtgtgccccgggccagtggtgtcagagcagccagggagacccagcatggcgtat

SEQ ID NO: 3791 - DNA, 140 bp, Artificial Sequence
  Synthetic
atacgccatgctgggtctccaggaaagagtgtggacatgtacattgaaagagcaggtgacatcacatgggaaaaagatgcggaagtcactggaaacagtccccggctcgatgtggcactacgtacttgggagtcggccat

SEQ ID NO: 3792 - DNA, 140 bp, Artificial Sequence
  Synthetic
atggccgactcccaagtacgtagtgccacatcgagccggggactgtttccagtgacttccgcatctttttcccatgtgatgtcacctgctctttcaatgtacatgtccacactctttcctggagacccagcatggcgtat

SEQ ID NO: 3793 - DNA, 140 bp, Artificial Sequence; identical to SEQ ID NO: 2219
  Synthetic

SEQ ID NO: 3794 - DNA, 140 bp, Artificial Sequence; identical to SEQ ID NO: 2220
  Synthetic

SEQ ID NO: 3795 - DNA, 140 bp, Artificial Sequence
  Synthetic
atacgccatgctgggtctccgatgagagtggtgatttctccctagtggaggatgatggtccccccatgagagagatcatactcaaagtggtcctgatgtccatctgtggcatgaacccaacgtacttgggagtcggccat

SEQ ID NO: 3796 - DNA, 140 bp, Artificial Sequence
  Synthetic
atggccgactcccaagtacgttgggttcatgccacagatggacatcaggaccactttgagtatgatctctctcatggggggaccatcatcctccactagggagaaatcaccactctcatcggagacccagcatggcgtat

SEQ ID NO: 3797 - DNA, 140 bp, Artificial Sequence
  Synthetic
atacgccatgctgggtctccgatgagagtggtgatttctccctagtggaggatgatggtccccccatgagagagatcatactcaaagtggtcctgatgcccatctgtggcatgaacccaacgtacttgggagtcggccat

SEQ ID NO: 3798 - DNA, 140 bp, Artificial Sequence
  Synthetic
atggccgactcccaagtacgttgggttcatgccacagatgggcatcaggaccactttgagtatgatctctctcatggggggaccatcatcctccactagggagaaatcaccactctcatcggagacccagcatggcgtat

SEQ ID NO: 3799 - DNA, 140 bp, Artificial Sequence
  Synthetic
atacgccatgctgggtctccgatgagagtggtgatttctccctagtggaggatgatggtccccccatgagagagatcatactcaaagtggtcctgatggccatctgtggcatgaacccaacgtacttgggagtcggccat

SEQ ID NO: 3800 - DNA, 140 bp, Artificial Sequence
  Synthetic
atggccgactcccaagtacgttgggttcatgccacagatggccatcaggaccactttgagtatgatctctctcatggggggaccatcatcctccactagggagaaatcaccactctcatcggagacccagcatggcgtat

SEQ ID NO: 3801 - DNA, 140 bp, Artificial Sequence
  Synthetic
atacgccatgctgggtctccatttaagacaaaggatggggacattggagcagttgcgctggactacccagcaggaacttcaggatctccaatcctagataagtgtgggagagtgataggacgtacttgggagtcggccat

SEQ ID NO: 3802 - DNA, 140 bp, Artificial Sequence
  Synthetic
atggccgactcccaagtacgtcctatcactctcccacacttatctaggattggagatcctgaagttcctgctgggtagtccagcgcaactgctccaatgtccccatcctttgtcttaaatggagacccagcatggcgtat

SEQ ID NO: 3803 - DNA, 140 bp, Artificial Sequence
  Synthetic
aggccctggctgctgatatgcaggaacttcaggatctccaatcctagataagtgtgggagagtgataggactctatggtaatggggtcgtgatcaaaaatgggagttacgttagtgccatgaccttttgggacagcggtg

SEQ ID NO: 3804 - DNA, 140 bp, Artificial Sequence
  Synthetic
caccgctgtcccaaaaggtcatggcactaacgtaactcccatttttgatcacgaccccattaccatagagtcctatcactctcccacacttatctaggattggagatcctgaagttcctgcatatcagcagccagggcct

SEQ ID NO: 3805 - DNA, 140 bp, Artificial Sequence
  Synthetic
atacgccatgctgggtctccgggaaaaccaggagagttcttcctgaaatagtccgtgaagccataaaaacaagactccgcactgtgatcttagctccaaccagggttgtcgctgctgaaacgtacttgggagtcggccat

SEQ ID NO: 3806 - DNA, 140 bp, Artificial Sequence
  Synthetic
atggccgactcccaagtacgtttcagcagcgacaaccctggttggagctaagatcacagtgcggagtcttgtttttatggcttcacggactatttcaggaagaactctcctggttttcccggagacccagcatggcgtat

SEQ ID NO: 3807 - DNA, 140 bp, Artificial Sequence
  Synthetic
aggccctggctgctgatatgggatacatttcaacaagggttgagatgggcgaggcggctgccatcttcatgactgccacgccaccaggaacccgtgacgcattcccggactccaactcacgaccttttgggacagcggtg

SEQ ID NO: 3808 - DNA, 140 bp, Artificial Sequence
  Synthetic
caccgctgtcccaaaaggtcgtgagttggagtccgggaatgcgtcacgggttcctggtggcgtggcagtcatgaagatggcagccgcctcgcccatctcaacccttgttgaaatgtatcccatatcagcagccagggcct

SEQ ID NO: 3809 - DNA, 140 bp, Artificial Sequence
  Synthetic
aggccctggctgctgatatgtttgattgggtgacggatcattctggaaaaacagtttggtttgttccaagcgtgaggaatggcaatgagatcgcagcttgtctgacaaaggctggaaaacgaccttttgggacagcggtg

SEQ ID NO: 3810 - DNA, 140 bp, Artificial Sequence
  Synthetic
caccgctgtcccaaaaggtcgttttccagcctttgtcagacaagctgcgatctcattgccattcctcacgcttggaacaaaccaaactgtttttccagaatgatccgtcacccaatcaaacatatcagcagccagggcct

SEQ ID NO: 3811 - DNA, 140 bp, Artificial Sequence
  Synthetic
aggccctggctgctgatatgacacatgccagcgctgcccagaggagggggcgcataggcaggaaccccaacaaacctggagatgagtatctgtatggaggtgggtgcgcagagactgatggaccttttgggacagcggtg

SEQ ID NO: 3812 - DNA, 140 bp, Artificial Sequence
  Synthetic
caccgctgtcccaaaaggtccatcagtctctgcgcacccacctccatacagatactcatctccaggtttgttggggttcctgcctatgcgccccctcctctgggcagcgctggcatgtgtcatatcagcagccagggcct

SEQ ID NO: 3813 - DNA, 140 bp, Artificial Sequence
  Synthetic
atacgccatgctgggtctccgaaaagaggagcggcctttggagtgatggaagccctgggaacactgccaggacatatgacagagagattccaggaggccattgacaacctcgctgtgctccgtacttgggagtcggccat

SEQ ID NO: 3814 - DNA, 140 bp, Artificial Sequence
  Synthetic
atggccgactcccaagtacggagcacagcgaggttgtcaatggcctcctggaatctctctgtcatatgtcctggcagtgttcccagggcttccatcactccaaaggccgctcctcttttcggagacccagcatggcgtat

SEQ ID NO: 3815 - DNA, 140 bp, Artificial Sequence
  Synthetic
atacgccatgctgggtctccatgcgggcagagactggaagcaggccctacaaagccgcggcggcccaattaccggagaccctagagactatcatgcttttggggttgctgggaacagtctcgtacttgggagtcggccat

SEQ ID NO: 3816 - DNA, 140 bp, Artificial Sequence
  Synthetic
atggccgactcccaagtacgagactgttcccagcaaccccaaaagcatgatagtctctagggtctccggtaattgggccgccgcggctttgtagggcctgcttccagtctctgcccgcatggagacccagcatggcgtat

SEQ ID NO: 3817 - DNA, 140 bp, Artificial Sequence
  Synthetic
atacgccatgctgggtctcccgctgggaatctttttcgtcttgatgcggaacaagggcatagggaagatgggctttggaatggtgactcttggggccagcgcatggcttatgtggctctccgtacttgggagtcggccat

SEQ ID NO: 3818 - DNA, 140 bp, Artificial Sequence
  Synthetic
atggccgactcccaagtacggagagccacataagccatgcgctggccccaagagtcaccattccaaagcccatcttccctatgcccttgttccgcatcaagacgaaaaagattcccagcgggagacccagcatggcgtat

SEQ ID NO: 3819 - DNA, 140 bp, Artificial Sequence
  Synthetic
aggccctggctgctgatatgaaccaaatggcaatcatcatcatggtagcagtgggtcttctgggcttgattaccgccaatgaactcggatggttggagagaacaaagagtgacctaagccgaccttttgggacagcggtg

SEQ ID NO: 3820 - DNA, 140 bp, Artificial Sequence
  Synthetic
caccgctgtcccaaaaggtcggcttaggtcactctttgttctctccaaccatccgagttcattggcggtaatcaagcccagaagacccactgctaccatgatgatgattgccatttggttcatatcagcagccagggcct

SEQ ID NO: 3821 - DNA, 140 bp, Artificial Sequence
  Synthetic
atacgccatgctgggtctccatctaatgggaaggagagaggagggggcaacaataggattctcaatggacattgacctgcggccagcctcagcttgggctatctatgctgctctgacaaccgtacttgggagtcggccat

SEQ ID NO: 3822 - DNA, 140 bp, Artificial Sequence
  Synthetic
atggccgactcccaagtacggttgtcagagcagcatagatagcccaagctgaggctggccgcaggtcaatgtccattgagaatcctattgttgccccctcctctctccttcccattagatggagacccagcatggcgtat

SEQ ID NO: 3823 - DNA, 140 bp, Artificial Sequence
  Synthetic
atacgccatgctgggtctccatctaatgggaaggagagaggagggggcaactataggattctcaatggacattgacctgcggccagcctcagcttgggctatctatgctgctctgacaaccgtacttgggagtcggccat

SEQ ID NO: 3824 - DNA, 140 bp, Artificial Sequence
  Synthetic
atggccgactcccaagtacggttgtcagagcagcatagatagcccaagctgaggctggccgcaggtcaatgtccattgagaatcctatagttgccccctcctctctccttcccattagatggagacccagcatggcgtat

SEQ ID NO: 3825 - DNA, 140 bp, Artificial Sequence
  Synthetic
atacgccatgctgggtctccatctaatgggaaggagagaggagggggcaaccataggattctcaatggacattgacctgcggccagcctcagcttgggctatctatgctgctctgacaaccgtacttgggagtcggccat

SEQ ID NO: 3826 - DNA, 140 bp, Artificial Sequence
  Synthetic
atggccgactcccaagtacggttgtcagagcagcatagatagcccaagctgaggctggccgcaggtcaatgtccattgagaatcctatggttgccccctcctctctccttcccattagatggagacccagcatggcgtat

SEQ ID NO: 3827 - DNA, 140 bp, Artificial Sequence
  Synthetic
atacgccatgctgggtctccatctaatgggaaggagagaggagggggcaacgataggattctcaatggacattgacctgcggccagcctcagcttgggctatctatgctgctctgacaaccgtacttgggagtcggccat

SEQ ID NO: 3828 - DNA, 140 bp, Artificial Sequence
  Synthetic
atggccgactcccaagtacggttgtcagagcagcatagatagcccaagctgaggctggccgcaggtcaatgtccattgagaatcctatcgttgccccctcctctctccttcccattagatggagacccagcatggcgtat

SEQ ID NO: 3829 - DNA, 140 bp, Artificial Sequence
  Synthetic
atacgccatgctgggtctcctttcattaccccagccgtccaacatgcagtgaccacttcatacaacaactactccttaatggcgatggccacgcaagctggagtgttgttcggtatgggtcgtacttgggagtcggccat

SEQ ID NO: 3830 - DNA, 140 bp, Artificial Sequence
  Synthetic
atggccgactcccaagtacgacccataccgaacaacactccagcttgcgtggccatcgccattaaggagtagttgttgtatgaagtggtcactgcatgttggacggctggggtaatgaaaggagacccagcatggcgtat

SEQ ID NO: 3831 - DNA, 140 bp, Artificial Sequence
  Synthetic
aggccctggctgctgatatgactccttaatggcgatggccacgcaagctggagtgttgttcggtatgggtaaagggatgccattctatgcatgggactttggagtcccgctgctaatgatgaccttttgggacagcggtg

SEQ ID NO: 3832 - DNA, 140 bp, Artificial Sequence
  Synthetic
caccgctgtcccaaaaggtcatcattagcagcgggactccaaagtcccatgcatagaatggcatccctttacccataccgaacaacactccagcttgcgtggccatcgccattaaggagtcatatcagcagccagggcct

SEQ ID NO: 3833 - DNA, 140 bp, Artificial Sequence
  Synthetic
aggccctggctgctgatatgtgtggatggaatagtggtgactgacattgacacaatgacaattgacccccaagtggagaaaaagatgggacaggtgctactcatagcagtagctgtctccgaccttttgggacagcggtg

SEQ ID NO: 3834 - DNA, 140 bp, Artificial Sequence
  Synthetic
caccgctgtcccaaaaggtcggagacagctactgctatgagtagcacctgtcccatctttttctccacttgggggtcaattgtcattgtgtcaatgtcagtcaccactattccatccacacatatcagcagccagggcct

SEQ ID NO: 3835 - DNA, 140 bp, Artificial Sequence
  Synthetic
atacgccatgctgggtctccagcgccatactgtcgcggaccgcctgggggtggggtgaggctggggccctgatcacagctgcaacttccactttgtgggagggctctccgaacaagtactcgtacttgggagtcggccat

SEQ ID NO: 3836 - DNA, 140 bp, Artificial Sequence
  Synthetic
atggccgactcccaagtacgagtacttgttcggagagccctcccacaaagtggaagttgcagctgtgatcagggccccagcctcaccccacccccaggcggtccgcgacagtatggcgctggagacccagcatggcgtat

SEQ ID NO: 3837 - DNA, 140 bp, Artificial Sequence
  Synthetic
aggccctggctgctgatatggatcacagctgcaacttccactttgtgggagggctctccgaacaagtactggaactcctccacagccacctcactgtgtaacatttttaggggaagctacgaccttttgggacagcggtg

SEQ ID NO: 3838 - DNA, 140 bp, Artificial Sequence
  Synthetic
caccgctgtcccaaaaggtcgtagcttcccctaaaaatgttacacagtgaggtggctgtggaggagttccagtacttgttcggagagccctcccacaaagtggaagttgcagctgtgatccatatcagcagccagggcct

SEQ ID NO: 3839 - DNA, 140 bp, Artificial Sequence
  Synthetic
aggccctggctgctgatatgggcatcaccgaggtgtgcagagaagaggcccgccgcgccctcaaggacggtgtggcaacgggaggccacgctgtgtcccgaggaagtgcaaagctgagatgaccttttgggacagcggtg

SEQ ID NO: 3840 - DNA, 140 bp, Artificial Sequence
  Synthetic
caccgctgtcccaaaaggtcatctcagctttgcacttcctcgggacacagcgtggcctcccgttgccacaccgtccttgagggcgcggcgggcctcttctctgcacacctcggtgatgcccatatcagcagccagggcct

SEQ ID NO: 3841 - DNA, 140 bp, Artificial Sequence
  Synthetic
atacgccatgctgggtctccggttggtggagaggggatacctgcagccctatggaaaggtcattgatcttggatgtggcagagggggctggagttactatgccgccaccatccgcaaagtcgtacttgggagtcggccat

SEQ ID NO: 3842 - DNA, 140 bp, Artificial Sequence
  Synthetic
atggccgactcccaagtacgactttgcggatggtggcggcatagtaactccagccccctctgccacatccaagatcaatgacctttccatagggctgcaggtatcccctctccaccaaccggagacccagcatggcgtat

SEQ ID NO: 3843 - DNA, 140 bp, Artificial Sequence
  Synthetic
atacgccatgctgggtctccaaaagtgtgtccaccacgagccagctccttttggggcgcatggacgggcccaggaggccagtgaaatatgaagaggatgtgaatctcggctctggcacgccgtacttgggagtcggccat

SEQ ID NO: 3844 - DNA, 140 bp, Artificial Sequence
  Synthetic
atggccgactcccaagtacggcgtgccagagccgagattcacatcctcttcatatttcactggcctcctgggcccgtccatgcgccccaaaaggagctggctcgtggtggacacacttttggagacccagcatggcgtat

SEQ ID NO: 3845 - DNA, 140 bp, Artificial Sequence
  Synthetic
atacgccatgctgggtctccgaaccacccatataggacatgggcttaccatggaagctacgaggcccccacacaagggtcagcgtcctctctaataaacggggttgtcaggctcctgtcacgtacttgggagtcggccat

SEQ ID NO: 3846 - DNA, 140 bp, Artificial Sequence
  Synthetic
atggccgactcccaagtacgtgacaggagcctgacaaccccgtttattagagaggacgctgacccttgtgtgggggcctcgtagcttccatggtaagcccatgtcctatatgggtggttcggagacccagcatggcgtat

SEQ ID NO: 3847 - DNA, 140 bp, Artificial Sequence
  Synthetic
aggccctggctgctgatatgtggttgtggaaagagttaggcaaacacaaacggccacgagtctgtaccaaagaagagttcatcaacaaggttcgtagcaacgcagcattaggggcaatatgaccttttgggacagcggtg

SEQ ID NO: 3848 - DNA, 140 bp, Artificial Sequence
  Synthetic
caccgctgtcccaaaaggtcatattgcccctaatgctgcgttgctacgaaccttgttgatgaactcttctttggtacagactcgtggccgtttgtgtttgcctaactctttccacaaccacatatcagcagccagggcct

SEQ ID NO: 3849 - DNA, 140 bp, Artificial Sequence
  Synthetic
atacgccatgctgggtctccgggaatttggaaaggccaagggcagccgcgccatctggtacatgtggctaggggctagatttctagagttcgaagcccttggattcttgaacgaggatcacgtacttgggagtcggccat

SEQ ID NO: 3850 - DNA, 140 bp, Artificial Sequence
  Synthetic
atggccgactcccaagtacgtgatcctcgttcaagaatccaagggcttcgaactctagaaatctagcccctagccacatgtaccagatggcgcggctgcccttggcctttccaaattcccggagacccagcatggcgtat

SEQ ID NO: 3851 - DNA, 140 bp, Artificial Sequence
  Synthetic
atacgccatgctgggtctccctggatggggagagagaattcaggaggtggtgttgaagggctaggattacaaagactcggatatgtcttagaagagatgagtcgcataccaggaggaaggcgtacttgggagtcggccat

SEQ ID NO: 3852 - DNA, 140 bp, Artificial Sequence
  Synthetic
atggccgactcccaagtacgccttcctcctggtatgcgactcatctcttctaagacatatccgagtctttgtaatcctagcccttcaacaccacctcctgaattctctctccccatccagggagacccagcatggcgtat

SEQ ID NO: 3853 - DNA, 140 bp, Artificial Sequence
  Synthetic
atacgccatgctgggtctccttaccaacctagtggtgcagctcattcggaatatggaggctgaggaagttctagagatgcaagacttgtggctgctgcggaggtcagagaaagtgaccaacgtacttgggagtcggccat

SEQ ID NO: 3854 - DNA, 140 bp, Artificial Sequence
  Synthetic
atggccgactcccaagtacgttggtcactttctctgacctccgcagcagccacaagtcttgcatctctagaacttcctcagcctccatattccgaatgagctgcaccactaggttggtaaggagacccagcatggcgtat

SEQ ID NO: 3855 - DNA, 140 bp, Artificial Sequence
  Synthetic
atacgccatgctgggtctccctggttgcagagcaatggatgggataggctcaaacgaatggcagtcagtggagatgattgcgttgtgaaaccaattgatgataggtttgcacatgctctccgtacttgggagtcggccat

SEQ ID NO: 3856 - DNA, 140 bp, Artificial Sequence
  Synthetic
atggccgactcccaagtacggagagcatgtgcaaacctatcatcaattggtttcacaacgcaatcatctccactgactgccattcgtttgagcctatcccatccattgctctgcaaccagggagacccagcatggcgtat

SEQ ID NO: 3857 - DNA, 140 bp, Artificial Sequence
  Synthetic
atacgccatgctgggtctccaggttcttgaatgatatgggaaaagttaggaaggacacacaagagtggaagccctcaactggatgggacaactgggaagaagttccgttttgctcccacccgtacttgggagtcggccat

SEQ ID NO: 3858 - DNA, 140 bp, Artificial Sequence
  Synthetic
atggccgactcccaagtacgggtgggagcaaaacggaacttcttcccagttgtcccatccagttgagggcttccactcttgtgtgtccttcctaacttttcccatatcattcaagaacctggagacccagcatggcgtat

SEQ ID NO: 3859 - DNA, 140 bp, Artificial Sequence
  Synthetic
atacgccatgctgggtctccacttcaacaagctccatctcaaggacgggaggtccattgtggttccctgccgccaccaagatgaactgattggccgagctcgcgtctcaccgggggcgggcgtacttgggagtcggccat

SEQ ID NO: 3860 - DNA, 140 bp, Artificial Sequence
  Synthetic
atggccgactcccaagtacgcccgcccccggtgagacgcgagctcggccaatcagttcatcttggtggcggcagggaaccacaatggacctcccgtccttgagatggagcttgttgaagtggagacccagcatggcgtat

SEQ ID NO: 3861 - DNA, 140 bp, Artificial Sequence
  Synthetic
aggccctggctgctgatatgccagttacgaaatggacagacattccctatttgggaaaaagggaagacttgtggtgtgggtctctcatagggcacagaccgcgcaccacctgggctgagagaccttttgggacagcggtg

SEQ ID NO: 3862 - DNA, 140 bp, Artificial Sequence
  Synthetic
caccgctgtcccaaaaggtctctcagcccaggtggtgcgcggtctgtgccctatgagagacccacaccacaagtcttccctttttcccaaatagggaatgtctgtccatttcgtaactggcatatcagcagccagggcct

SEQ ID NO: 3863 - DNA, 140 bp, Artificial Sequence
  Synthetic
atacgccatgctgggtctccacattaaaaacacagtcaacatgatgcgtaggatcataggtgatgaagaaaagtacgtggactacctatccacccaagttcgctacttgggcgaagaaggcgtacttgggagtcggccat

SEQ ID NO: 3864 - DNA, 140 bp, Artificial Sequence
  Synthetic
atggccgactcccaagtacgccttcttcgcccaagtagcgaacttgggtggataggtagtccacgtacttttcttcatcacctatgatcctacgcatcatgttgactgtgtttttaatgtggagacccagcatggcgtat

SEQ ID NO: 3865 - DNA, 140 bp, Artificial Sequence
  Synthetic
aggccctggctgctgatatgcatgatgcgtaggatcataggtgatgaagaaaagtacgtggactacctatccacccaagttcgctacttgggcgaagaagggtccacacctggagtgctagaccttttgggacagcggtg

SEQ ID NO: 3866 - DNA, 140 bp, Artificial Sequence
  Synthetic
caccgctgtcccaaaaggtctagcactccaggtgtggacccttcttcgcccaagtagcgaacttgggtggataggtagtccacgtacttttcttcatcacctatgatcctacgcatcatgcatatcagcagccagggcct

SEQ ID NO: 3867 - DNA, 140 bp, Artificial Sequence
  Synthetic
atacgccatgctgggtctccctagccttcttgagattcacagcaatcaagccatcactgggcctcatcaatagatggggttccgtggggaagaaggaggctatggaaataataaaaaagtcgtacttgggagtcggccat

SEQ ID NO: 3868 - DNA, 140 bp, Artificial Sequence
  Synthetic
atggccgactcccaagtacgacttttttattatttccatagcctccttcttccccacggaaccccatctattgatgaggcccagtgatggcttgattgctgtgaatctcaagaaggctagggagacccagcatggcgtat

SEQ ID NO: 3869 - DNA, 140 bp, Artificial Sequence
  Synthetic
atacgccatgctgggtctcctcaagaaagaccttgctgccatgttgagaatcatcaatgctaggaaggagaggaagagacgtggcgctgacaccagcatcggaatcgtcggcctcctgctcgtacttgggagtcggccat

SEQ ID NO: 3870 - DNA, 140 bp, Artificial Sequence
  Synthetic
atggccgactcccaagtacgagcaggaggccgacgattccgatgctggtgtcagcgccacgtctcttcctctccttcctagcattgatgattctcaacatggcagcaaggtctttcttgaggagacccagcatggcgtat

SEQ ID NO: 3871 - DNA, 140 bp, Artificial Sequence
  Synthetic
atacgccatgctgggtctccgaccacagccatggcagccgagatcactagacgtgggagtgcatactacatgtacttggacaggagcgatgctggtaaggccatttcttttgccaccacacgtacttgggagtcggccat

SEQ ID NO: 3872 - DNA, 140 bp, Artificial Sequence
  Synthetic
atggccgactcccaagtacgtgtggtggcaaaagaaatggccttaccagcatcgctcctgtccaagtacatgtagtatgcactcccacgtctagtgatctcggctgccatggctgtggtcggagacccagcatggcgtat

SEQ ID NO: 3873 - DNA, 140 bp, Artificial Sequence
  Synthetic
atacgccatgctgggtctccttgggggtgaacaaatgccatgtacagatcatggacctcgggcacatgtgtgacgccaccatgagttatgagtgccccatgctagacgagggagtggagccgtacttgggagtcggccat

SEQ ID NO: 3874 - DNA, 140 bp, Artificial Sequence
  Synthetic
atggccgactcccaagtacggctccactccctcgtctagcatggggcactcataactcatggtggcgtcacacatgtgcccgaggtccatgatctgtacatggcatttgttcacccccaaggagacccagcatggcgtat

SEQ ID NO: 3875 - DNA, 140 bp, Artificial Sequence
  Synthetic
atacgccatgctgggtctcccagatgacgtcgattgctggtgcaacacgacatcgacttgggttgtgtacggaacctgtcatcataaaaaaggtgaagcacgacgatccagaagagccgtcgtacttgggagtcggccat

SEQ ID NO: 3876 - DNA, 140 bp, Artificial Sequence
  Synthetic
atggccgactcccaagtacgacggctcttctggatcgtcgtgcttcaccttttttatgatgacaggttccgtacacaacccaagtcgatgtcgtgttgcaccagcaatcgacgtcatctgggagacccagcatggcgtat

SEQ ID NO: 3877 - DNA, 140 bp, Artificial Sequence
  Synthetic
atacgccatgctgggtctccgacgcttccttctcactccacgaggaagctgcaaacgcgatcgcagacttggctagagtcaagagaatacacaaagcacctgatcaaggttgaaaattggcgtacttgggagtcggccat

SEQ ID NO: 3878 - DNA, 140 bp, Artificial Sequence
  Synthetic
atggccgactcccaagtacgccaattttcaaccttgatcaggtgctttgtgtattctcttgactctagccaagtctgcgatcgcgtttgcagcttcctcgtggagtgagaaggaagcgtcggagacccagcatggcgtat

SEQ ID NO: 3879 - DNA, 140 bp, Artificial Sequence
  Synthetic
atacgccatgctgggtctccatatttaggaaccccgggtttgcgctagtggctgtagctatagcctggctcctgggaagctcgacgagccaaaaagttatatacttggtcatgatattgtcgtacttgggagtcggccat

SEQ ID NO: 3880 - DNA, 140 bp, Artificial Sequence
  Synthetic
atggccgactcccaagtacgacaatatcatgaccaagtatataactttttggctcgtcgagcttcccaggagccaggctatagctacagccactagcgcaaacccggggttcctaaatatggagacccagcatggcgtat

SEQ ID NO: 3881 - DNA, 140 bp, Artificial Sequence
  Synthetic
atacgccatgctgggtctcctgattgccccggcatacagcattaggtgcataggagttagcaatagagacttcgtggagggcatgtcaggtgggacctgggttgatgttgtcttggaacacgtacttgggagtcggccat

SEQ ID NO: 3882 - DNA, 140 bp, Artificial Sequence
  Synthetic
atggccgactcccaagtacgtgttccaagacaacatcaacccaggtcccacctgacatgccctccacgaagtctctattgctaactcctatgcacctaatgctgtatgccggggcaatcaggagacccagcatggcgtat

SEQ ID NO: 3883 - DNA, 140 bp, Artificial Sequence
  Synthetic
atacgccatgctgggtctcctgggggttgcgtcaccgtgatggcacaggacaagccaacagttgatatcgagttggtcacgacaacggttagcaacatggccgaggtaagatcctactgccgtacttgggagtcggccat

SEQ ID NO: 3884 - DNA, 140 bp, Artificial Sequence
  Synthetic
atggccgactcccaagtacggcagtaggatcttacctcggccatgttgctaaccgttgtcgtgaccaactcgatatcaactgttggcttgtcctgtgccatcacggtgacgcaacccccaggagacccagcatggcgtat

SEQ ID NO: 3885 - DNA, 140 bp, Artificial Sequence
  Synthetic
aggccctggctgctgatatgagttggtcacgacaacggttagcaacatggccgaggtaagatcctactgctatgaggcatcaatatcggacatggcttcggacagccgttgtccaacacagaccttttgggacagcggtg

SEQ ID NO: 3886 - DNA, 140 bp, Artificial Sequence
  Synthetic
caccgctgtcccaaaaggtctgtgttggacaacggctgtccgaagccatgtccgatattgatgcctcatagcagtaggatcttacctcggccatgttgctaaccgttgtcgtgaccaactcatatcagcagccagggcct

SEQ ID NO: 3887 - DNA, 140 bp, Artificial Sequence
  Synthetic
atacgccatgctgggtctccagttcaaggacgcccacgccaagaggcaaactgttgtggttctggggagccaagagggagctgttcatacggccctcgctggagctttggaggctgagatcgtacttgggagtcggccat

SEQ ID NO: 3888 - DNA, 140 bp, Artificial Sequence
  Synthetic
atggccgactcccaagtacgatctcagcctccaaagctccagcgagggccgtatgaacagctccctcttggctccccagaaccacaacagtttgcctcttggcgtgggcgtccttgaactggagacccagcatggcgtat

SEQ ID NO: 3889 - DNA, 140 bp, Artificial Sequence
  Synthetic
atacgccatgctgggtctccagtggaggtgcagtatgcagggacagacggaccctgcaaagtcccagcccagatggcggtggacatgcagaccctgaccccagttggaaggctgataacccgtacttgggagtcggccat

SEQ ID NO: 3890 - DNA, 140 bp, Artificial Sequence
  Synthetic
atggccgactcccaagtacgggttatcagccttccaactggggtcagggtctgcatgtccaccgccatctgggctgggactttgcagggtccgtctgtccctgcatactgcacctccactggagacccagcatggcgtat

SEQ ID NO: 3891 - DNA, 140 bp, Artificial Sequence
  Synthetic
atacgccatgctgggtctccgtattcaccagatctttggagcagctttcaaatcactgtttggaggaatgtcctggttctcacagatcctcataggcacactgttggtgtggttaggtttcgtacttgggagtcggccat

SEQ ID NO: 3892 - DNA, 140 bp, Artificial Sequence
  Synthetic
atggccgactcccaagtacgaaacctaaccacaccaacagtgtgcctatgaggatctgtgagaaccaggacattcctccaaacagtgatttgaaagctgctccaaagatctggtgaatacggagacccagcatggcgtat

SEQ ID NO: 3893 - DNA, 140 bp, Artificial Sequence
  Synthetic
atacgccatgctgggtctccggagcttaatgcaatcctagaggagaatggagttcaactgacagttgtagtggggtctgtaaaaaaccctatgtggagaggtccacagagattgccagtgcgtacttgggagtcggccat

SEQ ID NO: 3894 - DNA, 140 bp, Artificial Sequence
  Synthetic
atggccgactcccaagtacgcactggcaatctctgtggacctctccacatagggttttttacagaccccactacaactgtcagttgaactccattctcctctaggattgcattaagctccggagacccagcatggcgtat

SEQ ID NO: 3895 - DNA, 140 bp, Artificial Sequence
  Synthetic
atacgccatgctgggtctcccctgtgaatgagctgccccatggctggaaagcctgggggaaatcgtactttgtcagagcagcaaagaccaacaacagttttgttgtcgacggtgacacaccgtacttgggagtcggccat

SEQ ID NO: 3896 - DNA, 140 bp, Artificial Sequence
  Synthetic
atggccgactcccaagtacggtgtgtcaccgtcgacaacaaaactgttgttggtctttgctgctctgacaaagtacgatttcccccaggctttccagccatggggcagctcattcacaggggagacccagcatggcgtat

SEQ ID NO: 3897 - DNA, 140 bp, Artificial Sequence
  Synthetic
aggccctggctgctgatatggatcacgggtttgggatcttccacaccagtgtttggctgaaggtcagagaggactactcactagagtgtgacccagccgtcataggaacagctgtcaagggaccttttgggacagcggtg

SEQ ID NO: 3898 - DNA, 140 bp, Artificial Sequence
  Synthetic
caccgctgtcccaaaaggtcccttgacagctgttcctatgacggctgggtcacactctagtgagtagtcctctctgaccttcagccaaacactggtgtggaagatcccaaacccgtgatccatatcagcagccagggcct

SEQ ID NO: 3899 - DNA, 140 bp, Artificial Sequence
  Synthetic
atacgccatgctgggtctccagagagggttacagaactcaattgaaagggccatggcacagtgaagagctcgaaatccggtttgaggagtgcccaggaaccaaggttcacgtggaggagacgtacttgggagtcggccat

SEQ ID NO: 3900 - DNA, 140 bp, Artificial Sequence
  Synthetic
atggccgactcccaagtacgtctcctccacgtgaaccttggttcctgggcactcctcaaaccggatttcgagctcttcactgtgccatggccctttcaattgagttctgtaaccctctctggagacccagcatggcgtat

SEQ ID NO: 3901 - DNA, 140 bp, Artificial Sequence
  Synthetic
aggccctggctgctgatatgcgaaatccggtttgaggagtgcccaggaaccaaggttcacgtggaggagacatgcggaactagaggaccatctctgagatcgactactgcaagtggaagggaccttttgggacagcggtg

SEQ ID NO: 3902 - DNA, 140 bp, Artificial Sequence
  Synthetic
caccgctgtcccaaaaggtcccttccacttgcagtagtcgatctcagagatggtcctctagttccgcatgtctcctccacgtgaaccttggttcctgggcactcctcaaaccggatttcgcatatcagcagccagggcct

SEQ ID NO: 3903 - DNA, 140 bp, Artificial Sequence
  Synthetic
atacgccatgctgggtctccgtcatagaggaatggtgctgtagggaatgcacaatgcctccactatcgttccgggcaaaagacggctgctggtatggaatggagataaggcccagaaaggcgtacttgggagtcggccat

SEQ ID NO: 3904 - DNA, 140 bp, Artificial Sequence
  Synthetic
atggccgactcccaagtacgcctttctgggccttatctccattccataccagcagccgtcttttgcccggaacgatagtggaggcattgtgcattccctacagcaccattcctctatgacggagacccagcatggcgtat

SEQ ID NO: 3905 - DNA, 140 bp, Artificial Sequence
  Synthetic
aggccctggctgctgatatgtggcagtgctggtagccatggtcttgggaggattctcaatgagtgacctggctaagctcgtgatcctgatgggtgccactttcgcagaaatgaacactgggaccttttgggacagcggtg

SEQ ID NO: 3906 - DNA, 140 bp, Artificial Sequence
  Synthetic
caccgctgtcccaaaaggtcccagtgttcatttctgcgaaagtggcacccatcaggatcacgagcttagccaggtcactcattgagaatcctcccaagaccatggctaccagcactgccacatatcagcagccagggcct

SEQ ID NO: 3907 - DNA, 140 bp, Artificial Sequence
  Synthetic
atacgccatgctgggtctccatgctgctagccctggcttcgtgcctcctgcagactgcgatctctgctcttgaaggcgagctgatggtcctcgttaatggatttgctttggcctggttggcgtacttgggagtcggccat

SEQ ID NO: 3908 - DNA, 140 bp, Artificial Sequence
  Synthetic
atggccgactcccaagtacgccaaccaggccaaagcaaatccattaacgaggaccatcagctcgccttcaagagcagagatcgcagtctgcaggaggcacgaagccagggctagcagcatggagacccagcatggcgtat

SEQ ID NO: 3909 - DNA, 140 bp, Artificial Sequence
  Synthetic
aggccctggctgctgatatgtgaaggcgagctgatggtcctcgttaatggatttgctttggcctggttggcaatacgagcaatggccgtgccacgcactgacaatatcgctctggcaattgaccttttgggacagcggtg

SEQ ID NO: 3910 - DNA, 140 bp, Artificial Sequence
  Synthetic
caccgctgtcccaaaaggtcaattgccagagcgatattgtcagtgcgtggcacggccattgctcgtattgccaaccaggccaaagcaaatccattaacgaggaccatcagctcgccttcacatatcagcagccagggcct

SEQ ID NO: 3911 - DNA, 140 bp, Artificial Sequence
  Synthetic
aggccctggctgctgatatggctgtgaggatagtggaccccatcaatgtggtaggactactgttactcacaaggagtggaaaacggagctggcctcctagtgaagtgcttacagctgttggaccttttgggacagcggtg

SEQ ID NO: 3912 - DNA, 140 bp, Artificial Sequence
  Synthetic
caccgctgtcccaaaaggtccaacagctgtaagcacttcactaggaggccagctccgttttccactccttgtgagtaacagtagtcctaccacattgatggggtccactatcctcacagccatatcagcagccagggcct

SEQ ID NO: 3913 - DNA, 140 bp, Artificial Sequence
  Synthetic
atacgccatgctgggtctcccaggaacttcaggatctccaatcctagacaaatgcggaagagtgataggactttatggcaatggggttgtgatcaagaatggaagctatgttagtgcaatcgtacttgggagtcggccat

SEQ ID NO: 3914 - DNA, 140 bp, Artificial Sequence
  Synthetic
atggccgactcccaagtacgattgcactaacatagcttccattcttgatcacaaccccattgccataaagtcctatcactcttccgcatttgtctaggattggagatcctgaagttcctgggagacccagcatggcgtat

SEQ ID NO: 3915 - DNA, 140 bp, Artificial Sequence
  Synthetic
atacgccatgctgggtctccaacccagggaaaaagggaggaggaggctccagttgagtgctttgaaccttcgatgctgaggaagaagcagctaacagtcttggatctgcatccaggagcccgtacttgggagtcggccat

SEQ ID NO: 3916 - DNA, 140 bp, Artificial Sequence
  Synthetic
atggccgactcccaagtacgggctcctggatgcagatccaagactgttagctgcttcttcctcagcatcgaaggttcaaagcactcaactggagcctcctcctccctttttccctgggttggagacccagcatggcgtat

SEQ ID NO: 3917 - DNA, 140 bp, Artificial Sequence
  Synthetic
atacgccatgctgggtctccggaaaaaccaggagggtccttcctgaaatagtccgtgaagccataaagaagagacttcgcacagtgatcctagcaccaaccagggtcgttgctgccgagacgtacttgggagtcggccat

SEQ ID NO: 3918 - DNA, 140 bp, Artificial Sequence
  Synthetic
atggccgactcccaagtacgtctcggcagcaacgaccctggttggtgctaggatcactgtgcgaagtctcttctttatggcttcacggactatttcaggaaggaccctcctggtttttccggagacccagcatggcgtat

SEQ ID NO: 3919 - DNA, 140 bp, Artificial Sequence
  Synthetic
atacgccatgctgggtctcctggaggaagccctaagaggacttccggtgcgttacatgacaacagcagtcaacgtcacccactctgggacagaaatcgtcgatttgatgtgccatgccaccgtacttgggagtcggccat

SEQ ID NO: 3920 - DNA, 140 bp, Artificial Sequence
  Synthetic
atggccgactcccaagtacggtggcatggcacatcaaatcgacgatttctgtcccagagtgggtgacgttgactgctgttgtcatgtaacgcaccggaagtcctcttagggcttcctccaggagacccagcatggcgtat

SEQ ID NO: 3921 - DNA, 140 bp, Artificial Sequence
  Synthetic
atacgccatgctgggtctcccttcacttcacgcctactacaacccatcagagtccccaactacaacctttacatcatggatgaagctcatttcacagatccctcaagcatagctgcacgacgtacttgggagtcggccat

SEQ ID NO: 3922 - DNA, 140 bp, Artificial Sequence
  Synthetic
atggccgactcccaagtacgtcgtgcagctatgcttgagggatctgtgaaatgagcttcatccatgatgtaaaggttgtagttggggactctgatgggttgtagtaggcgtgaagtgaagggagacccagcatggcgtat

SEQ ID NO: 3923 - DNA, 140 bp, Artificial Sequence
  Synthetic
atacgccatgctgggtctccggatatatatcaacaagggttgaaatgggcgaggcggctgctatcttcatgactgctacaccaccaggaacccgcgatgcgtttccggattccaactcaccgtacttgggagtcggccat

SEQ ID NO: 3924 - DNA, 140 bp, Artificial Sequence
  Synthetic
atggccgactcccaagtacggtgagttggaatccggaaacgcatcgcgggttcctggtggtgtagcagtcatgaagatagcagccgcctcgcccatttcaacccttgttgatatatatccggagacccagcatggcgtat

SEQ ID NO: 3925 - DNA, 140 bp, Artificial Sequence
  Synthetic
atacgccatgctgggtctcccaatcatggacacagaagtggaagttccagagagagcctggagctcaggctttgactgggtgacggatcattctgggaaaacaatttggtttgttccaagcgtacttgggagtcggccat

SEQ ID NO: 3926 - DNA, 140 bp, Artificial Sequence
  Synthetic
atggccgactcccaagtacgcttggaacaaaccaaattgttttcccagaatgatccgtcacccagtcaaagcctgagctccaggctctctctggaacttccacttctgtgtccatgattgggagacccagcatggcgtat

SEQ ID NO: 3927 - DNA, 140 bp, Artificial Sequence
  Synthetic
atacgccatgctgggtctcctgtgagaaacggaaatgaaatcgcagcctgtctgacaaaggctggaaagcgggtcatacagctcagcaggaagacttttgagacagagtttcagaagacacgtacttgggagtcggccat

SEQ ID NO: 3928 - DNA, 140 bp, Artificial Sequence
  Synthetic
atggccgactcccaagtacgtgtcttctgaaactctgtctcaaaagtcttcctgctgagctgtatgacccgctttccagcctttgtcagacaggctgcgatttcatttccgtttctcacaggagacccagcatggcgtat

SEQ ID NO: 3929 - DNA, 140 bp, Artificial Sequence
  Synthetic
atacgccatgctgggtctcccagtcatacttgatggggagagagtcatcctggctgggcccatgcctgtcacgcatgccagtgctgctcagaggagaggacgtgtaggcaggaaccccaacgtacttgggagtcggccat

SEQ ID NO: 3930 - DNA, 140 bp, Artificial Sequence
  Synthetic
atggccgactcccaagtacgttggggttcctgcctacacgtcctctcctctgagcagcactggcatgcgtgacaggcatgggcccagccaggatgactctctccccatcaagtatgactgggagacccagcatggcgtat

SEQ ID NO: 3931 - DNA, 140 bp, Artificial Sequence
  Synthetic
atacgccatgctgggtctccttgtggaactcatgaagagaggagaccttcccgtttggctggcctatcaagtagcatctgccggaataacttacacagatagaagatggtgctttgatggcgtacttgggagtcggccat

SEQ ID NO: 3932 - DNA, 140 bp, Artificial Sequence
  Synthetic
atggccgactcccaagtacgccatcaaagcaccatcttctatctgtgtaagttattccggcagatgctacttgataggccagccaaacgggaaggtctcctctcttcatgagttccacaaggagacccagcatggcgtat

SEQ ID NO: 3933 - DNA, 140 bp, Artificial Sequence
  Synthetic
atacgccatgctgggtctccgccggagaccttagagactatcatgcttctgggcttattgggaacagtttcgctaggaatcttctttgtcttgatgcggaacaagggcatcgggaagatgcgtacttgggagtcggccat

SEQ ID NO: 3934 - DNA, 140 bp, Artificial Sequence
  Synthetic
atggccgactcccaagtacgcatcttcccgatgcccttgttccgcatcaagacaaagaagattcctagcgaaactgttcccaataagcccagaagcatgatagtctctaaggtctccggcggagacccagcatggcgtat

SEQ ID NO: 3935 - DNA, 140 bp, Artificial Sequence
  Synthetic
atacgccatgctgggtctcctgctggtggtgctcatacccgagccagagaagcaaagatctccccaggataatcaaatggcaatcatcatcatggtggcagttggccttctgggtttgatcgtacttgggagtcggccat

SEQ ID NO: 3936 - DNA, 140 bp, Artificial Sequence
  Synthetic
atggccgactcccaagtacgatcaaacccagaaggccaactgccaccatgatgatgattgccatttgattatcctggggagatctttgcttctctggctcgggtatgagcaccaccagcaggagacccagcatggcgtat

SEQ ID NO: 3937 - DNA, 140 bp, Artificial Sequence
  Synthetic
atacgccatgctgggtctccaactgcaaatgaactcggatggctggaaaggacaaaaagtgatatagctcatctaatgggaaggaaagaagaggggacaaccatgggattctcaatggatcgtacttgggagtcggccat

SEQ ID NO: 3938 - DNA, 140 bp, Artificial Sequence
  Synthetic
atggccgactcccaagtacgatccattgagaatcccatggttgtcccctcttctttccttcccattagatgagctatatcactttttgtcctttccagccatccgagttcatttgcagttggagacccagcatggcgtat

SEQ ID NO: 3939 - DNA, 140 bp, Artificial Sequence
  Synthetic
atacgccatgctgggtctccaagtggagaagaagatgggacaagtgttactcatagcagtagctgtctccagtgctgtgctactgcggaccgcttggggatggggggaggctggggctctcgtacttgggagtcggccat

SEQ ID NO: 3940 - DNA, 140 bp, Artificial Sequence
  Synthetic
atggccgactcccaagtacgagagccccagcctccccccatccccaagcggtccgcagtagcacagcactggagacagctactgctatgagtaacacttgtcccatcttcttctccacttggagacccagcatggcgtat

SEQ ID NO: 3941 - DNA, 140 bp, Artificial Sequence
  Synthetic
aggccctggctgctgatatgtaagagacgtggaggtggaacgggagagaccctgggagagaagtggaaagcccgcctgaaccagatgtcggccttggagttctactcttacaaaaagtcagaccttttgggacagcggtg

SEQ ID NO: 3942 - DNA, 140 bp, Artificial Sequence
  Synthetic
caccgctgtcccaaaaggtctgactttttgtaagagtagaactccaaggccgacatctggttcaggcgggctttccacttctctcccagggtctctcccgttccacctccacgtctcttacatatcagcagccagggcct

SEQ ID NO: 3943 - DNA, 140 bp, Artificial Sequence
  Synthetic
atacgccatgctgggtctccgcaggaggtcagaggatacacaaagggaggtcctggccatgaagagcccatgctggtgcaaagctatgggtggaacatagttcgcctcaagagtggagtgcgtacttgggagtcggccat

SEQ ID NO: 3944 - DNA, 140 bp, Artificial Sequence
  Synthetic
atggccgactcccaagtacgcactccactcttgaggcgaactatgttccacccatagctttgcaccagcatgggctcttcatggccaggacctccctttgtgtatcctctgacctcctgcggagacccagcatggcgtat

SEQ ID NO: 3945 - DNA, 140 bp, Artificial Sequence
  Synthetic
atacgccatgctgggtctccgacgtcttccacatggcggctgaaccgtgtgacactctgctgtgtgacataggcgagtcatcatccagtcctgaagtggaagagacgcgaacactcagagcgtacttgggagtcggccat

SEQ ID NO: 3946 - DNA, 140 bp, Artificial Sequence
  Synthetic
atggccgactcccaagtacgctctgagtgttcgcgtctcttccacttcaggactggatgatgactcgcctatgtcacacagcagagtgtcacacggttcagccgccatgtggaagacgtcggagacccagcatggcgtat

SEQ ID NO: 3947 - DNA, 140 bp, Artificial Sequence
  Synthetic
atacgccatgctgggtctcctgctctccatggtgggagactggcttgaaaaaagaccaggggccttctgcataaaggtgctgtgcccatacaccagcacaatgatggagaccatggagcgcgtacttgggagtcggccat

SEQ ID NO: 3948 - DNA, 140 bp, Artificial Sequence
  Synthetic
atggccgactcccaagtacgcgctccatggtctccatcattgtgctggtgtatgggcacagcacctttatgcagaaggcccctggtcttttttcaagccagtctcccaccatggagagcaggagacccagcatggcgtat

SEQ ID NO: 3949 - DNA, 140 bp, Artificial Sequence
  Synthetic
atacgccatgctgggtctccactgcaacgtaggcatgggggaggattagtcagagtgccattgtcccgcaactctacacatgagatgtattgggtctctggagccaaaagtaacatcatacgtacttgggagtcggccat

SEQ ID NO: 3950 - DNA, 140 bp, Artificial Sequence
  Synthetic
atggccgactcccaagtacgtatgatgttacttttggctccagagacccaatacatctcatgtgtagagttgcgggacaatggcactctgactaatcctcccccatgcctacgttgcagtggagacccagcatggcgtat

SEQ ID NO: 3951 - DNA, 140 bp, Artificial Sequence
  Synthetic
aggccctggctgctgatatgactctacacatgagatgtattgggtctctggagccaaaagtaacatcataaagagtgtgtccaccacaagtcagctcctcttgggacgcatggaagggccgaccttttgggacagcggtg

SEQ ID NO: 3952 - DNA, 140 bp, Artificial Sequence
  Synthetic
caccgctgtcccaaaaggtcggcccttccatgcgtcccaagaggagctgacttgtggtggacacactctttatgatgttacttttggctccagagacccaatacatctcatgtgtagagtcatatcagcagccagggcct

SEQ ID NO: 3953 - DNA, 140 bp, Artificial Sequence
  Synthetic
atacgccatgctgggtctcccacgccatacggccaacaaagagtcttcaaggaaaaagtggacaccagggtgccagatccccaagaaggcactcgccaagtgatgaacatggtatcgtctcgtacttgggagtcggccat

SEQ ID NO: 3954 - DNA, 140 bp, Artificial Sequence
  Synthetic
atggccgactcccaagtacgagacgataccatgttcatcacttggcgagtgccttcttggggatctggcaccctggtgtccactttttccttgaagactctttgttggccgtatggcgtgggagacccagcatggcgtat

SEQ ID NO: 3955 - DNA, 140 bp, Artificial Sequence
  Synthetic
aggccctggctgctgatatgtgccagatccccaagaaggcactcgccaagtgatgaacatggtatcgtcttggctatggaaggagctgggaaaacgcaagcgaccacgtgtctgcaccaagaccttttgggacagcggtg

SEQ ID NO: 3956 - DNA, 140 bp, Artificial Sequence
  Synthetic
caccgctgtcccaaaaggtcttggtgcagacacgtggtcgcttgcgttttcccagctccttccatagccaagacgataccatgttcatcacttggcgagtgccttcttggggatctggcacatatcagcagccagggcct

SEQ ID NO: 3957 - DNA, 140 bp, Artificial Sequence
  Synthetic
atacgccatgctgggtctccgtgtcatagctgtgtgtacaacatgatgggcaaaagagaaaagaagcaaggagaattcgggaaagcaaaaggcagccgcgcaatctggtacatgtggttgcgtacttgggagtcggccat

SEQ ID NO: 3958 - DNA, 140 bp, Artificial Sequence
  Synthetic
atggccgactcccaagtacgcaaccacatgtaccagattgcgcggctgccttttgctttcccgaattctccttgcttcttttctcttttgcccatcatgttgtacacacagctatgacacggagacccagcatggcgtat

SEQ ID NO: 3959 - DNA, 140 bp, Artificial Sequence
  Synthetic
atacgccatgctgggtctccggagccagatttttggagtttgaagctcttgggttcttgaacgaggaccactggatggggagagaaaactcaggaggtggcgttgaagggctaggactgccgtacttgggagtcggccat

SEQ ID NO: 3960 - DNA, 140 bp, Artificial Sequence
  Synthetic
atggccgactcccaagtacggcagtcctagcccttcaacgccacctcctgagttttctctccccatccagtggtcctcgttcaagaacccaagagcttcaaactccaaaaatctggctccggagacccagcatggcgtat

SEQ ID NO: 3961 - DNA, 140 bp, Artificial Sequence
  Synthetic
atacgccatgctgggtctccaaaggcttggatatatcctagaagaaatgaaccgggcaccaggaggaaagatgtatgcagatgacactgctggctgggacacccgcattagcaagtttgacgtacttgggagtcggccat

SEQ ID NO: 3962 - DNA, 140 bp, Artificial Sequence
  Synthetic
atggccgactcccaagtacgtcaaacttgctaatgcgggtgtcccagccagcagtgtcatctgcatacatctttcctcctggtgcccggttcatttcttctaggatatatccaagcctttggagacccagcatggcgtat

SEQ ID NO: 3963 - DNA, 140 bp, Artificial Sequence
  Synthetic
aggccctggctgctgatatggagatgactgcgttgtgaagccaattgatgataggtttgcacatgccctcaggttcttgaatgacatgggaaaggttaggaaagacacacaggaatggaagaccttttgggacagcggtg

SEQ ID NO: 3964 - DNA, 140 bp, Artificial Sequence
  Synthetic
caccgctgtcccaaaaggtcttccattcctgtgtgtctttcctaacctttcccatgtcattcaagaacctgagggcatgtgcaaacctatcatcaattggcttcacaacgcagtcatctccatatcagcagccagggcct

SEQ ID NO: 3965 - DNA, 140 bp, Artificial Sequence
  Synthetic
atacgccatgctgggtctccactttaacaagctgcacctcaaggacgggagatccattgtggtcccctgccgccaccaagatgaactgattggccgagcccgtgtctcaccaggggcaggcgtacttgggagtcggccat

SEQ ID NO: 3966 - DNA, 140 bp, Artificial Sequence
  Synthetic
atggccgactcccaagtacgcctgcccctggtgagacacgggctcggccaatcagttcatcttggtggcggcaggggaccacaatggatctcccgtccttgaggtgcagcttgttaaagtggagacccagcatggcgtat

SEQ ID NO: 3967 - DNA, 140 bp, Artificial Sequence
  Synthetic
aggccctggctgctgatatgcatggtgcgtaggatcataggtgatgaagaaaagtacatggactacctatccacccaagtacgttacttgggtgaggaagggtccacacctggagtgctggaccttttgggacagcggtg

SEQ ID NO: 3968 - DNA, 140 bp, Artificial Sequence
  Synthetic
caccgctgtcccaaaaggtccagcactccaggtgtggacccttcctcacccaagtaacgtacttgggtggataggtagtccatgtacttttcttcatcacctatgatcctacgcaccatgcatatcagcagccagggcct

SEQ ID NO: 3969 - DNA, 140 bp, Artificial Sequence
  Synthetic
aggccctggctgctgatatgcatggtgcgtaggatcataggtgatgaagaaaagttcatggactacctatccacccaagtacgttacttgggtgaggaagggtccacacctggagtgctggaccttttgggacagcggtg

SEQ ID NO: 3970 - DNA, 140 bp, Artificial Sequence
  Synthetic
caccgctgtcccaaaaggtccagcactccaggtgtggacccttcctcacccaagtaacgtacttgggtggataggtagtccatgaacttttcttcatcacctatgatcctacgcaccatgcatatcagcagccagggcct

SEQ ID NO: 3971 - DNA, 140 bp, Artificial Sequence
  Synthetic
aggccctggctgctgatatgcatggtgcgtaggatcataggtgatgaagaaaagtccatggactacctatccacccaagtacgttacttgggtgaggaagggtccacacctggagtgctggaccttttgggacagcggtg

SEQ ID NO: 3972 - DNA, 140 bp, Artificial Sequence
  Synthetic
caccgctgtcccaaaaggtccagcactccaggtgtggacccttcctcacccaagtaacgtacttgggtggataggtagtccatggacttttcttcatcacctatgatcctacgcaccatgcatatcagcagccagggcct

SEQ ID NO: 3973 - DNA, 140 bp, Artificial Sequence
  Synthetic
aggccctggctgctgatatgcatggtgcgtaggatcataggtgatgaagaaaagtgcatggactacctatccacccaagtacgttacttgggtgaggaagggtccacacctggagtgctggaccttttgggacagcggtg

SEQ ID NO: 3974 - DNA, 140 bp, Artificial Sequence
  Synthetic
caccgctgtcccaaaaggtccagcactccaggtgtggacccttcctcacccaagtaacgtacttgggtggataggtagtccatgcacttttcttcatcacctatgatcctacgcaccatgcatatcagcagccagggcct

SEQ ID NO: 3975 - DNA, 140 bp, Artificial Sequence
  Synthetic
atacgccatgctgggtctccatgaaaaacccaaagaagaaatccggaggattccggattgtcaatatgctaaaacgcggagtagcccgtgtaaaccccttggggggtttgaagaggctgccgtacttgggagtcggccat

SEQ ID NO: 3976 - DNA, 140 bp, Artificial Sequence
  Synthetic
atggccgactcccaagtacggcagcctcttcaaaccccccaaggggtttacacgggctactccgcgttttagcatattgacaatccggaatcctccggatttcttctttgggtttttcatggagacccagcatggcgtat

SEQ ID NO: 3977 - DNA, 140 bp, Artificial Sequence
  Synthetic
aggccctggctgctgatatgaaaacgcggagtagcccgtgtaaaccccttggggggtttgaagaggctgccggccggactcctgctgggccatggacccatcagaatggttttggcgatagaccttttgggacagcggtg

SEQ ID NO: 3978 - DNA, 140 bp, Artificial Sequence
  Synthetic
caccgctgtcccaaaaggtctatcgccaaaaccattctgatgggtccatggcccagcaggagtccggccggcagcctcttcaaaccccccaaggggtttacacgggctactccgcgttttcatatcagcagccagggcct

SEQ ID NO: 3979 - DNA, 140 bp, Artificial Sequence
  Synthetic
atacgccatgctgggtctcctcaagaaagatcttgctgccatgttgagaataatcaatgctaggaaggagaggaagagacgtggagctgatgccagcatcggaatcgtcagcctcctgctcgtacttgggagtcggccat

SEQ ID NO: 3980 - DNA, 140 bp, Artificial Sequence
  Synthetic
atggccgactcccaagtacgagcaggaggctgacgattccgatgctggcatcagctccacgtctcttcctctccttcctagcattgattattctcaacatggcagcaagatctttcttgaggagacccagcatggcgtat

SEQ ID NO: 3981 - DNA, 140 bp, Artificial Sequence
  Synthetic
atacgccatgctgggtctccgactacagtcatggcagcagagatcactagacgcgggagtgcatactacatgtacttggacaggagcgatgctggtaaggccatttctttcgttaccacacgtacttgggagtcggccat

SEQ ID NO: 3982 - DNA, 140 bp, Artificial Sequence
  Synthetic
atggccgactcccaagtacgtgtggtaacgaaagaaatggccttaccagcatcgctcctgtccaagtacatgtagtatgcactcccgcgtctagtgatctctgctgccatgactgtagtcggagacccagcatggcgtat

SEQ ID NO: 3983 - DNA, 140 bp, Artificial Sequence
  Synthetic
aggccctggctgctgatatgtgtacttggacaggagcgatgctggtaaggccatttctttcgttaccacactgggggtgaacaaatgccatgtgcagatcatggacctcgggcatatgtggaccttttgggacagcggtg

SEQ ID NO: 3984 - DNA, 140 bp, Artificial Sequence
  Synthetic
caccgctgtcccaaaaggtccacatatgcccgaggtccatgatctgcacatggcatttgttcacccccagtgtggtaacgaaagaaatggccttaccagcatcgctcctgtccaagtacacatatcagcagccagggcct

SEQ ID NO: 3985 - DNA, 140 bp, Artificial Sequence
  Synthetic
atacgccatgctgggtctccggaacctgtcatcataaaaaaggtgaagcacgacgatccagaagagccgtgacgcttccttctcactctacaaggaagttgcaaacgcgatcgcagacttcgtacttgggagtcggccat

SEQ ID NO: 3986 - DNA, 140 bp, Artificial Sequence
  Synthetic
atggccgactcccaagtacgaagtctgcgatcgcgtttgcaacttccttgtagagtgagaaggaagcgtcacggctcttctggatcgtcgtgcttcaccttttttatgatgacaggttccggagacccagcatggcgtat

SEQ ID NO: 3987 - DNA, 140 bp, Artificial Sequence
  Synthetic
atacgccatgctgggtctcccctgggaagctcgacgagccaaaaagtcatatacttggtcatgatattgttgattgccccggcatacagtatcaggtgcataggagttagcaatagagaccgtacttgggagtcggccat

SEQ ID NO: 3988 - DNA, 140 bp, Artificial Sequence
  Synthetic
atggccgactcccaagtacggtctctattgctaactcctatgcacctgatactgtatgccggggcaatcaacaatatcatgaccaagtatatgactttttggctcgtcgagcttcccaggggagacccagcatggcgtat

SEQ ID NO: 3989 - DNA, 140 bp, Artificial Sequence
  Synthetic
atacgccatgctgggtctccttcgtggagggcatgtcaggtgggacctgggttgatgttgtcttggaacatggaggttgtgtcaccgtgatggcacaggacaagccaacagttgacatagcgtacttgggagtcggccat

SEQ ID NO: 3990 - DNA, 140 bp, Artificial Sequence
  Synthetic
atggccgactcccaagtacgctatgtcaactgttggcttgtcctgtgccatcacggtgacacaacctccatgttccaagacaacatcaacccaggtcccacctgacatgccctccacgaaggagacccagcatggcgtat

SEQ ID NO: 3991 - DNA, 140 bp, Artificial Sequence
  Synthetic
atacgccatgctgggtctccagttggtcacgacaacggttagcaacatggccgaggtgagatcctactgctacgaggcatcaatatcggacatggcttcggacagtcgctgcccaacacacgtacttgggagtcggccat

SEQ ID NO: 3992 - DNA, 140 bp, Artificial Sequence
  Synthetic
atggccgactcccaagtacgtgtgttgggcagcgactgtccgaagccatgtccgatattgatgcctcgtagcagtaggatctcacctcggccatgttgctaaccgttgtcgtgaccaactggagacccagcatggcgtat

SEQ ID NO: 3993 - DNA, 140 bp, Artificial Sequence
  Synthetic
atacgccatgctgggtctccaggtgaagcctaccttgacaagcagtcagacactcaatatgtctgtaaaagaacattggtggacagaggttggggaaatgggtgtggactttttggcaagcgtacttgggagtcggccat

SEQ ID NO: 3994 - DNA, 140 bp, Artificial Sequence
  Synthetic
atggccgactcccaagtacgcttgccaaaaagtccacacccatttccccaacctctgtccaccaatgttcttttacagacatattgagtgtctgactgcttgtcaaggtaggcttcacctggagacccagcatggcgtat

SEQ ID NO: 3995 - DNA, 140 bp, Artificial Sequence
  Synthetic
atacgccatgctgggtctccgggagcttggtgacgtgtgccaagtttacatgctccaagaaaatgacagggaagagcatccagccggagaacttggagtaccggataatgctatcagtgccgtacttgggagtcggccat

SEQ ID NO: 3996 - DNA, 140 bp, Artificial Sequence
  Synthetic
atggccgactcccaagtacggcactgatagcattatccggtactccaagttctccggctggatgctcttccctgtcattttcttggagcatgtaaacttggcacacgtcaccaagctcccggagacccagcatggcgtat

SEQ ID NO: 3997 - DNA, 140 bp, Artificial Sequence
  Synthetic
atacgccatgctgggtctccatggatcccagcacagtgggatgattgtgaatgacgaaaacagagcaaaagtcgaggttacacccaattcaccaagagcagaagcaaccttgggaggtttcgtacttgggagtcggccat

SEQ ID NO: 3998 - DNA, 140 bp, Artificial Sequence
  Synthetic
atggccgactcccaagtacgaaacctcccaaggttgcttctgctcttggtgaattgggtgtaacctcgacttttgctctgttttcgtcattcacaatcatcccactgtgctgggatccatggagacccagcatggcgtat

SEQ ID NO: 3999 - DNA, 140 bp, Artificial Sequence
  Synthetic
atacgccatgctgggtctcctggaagcctgggacttgattgtgaaccaaggacaggccttgacttttcagatctgtattacctgaccatgaacaataagcattggttggtgcacaaagagcgtacttgggagtcggccat

SEQ ID NO: 4000 - DNA, 140 bp, Artificial Sequence
  Synthetic
atggccgactcccaagtacgctctttgtgcaccaaccaatgcttattgttcatggtcaggtaatacagatctgaaaagtcaaggcctgtccttggttcacaatcaagtcccaggcttccaggagacccagcatggcgtat

SEQ ID NO: 4001 - DNA, 140 bp, Artificial Sequence
  Synthetic
atacgccatgctgggtctcctggtttcatgacatcccattaccttggcattctggtgcagacactgaaactccacactggaacaacaaagaggcactggtggagttcaaggacgcccacgcgtacttgggagtcggccat

SEQ ID NO: 4002 - DNA, 140 bp, Artificial Sequence
  Synthetic
atggccgactcccaagtacgcgtgggcgtccttgaactccaccagtgcctctttgttgttccagtgtggagtttcagtgtctgcaccagaatgccaaggtaatgggatgtcatgaaaccaggagacccagcatggcgtat

SEQ ID NO: 4003 - DNA, 140 bp, Artificial Sequence
  Synthetic
atacgccatgctgggtctccccaagaggcaaactgttgtggttctggggagccaagaaggagccgttcacacggctctcgctggagctctggaggctgagatggatggtgcgaagggaagcgtacttgggagtcggccat

SEQ ID NO: 4004 - DNA, 140 bp, Artificial Sequence
  Synthetic
atggccgactcccaagtacgcttcccttcgcaccatccatctcagcctccagagctccagcgagagccgtgtgaacggctccttcttggctccccagaaccacaacagtttgcctcttggggagacccagcatggcgtat

SEQ ID NO: 4005 - DNA, 140 bp, Artificial Sequence
  Synthetic
atacgccatgctgggtctccgctatcctcaggccatttgaaatgccgcctaaaaatggacaagcttaggttgaagggtgtgtcatattccctgtgtaccgcagcgttcacattcaccaagcgtacttgggagtcggccat

SEQ ID NO: 4006 - DNA, 140 bp, Artificial Sequence
  Synthetic
atggccgactcccaagtacgcttggtgaatgtgaacgctgcggtacacagggaatatgacacacccttcaacctaagcttgtccatttttaggcggcatttcaaatggcctgaggatagcggagacccagcatggcgtat

SEQ ID NO: 4007 - DNA, 140 bp, Artificial Sequence
  Synthetic
atacgccatgctgggtctccgttccagctgaaacattgcatggaacagtcacagtggaggtgcagtatgcagggagggatggaccctgcaaggtcccagcccagatggcggtggacatgccgtacttgggagtcggccat

SEQ ID NO: 4008 - DNA, 140 bp, Artificial Sequence
  Synthetic
atggccgactcccaagtacggcatgtccaccgccatctgggctgggaccttgcagggtccatccctccctgcatactgcacctccactgtgactgttccatgcaatgtttcagctggaacggagacccagcatggcgtat

SEQ ID NO: 4009 - DNA, 140 bp, Artificial Sequence
  Synthetic
atacgccatgctgggtctccagaccctgaccccagttggaaggctgataacggctaaccctgtgatcactgaaagcactgagaattcaaagatgatgttggagctcgacccaccatttggcgtacttgggagtcggccat

SEQ ID NO: 4010 - DNA, 140 bp, Artificial Sequence
  Synthetic
atggccgactcccaagtacgccaaatggtgggtcgagctccaacatcatctttgaattctcagtgctttcagtgatcacagggttagccgttatcagccttccaactggggtcagggtctggagacccagcatggcgtat

SEQ ID NO: 4011 - DNA, 140 bp, Artificial Sequence
  Synthetic
atacgccatgctgggtctccggattcttacattgtcataggagtcggggacaagaaaatcacccatcactggcatcggagtggtagcatcatcggaaaggcatttgaagccactgtgagacgtacttgggagtcggccat

SEQ ID NO: 4012 - DNA, 140 bp, Artificial Sequence
  Synthetic
atggccgactcccaagtacgtctcacagtggcttcaaatgcctttccgatgatgctaccactccgatgccagtgatgggtgattttcttgtccccgactcctatgacaatgtaagaatccggagacccagcatggcgtat

SEQ ID NO: 4013 - DNA, 140 bp, Artificial Sequence
  Synthetic
atacgccatgctgggtctccggcgccaagagaatggcagtcttgggagacacagcctgggactttggatcagttgggggtgtgtttaactcattgggcaagggtattcaccagatctttgcgtacttgggagtcggccat

SEQ ID NO: 4014 - DNA, 140 bp, Artificial Sequence
  Synthetic
atggccgactcccaagtacgcaaagatctggtgaatacccttgcccaatgagttaaacacacccccaactgatccaaagtcccaggctgtgtctcccaagactgccattctcttggcgccggagacccagcatggcgtat

SEQ ID NO: 4015 - DNA, 140 bp, Artificial Sequence
  Synthetic
atacgccatgctgggtctccgagcagctttcaaatcactgttcggaggaatgtcctggttctcacagatcctcataggcacactgttggtgtggttgggtctgaacacaaagaatggatccgtacttgggagtcggccat

SEQ ID NO: 4016 - DNA, 140 bp, Artificial Sequence
  Synthetic
atggccgactcccaagtacggatccattctttgtgttcagacccaaccacaccaacagtgtgcctatgaggatctgtgagaaccaggacattcctccgaacagtgatttgaaagctgctcggagacccagcatggcgtat

SEQ ID NO: 4017 - DNA, 140 bp, Artificial Sequence
  Synthetic
atacgccatgctgggtctcctatctccctcacatgcttggccttgggaggagtgatgatcttcctttccacggctgtttctgctgatgtggggtgttcggtggacttctcaaaaaaggaacgtacttgggagtcggccat

SEQ ID NO: 4018 - DNA, 140 bp, Artificial Sequence
  Synthetic
atggccgactcccaagtacgttccttttttgagaagtccaccgaacaccccacatcagcagaaacagccgtggaaaggaagatcatcactcctcccaaggccaagcatgtgagggagataggagacccagcatggcgtat

SEQ ID NO: 4019 - DNA, 140 bp, Artificial Sequence
  Synthetic
atacgccatgctgggtctccacgagatgtggcacgggggtgttcatctacaatgacgttgaagcctggagggatcgatacagataccatcctgactccccccgcagattggcagcagctgcgtacttgggagtcggccat

SEQ ID NO: 4020 - DNA, 140 bp, Artificial Sequence
  Synthetic
atggccgactcccaagtacgcagctgctgccaatctgcggggggagtcaggatggtatctgtatcgatccctccaggcttcaacgtcattgtagatgaacacccccgtgccacatctcgtggagacccagcatggcgtat

SEQ ID NO: 4021 - DNA, 140 bp, Artificial Sequence
  Synthetic
atacgccatgctgggtctccttaagcaggcttgggaagaggggatttgtgggatctcctccgtttcgagaatggaaaacatcatgtggaaatcagtggaaggggagcttaatgcgatcctcgtacttgggagtcggccat

SEQ ID NO: 4022 - DNA, 140 bp, Artificial Sequence
  Synthetic
atggccgactcccaagtacgaggatcgcattaagctccccttccactgatttccacatgatgttttccattctcgaaacggaggagatcccacaaatcccctcttcccaagcctgcttaaggagacccagcatggcgtat

SEQ ID NO: 4023 - DNA, 140 bp, Artificial Sequence
  Synthetic
atacgccatgctgggtctccagaggagaatggagtccaactgacagttgtagtggggtctgtaaaaaaccccatgtggagaggtccacgaagattgccagtgcccgtaaatgagctgccccgtacttgggagtcggccat

SEQ ID NO: 4024 - DNA, 140 bp, Artificial Sequence
  Synthetic
atggccgactcccaagtacggggcagctcatttacgggcactggcaatcttcgtggacctctccacatggggttttttacagaccccactacaactgtcagttggactccattctcctctggagacccagcatggcgtat

SEQ ID NO: 4025 - DNA, 140 bp, Artificial Sequence
  Synthetic
atacgccatgctgggtctcccatggctggaaagcctgggggaaatcgtactttgttagggcggcaaagaccaacaacagttttgttgtcgacggtgacacactgaaggaatgtccgctcacgtacttgggagtcggccat

SEQ ID NO: 4026 - DNA, 140 bp, Artificial Sequence
  Synthetic
atggccgactcccaagtacgtgagcggacattccttcagtgtgtcaccgtcgacaacaaaactgttgttggtctttgccgccctaacaaagtacgatttcccccaggctttccagccatgggagacccagcatggcgtat

SEQ ID NO: 4027 - DNA, 140 bp, Artificial Sequence
  Synthetic
atacgccatgctgggtctccaacatagagcatggaatagcttccttgtggaggatcacgggtttggggtcttccacaccagtgtttggctgaaggtcagagaggactattcattagagtgcgtacttgggagtcggccat

SEQ ID NO: 4028 - DNA, 140 bp, Artificial Sequence
  Synthetic
atggccgactcccaagtacgcactctaatgaatagtcctctctgaccttcagccaaacactggtgtggaagaccccaaacccgtgatcctccacaaggaagctattccatgctctatgttggagacccagcatggcgtat

SEQ ID NO: 4029 - DNA, 140 bp, Artificial Sequence
  Synthetic
atacgccatgctgggtctcctgacccagccgtcataggaacagctgtcaagggaaaggaggctgcacacagtgatctaggctattggattgagagtgaaaagaatgacacatggaggctgcgtacttgggagtcggccat

SEQ ID NO: 4030 - DNA, 140 bp, Artificial Sequence
  Synthetic
atggccgactcccaagtacgcagcctccatgtgtcattcttttcactctcaatccaatagcctagatcactgtgtgcagcctcctttcccttgacagctgttcctatgacggctgggtcaggagacccagcatggcgtat

SEQ ID NO: 4031 - DNA, 140 bp, Artificial Sequence
  Synthetic
aggccctggctgctgatatggtgatctaggctattggattgagagtgaaaagaatgacacatggaggctgaagagggctcatctgattgagatgaagacatgtgagtggccaaagtctcagaccttttgggacagcggtg

SEQ ID NO: 4032 - DNA, 140 bp, Artificial Sequence
  Synthetic
caccgctgtcccaaaaggtctgagactttggccactcacatgtcttcatctcaatcagatgagccctcttcagcctccatgtgtcattcttttcactctcaatccaatagcctagatcaccatatcagcagccagggcct

SEQ ID NO: 4033 - DNA, 140 bp, Artificial Sequence
  Synthetic
aggccctggctgctgatatgcacactgtggacagatggagtggaagaaagtgatctgatcatacccaagtccttagctggtccactcagccaccacaacaccagagagggttatagaactgaccttttgggacagcggtg

SEQ ID NO: 4034 - DNA, 140 bp, Artificial Sequence
  Synthetic
caccgctgtcccaaaaggtcagttctataaccctctctggtgttgtggtggctgagtggaccagctaaggacttgggtatgatcagatcactttcttccactccatctgtccacagtgtgcatatcagcagccagggcct

SEQ ID NO: 4035 - DNA, 140 bp, Artificial Sequence
  Synthetic
atacgccatgctgggtctcccaagtgaaagggccatggcatagtgaagagctcgaaatccggtttgaggaatgcccaggcaccaaggttcatgtggaggagacatgcggaactagaggaccgtacttgggagtcggccat

SEQ ID NO: 4036 - DNA, 140 bp, Artificial Sequence
  Synthetic
atggccgactcccaagtacggtcctctagttccgcatgtctcctccacatgaaccttggtgcctgggcattcctcaaaccggatttcgagctcttcactatgccatggccctttcacttgggagacccagcatggcgtat

SEQ ID NO: 4037 - DNA, 140 bp, Artificial Sequence
  Synthetic
aggccctggctgctgatatgatgcccaggcaccaaggttcatgtggaggagacatgcggaactagaggaccatctttaagatcaaccactgcaagtggaagggtcatagaggaatggtgcgaccttttgggacagcggtg

SEQ ID NO: 4038 - DNA, 140 bp, Artificial Sequence
  Synthetic
caccgctgtcccaaaaggtcgcaccattcctctatgacccttccacttgcagtggttgatcttaaagatggtcctctagttccgcatgtctcctccacatgaaccttggtgcctgggcatcatatcagcagccagggcct

SEQ ID NO: 4039 - DNA, 140 bp, Artificial Sequence
  Synthetic
aggccctggctgctgatatgtgtagggaatgcacaatgcctccactatcgttccgggcaaaagacggctgctggtatggaatggagataaggcccagaaaggaaccagagagcaacttaggaccttttgggacagcggtg

SEQ ID NO: 4040 - DNA, 140 bp, Artificial Sequence
  Synthetic
caccgctgtcccaaaaggtcctaagttgctctctggttcctttctgggccttatctccattccataccagcagccgtcttttgcccggaacgatagtggaggcattgtgcattccctacacatatcagcagccagggcct

SEQ ID NO: 4041 - DNA, 140 bp, Artificial Sequence
  Synthetic
atacgccatgctgggtctcctgaggtctatggtgacagcaggatcaaccgatcacatggatcacttctctcttggagtgcttgtgattctactcatggtgcaggaaggtttgaagaagagcgtacttgggagtcggccat

SEQ ID NO: 4042 - DNA, 140 bp, Artificial Sequence
  Synthetic
atggccgactcccaagtacgctcttcttcaaaccttcctgcaccatgagtagaatcacaagcactccaagagagaagtgatccatgtgatcggttgatcctgctgtcaccatagacctcaggagacccagcatggcgtat

SEQ ID NO: 4043 - DNA, 140 bp, Artificial Sequence
  Synthetic
atacgccatgctgggtctccaatgaccacaaagatcataatgagcacatcaatggcaatgctggtagccatggtcttgggaggattctcaatgagtgacctggctaagcttgtgatcctgcgtacttgggagtcggccat

SEQ ID NO: 4044 - DNA, 140 bp, Artificial Sequence
  Synthetic
atggccgactcccaagtacgcaggatcacaagcttagccaggtcactcattgagaatcctcccaagaccatggctaccagcattgccattgatgtgctcattatgatctttgtggtcattggagacccagcatggcgtat

SEQ ID NO: 4045 - DNA, 140 bp, Artificial Sequence
  Synthetic
aggccctggctgctgatatgtggtcttgggaggattctcaatgagtgacctggctaagcttgtgatcctgatgggtgccactttcgcagaaatgaacactggaggagatgtggctcacttgaccttttgggacagcggtg

SEQ ID NO: 4046 - DNA, 140 bp, Artificial Sequence
  Synthetic
caccgctgtcccaaaaggtcaagtgagccacatctcctccagtgttcatttctgcgaaagtggcacccatcaggatcacaagcttagccaggtcactcattgagaatcctcccaagaccacatatcagcagccagggcct

SEQ ID NO: 4047 - DNA, 140 bp, Artificial Sequence
  Synthetic
aggccctggctgctgatatgggcattggtagcggcatttaaagtcagaccagccttgttggtttccttcatcttcagagccaactggacaccccgtgagagcatgctgctagccctggctgaccttttgggacagcggtg

SEQ ID NO: 4048 - DNA, 140 bp, Artificial Sequence
  Synthetic
caccgctgtcccaaaaggtcagccagggctagcagcatgctctcacggggtgtccagttggctctgaagatgaaggaaaccaacaaggctggtctgactttaaatgccgctaccaatgcccatatcagcagccagggcct

SEQ ID NO: 4049 - DNA, 140 bp, Artificial Sequence
  Synthetic
atacgccatgctgggtctcctcgtgtctcctgcagactgcgatttccgctcttgaaggcgagctgatggtcctcgttaatggatttgctttggcctggttggcaatacgagcaatggccgcgtacttgggagtcggccat

SEQ ID NO: 4050 - DNA, 140 bp, Artificial Sequence
  Synthetic
atggccgactcccaagtacgcggccattgctcgtattgccaaccaggccaaagcaaatccattaacgaggaccatcagctcgccttcaagagcggaaatcgcagtctgcaggagacacgaggagacccagcatggcgtat

SEQ ID NO: 4051 - DNA, 140 bp, Artificial Sequence
  Synthetic
atacgccatgctgggtctcctgccacgcactgataacatcgctctagcaattctggccgctctaacaccattagccagaggcacactgcttgtggcatggagagcgggcctcgccacttgcgtacttgggagtcggccat

SEQ ID NO: 4052 - DNA, 140 bp, Artificial Sequence
  Synthetic
atggccgactcccaagtacgcaagtggcgaggcccgctctccatgccacaagcagtgtgcctctggctaatggtgttagagcggccagaattgctagagcgatgttatcagtgcgtggcaggagacccagcatggcgtat

SEQ ID NO: 4053 - DNA, 140 bp, Artificial Sequence
  Synthetic
atacgccatgctgggtctcctggagggttcatgctcatttccctgaaagggaaaggtagtgtgaagaagaacctgccatttgtcatggccttggggttgaccgctgtgaggatagtggaccgtacttgggagtcggccat

SEQ ID NO: 4054 - DNA, 140 bp, Artificial Sequence
  Synthetic
atggccgactcccaagtacggtccactatcctcacagcggtcaaccccaaggccatgacaaatggcaggttcttcttcacactacctttccctttcagggaaatgagcatgaaccctccaggagacccagcatggcgtat

SEQ ID NO: 4055 - DNA, 140 bp, Artificial Sequence
  Synthetic
atacgccatgctgggtctcccccattaatgtggtaggactactgttactgacaaggagtgggaaacggagctggccccctagtgaagtgcttacagctgtcggcctgatatgtgcactggcgtacttgggagtcggccat

SEQ ID NO: 4056 - DNA, 140 bp, Artificial Sequence
  Synthetic
atggccgactcccaagtacgccagtgcacatatcaggccgacagctgtaagcacttcactagggggccagctccgtttcccactccttgtcagtaacagtagtcctaccacattaatgggggagacccagcatggcgtat

SEQ ID NO: 4057 - DNA, 140 bp, Artificial Sequence
  Synthetic
atacgccatgctgggtctccccggagggtttgccaaggcagacatagagatggctgggcccatggctgcagtaggcctgctaattgtcagttatgtggtcacgggaaagagtgtggacatcgtacttgggagtcggccat

SEQ ID NO: 4058 - DNA, 140 bp, Artificial Sequence
  Synthetic
atggccgactcccaagtacgatgtccacactctttcccgtgaccacataactgacaattagcaggcctactgcagccatgggcccagccatctctatgtctgccttggcaaaccctccggggagacccagcatggcgtat

SEQ ID NO: 4059 - DNA, 140 bp, Artificial Sequence
  Synthetic
atacgccatgctgggtctccgtacattgaaagagcaggtgatattacatgggaaaaagacgcggaagtcactggaaacagtcctcggcttgacgtggcactagatgagagtggtgatttccgtacttgggagtcggccat

SEQ ID NO: 4060 - DNA, 140 bp, Artificial Sequence
  Synthetic
atggccgactcccaagtacggaaatcaccactctcatctagtgccacgtcaagccgaggactgtttccagtgacttccgcgtctttttcccatgtaatatcacctgctctttcaatgtacggagacccagcatggcgtat

SEQ ID NO: 4061 - DNA, 140 bp, Artificial Sequence
  Synthetic
aggccctggctgctgatatgctggaaacagtcctcggcttgacgtggcactagatgagagtggtgatttctctttggtagaggaggatggcccacccatgagagagatcatactcaaggtgaccttttgggacagcggtg

SEQ ID NO: 4062 - DNA, 140 bp, Artificial Sequence
  Synthetic
caccgctgtcccaaaaggtcaccttgagtatgatctctctcatgggtgggccatcctcctctaccaaagagaaatcaccactctcatctagtgccacgtcaagccgaggactgtttccagcatatcagcagccagggcct

SEQ ID NO: 4063 - DNA, 140 bp, Artificial Sequence
  Synthetic
aggccctggctgctgatatgggtcctgatggccatctgtggcatgaacccaatagccatacccttcgctgcaggagcgtggtatgtgtatgtaaagactgggaaaaggagcggtgccctcgaccttttgggacagcggtg

SEQ ID NO: 4064 - DNA, 140 bp, Artificial Sequence
  Synthetic
caccgctgtcccaaaaggtcgagggcaccgctccttttcccagtctttacatacacataccacgctcctgcagcgaagggtatggctattgggttcatgccacagatggccatcaggacccatatcagcagccagggcct

SEQ ID NO: 4065 - DNA, 140 bp, Artificial Sequence
  Synthetic
atacgccatgctgggtctcctgggacgtgcctgctcccaaagaagtaaaaaagggagagactacagatggagtgtacagagttatgactcgcagactgctgggttcaacacaggttggagcgtacttgggagtcggccat

SEQ ID NO: 4066 - DNA, 140 bp, Artificial Sequence
  Synthetic
atggccgactcccaagtacgctccaacctgtgttgaacccagcagtctgcgagtcataactctgtacactccatctgtagtctctcccttttttacttctttgggagcaggcacgtcccaggagacccagcatggcgtat

SEQ ID NO: 4067 - DNA, 140 bp, Artificial Sequence
  Synthetic
atacgccatgctgggtctcctgggagtcatgcaagagggagtcttccataccatgtggcacgtcacaaaaggagccgcattgaggagcggtgaaggaagacttgatccatactggggggacgtacttgggagtcggccat

SEQ ID NO: 4068 - DNA, 140 bp, Artificial Sequence
  Synthetic
atggccgactcccaagtacgtccccccagtatggatcaagtcttccttcaccgctcctcaatgcggctccttttgtgacgtgccacatggtatggaagactccctcttgcatgactcccaggagacccagcatggcgtat

SEQ ID NO: 4069 - DNA, 140 bp, Artificial Sequence
  Synthetic
atacgccatgctgggtctcccgtcaagcaggacctggtgtcatattgtgggccgtggaagttggatgcagcctgggatggactaagtgaggtgcagcttttggccgtaccccccggagagcgtacttgggagtcggccat

SEQ ID NO: 4070 - DNA, 140 bp, Artificial Sequence
  Synthetic
atggccgactcccaagtacgctctccggggggtacggccaaaagctgcacctcacttagtccatcccaggctgcatccaacttccacggcccacaatatgacaccaggtcctgcttgacgggagacccagcatggcgtat

SEQ ID NO: 4071 - DNA, 140 bp, Artificial Sequence
  Synthetic
atacgccatgctgggtctccagggctaaaaacattcagactctgcctggaatatttaagacaaaggatggggacatcggagcagttgctctagactaccctgcaggaacctcaggatctccgtacttgggagtcggccat

SEQ ID NO: 4072 - DNA, 140 bp, Artificial Sequence
  Synthetic
atggccgactcccaagtacggagatcctgaggttcctgcagggtagtctagagcaactgctccgatgtccccatcctttgtcttaaatattccaggcagagtctgaatgtttttagccctggagacccagcatggcgtat

SEQ ID NO: 4073 - DNA, 140 bp, Artificial Sequence
  Synthetic
atacgccatgctgggtctccgtgatcaagaatggaagctatgttagtgccataacccagggaaaaagggaggaggagactccggttgagtgctttgaaccctcgatgctgaggaagaagccgtacttgggagtcggccat

SEQ ID NO: 4074 - DNA, 140 bp, Artificial Sequence
  Synthetic
atggccgactcccaagtacggcttcttcctcagcatcgagggttcaaagcactcaaccggagtctcctcctccctttttccctgggttatggcactaacatagcttccattcttgatcacggagacccagcatggcgtat

SEQ ID NO: 4075 - DNA, 140 bp, Artificial Sequence
  Synthetic
atacgccatgctgggtctccagctaacagtcttggatctgcatccaggagccgggaaaaccaggagggttcttcctgaaatagtccgtgaagccataaagaagagacttcgcacagtgatcgtacttgggagtcggccat

SEQ ID NO: 4076 - DNA, 140 bp, Artificial Sequence
  Synthetic
atggccgactcccaagtacgatcactgtgcgaagtctcttctttatggcttcacggactatttcaggaagaaccctcctggttttcccggctcctggatgcagatccaagactgttagctggagacccagcatggcgtat

SEQ ID NO: 4077 - DNA, 140 bp, Artificial Sequence
  Synthetic
atacgccatgctgggtctcccttagcaccaaccagggttgttgctgctgagatggaggaagccctaagaggacttccggtgcgttacatgacaacagcagtcaacgtcacccattctgggcgtacttgggagtcggccat

SEQ ID NO: 4078 - DNA, 140 bp, Artificial Sequence
  Synthetic
atggccgactcccaagtacgcccagaatgggtgacgttgactgctgttgtcatgtaacgcaccggaagtcctcttagggcttcctccatctcagcagcaacaaccctggttggtgctaagggagacccagcatggcgtat

SEQ ID NO: 4079 - DNA, 140 bp, Artificial Sequence
  Synthetic
atacgccatgctgggtctccacagaaatcgttgatttgatgtgccatgccaccttcacttcacgcctactacaaccaatcagagtccccaactacaacctttatatcatggatgaggctccgtacttgggagtcggccat

SEQ ID NO: 4080 - DNA, 140 bp, Artificial Sequence
  Synthetic
atggccgactcccaagtacggagcctcatccatgatataaaggttgtagttggggactctgattggttgtagtaggcgtgaagtgaaggtggcatggcacatcaaatcaacgatttctgtggagacccagcatggcgtat

SEQ ID NO: 4081 - DNA, 140 bp, Artificial Sequence
  Synthetic
atacgccatgctgggtctccatttcacagatccttcaagcatagctgcaagaggatacatatcaacaagggttgaaatgggcgaggcggctgctatcttcatgactgctacaccaccaggcgtacttgggagtcggccat

SEQ ID NO: 4082 - DNA, 140 bp, Artificial Sequence
  Synthetic
atggccgactcccaagtacgcctggtggtgtagcagtcatgaagatagcagccgcctcgcccatttcaacccttgttgatatgtatcctcttgcagctatgcttgaaggatctgtgaaatggagacccagcatggcgtat

SEQ ID NO: 4083 - DNA, 140 bp, Artificial Sequence
  Synthetic
atacgccatgctgggtctccaacccgcgatgcgtttccagattccaactcaccaatcatggacacagaagtggaagtcccagagagagcctggagctcaggctttgactgggtgacggaccgtacttgggagtcggccat

SEQ ID NO: 4084 - DNA, 140 bp, Artificial Sequence
  Synthetic
atggccgactcccaagtacggtccgtcacccagtcaaagcctgagctccaggctctctctgggacttccacttctgtgtccatgattggtgagttggaatctggaaacgcatcgcgggttggagacccagcatggcgtat

SEQ ID NO: 4085 - DNA, 140 bp, Artificial Sequence
  Synthetic
atacgccatgctgggtctcccattctggaaaaacaatttggtttgttccaagtgtgagaaacggaaatgaaatcgcagcctgtctgacaaaggctggaaagcgggttatacagctcagcacgtacttgggagtcggccat

SEQ ID NO: 4086 - DNA, 140 bp, Artificial Sequence
  Synthetic
atggccgactcccaagtacgtgctgagctgtataacccgctttccagcctttgtcagacaggctgcgatttcatttccgtttctcacacttggaacaaaccaaattgtttttccagaatgggagacccagcatggcgtat

SEQ ID NO: 4087 - DNA, 140 bp, Artificial Sequence
  Synthetic
atacgccatgctgggtctccggaagacttttgagacagagtttcagaagacaaaaaatcaagagtgggactttgtcataacaactgacatttcagagatgggtgccaacttcaaggctgacgtacttgggagtcggccat

SEQ ID NO: 4088 - DNA, 140 bp, Artificial Sequence
  Synthetic
atggccgactcccaagtacgtcagccttgaagttggcacccatctctgaaatgtcagttgttatgacaaagtcccactcttgattttttgtcttctgaaactctgtctcaaaagtcttccggagacccagcatggcgtat

SEQ ID NO: 4089 - DNA, 140 bp, Artificial Sequence
  Synthetic
atacgccatgctgggtctccccgggtcatagattccaggagatgcctaaagccagtcatacttgatggtgagagagtcatcctggctgggcctatgcccgtcacgcacgccagtgctgctcgtacttgggagtcggccat

SEQ ID NO: 4090 - DNA, 140 bp, Artificial Sequence
  Synthetic
atggccgactcccaagtacgagcagcactggcgtgcgtgacgggcataggcccagccaggatgactctctcaccatcaagtatgactggctttaggcatctcctggaatctatgacccggggagacccagcatggcgtat

SEQ ID NO: 4091 - DNA, 140 bp, Artificial Sequence
  Synthetic
atacgccatgctgggtctcccagaggagaggacgtataggcaggaaccccaacaaacctggagatgagtatatgtatggaggtgggtgtgcagagactgatgaagaccatgcacactggccgtacttgggagtcggccat

SEQ ID NO: 4092 - DNA, 140 bp, Artificial Sequence
  Synthetic
atggccgactcccaagtacggccagtgtgcatggtcttcatcagtctctgcacacccacctccatacatatactcatctccaggtttgttggggttcctgcctatacgtcctctcctctgggagacccagcatggcgtat

SEQ ID NO: 4093 - DNA, 140 bp, Artificial Sequence
  Synthetic
atacgccatgctgggtctccttgaagcaagaatgcttctcgacaacatttacctccaggatggcctcatagcctcgctctatcggcctgaggctgacaaggttgccgccattgagggagacgtacttgggagtcggccat

SEQ ID NO: 4094 - DNA, 140 bp, Artificial Sequence
  Synthetic
atggccgactcccaagtacgtctccctcaatggcggcaaccttgtcagcctcaggccgatagagcgaggctatgaggccatcctggaggtaaatgttgtcgagaagcattcttgcttcaaggagacccagcatggcgtat

SEQ ID NO: 4095 - DNA, 140 bp, Artificial Sequence
  Synthetic
aggccctggctgctgatatggttcaagctgaggacagagcaaaggaagacctttgtggaactcatgaagagaggagaccttcccgtttggctggcctatcaagtagcatctgccggaatagaccttttgggacagcggtg

SEQ ID NO: 4096 - DNA, 140 bp, Artificial Sequence
  Synthetic
caccgctgtcccaaaaggtctattccggcagatgctacttgataggccagccaaacgggaaggtctcctctcttcatgagttccacaaaggtcttcctttgctctgtcctcagcttgaaccatatcagcagccagggcct

SEQ ID NO: 4097 - DNA, 140 bp, Artificial Sequence
  Synthetic
atacgccatgctgggtctccacttacacagacagaagatggtgctttgatggcactaccaacaacaccataatggaagacagtgtaccagcagaggtgtggaccaagtatggagagaagacgtacttgggagtcggccat

SEQ ID NO: 4098 - DNA, 140 bp, Artificial Sequence
  Synthetic
atggccgactcccaagtacgtcttctctccatacttggtccacacctctgctggtacactgtcttccattatggtgttgttggtagtgccatcaaagcaccatcttctgtctgtgtaagtggagacccagcatggcgtat

SEQ ID NO: 4099 - DNA, 140 bp, Artificial Sequence
  Synthetic
atacgccatgctgggtctccgagtgctcaaaccgaggtggatggatgccagggtctgttcagatcatgcggctttgaagtcgttcaaagaatttgccgctgggaagagaggagcggctttcgtacttgggagtcggccat

SEQ ID NO: 4100 - DNA, 140 bp, Artificial Sequence
  Synthetic
atggccgactcccaagtacgaaagccgctcctctcttcccagcggcaaattctttgaacgacttcaaagccgcatgatctgaacagaccctggcatccatccacctcggtttgagcactcggagacccagcatggcgtat

SEQ ID NO: 4101 - DNA, 140 bp, Artificial Sequence
  Synthetic
aggccctggctgctgatatggctttgaagtcgttcaaagaatttgccgctgggaagagaggagcggctttgggagtaatggatgccctaggaacattgccaggacacatgacagagaggtgaccttttgggacagcggtg

SEQ ID NO: 4102 - DNA, 140 bp, Artificial Sequence
  Synthetic
caccgctgtcccaaaaggtcacctctctgtcatgtgtcctggcaatgttcctagggcatccattactcccaaagccgctcctctcttcccagcggcaaattctttgaacgacttcaaagccatatcagcagccagggcct

SEQ ID NO: 4103 - DNA, 140 bp, Artificial Sequence
  Synthetic
aggccctggctgctgatatgagtaggccctacaaagcagcggcagctcaactgccggagaccctagagaccattatgctcttgggtttattgggaacagtttcgctagggatcttctttggaccttttgggacagcggtg

SEQ ID NO: 4104 - DNA, 140 bp, Artificial Sequence
  Synthetic
caccgctgtcccaaaaggtccaaagaagatccctagcgaaactgttcccaataaacccaagagcataatggtctctagggtctccggcagttgagctgccgctgctttgtagggcctactcatatcagcagccagggcct

SEQ ID NO: 4105 - DNA, 140 bp, Artificial Sequence
  Synthetic
aggccctggctgctgatatgtcttgatgcggaacaagggcatcgggaagatgggcttcggaatggtaacccttggggccagcgcatggctcatgtggctttcggaaattgaaccagccaggaccttttgggacagcggtg

SEQ ID NO: 4106 - DNA, 140 bp, Artificial Sequence
  Synthetic
caccgctgtcccaaaaggtcctggctggttcaatttccgaaagccacatgagccatgcgctggccccaagggttaccattccgaagcccatcttcccgatgcccttgttccgcatcaagacatatcagcagccagggcct

SEQ ID NO: 4107 - DNA, 140 bp, Artificial Sequence
  Synthetic
atacgccatgctgggtctccaatcgcatgtgtcctcattgtcgtgtttctgttactggtggtgctcatacctgagccagagaagcaaagatctccccaggacaatcaaatggcaatcatccgtacttgggagtcggccat

SEQ ID NO: 4108 - DNA, 140 bp, Artificial Sequence
  Synthetic
atggccgactcccaagtacggatgattgccatttgattgtcctggggagatctttgcttctctggctcaggtatgagcaccaccagtaacagaaacacgacaatgaggacacatgcgattggagacccagcatggcgtat

SEQ ID NO: 4109 - DNA, 140 bp, Artificial Sequence
  Synthetic
atacgccatgctgggtctccatcatggtggcagtgggccttctgggtttgataactgcaaacgaactcggatggctggaaagaacaaaaagtgatatagctcatctaatgggaaggaaagcgtacttgggagtcggccat

SEQ ID NO: 4110 - DNA, 140 bp, Artificial Sequence
  Synthetic
atggccgactcccaagtacgctttccttcccattagatgagctatatcactttttgttctttccagccatccgagttcgtttgcagttatcaaacccagaaggcccactgccaccatgatggagacccagcatggcgtat

SEQ ID NO: 4111 - DNA, 140 bp, Artificial Sequence
  Synthetic
atacgccatgctgggtctccaagaggggacaaccgtaggattctcaatggatattgatctgcggccagcctccgcctgggctatttatgccgcattgacaactctcatcaccccagccgtcgtacttgggagtcggccat

SEQ ID NO: 4112 - DNA, 140 bp, Artificial Sequence
  Synthetic
atggccgactcccaagtacgacggctggggtgatgagagttgtcaatgcggcataaatagcccaggcggaggctggccgcagatcaatatccattgagaatcctacggttgtcccctcttggagacccagcatggcgtat

SEQ ID NO: 4113 - DNA, 140 bp, Artificial Sequence
  Synthetic
aggccctggctgctgatatgtccgcctgggctatttatgccgcattgacaactctcatcaccccagccgtccaacatgcggtgaccacctcatacaacaactactccctgatggcgatgggaccttttgggacagcggtg

SEQ ID NO: 4114 - DNA, 140 bp, Artificial Sequence
  Synthetic
caccgctgtcccaaaaggtcccatcgccatcagggagtagttgttgtatgaggtggtcaccgcatgttggacggctggggtgatgagagttgtcaatgcggcataaatagcccaggcggacatatcagcagccagggcct

SEQ ID NO: 4115 - DNA, 140 bp, Artificial Sequence
  Synthetic
aggccctggctgctgatatgccacacaagctggagtgctgtttggcatgggcaaagggatgccattttatgcatgggactttggagtcccgctgctaatgatgggttgttactcacaattgaccttttgggacagcggtg

SEQ ID NO: 4116 - DNA, 140 bp, Artificial Sequence
  Synthetic
caccgctgtcccaaaaggtcaattgtgagtaacaacccatcattagcagcgggactccaaagtcccatgcataaaatggcatccctttgcccatgccaaacagcactccagcttgtgtggcatatcagcagccagggcct

SEQ ID NO: 4117 - DNA, 140 bp, Artificial Sequence
  Synthetic
atacgccatgctgggtctccaacacccctgaccctgatagtggccatcattctgcttgtggcacactacatgtatttgatcccaggtttgcaggcagcagcagcacgtgccgcccagaagcgtacttgggagtcggccat

SEQ ID NO: 4118 - DNA, 140 bp, Artificial Sequence
  Synthetic
atggccgactcccaagtacgcttctgggcggcacgtgctgctgctgcctgcaaacctgggatcaaatacatgtagtgtgccacaagcagaatgatggccactatcagggtcaggggtgttggagacccagcatggcgtat

SEQ ID NO: 4119 - DNA, 140 bp, Artificial Sequence
  Synthetic
atacgccatgctgggtctccaggacagcagctggcatcatgaagaatcccgttgttgatggaatagtggtgactgacattgacacaatgacaattgacccccaagtggagaagaagatggcgtacttgggagtcggccat

SEQ ID NO: 4120 - DNA, 140 bp, Artificial Sequence
  Synthetic
atggccgactcccaagtacgccatcttcttctccacttgggggtcaattgtcattgtgtcaatgtcagtcaccactattccatcaacaacgggattcttcatgatgccagctgctgtcctggagacccagcatggcgtat

SEQ ID NO: 4121 - DNA, 140 bp, Artificial Sequence
  Synthetic
atacgccatgctgggtctccgacaagtgttactcatagcagtagctgcctccagtgccgtgctgctgcggaccgcttggggatggggggaggctggggctctgatcacagcagcaacctccgtacttgggagtcggccat

SEQ ID NO: 4122 - DNA, 140 bp, Artificial Sequence
  Synthetic
atggccgactcccaagtacggaggttgctgctgtgatcagagccccagcctccccccatccccaagcggtccgcagcagcacggcactggaggcagctactgctatgagtaacacttgtcggagacccagcatggcgtat

SEQ ID NO: 4123 - DNA, 140 bp, Artificial Sequence
  Synthetic
atacgccatgctgggtctcccaccttatgggaaggctctccaaacaaatactggaactcctctacagccacttcactgtgcaatatcttcagaggaagttatttggcaggggcttcccttcgtacttgggagtcggccat

SEQ ID NO: 4124 - DNA, 140 bp, Artificial Sequence
  Synthetic
atggccgactcccaagtacgaagggaagcccctgccaaataacttcctctgaagatattgcacagtgaagtggctgtagaggagttccagtatttgtttggagagccttcccataaggtgggagacccagcatggcgtat

SEQ ID NO: 4125 - DNA, 140 bp, Artificial Sequence
  Synthetic
atacgccatgctgggtctccatttacacagtgacaagaaatgccggtctggttaagagacgtggaggtggaacgggagagactctgggagagaagtggaaagcccgcctgaaccagatgtcgtacttgggagtcggccat

SEQ ID NO: 4126 - DNA, 140 bp, Artificial Sequence
  Synthetic
atggccgactcccaagtacgacatctggttcaggcgggctttccacttctctcccagagtctctcccgttccacctccacgtctcttaaccagaccggcatttcttgtcactgtgtaaatggagacccagcatggcgtat

SEQ ID NO: 4127 - DNA, 140 bp, Artificial Sequence
  Synthetic
atacgccatgctgggtctcccggctttggagttctattcttacaaaaagtcaggcatcaccgaagtgtgtagggaggaggcacgccgcgccctcaaggatggagtggccacaggaggacacgtacttgggagtcggccat

SEQ ID NO: 4128 - DNA, 140 bp, Artificial Sequence
  Synthetic
atggccgactcccaagtacgtgtcctcctgtggccactccatccttgagggcgcggcgtgcctcctccctacacacttcggtgatgcctgactttttgtaagaatagaactccaaagccgggagacccagcatggcgtat

SEQ ID NO: 4129 - DNA, 140 bp, Artificial Sequence
  Synthetic
atacgccatgctgggtctcctgctgtatcccggggaagcgcaaagcttagatggttggtagagagaggatacctgcagccccatggaaaggttgttgacctcggatgtggcagagggggccgtacttgggagtcggccat

SEQ ID NO: 4130 - DNA, 140 bp, Artificial Sequence
  Synthetic
atggccgactcccaagtacggccccctctgccacatccgaggtcaacaacctttccatggggctgcaggtatcctctctctaccaaccatctaagctttgcgcttccccgggatacagcaggagacccagcatggcgtat

SEQ ID NO: 4131 - DNA, 140 bp, Artificial Sequence
  Synthetic
aggccctggctgctgatatgacctgcagccccatggaaaggttgttgacctcggatgtggcagagggggctggagttattacgctgccaccatccgtaaagtgcaggaggtcagaggatagaccttttgggacagcggtg

SEQ ID NO: 4132 - DNA, 140 bp, Artificial Sequence
  Synthetic
caccgctgtcccaaaaggtctatcctctgacctcctgcactttacggatggtggcagcgtaataactccagccccctctgccacatccgaggtcaacaacctttccatggggctgcaggtcatatcagcagccagggcct

SEQ ID NO: 4133 - DNA, 140 bp, Artificial Sequence
  Synthetic
aggccctggctgctgatatgcacaaagggaggtcctggtcatgaagaacccatgctggtgcaaagctatgggtggaacatagttcgcctcaagagtggagtggacgtctttcacatggcggaccttttgggacagcggtg

SEQ ID NO: 4134 - DNA, 140 bp, Artificial Sequence
  Synthetic
caccgctgtcccaaaaggtccgccatgtgaaagacgtccactccactcttgaggcgaactatgttccacccatagctttgcaccagcatgggttcttcatgaccaggacctccctttgtgcatatcagcagccagggcct

SEQ ID NO: 4135 - DNA, 140 bp, Artificial Sequence
  Synthetic
atacgccatgctgggtctccgctgagccgtgtgacactttgctgtgtgacattggcgagtcatcgtccagtcctgaagtggaagagacgcgaacactcagagtgctctccatggtgggagcgtacttgggagtcggccat

SEQ ID NO: 4136 - DNA, 140 bp, Artificial Sequence
  Synthetic
atggccgactcccaagtacgctcccaccatggagagcactctgagtgttcgcgtctcttccacttcaggactggacgatgactcgccaatgtcacacagcaaagtgtcacacggctcagcggagacccagcatggcgtat

SEQ ID NO: 4137 - DNA, 140 bp, Artificial Sequence
  Synthetic
atacgccatgctgggtctccactggctcgagaaaagaccaggggccttctgcataaaggtgctgtgcccatacaccagtactatgatggagaccatggagcgactgcaacgtaggtatggcgtacttgggagtcggccat

SEQ ID NO: 4138 - DNA, 140 bp, Artificial Sequence
  Synthetic
atggccgactcccaagtacgccatacctacgttgcagtcgctccatggtctccatcatagtactggtgtatgggcacagcacctttatgcagaaggcccctggtcttttctcgagccagtggagacccagcatggcgtat

SEQ ID NO: 4139 - DNA, 140 bp, Artificial Sequence
  Synthetic
aggccctggctgctgatatgtacaccagtactatgatggagaccatggagcgactgcaacgtaggtatgggggaggattggtcagagtgccattgtcccgcaactccacacatgagatgtgaccttttgggacagcggtg

SEQ ID NO: 4140 - DNA, 140 bp, Artificial Sequence
  Synthetic
caccgctgtcccaaaaggtcacatctcatgtgtggagttgcgggacaatggcactctgaccaatcctcccccatacctacgttgcagtcgctccatggtctccatcatagtactggtgtacatatcagcagccagggcct

SEQ ID NO: 4141 - DNA, 140 bp, Artificial Sequence
  Synthetic
aggccctggctgctgatatgattgggtctctggagccaaaagtaacatcataaagagtgtgtccaccacaagtcagctcctcttgggacgcatggatgggcctaggaggccagtgaaatagaccttttgggacagcggtg

SEQ ID NO: 4142 - DNA, 140 bp, Artificial Sequence
  Synthetic
caccgctgtcccaaaaggtctatttcactggcctcctaggcccatccatgcgtcccaagaggagctgacttgtggtggacacactctttatgatgttacttttggctccagagacccaatcatatcagcagccagggcct

SEQ ID NO: 4143 - DNA, 140 bp, Artificial Sequence
  Synthetic
atacgccatgctgggtctcctgaagaggatgtgaacctcggctcaggcacacgagctgtggcaagctgtgctgaggctcccaacatgaagatcattggtaggcgcattgagagaatccgccgtacttgggagtcggccat

SEQ ID NO: 4144 - DNA, 140 bp, Artificial Sequence
  Synthetic
atggccgactcccaagtacggcggattctctcaatgcgcctaccaatgatcttcatgttgggagcctcagcacagcttgccacagctcgtgtgcctgagccgaggttcacatcctcttcaggagacccagcatggcgtat

SEQ ID NO: 4145 - DNA, 140 bp, Artificial Sequence
  Synthetic
aggccctggctgctgatatgaatgaacatgcagagacatggttctttgatgaaaaccacccatacaggacatgggcctaccatgggagctacgaagcccccacgcaggggtcagcgtcatgaccttttgggacagcggtg

SEQ ID NO: 4146 - DNA, 140 bp, Artificial Sequence
  Synthetic
caccgctgtcccaaaaggtcatgacgctgacccctgcgtgggggcttcgtagctcccatggtaggcccatgtcctgtatgggtggttttcatcaaagaaccatgtctctgcatgttcattcatatcagcagccagggcct

SEQ ID NO: 4147 - DNA, 140 bp, Artificial Sequence
  Synthetic
atacgccatgctgggtctccccctcgtgaacggggttgttagactcctgtcaaagccctgggatgtggtgactggagtcacaggaatagctatgactgacaccacgccatacggccaacacgtacttgggagtcggccat

SEQ ID NO: 4148 - DNA, 140 bp, Artificial Sequence
  Synthetic
atggccgactcccaagtacgtgttggccgtatggcgtggtgtcagtcatagctattcctgtgactccagtcaccacatcccagggctttgacaggagtctaacaaccccgttcacgagggggagacccagcatggcgtat

SEQ ID NO: 4149 - DNA, 140 bp, Artificial Sequence
  Synthetic
atacgccatgctgggtctccaagagtcttcaaagaaaaggtggacactagggtgccagacccccaagaaggcacccgccgagtaatgaacatggtctcgtcttggctatggaaggagctgcgtacttgggagtcggccat

SEQ ID NO: 4150 - DNA, 140 bp, Artificial Sequence
  Synthetic
atggccgactcccaagtacgcagctccttccatagccaagacgagaccatgttcattactcggcgggtgccttcttgggggtctggcaccctagtgtccaccttttctttgaagactcttggagacccagcatggcgtat

SEQ ID NO: 4151 - DNA, 140 bp, Artificial Sequence
  Synthetic
atacgccatgctgggtctccggaaaacgcaagcggccacgtgtctgcaccaaagaagagttcatcaataaggtgcgcagcaatgcagcactgggagcaatatttgaagaggaaaaagaatcgtacttgggagtcggccat

SEQ ID NO: 4152 - DNA, 140 bp, Artificial Sequence
  Synthetic
atggccgactcccaagtacgattctttttcctcttcaaatattgctcccagtgctgcattgctgcgcaccttattgatgaactcttctttggtgcagacacgtggccgcttgcgttttccggagacccagcatggcgtat

SEQ ID NO: 4153 - DNA, 140 bp, Artificial Sequence
  Synthetic
atacgccatgctgggtctccggaagacagctgtagaagctgtgaatgatccgagattttgggctctagtggacaaggaaagagaacaccacctgagaggagagtgtcacagctgtgtgtacgtacttgggagtcggccat

SEQ ID NO: 4154 - DNA, 140 bp, Artificial Sequence
  Synthetic
atggccgactcccaagtacgtacacacagctgtgacactctcctctcaggtggtgttctctttccttgtccactagagcccaaaatctcggatcattcacagcttctacagctgtcttccggagacccagcatggcgtat

SEQ ID NO: 4155 - DNA, 140 bp, Artificial Sequence
  Synthetic
atacgccatgctgggtctcccaacatgatgggaaaaagagaaaagaagcaaggagaattcgggaaagcaaaaggcagccgcgcaatctggtacatgtggttgggagccagatttctggagcgtacttgggagtcggccat

SEQ ID NO: 4156 - DNA, 140 bp, Artificial Sequence
  Synthetic
atggccgactcccaagtacgctccagaaatctggctcccaaccacatgtaccagattgcgcggctgccttttgctttcccgaattctccttgcttcttttctctttttcccatcatgttgggagacccagcatggcgtat

SEQ ID NO: 4157 - DNA, 140 bp, Artificial Sequence
  Synthetic
atacgccatgctgggtctcctttgaggctcttggattcttgaatgaggaccattggatgggaagagaaaactcaggaggtggcgttgaagggctaggactgcaaaggcttggatacattccgtacttgggagtcggccat

SEQ ID NO: 4158 - DNA, 140 bp, Artificial Sequence
  Synthetic
atggccgactcccaagtacggaatgtatccaagcctttgcagtcctagcccttcaacgccacctcctgagttttctcttcccatccaatggtcctcattcaagaatccaagagcctcaaaggagacccagcatggcgtat

SEQ ID NO: 4159 - DNA, 140 bp, Artificial Sequence
  Synthetic
atacgccatgctgggtctcctagaagaaatgaaccgggcgccaggaggaaagatgtatgcagatgacaccgctggctgggatacccgtattagcaggtttgatctggagaatgaagccctcgtacttgggagtcggccat

SEQ ID NO: 4160 - DNA, 140 bp, Artificial Sequence
  Synthetic
atggccgactcccaagtacgagggcttcattctccagatcaaacctgctaatacgggtatcccagccagcggtgtcatctgcatacatctttcctcctggcgcccggttcatttcttctaggagacccagcatggcgtat

SEQ ID NO: 4161 - DNA, 140 bp, Artificial Sequence
  Synthetic
atacgccatgctgggtctcccggacaagttgttacttatgctctcaacacattcaccaacctggtggtgcagcttatccggaacatggaggctgaggaggtgctagagatgcatgatctacgtacttgggagtcggccat

SEQ ID NO: 4162 - DNA, 140 bp, Artificial Sequence
  Synthetic
atggccgactcccaagtacgtagatcatgcatctctagcacctcctcagcctccatgttccggataagctgcaccaccaggttggtgaatgtgttgagagcataagtaacaacttgtccgggagacccagcatggcgtat

SEQ ID NO: 4163 - DNA, 140 bp, Artificial Sequence
  Synthetic
atacgccatgctgggtctcctggctgttgaggaagccagagaaagtgaccagatggttgcagagcaatggatgggacagactcaaacgaatggcagtcagtggagatgactgcgttgtaacgtacttgggagtcggccat

SEQ ID NO: 4164 - DNA, 140 bp, Artificial Sequence
  Synthetic
atggccgactcccaagtacgttacaacgcagtcatctccactgactgccattcgtttgagtctgtcccatccattgctctgcaaccatctggtcactttctctggcttcctcaacagccaggagacccagcatggcgtat

SEQ ID NO: 4165 - DNA, 140 bp, Artificial Sequence
  Synthetic
aggccctggctgctgatatgagccaattgatgataggtttgcacatgccctcaggttcttgaatgacatgggaaaagttaggaaagacacacaggaatggaaaccctcgactggatggaggaccttttgggacagcggtg

SEQ ID NO: 4166 - DNA, 140 bp, Artificial Sequence
  Synthetic
caccgctgtcccaaaaggtcctccatccagtcgagggtttccattcctgtgtgtctttcctaacttttcccatgtcattcaagaacctgagggcatgtgcaaacctatcatcaattggctcatatcagcagccagggcct

SEQ ID NO: 4167 - DNA, 140 bp, Artificial Sequence
  Synthetic
atacgccatgctgggtctcccaattgggaagaagtcccgttctgttcccaccacttcaacaagctgcacctcaaggatgggagatccattgtggtcccctgccgccaccaagatgaactgcgtacttgggagtcggccat

SEQ ID NO: 4168 - DNA, 140 bp, Artificial Sequence
  Synthetic
atggccgactcccaagtacgcagttcatcttggtggcggcaggggaccacaatggatctcccatccttgaggtgcagcttgttgaagtggtgggaacagaacgggacttcttcccaattgggagacccagcatggcgtat

SEQ ID NO: 4169 - DNA, 140 bp, Artificial Sequence
  Synthetic
atacgccatgctgggtctccattggccgagcccgtgtctcaccaggggcaggatggagcatccgggagactgcctgtcttgcaaaatcatatgcccagatgtggcagcttctttatttcccgtacttgggagtcggccat

SEQ ID NO: 4170 - DNA, 140 bp, Artificial Sequence
  Synthetic
atggccgactcccaagtacgggaaataaagaagctgccacatctgggcatatgattttgcaagacaggcagtctcccggatgctccatcctgcccctggtgagacacgggctcggccaatggagacccagcatggcgtat

SEQ ID NO: 4171 - DNA, 140 bp, Artificial Sequence
  Synthetic
atacgccatgctgggtctccacagaagagacctccgactgatggccaatgccatctgttcggccgtgccagccgactgggtcccaactgggagaaccacctggtcaatccatggaaagggcgtacttgggagtcggccat

SEQ ID NO: 4172 - DNA, 140 bp, Artificial Sequence
  Synthetic
atggccgactcccaagtacgccctttccatggattgaccaggtggttctcccagttgggacccagtcggctggcacggccgaacagatggcattggccatcagtcggaggtctcttctgtggagacccagcatggcgtat

SEQ ID NO: 4173 - DNA, 140 bp, Artificial Sequence
  Synthetic
atacgccatgctgggtctccagaatggatgactaatgaggacatgctcatggtgtggaatagagtgtggattgaggagaacgaccacatgggggacaagacccctgtaacaaaatggacacgtacttgggagtcggccat

SEQ ID NO: 4174 - DNA, 140 bp, Artificial Sequence
  Synthetic
atggccgactcccaagtacgtgtccattttgttacaggggtcttgtcccccatgtggtcgttctcctcaatccacactctattccacaccatgagcatgtcctcattagtcatccattctggagacccagcatggcgtat

SEQ ID NO: 4175 - DNA, 140 bp, Artificial Sequence
  Synthetic
aggccctggctgctgatatgcatggtgcgtaggatcataggtgatgaagaaaggtacatggactacctatccacccaggtacgctacttgggtgaggaggggtccacacctggagtgctggaccttttgggacagcggtg

SEQ ID NO: 4176 - DNA, 140 bp, Artificial Sequence
  Synthetic
caccgctgtcccaaaaggtccagcactccaggtgtggacccctcctcacccaagtagcgtacctgggtggataggtagtccatgtacctttcttcatcacctatgatcctacgcaccatgcatatcagcagccagggcct

SEQ ID NO: 4177 - DNA, 140 bp, Artificial Sequence
  Synthetic
atacgccatgctgggtctccatgaaaaacccaaaaaagaaatccggaggattccggattgtcaatatgctaaaacgcggagtagcccgtgtgagcccctttgggggcttgaagaggctaccgtacttgggagtcggccat

SEQ ID NO: 4178 - DNA, 140 bp, Artificial Sequence
  Synthetic
atggccgactcccaagtacggtagcctcttcaagcccccaaaggggctcacacgggctactccgcgttttagcatattgacaatccggaatcctccggatttcttttttgggtttttcatggagacccagcatggcgtat

SEQ ID NO: 4179 - DNA, 140 bp, Artificial Sequence
  Synthetic
atacgccatgctgggtctcccagctggacttctgctgggtcatggacccatcaggatggtcttggcgatactagccttcttgagattcacggcaatcaagccatcactgggtctcatcaacgtacttgggagtcggccat

SEQ ID NO: 4180 - DNA, 140 bp, Artificial Sequence
  Synthetic
atggccgactcccaagtacgttgatgagacccagtgatggcttgattgccgtgaatctcaagaaggctagtatcgccaagaccatcctgatgggtccatgacccagcagaagtccagctgggagacccagcatggcgtat

SEQ ID NO: 4181 - DNA, 140 bp, Artificial Sequence
  Synthetic
atacgccatgctgggtctcctagatggggttccgtggggaaaaaagaggctatggaaataataaagaagttcaagaaagatctggctgccatgctgagaataatcaatgctaggaaggagcgtacttgggagtcggccat

SEQ ID NO: 4182 - DNA, 140 bp, Artificial Sequence
  Synthetic
atggccgactcccaagtacgctccttcctagcattgattattctcagcatggcagccagatctttcttgaacttctttattatttccatagcctcttttttccccacggaaccccatctaggagacccagcatggcgtat

SEQ ID NO: 4183 - DNA, 140 bp, Artificial Sequence
  Synthetic
atacgccatgctgggtctccaagaagagacgtggcgcagacaccagtgtcggaattgttggcctcctgctgaccacagccatggcagtggaggtcaccagacgtgggagtgcatactatacgtacttgggagtcggccat

SEQ ID NO: 4184 - DNA, 140 bp, Artificial Sequence
  Synthetic
atggccgactcccaagtacgtatagtatgcactcccacgtctggtgacctccactgccatggctgtggtcagcaggaggccaacaattccgacactggtgtctgcgccacgtctcttcttggagacccagcatggcgtat

SEQ ID NO: 4185 - DNA, 140 bp, Artificial Sequence
  Synthetic
atacgccatgctgggtctcctgtacttagacagaagcgatgctggggaggccatatcttttccaaccacactgggggtgaataagtgttacatacagatcatggatcttggacacatgtgcgtacttgggagtcggccat

SEQ ID NO: 4186 - DNA, 140 bp, Artificial Sequence
  Synthetic
atggccgactcccaagtacgcacatgtgtccaagatccatgatctgtatgtaacacttattcacccccagtgtggttggaaaagatatggcctccccagcatcgcttctgtctaagtacaggagacccagcatggcgtat

SEQ ID NO: 4187 - DNA, 140 bp, Artificial Sequence
  Synthetic
atacgccatgctgggtctcctgatgccacaatgagctatgaatgccctatgttggatgagggggtagaaccagatgacgtcgattgctggtgcaacacgacatcgacttgggttgtgtaccgtacttgggagtcggccat

SEQ ID NO: 4188 - DNA, 140 bp, Artificial Sequence
  Synthetic
atggccgactcccaagtacggtacacaacccaagtcgatgtcgtgttgcaccagcaatcgacgtcatctggttctaccccctcatccaacatagggcattcatagctcattgtggcatcaggagacccagcatggcgtat

SEQ ID NO: 4189 - DNA, 140 bp, Artificial Sequence
  Synthetic
atacgccatgctgggtctccggaacctgccatcacaaaaaaggtgaggcacggagatctagaagagctgtgacgctcccctctcattccactaggaagctgcaaacgcggtcgcagacctcgtacttgggagtcggccat

SEQ ID NO: 4190 - DNA, 140 bp, Artificial Sequence
  Synthetic
atggccgactcccaagtacgaggtctgcgaccgcgtttgcagcttcctagtggaatgagaggggagcgtcacagctcttctagatctccgtgcctcaccttttttgtgatggcaggttccggagacccagcatggcgtat

SEQ ID NO: 4191 - DNA, 140 bp, Artificial Sequence
  Synthetic
atacgccatgctgggtctccggttggaatcaagagaatacacaaagcacttgatcagagtcgaaaattggatattcaggaaccctggctttgcgttggcagcagctgccattgcttggctcgtacttgggagtcggccat

SEQ ID NO: 4192 - DNA, 140 bp, Artificial Sequence
  Synthetic
atggccgactcccaagtacgagccaagcaatggcagctgctgccaacgcaaagccagggttcctgaatatccaattttcgactctgatcaagtgctttgtgtattctcttgattccaaccggagacccagcatggcgtat

SEQ ID NO: 4193 - DNA, 140 bp, Artificial Sequence
  Synthetic
atacgccatgctgggtctcctttgggaagctcaacgagccaaaaagtcatatacttggtcatgatactgttgattgccccggcatacagtatcaggtgcataggagtcagcaatagggatcgtacttgggagtcggccat

SEQ ID NO: 4194 - DNA, 140 bp, Artificial Sequence
  Synthetic
atggccgactcccaagtacgatccctattgctgactcctatgcacctgatactgtatgccggggcaatcaacagtatcatgaccaagtatatgactttttggctcgttgagcttcccaaaggagacccagcatggcgtat

SEQ ID NO: 4195 - DNA, 140 bp, Artificial Sequence
  Synthetic
atacgccatgctgggtctcctttgtggaaggtatgtcaggtgggacctgggttgatgttgtcttggaacatggaggttgtgttaccgtaatggcacaggacaagccaactgttgatatagcgtacttgggagtcggccat

SEQ ID NO: 4196 - DNA, 140 bp, Artificial Sequence
  Synthetic
atggccgactcccaagtacgctatatcaacagttggcttgtcctgtgccattacggtaacacaacctccatgttccaagacaacatcaacccaggtcccacctgacataccttccacaaaggagacccagcatggcgtat

SEQ ID NO: 4197 - DNA, 140 bp, Artificial Sequence
  Synthetic
atacgccatgctgggtctccagttggtcacaacaacggttagcaacatggcggaggtaagatcctactgctacgaggcatcaatatcggacatggcttcggacagccgctgcccaacacacgtacttgggagtcggccat

SEQ ID NO: 4198 - DNA, 140 bp, Artificial Sequence
  Synthetic
atggccgactcccaagtacgtgtgttgggcagcggctgtccgaagccatgtccgatattgatgcctcgtagcagtaggatcttacctccgccatgttgctaaccgttgttgtgaccaactggagacccagcatggcgtat

SEQ ID NO: 4199 - DNA, 140 bp, Artificial Sequence
  Synthetic
atacgccatgctgggtctccaggtgaagcctaccttgacaagcagtcagacactcaatatgtttgcaaaagaacgttagtggacagaggttggggaaatggatgtggactctttggcaaacgtacttgggagtcggccat

SEQ ID NO: 4200 - DNA, 140 bp, Artificial Sequence
  Synthetic
atggccgactcccaagtacgtttgccaaagagtccacatccatttccccaacctctgtccactaacgttcttttgcaaacatattgagtgtctgactgcttgtcaaggtaggcttcacctggagacccagcatggcgtat

SEQ ID NO: 4201 - DNA, 140 bp, Artificial Sequence
  Synthetic
atacgccatgctgggtctccgggagcctggtgacatgcgccaagtttgcatgctccaagaaaatgactgggaagagcatccagccagagaacctggagtaccggataatgctgtcagttccgtacttgggagtcggccat

SEQ ID NO: 4202 - DNA, 140 bp, Artificial Sequence
  Synthetic
atggccgactcccaagtacggaactgacagcattatccggtactccaggttctctggctggatgctcttcccagtcattttcttggagcatgcaaacttggcgcatgtcaccaggctcccggagacccagcatggcgtat

SEQ ID NO: 4203 - DNA, 140 bp, Artificial Sequence
  Synthetic
atacgccatgctgggtctccatggctcccagcacagtgggatgattgttaatgacaaaggacatgaaactgatgagaatagagcgaaggttgagataacgcccaattcaccaagagccgacgtacttgggagtcggccat

SEQ ID NO: 4204 - DNA, 140 bp, Artificial Sequence
  Synthetic
atggccgactcccaagtacgtcggctcttggtgaattgggcgttatctcaaccttcgctctattctcatcagtttcatgtcctttgtcattaacaatcatcccactgtgctgggagccatggagacccagcatggcgtat

SEQ ID NO: 4205 - DNA, 140 bp, Artificial Sequence
  Synthetic
atacgccatgctgggtctccatggctcccagcacagtgggatgattgttaatgacataggacatgaaactgatgagaatagagcgaaggttgagataacgcccaattcaccaagagccgacgtacttgggagtcggccat

SEQ ID NO: 4206 - DNA, 140 bp, Artificial Sequence
  Synthetic
atggccgactcccaagtacgtcggctcttggtgaattgggcgttatctcaaccttcgctctattctcatcagtttcatgtcctatgtcattaacaatcatcccactgtgctgggagccatggagacccagcatggcgtat

SEQ ID NO: 4207 - DNA, 140 bp, Artificial Sequence
  Synthetic
atacgccatgctgggtctccatggctcccagcacagtgggatgattgttaatgacacaggacatgaaactgatgagaatagagcgaaggttgagataacgcccaattcaccaagagccgacgtacttgggagtcggccat

SEQ ID NO: 4208 - DNA, 140 bp, Artificial Sequence
  Synthetic
atggccgactcccaagtacgtcggctcttggtgaattgggcgttatctcaaccttcgctctattctcatcagtttcatgtcctgtgtcattaacaatcatcccactgtgctgggagccatggagacccagcatggcgtat

SEQ ID NO: 4209 - DNA, 140 bp, Artificial Sequence
  Synthetic
atacgccatgctgggtctccatggctcccagcacagtgggatgattgttaatgacagaggacatgaaactgatgagaatagagcgaaggttgagataacgcccaattcaccaagagccgacgtacttgggagtcggccat

SEQ ID NO: 4210 - DNA, 140 bp, Artificial Sequence
  Synthetic
atggccgactcccaagtacgtcggctcttggtgaattgggcgttatctcaaccttcgctctattctcatcagtttcatgtcctctgtcattaacaatcatcccactgtgctgggagccatggagacccagcatggcgtat

SEQ ID NO: 4211 - DNA, 140 bp, Artificial Sequence
  Synthetic
atacgccatgctgggtctcccaggccttgacttttcagatttgtattacttgactatgaataacaagcattggttggtgcacaaggagtggttccatgacattccactaccttggcatgccgtacttgggagtcggccat

SEQ ID NO: 4212 - DNA, 140 bp, Artificial Sequence
  Synthetic
atggccgactcccaagtacggcatgccaaggtagtggaatgtcatggaaccactccttgtgcaccaaccaatgcttgttattcatagtcaagtaatacaaatctgaaaagtcaaggcctgggagacccagcatggcgtat

SEQ ID NO: 4213 - DNA, 140 bp, Artificial Sequence
  Synthetic
atacgccatgctgggtctcccaagaaggagccgttcacacggctcttgctggagccctggaggctgagatggatggtgcaaagggaaggctgtcctctggccacttgaaatgtcgcttgacgtacttgggagtcggccat

SEQ ID NO: 4214 - DNA, 140 bp, Artificial Sequence
  Synthetic
atggccgactcccaagtacgtcaagcgacatttcaagtggccagaggacagccttccctttgcaccatccatctcagcctccagggctccagcaagagccgtgtgaacggctccttcttgggagacccagcatggcgtat

SEQ ID NO: 4215 - DNA, 140 bp, Artificial Sequence
  Synthetic
atacgccatgctgggtctccaaatggacaaacttagattgaagggcgtgtcatactccttatgtaccgcggcgttcacattcaccaagatcccggctgaaacgctgcatgggacagtcaccgtacttgggagtcggccat

SEQ ID NO: 4216 - DNA, 140 bp, Artificial Sequence
  Synthetic
atggccgactcccaagtacggtgactgtcccatgcagcgtttcagccgggatcttggtgaatgtgaacgccgcggtacataaggagtatgacacgcccttcaatctaagtttgtccatttggagacccagcatggcgtat

SEQ ID NO: 4217 - DNA, 140 bp, Artificial Sequence
  Synthetic
atacgccatgctgggtctccagtggaggtacagtatgcagggacagatggaccctgcaaggttccagctcagatggcggtggatatgcaaactctgaccccagttgggaggttgataacccgtacttgggagtcggccat

SEQ ID NO: 4218 - DNA, 140 bp, Artificial Sequence
  Synthetic
atggccgactcccaagtacgggttatcaacctcccaactggggtcagagtttgcatatccaccgccatctgagctggaaccttgcagggtccatctgtccctgcatactgtacctccactggagacccagcatggcgtat

SEQ ID NO: 4219 - DNA, 140 bp, Artificial Sequence
  Synthetic
atacgccatgctgggtctccgctaaccctgtgatcactgaaagcactgagaattcaaagatgatgttggaacttgacccaccatttggggattcttacattgtcataggagttggggatacgtacttgggagtcggccat

SEQ ID NO: 4220 - DNA, 140 bp, Artificial Sequence
  Synthetic
atggccgactcccaagtacgtatccccaactcctatgacaatgtaagaatccccaaatggtgggtcaagttccaacatcatctttgaattctcagtgctttcagtgatcacagggttagcggagacccagcatggcgtat

SEQ ID NO: 4221 - DNA, 140 bp, Artificial Sequence
  Synthetic
atacgccatgctgggtctccagaagatcacccaccactggaacaggagtggcagcaccatcggaaaagcatttgaagccactgtgagaggcgccaagagaatggcagtcttgggagacaccgtacttgggagtcggccat

SEQ ID NO: 4222 - DNA, 140 bp, Artificial Sequence
  Synthetic
atggccgactcccaagtacggtgtctcccaagactgccattctcttggcgcctctcacagtggcttcaaatgcttttccgatggtgctgccactcctgttccagtggtgggtgatcttctggagacccagcatggcgtat

SEQ ID NO: 4223 - DNA, 140 bp, Artificial Sequence
  Synthetic
atacgccatgctgggtctccagaagatcacccaccactggtacaggagtggcagcaccatcggaaaagcatttgaagccactgtgagaggcgccaagagaatggcagtcttgggagacaccgtacttgggagtcggccat

SEQ ID NO: 4224 - DNA, 140 bp, Artificial Sequence
  Synthetic
atggccgactcccaagtacggtgtctcccaagactgccattctcttggcgcctctcacagtggcttcaaatgcttttccgatggtgctgccactcctgtaccagtggtgggtgatcttctggagacccagcatggcgtat

SEQ ID NO: 4225 - DNA, 140 bp, Artificial Sequence
  Synthetic
atacgccatgctgggtctccagaagatcacccaccactggcacaggagtggcagcaccatcggaaaagcatttgaagccactgtgagaggcgccaagagaatggcagtcttgggagacaccgtacttgggagtcggccat

SEQ ID NO: 4226 - DNA, 140 bp, Artificial Sequence
  Synthetic
atggccgactcccaagtacggtgtctcccaagactgccattctcttggcgcctctcacagtggcttcaaatgcttttccgatggtgctgccactcctgtgccagtggtgggtgatcttctggagacccagcatggcgtat

SEQ ID NO: 4227 - DNA, 140 bp, Artificial Sequence
  Synthetic
atacgccatgctgggtctccagaagatcacccaccactgggacaggagtggcagcaccatcggaaaagcatttgaagccactgtgagaggcgccaagagaatggcagtcttgggagacaccgtacttgggagtcggccat

SEQ ID NO: 4228 - DNA, 140 bp, Artificial Sequence
  Synthetic
atggccgactcccaagtacggtgtctcccaagactgccattctcttggcgcctctcacagtggcttcaaatgcttttccgatggtgctgccactcctgtcccagtggtgggtgatcttctggagacccagcatggcgtat

SEQ ID NO: 4229 - DNA, 140 bp, Artificial Sequence
  Synthetic
atacgccatgctgggtctccagcctgggactttggatcagtcggaggtgctctcaactcattgggcaagggcatccatcaaatttttggagcagctttcaaatcattgtttggaggaatgcgtacttgggagtcggccat

SEQ ID NO: 4230 - DNA, 140 bp, Artificial Sequence
  Synthetic
atggccgactcccaagtacgcattcctccaaacaatgatttgaaagctgctccaaaaatttgatggatgcccttgcccaatgagttgagagcacctccgactgatccaaagtcccaggctggagacccagcatggcgtat

SEQ ID NO: 4231 - DNA, 140 bp, Artificial Sequence
  Synthetic
atacgccatgctgggtctcctcctggttctcacaaatcctcataggaacgttgctggtgtggttgggtctgaacacaaagaatggatctatttcccttacgtgcttggccttagggggagcgtacttgggagtcggccat

SEQ ID NO: 4232 - DNA, 140 bp, Artificial Sequence
  Synthetic
atggccgactcccaagtacgctccccctaaggccaagcacgtaagggaaatagatccattctttgtgttcagacccaaccacaccagcaacgttcctatgaggatttgtgagaaccaggaggagacccagcatggcgtat

SEQ ID NO: 4233 - DNA, 140 bp, Artificial Sequence
  Synthetic
atacgccatgctgggtctcctgttgatcttcctatctacagccgtctctgctgatgtggggtgttcggtggacttctcaaagaaggaaacgagatgcggtacgggggtgttcgtctataacgtacttgggagtcggccat

SEQ ID NO: 4234 - DNA, 140 bp, Artificial Sequence
  Synthetic
atggccgactcccaagtacgttatagacgaacacccccgtaccgcatctcgtttccttctttgagaagtccaccgaacaccccacatcagcagagacggctgtagataggaagatcaacaggagacccagcatggcgtat

SEQ ID NO: 4235 - DNA, 140 bp, Artificial Sequence
  Synthetic
atacgccatgctgggtctcccgacgttgaagcctggagggacaggtacaagtaccatcctgactcccctcgtagattggcagcagcagtcaagcaggcctgggaagatgggatctgtgggcgtacttgggagtcggccat

SEQ ID NO: 4236 - DNA, 140 bp, Artificial Sequence
  Synthetic
atggccgactcccaagtacgcccacagatcccatcttcccaggcctgcttgactgctgctgccaatctacgaggggagtcaggatggtacttgtacctgtccctccaggcttcaacgtcgggagacccagcatggcgtat

SEQ ID NO: 4237 - DNA, 140 bp, Artificial Sequence
  Synthetic
atacgccatgctgggtctccatctcctctgtttcaagaatggaaaacattatgtggagatcagtagaaggggagctcaacgcaattctggaagagaatggagttcaactgacggtcgttgcgtacttgggagtcggccat

SEQ ID NO: 4238 - DNA, 140 bp, Artificial Sequence
  Synthetic
atggccgactcccaagtacgcaacgaccgtcagttgaactccattctcttccagaattgcgttgagctccccttctactgatctccacataatgttttccattcttgaaacagaggagatggagacccagcatggcgtat

SEQ ID NO: 4239 - DNA, 140 bp, Artificial Sequence
  Synthetic
atacgccatgctgggtctcctgggatctgtaaaaaaccccatgtggagaggtccgcagaggttgcctgtgcctgtgaatgagctgccccacggttggaaggcctgggggaaatcgtacttcgtacttgggagtcggccat

SEQ ID NO: 4240 - DNA, 140 bp, Artificial Sequence
  Synthetic
atggccgactcccaagtacgaagtacgatttcccccaggccttccaaccgtggggcagctcattcacaggcacaggcaacctctgcggacctctccacatggggttttttacagatcccaggagacccagcatggcgtat

SEQ ID NO: 4241 - DNA, 140 bp, Artificial Sequence
  Synthetic
atacgccatgctgggtctcctgtcagggcagcaaagaccaacaacagctttgttgtggatggtgacacactgaaggaatgcccgctcaaacacagagcatggaacagctttcttgtggagcgtacttgggagtcggccat

SEQ ID NO: 4242 - DNA, 140 bp, Artificial Sequence
  Synthetic
atggccgactcccaagtacgctccacaagaaagctgttccatgctctgtgtttgagcgggcattccttcagtgtgtcaccatccacaacaaagctgttgttggtctttgctgccctgacaggagacccagcatggcgtat

SEQ ID NO: 4243 - DNA, 140 bp, Artificial Sequence
  Synthetic
atacgccatgctgggtctccgatcacgggttcggggtatttcacactagtgtctggcttaaagtcagagaggattactcattagagtgtgatccagccgtcataggaacagctgctaaggcgtacttgggagtcggccat

SEQ ID NO: 4244 - DNA, 140 bp, Artificial Sequence
  Synthetic
atggccgactcccaagtacgccttagcagctgttcctatgacggctggatcacactctaatgagtaatcctctctgactttaagccagacactagtgtgaaataccccgaacccgtgatcggagacccagcatggcgtat

SEQ ID NO: 4245 - DNA, 140 bp, Artificial Sequence
  Synthetic
atacgccatgctgggtctccgaaaggaggccgtgcacagtgatctaggctactggattgagagtgaaaagaacgacacatggaggctgaagagggctcacctgatcgagatgaaaacatgcgtacttgggagtcggccat

SEQ ID NO: 4246 - DNA, 140 bp, Artificial Sequence
  Synthetic
atggccgactcccaagtacgcatgttttcatctcgatcaggtgagccctcttcagcctccatgtgtcgttcttttcactctcaatccagtagcctagatcactgtgcacggcctcctttcggagacccagcatggcgtat

SEQ ID NO: 4247 - DNA, 140 bp, Artificial Sequence
  Synthetic
atacgccatgctgggtctcctgaatggccaaagtcccacacactgtggacagatggaatagaagaaagtgatctgatcatacctaagtctttagctgggccactcagccaccacaacacccgtacttgggagtcggccat

SEQ ID NO: 4248 - DNA, 140 bp, Artificial Sequence
  Synthetic
atggccgactcccaagtacgggtgttgtggtggctgagtggcccagctaaagacttaggtatgatcagatcactttcttctattccatctgtccacagtgtgtgggactttggccattcaggagacccagcatggcgtat

SEQ ID NO: 4249 - DNA, 140 bp, Artificial Sequence
  Synthetic
atacgccatgctgggtctccagagagggctacaggactcaagtgaaagggccgtggcatagtgaagagcttgaaatccggtttgaggaatgtccaggcaccaaggtccacgtggaggaaacgtacttgggagtcggccat

SEQ ID NO: 4250 - DNA, 140 bp, Artificial Sequence
  Synthetic
atggccgactcccaagtacgtttcctccacgtggaccttggtgcctggacattcctcaaaccggatttcaagctcttcactatgccacggccctttcacttgagtcctgtagccctctctggagacccagcatggcgtat

SEQ ID NO: 4251 - DNA, 140 bp, Artificial Sequence
  Synthetic
atacgccatgctgggtctcccatgtggaacgagaggaccgtccctgagatcaaccactgcaagcggaagggtgatcgaggaatggtgctgcagggaatgcacaatgcccccattgtcgttcgtacttgggagtcggccat

SEQ ID NO: 4252 - DNA, 140 bp, Artificial Sequence
  Synthetic
atggccgactcccaagtacgaacgacaatgggggcattgtgcattccctgcagcaccattcctcgatcacccttccgcttgcagtggttgatctcagggacggtcctctcgttccacatgggagacccagcatggcgtat

SEQ ID NO: 4253 - DNA, 140 bp, Artificial Sequence
  Synthetic
atacgccatgctgggtctccccgggcaaaagatggctgttggtatggaatggagataaggcccaggaaggaaccagagagtaacctagtaaggtcaatggtgactgcaggatcaactgatcgtacttgggagtcggccat

SEQ ID NO: 4254 - DNA, 140 bp, Artificial Sequence
  Synthetic
atggccgactcccaagtacgatcagttgatcctgcagtcaccattgaccttactaggttactctctggttccttcctgggccttatctccattccataccaacagccatcttttgcccggggagacccagcatggcgtat

SEQ ID NO: 4255 - DNA, 140 bp, Artificial Sequence
  Synthetic
aggccctggctgctgatatgtggcagtgttggtagctatgatcctgggaggattttcaatgagtgacttggctaagcttgcaattctgatgggtgccaccttcgcggaaatgaacactgggaccttttgggacagcggtg

SEQ ID NO: 4256 - DNA, 140 bp, Artificial Sequence
  Synthetic
caccgctgtcccaaaaggtcccagtgttcatttccgcgaaggtggcacccatcagaattgcaagcttagccaagtcactcattgaaaatcctcccaggatcatagctaccaacactgccacatatcagcagccagggcct

SEQ ID NO: 4257 - DNA, 140 bp, Artificial Sequence
  Synthetic
atacgccatgctgggtctccaggagatgtagctcatctggcgctgatagcggcattcaaagtcagacccgcgttgctggtctctttcatcttcagagccaattggacaccccgtgagagccgtacttgggagtcggccat

SEQ ID NO: 4258 - DNA, 140 bp, Artificial Sequence
  Synthetic
atggccgactcccaagtacggctctcacggggtgtccaattggctctgaagatgaaagagaccagcaacgcgggtctgactttgaatgccgctatcagcgccagatgagctacatctcctggagacccagcatggcgtat

SEQ ID NO: 4259 - DNA, 140 bp, Artificial Sequence
  Synthetic
atacgccatgctgggtctccatgctgctggccttggcctcgtgccttctgcaaactgagatctccgccctggaaggcgacctgatggttctcatcaatggttttgctttggcctggttggcgtacttgggagtcggccat

SEQ ID NO: 4260 - DNA, 140 bp, Artificial Sequence
  Synthetic
atggccgactcccaagtacgccaaccaggccaaagcaaaaccattgatgagaaccatcaggtcgccttccagggcggagatctcagtttgcagaaggcacgaggccaaggccagcagcatggagacccagcatggcgtat

SEQ ID NO: 4261 - DNA, 140 bp, Artificial Sequence
  Synthetic
atacgccatgctgggtctccatgctgctggccttggcctcgtgccttctgcaaactgtgatctccgccctggaaggcgacctgatggttctcatcaatggttttgctttggcctggttggcgtacttgggagtcggccat

SEQ ID NO: 4262 - DNA, 140 bp, Artificial Sequence
  Synthetic
atggccgactcccaagtacgccaaccaggccaaagcaaaaccattgatgagaaccatcaggtcgccttccagggcggagatcacagtttgcagaaggcacgaggccaaggccagcagcatggagacccagcatggcgtat

SEQ ID NO: 4263 - DNA, 140 bp, Artificial Sequence
  Synthetic
atacgccatgctgggtctccatgctgctggccttggcctcgtgccttctgcaaactgcgatctccgccctggaaggcgacctgatggttctcatcaatggttttgctttggcctggttggcgtacttgggagtcggccat

SEQ ID NO: 4264 - DNA, 140 bp, Artificial Sequence
  Synthetic
atggccgactcccaagtacgccaaccaggccaaagcaaaaccattgatgagaaccatcaggtcgccttccagggcggagatcgcagtttgcagaaggcacgaggccaaggccagcagcatggagacccagcatggcgtat

SEQ ID NO: 4265 - DNA, 140 bp, Artificial Sequence
  Synthetic
atacgccatgctgggtctccatgctgctggccttggcctcgtgccttctgcaaactgggatctccgccctggaaggcgacctgatggttctcatcaatggttttgctttggcctggttggcgtacttgggagtcggccat

SEQ ID NO: 4266 - DNA, 140 bp, Artificial Sequence
  Synthetic
atggccgactcccaagtacgccaaccaggccaaagcaaaaccattgatgagaaccatcaggtcgccttccagggcggagatcccagtttgcagaaggcacgaggccaaggccagcagcatggagacccagcatggcgtat

SEQ ID NO: 4267 - DNA, 140 bp, Artificial Sequence
  Synthetic
atacgccatgctgggtctcccaatacgagcgatggctgttccacgcactgacaacatcaccttggcaatcctggctgctctgacaccactggcccgaggcacactgcttgtagcgtggagcgtacttgggagtcggccat

SEQ ID NO: 4268 - DNA, 140 bp, Artificial Sequence
  Synthetic
atggccgactcccaagtacgctccacgctacaagcagtgtgcctcgggccagtggtgtcagagcagccaggattgccaaggtgatgttgtcagtgcgtggaacagccatcgctcgtattgggagacccagcatggcgtat

SEQ ID NO: 4269 - DNA, 140 bp, Artificial Sequence
  Synthetic
atacgccatgctgggtctccagcaggccttgctacttgtggggggttcatgctcctctctctgaaggggaaaggtagtgtgaagaagaacctaccatttgtcatggccttgggactaacccgtacttgggagtcggccat

SEQ ID NO: 4270 - DNA, 140 bp, Artificial Sequence
  Synthetic
atggccgactcccaagtacgggttagtcccaaggccatgacaaatggtaggttcttcttcacactacctttccccttcagagagaggagcatgaaccccccacaagtagcaaggcctgctggagacccagcatggcgtat

SEQ ID NO: 4271 - DNA, 140 bp, Artificial Sequence
  Synthetic
atacgccatgctgggtctccgctgtgaggctggttgaccccatcaacgtggtgggactgctgttgctcacaaggagtgggaagcggagctggccccctagtgaagtactcacagctgttgcgtacttgggagtcggccat

SEQ ID NO: 4272 - DNA, 140 bp, Artificial Sequence
  Synthetic
atggccgactcccaagtacgcaacagctgtgagtacttcactagggggccagctccgcttcccactccttgtgagcaacagcagtcccaccacgttgatggggtcaaccagcctcacagcggagacccagcatggcgtat

SEQ ID NO: 4273 - DNA, 140 bp, Artificial Sequence
  Synthetic
atacgccatgctgggtctccgcctgatatgtgcactggccggagggttcgccaaagcagatatagagatggctgggcccatggctgcagttggcctgctaattgttagttacgtggtctccgtacttgggagtcggccat

SEQ ID NO: 4274 - DNA, 140 bp, Artificial Sequence
  Synthetic
atggccgactcccaagtacggagaccacgtaactaacaattagcaggccaactgcagccatgggcccagccatctctatatctgctttggcgaaccctccggccagtgcacatatcaggcggagacccagcatggcgtat

SEQ ID NO: 4275 - DNA, 140 bp, Artificial Sequence
  Synthetic
atacgccatgctgggtctccaggaaagagtgtggacatgtacattgaaagagcaggtgacatcacatgggaaaaagatgcggaagttactggaaacagcccccggctcgatgtggcactacgtacttgggagtcggccat

SEQ ID NO: 4276 - DNA, 140 bp, Artificial Sequence
  Synthetic
atggccgactcccaagtacgtagtgccacatcgagccgggggctgtttccagtaacttccgcatctttttcccatgtgatgtcacctgctctttcaatgtacatgtccacactctttcctggagacccagcatggcgtat

SEQ ID NO: 4277 - DNA, 140 bp, Artificial Sequence
  Synthetic
atacgccatgctgggtctccgatgagagtggtgatttctccctggtggaggatgatggtccccccatgagagagatcatactcaaggtggtcctgatgaccatctgtggcatgaacccaacgtacttgggagtcggccat

SEQ ID NO: 4278 - DNA, 140 bp, Artificial Sequence
  Synthetic
atggccgactcccaagtacgttgggttcatgccacagatggtcatcaggaccaccttgagtatgatctctctcatggggggaccatcatcctccaccagggagaaatcaccactctcatcggagacccagcatggcgtat

SEQ ID NO: 4279 - DNA, 140 bp, Artificial Sequence
  Synthetic
atacgccatgctgggtctcctagccataccctttgcagctggagcgtggtatgtgtatgtgaagactggaaagaggagtggtgctctatgggatgtgcctgctcccaaggaagtaaaaaacgtacttgggagtcggccat

SEQ ID NO: 4280 - DNA, 140 bp, Artificial Sequence
  Synthetic
atggccgactcccaagtacgttttttacttccttgggagcaggcacatcccatagagcaccactcctctttccagtcttcacatacacataccacgctccagctgcaaagggtatggctaggagacccagcatggcgtat

SEQ ID NO: 4281 - DNA, 140 bp, Artificial Sequence
  Synthetic
atacgccatgctgggtctccgggggagaccacagatggagtgtatagagtgatgactcgcagactgctaggttcaacacaagttggagtgggagtcatgcaagagggggtcttccacactcgtacttgggagtcggccat

SEQ ID NO: 4282 - DNA, 140 bp, Artificial Sequence
  Synthetic
atggccgactcccaagtacgagtgtggaagaccccctcttgcatgactcccactccaacttgtgttgaacctagcagtctgcgagtcatcactctatacactccatctgtggtctcccccggagacccagcatggcgtat

SEQ ID NO: 4283 - DNA, 140 bp, Artificial Sequence
  Synthetic
atacgccatgctgggtctccatgtggcacgtcacaaaaggatccgcgctgaggagcggtgaagggagacttgatccatactggggagatgttaagcaggatctggtgtcatactgtggcccgtacttgggagtcggccat

SEQ ID NO: 4284 - DNA, 140 bp, Artificial Sequence
  Synthetic
atggccgactcccaagtacgggccacagtatgacaccagatcctgcttaacatctccccagtatggatcaagtctcccttcaccgctcctcagcgcggatccttttgtgacgtgccacatggagacccagcatggcgtat

SEQ ID NO: 4285 - DNA, 140 bp, Artificial Sequence
  Synthetic
atacgccatgctgggtctcccgtggaagctagatgccgcttgggacggacacagcgaggtgcagcttttggccgtgccccccggagagagagcgaggaacatccagactctgcccggaatcgtacttgggagtcggccat

SEQ ID NO: 4286 - DNA, 140 bp, Artificial Sequence
  Synthetic
atggccgactcccaagtacgattccgggcagagtctggatgttcctcgctctctctccggggggcacggccaaaagctgcacctcgctgtgtccgtcccaagcggcatctagcttccacgggagacccagcatggcgtat

SEQ ID NO: 4287 - DNA, 140 bp, Artificial Sequence
  Synthetic
atacgccatgctgggtctccattcaagacaaaggatggggacatcggagcagttgctctggactacccagcaggaacttcaggatctccgatcctagacaagtgtgggagagtgataggacgtacttgggagtcggccat

SEQ ID NO: 4288 - DNA, 140 bp, Artificial Sequence
  Synthetic
atggccgactcccaagtacgtcctatcactctcccacacttgtctaggatcggagatcctgaagttcctgctgggtagtccagagcaactgctccgatgtccccatcctttgtcttgaatggagacccagcatggcgtat

SEQ ID NO: 4289 - DNA, 140 bp, Artificial Sequence
  Synthetic
atacgccatgctgggtctccctctatggcaatggggtcgtgatcaaaaatggaagttatgttagtgccatcacccaagggaggagggaggaagagactcctgttgaatgcttcgaaccttcgtacttgggagtcggccat

SEQ ID NO: 4290 - DNA, 140 bp, Artificial Sequence
  Synthetic
atggccgactcccaagtacgaaggttcgaagcattcaacaggagtctcttcctccctcctcccttgggtgatggcactaacataacttccatttttgatcacgaccccattgccatagagggagacccagcatggcgtat

SEQ ID NO: 4291 - DNA, 140 bp, Artificial Sequence
  Synthetic
atacgccatgctgggtctcccgatgctgaagaagaagcagctaactgtcttggatctgcatcctggagctgggaaaaccaggagagttcttcctgaaatagtccgtgaagccataaaaaccgtacttgggagtcggccat

SEQ ID NO: 4292 - DNA, 140 bp, Artificial Sequence
  Synthetic
atggccgactcccaagtacggtttttatggcttcacggactatttcaggaagaactctcctggttttcccagctccaggatgcagatccaagacagttagctgcttcttcttcagcatcgggagacccagcatggcgtat

SEQ ID NO: 4293 - DNA, 140 bp, Artificial Sequence
  Synthetic
atacgccatgctgggtctccaagactccgcacggtgatcctggctccaaccagggttgtcgctgctgaaatggaggaagcccttagagggcttccagtgcgttacatgacaacagcagttcgtacttgggagtcggccat

SEQ ID NO: 4294 - DNA, 140 bp, Artificial Sequence
  Synthetic
atggccgactcccaagtacgaactgctgttgtcatgtaacgcactggaagccctctaagggcttcctccatttcagcagcgacaaccctggttggagccaggatcaccgtgcggagtcttggagacccagcatggcgtat

SEQ ID NO: 4295 - DNA, 140 bp, Artificial Sequence
  Synthetic
atacgccatgctgggtctccaatgtcacccactctgggacagaaatcgttgatttaatgtgccatgccaccttcacttcacgcctactacaacccattagagtccccaactacaatctttcgtacttgggagtcggccat

SEQ ID NO: 4296 - DNA, 140 bp, Artificial Sequence
  Synthetic
atggccgactcccaagtacgaaagattgtagttggggactctaatgggttgtagtaggcgtgaagtgaaggtggcatggcacattaaatcaacgatttctgtcccagagtgggtgacattggagacccagcatggcgtat

SEQ ID NO: 4297 - DNA, 140 bp, Artificial Sequence
  Synthetic
atacgccatgctgggtctccacattatggatgaggcccacttcacagatccctcaagtatagcagcaagaggatacatatcaacaagggttgagatgggcgaggcggctgccatcttcatcgtacttgggagtcggccat

SEQ ID NO: 4298 - DNA, 140 bp, Artificial Sequence
  Synthetic
atggccgactcccaagtacgatgaagatggcagccgcctcgcccatctcaacccttgttgatatgtatcctcttgctgctatacttgagggatctgtgaagtgggcctcatccataatgtggagacccagcatggcgtat

SEQ ID NO: 4299 - DNA, 140 bp, Artificial Sequence
  Synthetic
atacgccatgctgggtctccgaccgccacaccaccaggaacccgcgacgcatttccggactctaactcaccaatcatggacacagaagtggaagtcccagagagagcctggagctcaggccgtacttgggagtcggccat

SEQ ID NO: 4300 - DNA, 140 bp, Artificial Sequence
  Synthetic
atggccgactcccaagtacggcctgagctccaggctctctctgggacttccacttctgtgtccatgattggtgagttagagtccggaaatgcgtcgcgggttcctggtggtgtggcggtcggagacccagcatggcgtat

SEQ ID NO: 4301 - DNA, 140 bp, Artificial Sequence
  Synthetic
atacgccatgctgggtctcctttgattgggtgacggatcattctggaaaaacagtttggtttgttccaagcgtgaggaacggcaacgagatcgcggcttgtctgacaaaagctggaaaaccgtacttgggagtcggccat

SEQ ID NO: 4302 - DNA, 140 bp, Artificial Sequence
  Synthetic
atggccgactcccaagtacggttttccagcttttgtcagacaagccgcgatctcgttgccgttcctcacgcttggaacaaaccaaactgtttttccagaatgatccgtcacccaatcaaaggagacccagcatggcgtat

SEQ ID NO: 4303 - DNA, 140 bp, Artificial Sequence
  Synthetic
atacgccatgctgggtctccgggtcatacagctcagcagaaagacttttgagacagagttccagaaaacaaaaaatcaagagtgggacttcgtcgtaacaactgacatctcagagatgggcgtacttgggagtcggccat

SEQ ID NO: 4304 - DNA, 140 bp, Artificial Sequence
  Synthetic
atggccgactcccaagtacgcccatctctgagatgtcagttgttacgacgaagtcccactcttgattttttgttttctggaactctgtctcaaaagtctttctgctgagctgtatgacccggagacccagcatggcgtat

SEQ ID NO: 4305 - DNA, 140 bp, Artificial Sequence
  Synthetic
aggccctggctgctgatatgaaaaatcaagagtgggacttcgtcgtaacaactgacatctcagagatgggcgccaacttcaaagctgaccgggtcatagattccaggagatgcctgaagcgaccttttgggacagcggtg

SEQ ID NO: 4306 - DNA, 140 bp, Artificial Sequence
  Synthetic
caccgctgtcccaaaaggtcgcttcaggcatctcctggaatctatgacccggtcagctttgaagttggcgcccatctctgagatgtcagttgttacgacgaagtcccactcttgatttttcatatcagcagccagggcct

SEQ ID NO: 4307 - DNA, 140 bp, Artificial Sequence
  Synthetic
aggccctggctgctgatatgacacatgccagcgctgcccagaggagggggcgcataggcaggaatcccaacaaacctggagatgagtatatgtatggaggtgggtgcgcagagactgatggaccttttgggacagcggtg

SEQ ID NO: 4308 - DNA, 140 bp, Artificial Sequence
  Synthetic
caccgctgtcccaaaaggtccatcagtctctgcgcacccacctccatacatatactcatctccaggtttgttgggattcctgcctatgcgccccctcctctgggcagcgctggcatgtgtcatatcagcagccagggcct

SEQ ID NO: 4309 - DNA, 140 bp, Artificial Sequence
  Synthetic
aggccctggctgctgatatgaagaccatgcacactggcttgaagcaagaatgcttcttgataacatttacctccaagatggcctcatagcctcgctctatcgacctgaggccgataaggtgaccttttgggacagcggtg

SEQ ID NO: 4310 - DNA, 140 bp, Artificial Sequence
  Synthetic
caccgctgtcccaaaaggtcaccttatcggcctcaggtcgatagagcgaggctatgaggccatcttggaggtaaatgttatcaagaagcattcttgcttcaagccagtgtgcatggtcttcatatcagcagccagggcct

SEQ ID NO: 4311 - DNA, 140 bp, Artificial Sequence
  Synthetic
aggccctggctgctgatatggttgcatctgccggaataacctacacagatagaagatggtgttttgatggcacgaccaacaacaccataatggaagacagtgtgccggcagaggtgtggagaccttttgggacagcggtg

SEQ ID NO: 4312 - DNA, 140 bp, Artificial Sequence
  Synthetic
caccgctgtcccaaaaggtctccacacctctgccggcacactgtcttccattatggtgttgttggtcgtgccatcaaaacaccatcttctatctgtgtaggttattccggcagatgcaaccatatcagcagccagggcct

SEQ ID NO: 4313 - DNA, 140 bp, Artificial Sequence
  Synthetic
aggccctggctgctgatatgccagatacggagagaaaagagtgctcaaaccgaggtggatggacgccagagtttgttcagatcatgcggccctgaagtcattcaaagaatttgccgctgggaccttttgggacagcggtg

SEQ ID NO: 4314 - DNA, 140 bp, Artificial Sequence
  Synthetic
caccgctgtcccaaaaggtcccagcggcaaattctttgaatgacttcagggccgcatgatctgaacaaactctggcgtccatccacctcggtttgagcactcttttctctccgtatctggcatatcagcagccagggcct

SEQ ID NO: 4315 - DNA, 140 bp, Artificial Sequence
  Synthetic
atacgccatgctgggtctccgaaaagaggagcggcctttggagtgatggaagccctgggaacactgccaggacacatgacagagaggtttcaggaagccattgacaacctcgctgtgctccgtacttgggagtcggccat

SEQ ID NO: 4316 - DNA, 140 bp, Artificial Sequence
  Synthetic
atggccgactcccaagtacggagcacagcgaggttgtcaatggcttcctgaaacctctctgtcatgtgtcctggcagtgttcccagggcttccatcactccaaaggccgctcctcttttcggagacccagcatggcgtat

SEQ ID NO: 4317 - DNA, 140 bp, Artificial Sequence
  Synthetic
atacgccatgctgggtctccatgcgggcagagactggaagcaggccctacaaagccgcggcggcccaattaccggagaccttagagaccatcatgcttttgggtttgctgggaacagtctcgtacttgggagtcggccat

SEQ ID NO: 4318 - DNA, 140 bp, Artificial Sequence
  Synthetic
atggccgactcccaagtacgagactgttcccagcaaacccaaaagcatgatggtctctaaggtctccggtaattgggccgccgcggctttgtagggcctgcttccagtctctgcccgcatggagacccagcatggcgtat

SEQ ID NO: 4319 - DNA, 140 bp, Artificial Sequence
  Synthetic
atacgccatgctgggtctcccgctgggaatcttctttgtcttgatgcggaacaagggcatagggaagatgggctttggaatggtgacccttggggccagtgcatggcttatgtggctctccgtacttgggagtcggccat

SEQ ID NO: 4320 - DNA, 140 bp, Artificial Sequence
  Synthetic
atggccgactcccaagtacggagagccacataagccatgcactggccccaagggtcaccattccaaagcccatcttccctatgcccttgttccgcatcaagacaaagaagattcccagcgggagacccagcatggcgtat

SEQ ID NO: 4321 - DNA, 140 bp, Artificial Sequence
  Synthetic
atacgccatgctgggtctccggaaattgagccagccagaattgcatgtgtcctcattgtcgtgtttctattgctggtggtgctcatacctgagccagaaaagcagagatctccccaggaccgtacttgggagtcggccat

SEQ ID NO: 4322 - DNA, 140 bp, Artificial Sequence
  Synthetic
atggccgactcccaagtacggtcctggggagatctctgcttttctggctcaggtatgagcaccaccagcaatagaaacacgacaatgaggacacatgcaattctggctggctcaatttccggagacccagcatggcgtat

SEQ ID NO: 4323 - DNA, 140 bp, Artificial Sequence
  Synthetic
atacgccatgctgggtctccaaccaaatggcaattatcatcatggtagcagtgggtcttctgggcttgataaccgccaatgaactcggatggttggagagaacaaaaagtgacctaggcccgtacttgggagtcggccat

SEQ ID NO: 4324 - DNA, 140 bp, Artificial Sequence
  Synthetic
atggccgactcccaagtacgggcctaggtcactttttgttctctccaaccatccgagttcattggcggttatcaagcccagaagacccactgctaccatgatgataattgccatttggttggagacccagcatggcgtat

SEQ ID NO: 4325 - DNA, 140 bp, Artificial Sequence
  Synthetic
atacgccatgctgggtctccatctaatgggaaggagagaggagggggcaaccatgggattctcaatggacattgacttgcggccagcctcagcttgggctatctatgccgctctgacaaccgtacttgggagtcggccat

SEQ ID NO: 4326 - DNA, 140 bp, Artificial Sequence
  Synthetic
atggccgactcccaagtacggttgtcagagcggcatagatagcccaagctgaggctggccgcaagtcaatgtccattgagaatcccatggttgccccctcctctctccttcccattagatggagacccagcatggcgtat

SEQ ID NO: 4327 - DNA, 140 bp, Artificial Sequence
  Synthetic
atacgccatgctgggtctcctctcatcaccccagccgtccaacatgcggtaaccacttcatacaacaactactccttaatggcgatggccacgcaagccggagtgttgtttggcatgggccgtacttgggagtcggccat

SEQ ID NO: 4328 - DNA, 140 bp, Artificial Sequence
  Synthetic
atggccgactcccaagtacggcccatgccaaacaacactccggcttgcgtggccatcgccattaaggagtagttgttgtatgaagtggttaccgcatgttggacggctggggtgatgagaggagacccagcatggcgtat

SEQ ID NO: 4329 - DNA, 140 bp, Artificial Sequence
  Synthetic
atacgccatgctgggtctccaaagggatgccattctatgcgtgggacttcggagtcccgctgctaatgatgggttgctactcacaattaacacccttgaccttaatagtggccatcattccgtacttgggagtcggccat

SEQ ID NO: 4330 - DNA, 140 bp, Artificial Sequence
  Synthetic
atggccgactcccaagtacggaatgatggccactattaaggtcaagggtgttaattgtgagtagcaacccatcattagcagcgggactccgaagtcccacgcatagaatggcatccctttggagacccagcatggcgtat

SEQ ID NO: 4331 - DNA, 140 bp, Artificial Sequence
  Synthetic
atacgccatgctgggtctcctgctcgtggcgcactacatgtacttgatcccaggtctacaggcagcagcggcgcgcgctgcccagaagagaacggcagctggcatcatgaagaaccctgtcgtacttgggagtcggccat

SEQ ID NO: 4332 - DNA, 140 bp, Artificial Sequence
  Synthetic
atggccgactcccaagtacgacagggttcttcatgatgccagctgccgttctcttctgggcagcgcgcgccgctgctgcctgtagacctgggatcaagtacatgtagtgcgccacgagcaggagacccagcatggcgtat

SEQ ID NO: 4333 - DNA, 140 bp, Artificial Sequence
  Synthetic
atacgccatgctgggtctcctgtggatggaatagtggtgactgacattgacacaatgacaattgacccccaagtggagaaaaagatgggacaagtgctactcatagcagtagccatctcccgtacttgggagtcggccat

SEQ ID NO: 4334 - DNA, 140 bp, Artificial Sequence
  Synthetic
atggccgactcccaagtacgggagatggctactgctatgagtagcacttgtcccatctttttctccacttgggggtcaattgtcattgtgtcaatgtcagtcaccactattccatccacaggagacccagcatggcgtat

SEQ ID NO: 4335 - DNA, 140 bp, Artificial Sequence
  Synthetic
atacgccatgctgggtctccagtgccgttctgctgcgcaccgcctgggggtggggggaggctggggccctgatcacagccgcaacttccactttgtgggaaggctctccgaataaatactcgtacttgggagtcggccat

SEQ ID NO: 4336 - DNA, 140 bp, Artificial Sequence
  Synthetic
atggccgactcccaagtacgagtatttattcggagagccttcccacaaagtggaagttgcggctgtgatcagggccccagcctccccccacccccaggcggtgcgcagcagaacggcactggagacccagcatggcgtat

SEQ ID NO: 4337 - DNA, 140 bp, Artificial Sequence
  Synthetic
atacgccatgctgggtctccggaactcctccacagccacttcactgtgtaacatttttaggggaagttacttggctggagcttctcttatttacacagtaacaagaaacgctggcctggtcgtacttgggagtcggccat

SEQ ID NO: 4338 - DNA, 140 bp, Artificial Sequence
  Synthetic
atggccgactcccaagtacgaccaggccagcgtttcttgttactgtgtaaataagagaagctccagccaagtaacttcccctaaaaatgttacacagtgaagtggctgtggaggagttccggagacccagcatggcgtat

SEQ ID NO: 4339 - DNA, 140 bp, Artificial Sequence
  Synthetic
atacgccatgctgggtctcccaagagacgtggaggtggaacgggagagaccctgggggagaaatggaaggcccgcctgaaccagatgtcggccctggagttttactcctacaaaaagtcacgtacttgggagtcggccat

SEQ ID NO: 4340 - DNA, 140 bp, Artificial Sequence
  Synthetic
atggccgactcccaagtacgtgactttttgtaggagtaaaactccagggccgacatctggttcaggcgggccttccatttctcccccagggtctctcccgttccacctccacgtctcttgggagacccagcatggcgtat

SEQ ID NO: 4341 - DNA, 140 bp, Artificial Sequence
  Synthetic
atacgccatgctgggtctccggcatcaccgaagtgtgcagagaagaagcccgccgcgccctcaaggacggagtggcaacaggaggccatgctgtgtcccgaggaagcgcaaagcttagatcgtacttgggagtcggccat

SEQ ID NO: 4342 - DNA, 140 bp, Artificial Sequence
  Synthetic
atggccgactcccaagtacgatctaagctttgcgcttcctcgggacacagcatggcctcctgttgccactccgtccttgagggcgcggcgggcttcttctctgcacacttcggtgatgccggagacccagcatggcgtat

SEQ ID NO: 4343 - DNA, 140 bp, Artificial Sequence
  Synthetic
atacgccatgctgggtctcctcaagaggtgaaaggatacacaaagggaggccctggtcatgaagaacccacgttggtgcaaagctatggatggaacatagtccgtcttaagagtggggtgcgtacttgggagtcggccat

SEQ ID NO: 4344 - DNA, 140 bp, Artificial Sequence
  Synthetic
atggccgactcccaagtacgcaccccactcttaagacggactatgttccatccatagctttgcaccaacgtgggttcttcatgaccagggcctccctttgtgtatcctttcacctcttgaggagacccagcatggcgtat

SEQ ID NO: 4345 - DNA, 140 bp, Artificial Sequence
  Synthetic
atacgccatgctgggtctccgacgtctttcacatggcggcggagtcgtgtgacactttgctgtgtgacataggtgagtcatcatctagtcctgaagtggaagaagcacggacgctcagagcgtacttgggagtcggccat

SEQ ID NO: 4346 - DNA, 140 bp, Artificial Sequence
  Synthetic
atggccgactcccaagtacgctctgagcgtccgtgcttcttccacttcaggactagatgatgactcacctatgtcacacagcaaagtgtcacacgactccgccgccatgtgaaagacgtcggagacccagcatggcgtat

SEQ ID NO: 4347 - DNA, 140 bp, Artificial Sequence
  Synthetic
atacgccatgctgggtctcctactctccatggtgggggattggcttgaaaaaagaccaggggccttttgtataaaggtgttgtgcccatacaccagcaccatgatggaaaccctagagcgcgtacttgggagtcggccat

SEQ ID NO: 4348 - DNA, 140 bp, Artificial Sequence
  Synthetic
atggccgactcccaagtacgcgctctagggtttccatcatggtgctggtgtatgggcacaacacctttatacaaaaggcccctggtcttttttcaagccaatcccccaccatggagagtaggagacccagcatggcgtat

SEQ ID NO: 4349 - DNA, 140 bp, Artificial Sequence
  Synthetic
atacgccatgctgggtctccactgcagcgtaggtatgggggaggactggtcagagtgccactctcccgcaactctacacatgagatgtactgggtctctggagcgaaaagcaacatcatacgtacttgggagtcggccat

SEQ ID NO: 4350 - DNA, 140 bp, Artificial Sequence
  Synthetic
atggccgactcccaagtacgtatgatgttgcttttcgctccagagacccagtacatctcatgtgtagagttgcgggagagtggcactctgaccagtcctcccccatacctacgctgcagtggagacccagcatggcgtat

SEQ ID NO: 4351 - DNA, 140 bp, Artificial Sequence
  Synthetic
atacgccatgctgggtctccaaaagtgtgtccaccacgagccagctcctcttgggacgcatggacgggcccaggaggccagtgaaatatgaggaggatgtgaatctcggctccggcacgccgtacttgggagtcggccat

SEQ ID NO: 4352 - DNA, 140 bp, Artificial Sequence
  Synthetic
atggccgactcccaagtacggcgtgccggagccgagattcacatcctcctcatatttcactggcctcctgggcccgtccatgcgtcccaagaggagctggctcgtggtggacacacttttggagacccagcatggcgtat

SEQ ID NO: 4353 - DNA, 140 bp, Artificial Sequence
  Synthetic
atacgccatgctgggtctccgagctgtggcaagctgcgccgaagctcccaacctgaagatcattggtaaccgcgttgagaggatccgcagtgagcatgcggaaacgtggttctttgatgacgtacttgggagtcggccat

SEQ ID NO: 4354 - DNA, 140 bp, Artificial Sequence
  Synthetic
atggccgactcccaagtacgtcatcaaagaaccacgtttccgcatgctcactgcggatcctctcaacgcggttaccaatgatcttcaggttgggagcttcggcgcagcttgccacagctcggagacccagcatggcgtat

SEQ ID NO: 4355 - DNA, 140 bp, Artificial Sequence
  Synthetic
atacgccatgctgggtctccgaaccacccatacaggacatgggcttaccatgggagctacgaggcccctacacaagggtcagcgtcttctctcataaacggggttgtcaggctcctgtcacgtacttgggagtcggccat

SEQ ID NO: 4356 - DNA, 140 bp, Artificial Sequence
  Synthetic
atggccgactcccaagtacgtgacaggagcctgacaaccccgtttatgagagaagacgctgacccttgtgtaggggcctcgtagctcccatggtaagcccatgtcctgtatgggtggttcggagacccagcatggcgtat

SEQ ID NO: 4357 - DNA, 140 bp, Artificial Sequence
  Synthetic
atacgccatgctgggtctccaagccctgggatgtggtgactggagtcacaggaatagccatgaccgacaccacaccgtatggccagcaaagagttttcaaggaaaaagtggacactagggcgtacttgggagtcggccat

SEQ ID NO: 4358 - DNA, 140 bp, Artificial Sequence
  Synthetic
atggccgactcccaagtacgccctagtgtccactttttccttgaaaactctttgctggccatacggtgtggtgtcggtcatggctattcctgtgactccagtcaccacatcccagggcttggagacccagcatggcgtat

SEQ ID NO: 4359 - DNA, 140 bp, Artificial Sequence
  Synthetic
atacgccatgctgggtctcctgccagacccccaggaaggcactcgtcaggtgatgaacatggtctcttcctggctatggaaggagctaggtaaacacaaacggccacgagtttgcaccaacgtacttgggagtcggccat

SEQ ID NO: 4360 - DNA, 140 bp, Artificial Sequence
  Synthetic
atggccgactcccaagtacgttggtgcaaactcgtggccgtttgtgtttacctagctccttccatagccaggaagagaccatgttcatcacctgacgagtgccttcctgggggtctggcaggagacccagcatggcgtat

SEQ ID NO: 4361 - DNA, 140 bp, Artificial Sequence
  Synthetic
atacgccatgctgggtctccagaagagttcatcaataaggttcgcagcaatgcagcactgggggcaatatttgaagaggagaaagaatggaagactgcagtggaagctgtgaacgatccacgtacttgggagtcggccat

SEQ ID NO: 4362 - DNA, 140 bp, Artificial Sequence
  Synthetic
atggccgactcccaagtacgtggatcgttcacagcttccactgcagtcttccattctttctcctcttcaaatattgcccccagtgctgcattgctgcgaaccttattgatgaactcttctggagacccagcatggcgtat

SEQ ID NO: 4363 - DNA, 140 bp, Artificial Sequence
  Synthetic
atacgccatgctgggtctccaggttctgggccctagtggacaaggaaagagagcaccacttgagaggagagtgtcagagctgtgtgtacaacatgatgggaaaaagagaaaagaagcaagcgtacttgggagtcggccat

SEQ ID NO: 4364 - DNA, 140 bp, Artificial Sequence
  Synthetic
atggccgactcccaagtacgcttgcttcttttctctttttcccatcatgttgtacacacagctctgacactctcctctcaagtggtgctctctttccttgtccactagggcccagaacctggagacccagcatggcgtat

SEQ ID NO: 4365 - DNA, 140 bp, Artificial Sequence
  Synthetic
atacgccatgctgggtctccgggaatttggaaaggccaagggcagccgcgccatttggtacatgtggctaggggctagatttctagagtttgaagcccttggattcttgaacgaggatcacgtacttgggagtcggccat

SEQ ID NO: 4366 - DNA, 140 bp, Artificial Sequence
  Synthetic
atggccgactcccaagtacgtgatcctcgttcaagaatccaagggcttcaaactctagaaatctagcccctagccacatgtaccaaatggcgcggctgcccttggcctttccaaattcccggagacccagcatggcgtat

SEQ ID NO: 4367 - DNA, 140 bp, Artificial Sequence
  Synthetic
atacgccatgctgggtctccctggatggggagagagaattcaggaggtggtgttgaagggctgggattacaaagacttggatatgttctagaagaaatgagccgcacaccaggaggaaagcgtacttgggagtcggccat

SEQ ID NO: 4368 - DNA, 140 bp, Artificial Sequence
  Synthetic
atggccgactcccaagtacgctttcctcctggtgtgcggctcatttcttctagaacatatccaagtctttgtaatcccagcccttcaacaccacctcctgaattctctctccccatccagggagacccagcatggcgtat

SEQ ID NO: 4369 - DNA, 140 bp, Artificial Sequence
  Synthetic
atacgccatgctgggtctccatgtatgcagatgataccgctggctgggacacccgcatcagtaggtttgatctggagaatgaagctctgatcaccaaccaaatggagaaagggcacagggcgtacttgggagtcggccat

SEQ ID NO: 4370 - DNA, 140 bp, Artificial Sequence
  Synthetic
atggccgactcccaagtacgccctgtgccctttctccatttggttggtgatcagagcttcattctccagatcaaacctactgatgcgggtgtcccagccagcggtatcatctgcatacatggagacccagcatggcgtat

SEQ ID NO: 4371 - DNA, 140 bp, Artificial Sequence
  Synthetic
atacgccatgctgggtctccccttggcgttggccataatcaagtacacataccaaaacaaagtggtaaaggtccttagaccagctgaaagagggaagacagttatggacatcatctcaagcgtacttgggagtcggccat

SEQ ID NO: 4372 - DNA, 140 bp, Artificial Sequence
  Synthetic
atggccgactcccaagtacgcttgagatgatgtccataactgtcttccctctttcagctggtctaaggacctttaccactttgttttggtatgtgtacttgattatggccaacgccaaggggagacccagcatggcgtat

SEQ ID NO: 4373 - DNA, 140 bp, Artificial Sequence
  Synthetic
atacgccatgctgggtctccacaagaccaaagagggagcggacaagttgttacttacgctcttaatacattcaccaacctggtggtgcagctcattcggaacatggaggctgaggaagttcgtacttgggagtcggccat

SEQ ID NO: 4374 - DNA, 140 bp, Artificial Sequence
  Synthetic
atggccgactcccaagtacgaacttcctcagcctccatgttccgaatgagctgcaccaccaggttggtgaatgtattaagagcgtaagtaacaacttgtccgctccctctttggtcttgtggagacccagcatggcgtat

SEQ ID NO: 4375 - DNA, 140 bp, Artificial Sequence
  Synthetic
atacgccatgctgggtctccctagagatgcaagacttgtggctgttgaggaggccagagaaggtgaccagctggttgcagagcaacggatgggataggctcaaacgaatggcagtcagtgcgtacttgggagtcggccat

SEQ ID NO: 4376 - DNA, 140 bp, Artificial Sequence
  Synthetic
atggccgactcccaagtacgcactgactgccattcgtttgagcctatcccatccgttgctctgcaaccagctggtcaccttctctggcctcctcaacagccacaagtcttgcatctctagggagacccagcatggcgtat

SEQ ID NO: 4377 - DNA, 140 bp, Artificial Sequence
  Synthetic
atacgccatgctgggtctccgagatgattgtgttgtgaaaccaattgatgataggtttgcacatgccctcaggtttttgaatgacatggggaaagttaggaaggacacacaggagtggaacgtacttgggagtcggccat

SEQ ID NO: 4378 - DNA, 140 bp, Artificial Sequence
  Synthetic
atggccgactcccaagtacgttccactcctgtgtgtccttcctaactttccccatgtcattcaaaaacctgagggcatgtgcaaacctatcatcaattggtttcacaacacaatcatctcggagacccagcatggcgtat

SEQ ID NO: 4379 - DNA, 140 bp, Artificial Sequence
  Synthetic
atacgccatgctgggtctccaccctcaactggatggagcaactgggaagaagttccgttttgctcccatcacttcaacaagctttacctcaaggacgggaggtccattgtggtcccctgtcgtacttgggagtcggccat

SEQ ID NO: 4380 - DNA, 140 bp, Artificial Sequence
  Synthetic
atggccgactcccaagtacgacaggggaccacaatggacctcccgtccttgaggtaaagcttgttgaagtgatgggagcaaaacggaacttcttcccagttgctccatccagttgagggtggagacccagcatggcgtat

SEQ ID NO: 4381 - DNA, 140 bp, Artificial Sequence
  Synthetic
atacgccatgctgggtctcccgccaccaagatgaactgattggccgagcccgcgtctcaccaggggcgggatggagcatccgggagactgcttgcctagcaaaatcatatgcacaaatgtcgtacttgggagtcggccat

SEQ ID NO: 4382 - DNA, 140 bp, Artificial Sequence
  Synthetic
atggccgactcccaagtacgacatttgtgcatatgattttgctaggcaagcagtctcccggatgctccatcccgcccctggtgagacgcgggctcggccaatcagttcatcttggtggcgggagacccagcatggcgtat

SEQ ID NO: 4383 - DNA, 140 bp, Artificial Sequence
  Synthetic
atacgccatgctgggtctccggcagcttctttatttccacagaagggacctccgactgatggccaacgccatttgttcatctgtgccagttgactgggttccaactgggagaaccacctgcgtacttgggagtcggccat

SEQ ID NO: 4384 - DNA, 140 bp, Artificial Sequence
  Synthetic
atggccgactcccaagtacgcaggtggttctcccagttggaacccagtcaactggcacagatgaacaaatggcgttggccatcagtcggaggtcccttctgtggaaataaagaagctgccggagacccagcatggcgtat

SEQ ID NO: 4385 - DNA, 140 bp, Artificial Sequence
  Synthetic
atacgccatgctgggtctccgtcaatccatggaaagggagaatggatgaccactgaggacatgcttgtggtgtggaacagagtgtggattgaggagaacgaccacatggaggacaagacccgtacttgggagtcggccat

SEQ ID NO: 4386 - DNA, 140 bp, Artificial Sequence
  Synthetic
atggccgactcccaagtacgggtcttgtcctccatgtggtcgttctcctcaatccacactctgttccacaccacaagcatgtcctcagtggtcatccattctccctttccatggattgacggagacccagcatggcgtat

SEQ ID NO: 4387 - DNA, 140 bp, Artificial Sequence
  Synthetic
atacgccatgctgggtctccccagtcacgaaatggacagacattccctatttgggaaaaagggaagacttatggtgtggatctcttatagggcacagaccacgcactacttgggctgagacgtacttgggagtcggccat

SEQ ID NO: 4388 - DNA, 140 bp, Artificial Sequence
  Synthetic
atggccgactcccaagtacgtctcagcccaagtagtgcgtggtctgtgccctataagagatccacaccataagtcttccctttttcccaaatagggaatgtctgtccatttcgtgactggggagacccagcatggcgtat

SEQ ID NO: 4389 - DNA, 140 bp, Artificial Sequence
  Synthetic
atacgccatgctgggtctccacattaaagacacagtcaacatggtgcgcaggatcataggtgatgaagaaaagtacatggactacctatccactcaagttcgctacttgggtgaagaaggcgtacttgggagtcggccat

SEQ ID NO: 4390 - DNA, 140 bp, Artificial Sequence
  Synthetic
atggccgactcccaagtacgccttcttcacccaagtagcgaacttgagtggataggtagtccatgtacttttcttcatcacctatgatcctgcgcaccatgttgactgtgtctttaatgtggagacccagcatggcgtat

SEQ ID NO: 4391 - DNA, 140 bp, Artificial Sequence
  Synthetic
aggccctggctgctgatatgcatggtgcgcaggatcataggtgatgaagaaaagtacatggactacctatccactcaagttcgctacttgggtgaagaagggtccacacctggagtgttagaccttttgggacagcggtg

SEQ ID NO: 4392 - DNA, 140 bp, Artificial Sequence
  Synthetic
caccgctgtcccaaaaggtctaacactccaggtgtggacccttcttcacccaagtagcgaacttgagtggataggtagtccatgtacttttcttcatcacctatgatcctgcgcaccatgcatatcagcagccagggcct

SEQ ID NO: 4393 - DNA, 140 bp, Artificial Sequence
  Synthetic
atacgccatgctgggtctccgggagcttggtgacatgtgccaagtttacgtgttctaagaagatgaccgggaagagcattcaaccggaaaatctggagtatcggataatgctatcagtgccgtacttgggagtcggccat

SEQ ID NO: 4394 - DNA, 140 bp, Artificial Sequence
  Synthetic
atggccgactcccaagtacggcactgatagcattatccgatactccagattttccggttgaatgctcttcccggtcatcttcttagaacacgtaaacttggcacatgtcaccaagctcccggagacccagcatggcgtat

SEQ ID NO: 4395 - DNA, 140 bp, Artificial Sequence
  Synthetic
atacgccatgctgggtctccatggctcccagcatagcgggatgattgtcaatgatacaggatatgaaactgacgaaaatagagcgaaagtcgaggttacgcctaattcaccaagagcggacgtacttgggagtcggccat

SEQ ID NO: 4396 - DNA, 140 bp, Artificial Sequence
  Synthetic
atggccgactcccaagtacgtccgctcttggtgaattaggcgtaacctcgactttcgctctattttcgtcagtttcatatcctgtatcattgacaatcatcccgctatgctgggagccatggagacccagcatggcgtat

SEQ ID NO: 4397 - DNA, 140 bp, Artificial Sequence
  Synthetic
atacgccatgctgggtctccagtggaggtgcagtatgcagggacagatggaccctgcaagatcccagtccagatggcggtggacatgcagaccctgaccccagttggaaggctgataacccgtacttgggagtcggccat

SEQ ID NO: 4398 - DNA, 140 bp, Artificial Sequence
  Synthetic
atggccgactcccaagtacgggttatcagccttccaactggggtcagggtctgcatgtccaccgccatctggactgggatcttgcagggtccatctgtccctgcatactgcacctccactggagacccagcatggcgtat

SEQ ID NO: 4399 - DNA, 140 bp, Artificial Sequence
  Synthetic
atacgccatgctgggtctccagaaaatcacccaccactggcataggagtggtagcaccatcggaaaggcatttgaggccactgtgagaggcgccaagagaatggcagtcctgggggataccgtacttgggagtcggccat

SEQ ID NO: 4400 - DNA, 140 bp, Artificial Sequence
  Synthetic
atggccgactcccaagtacggtatcccccaggactgccattctcttggcgcctctcacagtggcctcaaatgcctttccgatggtgctaccactcctatgccagtggtgggtgattttctggagacccagcatggcgtat

SEQ ID NO: 4401 - DNA, 140 bp, Artificial Sequence
  Synthetic
atacgccatgctgggtctccaacccagggaaagagggaggaggagactccggttgaatgtttcgaaccctcgatgctgaagaagaagcagctaactgtcttggatctgcatccaggagcccgtacttgggagtcggccat

SEQ ID NO: 4402 - DNA, 140 bp, Artificial Sequence
  Synthetic
atggccgactcccaagtacgggctcctggatgcagatccaagacagttagctgcttcttcttcagcatcgagggttcgaaacattcaaccggagtctcctcctccctctttccctgggttggagacccagcatggcgtat

SEQ ID NO: 4403 - DNA, 140 bp, Artificial Sequence
  Synthetic
atacgccatgctgggtctccagtggccacaggaggacatgccgtatcccggggaagtgcaaagctcagatggttggtggagagaggatatctgcagccctatgggaaggttgttgacctccgtacttgggagtcggccat

SEQ ID NO: 4404 - DNA, 140 bp, Artificial Sequence
  Synthetic
atggccgactcccaagtacggaggtcaacaaccttcccatagggctgcagatatcctctctccaccaaccatctgagctttgcacttccccgggatacggcatgtcctcctgtggccactggagacccagcatggcgtat

SEQ ID NO: 4405 - DNA, 140 bp, Artificial Sequence
  Synthetic
aggccctggctgctgatatgactccacacatgagatgtactgggtctctggggcaaagagcaacatcataaaaagtgtgtccaccacaagtcagctcctcctgggacgcatggatggcccgaccttttgggacagcggtg

SEQ ID NO: 4406 - DNA, 140 bp, Artificial Sequence
  Synthetic
caccgctgtcccaaaaggtcgggccatccatgcgtcccaggaggagctgacttgtggtggacacactttttatgatgttgctctttgccccagagacccagtacatctcatgtgtggagtcatatcagcagccagggcct

SEQ ID NO: 4407 - DNA, 140 bp, Artificial Sequence
  Synthetic
atacgccatgctgggtctccatttgctcggctgtgccagttgactgggtaccaactgggagaaccacctggtcaatccatggaaagggagaatggatgaccactgaggacatgctcatggcgtacttgggagtcggccat

SEQ ID NO: 4408 - DNA, 140 bp, Artificial Sequence
  Synthetic
atggccgactcccaagtacgccatgagcatgtcctcagtggtcatccattctccctttccatggattgaccaggtggttctcccagttggtacccagtcaactggcacagccgagcaaatggagacccagcatggcgtat

SEQ ID NO: 4409 - DNA, 140 bp, Artificial Sequence
  Synthetic
aggccctggctgctgatatgcatggtgcgcaggatcataggtgatgaagaaaagtacatggactatctatccacccaagtccgctacttgggtgaggaagggtccacacccggagtgttggaccttttgggacagcggtg

SEQ ID NO: 4410 - DNA, 140 bp, Artificial Sequence
  Synthetic
caccgctgtcccaaaaggtccaacactccgggtgtggacccttcctcacccaagtagcggacttgggtggatagatagtccatgtacttttcttcatcacctatgatcctgcgcaccatgcatatcagcagccagggcct

SEQ ID NO: 4411 - DNA, 140 bp, Artificial Sequence
  Synthetic
aggccctggctgctgatatgaagcaaggagagttcgggaaagcaaaaggtagccgcgccatctggtacatgtggttgggagccagattcttggagtttgaagcccttggattcttgaacggaccttttgggacagcggtg

SEQ ID NO: 4412 - DNA, 140 bp, Artificial Sequence
  Synthetic
caccgctgtcccaaaaggtccgttcaagaatccaagggcttcaaactccaagaatctggctcccaaccacatgtaccagatggcgcggctaccttttgctttcccgaactctccttgcttcatatcagcagccagggcct

SEQ ID NO: 4413 - DNA, 140 bp, Artificial Sequence
  Synthetic
atacgccatgctgggtctcctgaccagatggttgcagagcaatggatgggatagactcaaacgaatggcggtcagtggagatgactgcgttgtgaagccaatcgatgataggtttgcacacgtacttgggagtcggccat

SEQ ID NO: 4414 - DNA, 140 bp, Artificial Sequence
  Synthetic
atggccgactcccaagtacgtgtgcaaacctatcatcgattggcttcacaacgcagtcatctccactgaccgccattcgtttgagtctatcccatccattgctctgcaaccatctggtcaggagacccagcatggcgtat

SEQ ID NO: 4415 - DNA, 140 bp, Artificial Sequence
  Synthetic
aggccctggctgctgatatgaagagaccttcgactgatggctaatgccatttgctcggctgtgccagttgactgggtaccaactgggagaaccacctggtcaatccatggaaagggagaagaccttttgggacagcggtg

SEQ ID NO: 4416 - DNA, 140 bp, Artificial Sequence
  Synthetic
caccgctgtcccaaaaggtcttctccctttccatggattgaccaggtggttctcccagttggtacccagtcaactggcacagccgagcaaatggcattagccatcagtcgaaggtctcttcatatcagcagccagggcct

SEQ ID NO: 4417 - DNA, 140 bp, Artificial Sequence
  Synthetic
atacgccatgctgggtctccctgggtctctggagcaaaaagtaacatcataaaaagtgtgtccaccacaagtcagctcctcctgggacgcatggatgggcccaggaggccagtgaagtatcgtacttgggagtcggccat

SEQ ID NO: 4418 - DNA, 140 bp, Artificial Sequence
  Synthetic
atggccgactcccaagtacgatacttcactggcctcctgggcccatccatgcgtcccaggaggagctgacttgtggtggacacactttttatgatgttactttttgctccagagacccagggagacccagcatggcgtat

SEQ ID NO: 4419 - DNA, 140 bp, Artificial Sequence
  Synthetic
aggccctggctgctgatatgccacctgagaggagagtgccatagttgtgtgtacaacatgatgggaaaaagagaaaagaagcaaggggaattcgggaaagcaaaaggcagtcgcgccatcgaccttttgggacagcggtg

SEQ ID NO: 4420 - DNA, 140 bp, Artificial Sequence
  Synthetic
caccgctgtcccaaaaggtcgatggcgcgactgccttttgctttcccgaattccccttgcttcttttctctttttcccatcatgttgtacacacaactatggcactctcctctcaggtggcatatcagcagccagggcct

SEQ ID NO: 4421 - DNA, 140 bp, Artificial Sequence
  Synthetic
atacgccatgctgggtctccgttcacgtgctccaggaagatgactgggaagagcattcagccggagaacctggagtatcggataatgctatcagtgcatggctcccagcacagtgggatgcgtacttgggagtcggccat

SEQ ID NO: 4422 - DNA, 140 bp, Artificial Sequence
  Synthetic
atggccgactcccaagtacgcatcccactgtgctgggagccatgcactgatagcattatccgatactccaggttctccggctgaatgctcttcccagtcatcttcctggagcacgtgaacggagacccagcatggcgtat

SEQ ID NO: 4423 - DNA, 140 bp, Artificial Sequence
  Synthetic
aggccctggctgctgatatgctgataaccgccaaccccgtgattactgaaagcactgagaattcaaagatgatgttggagctcgacccaccatttggggattcttacattgtcataggaggaccttttgggacagcggtg

SEQ ID NO: 4424 - DNA, 140 bp, Artificial Sequence
  Synthetic
caccgctgtcccaaaaggtcctcctatgacaatgtaagaatccccaaatggtgggtcgagctccaacatcatctttgaattctcagtgctttcagtaatcacggggttggcggttatcagcatatcagcagccagggcct

SEQ ID NO: 4425 - DNA, 140 bp, Artificial Sequence
  Synthetic
aggccctggctgctgatatgagcactgagaattcaaagatgatgttggagctcgacccaccatttggggattcttacattgtcataggagttggggataagaaaatcacccatcactggcgaccttttgggacagcggtg

SEQ ID NO: 4426 - DNA, 140 bp, Artificial Sequence
  Synthetic
caccgctgtcccaaaaggtcgccagtgatgggtgattttcttatccccaactcctatgacaatgtaagaatccccaaatggtgggtcgagctccaacatcatctttgaattctcagtgctcatatcagcagccagggcct

SEQ ID NO: 4427 - DNA, 140 bp, Artificial Sequence
  Synthetic
aggccctggctgctgatatgaaaaagagaaaagaagcaaggggaattcgggaaagcaaaaggcagtcgcgccatctggtacatgtggttgggagccagattcttggagtttgaagcccttgaccttttgggacagcggtg

SEQ ID NO: 4428 - DNA, 140 bp, Artificial Sequence
  Synthetic
caccgctgtcccaaaaggtcaagggcttcaaactccaagaatctggctcccaaccacatgtaccagatggcgcgactgccttttgctttcccgaattccccttgcttcttttctctttttcatatcagcagccagggcct

SEQ ID NO: 4429 - DNA, 140 bp, Artificial Sequence
  Synthetic
aggccctggctgctgatatgccatctggtacatgtggttgggagccagattcttggagtttgaagcccttggattcttgaacgaggaccattggatgggaagagaaaactcaggaggtgggaccttttgggacagcggtg

SEQ ID NO: 4430 - DNA, 140 bp, Artificial Sequence
  Synthetic
caccgctgtcccaaaaggtcccacctcctgagttttctcttcccatccaatggtcctcgttcaagaatccaagggcttcaaactccaagaatctggctcccaaccacatgtaccagatggcatatcagcagccagggcct

SEQ ID NO: 4431 - DNA, 140 bp, Artificial Sequence
  Synthetic
aggccctggctgctgatatgagaaaactcaggaggtggtgtcgaagggttgggactgcaaagacttggatacgttctagaagaaatgagccgggcaccaggaggaaagatgtatgcagatgaccttttgggacagcggtg

SEQ ID NO: 4432 - DNA, 140 bp, Artificial Sequence
  Synthetic
caccgctgtcccaaaaggtcatctgcatacatctttcctcctggtgcccggctcatttcttctagaacgtatccaagtctttgcagtcccaacccttcgacaccacctcctgagttttctcatatcagcagccagggcct

SEQ ID NO: 4433 - DNA, 140 bp, Artificial Sequence
  Synthetic
atacgccatgctgggtctcctaacaccaattttagtgttgtcagcctgctagccagccacagtttgggaaacgtgtgcagcctgtagccccaggagacgctggaaaccaacgcattttgccgtacttgggagtcggccat

SEQ ID NO: 4434 - DNA, 140 bp, Artificial Sequence
  Synthetic
atggccgactcccaagtacggcaaaatgcgttggtttccagcgtctcctggggctacaggctgcacacgtttcccaaactgtggctggctagcaggctgacaacactaaaattggtgttaggagacccagcatggcgtat

SEQ ID NO: 4435 - DNA, 140 bp, Artificial Sequence
  Synthetic
atacgccatgctgggtctcctagccgagaacgccatggcacgaagaagccatgccgcctgtgagcccctcggaggacactgagttaaaaaaccccacgcgcttggaagcgcaggggagtgcgtacttgggagtcggccat

SEQ ID NO: 4436 - DNA, 140 bp, Artificial Sequence
  Synthetic
atggccgactcccaagtacgcactcccctgcgcttccaagcgcgtggggttttttaactcagtgtcctccgaggggctcacaggcggcatggcttcttcgtgccatggcgttctcggctaggagacccagcatggcgtat

SEQ ID NO: 4437 - DNA, 140 bp, Artificial Sequence
  Synthetic
atacgccatgctgggtctcccggcctgcgcagccccaggaggactgggttaccaaagccgttgagcccccacggcccaagcctcgtctaggatgcaatagacgaggtagagggactagagcgtacttgggagtcggccat

SEQ ID NO: 4438 - DNA, 140 bp, Artificial Sequence
  Synthetic
atggccgactcccaagtacgctctagtccctctacctcgtctattgcatcctagacgaggcttgggccgtgggggctcaacggctttggtaacccagtcctcctggggctgcgcaggccgggagacccagcatggcgtat

SEQ ID NO: 4439 - DNA, 140 bp, Artificial Sequence
  Synthetic
aggccctggctgctgatatgccaggaggactgggttaccaaagccgttgagcccccacggcccaagcctcgtctaggatgcaatagacgaggtagagggactagaggttagaggagacccgaccttttgggacagcggtg

SEQ ID NO: 4440 - DNA, 140 bp, Artificial Sequence
  Synthetic
caccgctgtcccaaaaggtcgggtctcctctaacctctagtccctctacctcgtctattgcatcctagacgaggcttgggccgtgggggctcaacggctttggtaacccagtcctcctggcatatcagcagccagggcct

SEQ ID NO: 4441 - DNA, 140 bp, Artificial Sequence
  Synthetic
aggccctggctgctgatatgaccgaaagaccatatagtcaattacccggcgtcacacaccaccctcggggtccaagacatttccgctacggcgatgtcatgggtgcagaagatcacgggagaccttttgggacagcggtg

SEQ ID NO: 4442 - DNA, 140 bp, Artificial Sequence
  Synthetic
caccgctgtcccaaaaggtctcccgtgatcttctgcacccatgacatcgccgtagcggaaatgtcttggaccccgagggtggtgtgtgacgccgggtaattgactatatggtctttcggtcatatcagcagccagggcct

SEQ ID NO: 4443 - DNA, 140 bp, Artificial Sequence
  Synthetic
aggccctggctgctgatatgcataattggcaaacggaagagatgtaggtacttaagcttcctaaaagcagccgaactcactttgagaagtaggcatagcataccgaactcttccacgattgaccttttgggacagcggtg

SEQ ID NO: 4444 - DNA, 140 bp, Artificial Sequence
  Synthetic
caccgctgtcccaaaaggtcaatcgtggaagagttcggtatgctatgcctacttctcaaagtgagttcggctgcttttaggaagcttaagtacctacatctcttccgtttgccaattatgcatatcagcagccagggcct

SEQ ID NO: 4445 - DNA, 140 bp, Artificial Sequence
  Synthetic
aggccctggctgctgatatgtgtatcaccagtaatactgagatgttcttcctatttagcagttttgacaatggcagaaggaattttacaacgcatgttatgaacaatcaactgaacgcaggaccttttgggacagcggtg

SEQ ID NO: 4446 - DNA, 140 bp, Artificial Sequence
  Synthetic
caccgctgtcccaaaaggtcctgcgttcagttgattgttcataacatgcgttgtaaaattccttctgccattgtcaaaactgctaaataggaagaacatctcagtattactggtgatacacatatcagcagccagggcct

SEQ ID NO: 4447 - DNA, 140 bp, Artificial Sequence
  Synthetic
aggccctggctgctgatatggggtaaagcgcatggacatcgcgaagaacgatgaagagtgcgtggtcaacgccgccaaccctcgcgggttaccgggtgacggtgtttgcaaggcagtatagaccttttgggacagcggtg

SEQ ID NO: 4448 - DNA, 140 bp, Artificial Sequence
  Synthetic
caccgctgtcccaaaaggtctatactgccttgcaaacaccgtcacccggtaacccgcgagggttggcggcgttgaccacgcactcttcatcgttcttcgcgatgtccatgcgctttaccccatatcagcagccagggcct

SEQ ID NO: 4449 - DNA, 140 bp, Artificial Sequence
  Synthetic
atacgccatgctgggtctcctagcctaccagtttcttactgctctactctgcaaagcaagagattaagaacccatcatggatcctgtgtacgtggacatagacgctgacagcgcctttttcgtacttgggagtcggccat

SEQ ID NO: 4450 - DNA, 140 bp, Artificial Sequence
  Synthetic
atggccgactcccaagtacgaaaaaggcgctgtcagcgtctatgtccacgtacacaggatccatgatgggttcttaatctcttgctttgcagagtagagcagtaagaaactggtaggctaggagacccagcatggcgtat

SEQ ID NO: 4451 - DNA, 140 bp, Artificial Sequence
  Synthetic
aggccctggctgctgatatggagacacacgtagcctaccagtttcttactgctctactctgcaaagcaagagattaagaacccatcatggatcctgtgtacgtggacatagacgctgacagaccttttgggacagcggtg

SEQ ID NO: 4452 - DNA, 140 bp, Artificial Sequence
  Synthetic
caccgctgtcccaaaaggtctgtcagcgtctatgtccacgtacacaggatccatgatgggttcttaatctcttgctttgcagagtagagcagtaagaaactggtaggctacgtgtgtctccatatcagcagccagggcct

SEQ ID NO: 4453 - DNA, 140 bp, Artificial Sequence
  Synthetic
aggccctggctgctgatatgttgacaactaggtatgaaggcatacgcgtccctaaagagacacaccgcttatagctaggaatcaacagataagtatagatctaagggctgaacaacccctgaccttttgggacagcggtg

SEQ ID NO: 4454 - DNA, 140 bp, Artificial Sequence
  Synthetic
caccgctgtcccaaaaggtcaggggttgttcagcccttagatctatacttatctgttgattcctagctataagcggtgtgtctctttagggacgcgtatgccttcatacctagttgtcaacatatcagcagccagggcct

SEQ ID NO: 4455 - DNA, 140 bp, Artificial Sequence
  Synthetic
aggccctggctgctgatatgcccatcatggatcctgtgtacgtggacatagacgctgacagcgcctttttgaaggccctgcaacgtgcgtaccccatgtttgaggtggaatctaggcagggaccttttgggacagcggtg

SEQ ID NO: 4456 - DNA, 140 bp, Artificial Sequence
  Synthetic
caccgctgtcccaaaaggtccctgcctagattccacctcaaacatggggtacgcacgttgcagggccttcaaaaaggcgctgtcagcgtctatgtccacgtacacaggatccatgatgggcatatcagcagccagggcct

SEQ ID NO: 4457 - DNA, 140 bp, Artificial Sequence
  Synthetic
aggccctggctgctgatatgaaactaatagagcaggaaattgatcccgactcaaccatcctggatatcggcagtgcgccagcaaggaggatgatgtcggaaaggaagtaccactgcgtctgaccttttgggacagcggtg

SEQ ID NO: 4458 - DNA, 140 bp, Artificial Sequence
  Synthetic
caccgctgtcccaaaaggtcagacgcagtggtacttcctttccgacatcatcctccttgctggcgcactgccgatatccaggatggttgagtcgggatcaatttcctgctctattagtttcatatcagcagccagggcct

SEQ ID NO: 4459 - DNA, 140 bp, Artificial Sequence
  Synthetic
aggccctggctgctgatatgcacacgtagcctaccagtttcttactgctctactctgcaaagcaagagattaataacccatcatggatcctgtgtacgtggacatagacgctgacagcgcgaccttttgggacagcggtg

SEQ ID NO: 4460 - DNA, 140 bp, Artificial Sequence
  Synthetic
caccgctgtcccaaaaggtcgcgctgtcagcgtctatgtccacgtacacaggatccatgatgggttattaatctcttgctttgcagagtagagcagtaagaaactggtaggctacgtgtgcatatcagcagccagggcct

SEQ ID NO: 4461 - DNA, 140 bp, Artificial Sequence
  Synthetic
atacgccatgctgggtctccgcccgatgcgcagcgcagaagaccccgagagactcgccaattatgcgagaaagctagcatctgccgcaggaaaagtcctggacagaaacatctctggaaacgtacttgggagtcggccat

SEQ ID NO: 4462 - DNA, 140 bp, Artificial Sequence
  Synthetic
atggccgactcccaagtacgtttccagagatgtttctgtccaggacttttcctgcggcagatgctagctttctcgcataattggcgagtctctcggggtcttctgcgctgcgcatcgggcggagacccagcatggcgtat

SEQ ID NO: 4463 - DNA, 140 bp, Artificial Sequence
  Synthetic
atacgccatgctgggtctccaatcggggacctacaagcagtaatggccgtgccagacacggagacgccgacattctgcttacacacagatgtctcatgtagacagagagcagacgtcgcgcgtacttgggagtcggccat

SEQ ID NO: 4464 - DNA, 140 bp, Artificial Sequence
  Synthetic
atggccgactcccaagtacgcgcgacgtctgctctctgtctacatgagacatctgtgtgtaagcagaatgtcggcgtctccgtgtctggcacggccattactgcttgtaggtccccgattggagacccagcatggcgtat

SEQ ID NO: 4465 - DNA, 140 bp, Artificial Sequence
  Synthetic
aggccctggctgctgatatgcattctgcttacacacagatgtctcatgtagacagagagcagacgtcgcgatataccaagacgtctatgctacacacgcacccacgtcgctataccaccagaccttttgggacagcggtg

SEQ ID NO: 4466 - DNA, 140 bp, Artificial Sequence
  Synthetic
caccgctgtcccaaaaggtctggtggtatagcgacgtgggtgcgtgtgtagcatagacgtcttggtatatcgcgacgtctgctctctgtctacatgagacatctgtgtgtaagcagaatgcatatcagcagccagggcct

SEQ ID NO: 4467 - DNA, 140 bp, Artificial Sequence
  Synthetic
aggccctggctgctgatatgcgttcatgtacaatgccatggcgggtgcctacccttcatattcgacaaactgggcagatgagcaggtactgaaggctaagaacataggattatgttcaacgaccttttgggacagcggtg

SEQ ID NO: 4468 - DNA, 140 bp, Artificial Sequence
  Synthetic
caccgctgtcccaaaaggtcgttgaacataatcctatgttcttagccttcagtacctgctcatctgcccagtttgtcgaatatgaagggtaggcacccgccatggcattgtacatgaacgcatatcagcagccagggcct

SEQ ID NO: 4469 - DNA, 140 bp, Artificial Sequence
  Synthetic
atacgccatgctgggtctccagacctgacggaaggtagacgaggcaaactgtctatcatgagagggaaaaagctaaaaccgtgcgaccgtgtgctgttctcagtagggtcaacgctctaccgtacttgggagtcggccat

SEQ ID NO: 4470 - DNA, 140 bp, Artificial Sequence
  Synthetic
atggccgactcccaagtacggtagagcgttgaccctactgagaacagcacacggtcgcacggttttagctttttccctctcatgatagacagtttgcctcgtctaccttccgtcaggtctggagacccagcatggcgtat

SEQ ID NO: 4471 - DNA, 140 bp, Artificial Sequence
  Synthetic
aggccctggctgctgatatgagctaaaaccgtgcgaccgtgtgctgttctcagtagggtcaacgctctacccggaaagccgtaagctacttaagagctggcacctaccatcggtgttccagaccttttgggacagcggtg

SEQ ID NO: 4472 - DNA, 140 bp, Artificial Sequence
  Synthetic
caccgctgtcccaaaaggtctggaacaccgatggtaggtgccagctcttaagtagcttacggctttccgggtagagcgttgaccctactgagaacagcacacggtcgcacggttttagctcatatcagcagccagggcct

SEQ ID NO: 4473 - DNA, 140 bp, Artificial Sequence
  Synthetic
atacgccatgctgggtctccagaggaaaaaagctagaaccgtgcgaccgtgtgctgttctcagtagggtcaacgctctacccggaaagccgtaagctacttaagagctggcacctaccctcgtacttgggagtcggccat

SEQ ID NO: 4474 - DNA, 140 bp, Artificial Sequence
  Synthetic
atggccgactcccaagtacgagggtaggtgccagctcttaagtagcttacggctttccgggtagagcgttgaccctactgagaacagcacacggtcgcacggttctagcttttttcctctggagacccagcatggcgtat

SEQ ID NO: 4475 - DNA, 140 bp, Artificial Sequence
  Synthetic
atacgccatgctgggtctccaaaaccacagggtatgcggtaacccaccacgcagacgggttcctgatgtgcaagactaccgacacggttgacggcgaaagagtatcattctcggtgtgcacgtacttgggagtcggccat

SEQ ID NO: 4476 - DNA, 140 bp, Artificial Sequence
  Synthetic
atggccgactcccaagtacgtgcacaccgagaatgatactctttcgccgtcaaccgtgtcggtagtcttgcacatcaggaacccgtctgcgtggtgggttaccgcataccctgtggttttggagacccagcatggcgtat

SEQ ID NO: 4477 - DNA, 140 bp, Artificial Sequence
  Synthetic
aggccctggctgctgatatgcctttacggaaaaaccacagggtatgcggtaacccaccacgcagacggattcctgatgtgcaagaccaccgacacggttgacggcgaaagagtgtcattcgaccttttgggacagcggtg

SEQ ID NO: 4478 - DNA, 140 bp, Artificial Sequence
  Synthetic
caccgctgtcccaaaaggtcgaatgacactctttcgccgtcaaccgtgtcggtggtcttgcacatcaggaatccgtctgcgtggtgggttaccgcataccctgtggtttttccgtaaaggcatatcagcagccagggcct

SEQ ID NO: 4479 - DNA, 140 bp, Artificial Sequence
  Synthetic
aggccctggctgctgatatgaaaattatctgcttcccgtggtcgcccaagccttcagtaagtgggcaaaggagtgccggaaagacatggaagatgaaaaactcctgggggtcagagaaaggaccttttgggacagcggtg

SEQ ID NO: 4480 - DNA, 140 bp, Artificial Sequence
  Synthetic
caccgctgtcccaaaaggtcctttctctgacccccaggagtttttcatcttccatgtctttccggcactcctttgcccacttactgaaggcttgggcgaccacgggaagcagataattttcatatcagcagccagggcct

SEQ ID NO: 4481 - DNA, 140 bp, Artificial Sequence
  Synthetic
aggccctggctgctgatatggcagaggaagaacgagaagcagaactgactcgcgaagccctaccacctctacaggcagcacaggaagatgttcaggtcgaaatcgacgtggaacagcttggaccttttgggacagcggtg

SEQ ID NO: 4482 - DNA, 140 bp, Artificial Sequence
  Synthetic
caccgctgtcccaaaaggtccaagctgttccacgtcgatttcgacctgaacatcttcctgtgctgcctgtagaggtggtagggcttcgcgagtcagttctgcttctcgttcttcctctgccatatcagcagccagggcct

SEQ ID NO: 4483 - DNA, 140 bp, Artificial Sequence
  Synthetic
aggccctggctgctgatatgcacacggtctacaagaggcctgatacccagtcaattcagaaggttcaggccgagtttgacagctttgtggtaccgagcctgtggtcgtccgggttgtcaagaccttttgggacagcggtg

SEQ ID NO: 4484 - DNA, 140 bp, Artificial Sequence
  Synthetic
caccgctgtcccaaaaggtcttgacaacccggacgaccacaggctcggtaccacaaagctgtcaaactcggcctgaaccttctgaattgactgggtatcaggcctcttgtagaccgtgtgcatatcagcagccagggcct

SEQ ID NO: 4485 - DNA, 140 bp, Artificial Sequence
  Synthetic
aggccctggctgctgatatgcatacagcggggacacccaagaagcccgggacgcagaaaaagaagcagaggaagaacgagaagcagaactgactcgtgtagccctaccacctctacaggcgaccttttgggacagcggtg

SEQ ID NO: 4486 - DNA, 140 bp, Artificial Sequence
  Synthetic
caccgctgtcccaaaaggtcgcctgtagaggtggtagggctacacgagtcagttctgcttctcgttcttcctctgcttctttttctgcgtcccgggcttcttgggtgtccccgctgtatgcatatcagcagccagggcct

SEQ ID NO: 4487 - DNA, 140 bp, Artificial Sequence
  Synthetic
aggccctggctgctgatatggttactgcccaaccaacagaccacgtcgtgggagagtacctggtactctccccgcagaccgtactacgtagccagaagctcagtctgattcacgctttgggaccttttgggacagcggtg

SEQ ID NO: 4488 - DNA, 140 bp, Artificial Sequence
  Synthetic
caccgctgtcccaaaaggtcccaaagcgtgaatcagactgagcttctggctacgtagtacggtctgcggggagagtaccaggtactctcccacgacgtggtctgttggttgggcagtaaccatatcagcagccagggcct

SEQ ID NO: 4489 - DNA, 140 bp, Artificial Sequence
  Synthetic
aggccctggctgctgatatgcccgcagaccgtactacgtagccagaagctcagtctgattcacgctttggcggagcaagtgaagacgtgcacgcacaacggacgagcagggaggtatgcggaccttttgggacagcggtg

SEQ ID NO: 4490 - DNA, 140 bp, Artificial Sequence
  Synthetic
caccgctgtcccaaaaggtccgcatacctccctgctcgtccgttgtgcgtgcacgtcttcacttgctccgccaaagcgtgaatcagactgagcttctggctacgtagtacggtctgcgggcatatcagcagccagggcct

SEQ ID NO: 4491 - DNA, 140 bp, Artificial Sequence
  Synthetic
aggccctggctgctgatatggagcgggtgcaggaataatagagactccgagaggagctatcaaagttactgcccaaccaatagaccacgtcgtgggagaatacctggtactttccccgcagaccttttgggacagcggtg

SEQ ID NO: 4492 - DNA, 140 bp, Artificial Sequence
  Synthetic
caccgctgtcccaaaaggtctgcggggaaagtaccaggtattctcccacgacgtggtctattggttgggcagtaactttgatagctcctctcggagtctctattattcctgcacccgctccatatcagcagccagggcct

SEQ ID NO: 4493 - DNA, 140 bp, Artificial Sequence
  Synthetic
atacgccatgctgggtctccgaccgtactacgtagccagaagctcagcttaatccacgctttggcggagcaagtgaagacgtgcacgcacagcggacgagcagggaggtatgcggtcgaacgtacttgggagtcggccat

SEQ ID NO: 4494 - DNA, 140 bp, Artificial Sequence
  Synthetic
atggccgactcccaagtacgttcgaccgcatacctccctgctcgtccgctgtgcgtgcacgtcttcacttgctccgccaaagcgtggattaagctgagcttctggctacgtagtacggtcggagacccagcatggcgtat

SEQ ID NO: 4495 - DNA, 140 bp, Artificial Sequence
  Synthetic
aggccctggctgctgatatggactagaatcaaatggttgttaagcaaggtgccaaaaaccgacctgatcccatacagcggggacacccaagaagcccgggacgcagaaaaagaagcagaggaccttttgggacagcggtg

SEQ ID NO: 4496 - DNA, 140 bp, Artificial Sequence
  Synthetic
caccgctgtcccaaaaggtcctctgcttctttttctgcgtcccgggcttcttgggtgtccccgctgtatgggatcaggtcggtttttggcaccttgcttaacaaccatttgattctagtccatatcagcagccagggcct

SEQ ID NO: 4497 - DNA, 140 bp, Artificial Sequence
  Synthetic
aggccctggctgctgatatgaacaccgacgaagagtcgtatgagctggtgagggcagagaggacagaacacgagtacgtctacgatgtggaccagagaagatgctgtaagaaggaagaaggaccttttgggacagcggtg

SEQ ID NO: 4498 - DNA, 140 bp, Artificial Sequence
  Synthetic
caccgctgtcccaaaaggtccttcttccttcttacagcatcttctctggtccacatcgtagacgtactcgtgttctgtcctctctgccctcaccagctcatacgactcttcgtcggtgttcatatcagcagccagggcct

SEQ ID NO: 4499 - DNA, 140 bp, Artificial Sequence
  Synthetic
aggccctggctgctgatatggccctgaacaccgacgaagagtcgtatgagctggtgagggcagagaggacagaacacgagtacgtctacgacgtggatcagagaagatgctgtaagaagggaccttttgggacagcggtg

SEQ ID NO: 4500 - DNA, 140 bp, Artificial Sequence
  Synthetic
caccgctgtcccaaaaggtcccttcttacagcatcttctctgatccacgtcgtagacgtactcgtgttctgtcctctctgccctcaccagctcatacgactcttcgtcggtgttcagggccatatcagcagccagggcct

SEQ ID NO: 4501 - DNA, 140 bp, Artificial Sequence
  Synthetic
atacgccatgctgggtctccccgcaggactggtactggtgggcgacttgactaatccgccctaccacgaattcgcatacgaagggctgaaaatccgccctgcctgcccatacaaaattgccgtacttgggagtcggccat

SEQ ID NO: 4502 - DNA, 140 bp, Artificial Sequence
  Synthetic
atggccgactcccaagtacggcaattttgtatgggcaggcagggcggattttcagcccttcgtatgcgaattcgtggtagggcggattagtcaagtcgcccaccagtaccagtcctgcggggagacccagcatggcgtat

SEQ ID NO: 4503 - DNA, 140 bp, Artificial Sequence
  Synthetic
aggccctggctgctgatatgagaacacgagtacgtctacgacgtggatcagagaagatgctgtaagaaggaagaagccgcaggactggtactggtgggcgacttgactaatccgccctacgaccttttgggacagcggtg

SEQ ID NO: 4504 - DNA, 140 bp, Artificial Sequence
  Synthetic
caccgctgtcccaaaaggtcgtagggcggattagtcaagtcgcccaccagtaccagtcctgcggcttcttccttcttacagcatcttctctgatccacgtcgtagacgtactcgtgttctcatatcagcagccagggcct

SEQ ID NO: 4505 - DNA, 140 bp, Artificial Sequence
  Synthetic
aggccctggctgctgatatgcacgaattcgcatatgaagggctaaaaatccgccctgcctgcccatacaaaattgcagtcataggagtcttcggagtaccgggatctggcaagtcagctagaccttttgggacagcggtg

SEQ ID NO: 4506 - DNA, 140 bp, Artificial Sequence
  Synthetic
caccgctgtcccaaaaggtctagctgacttgccagatcccggtactccgaagactcctatgactgcaattttgtatgggcaggcagggcggatttttagcccttcatatgcgaattcgtgcatatcagcagccagggcct

SEQ ID NO: 4507 - DNA, 140 bp, Artificial Sequence
  Synthetic
atacgccatgctgggtctccaacgaaagagagttcgtaaacagaaagctacaccatattgcgatgcatggaccagccctgaacaccgacgaagagtcgtatgagctggtgagggcagagacgtacttgggagtcggccat

SEQ ID NO: 4508 - DNA, 140 bp, Artificial Sequence
  Synthetic
atggccgactcccaagtacgtctctgccctcaccagctcatacgactcttcgtcggtgttcagggctggtccatgcatcgcaatatggtgtagctttctgtttacgaactctctttcgttggagacccagcatggcgtat

SEQ ID NO: 4509 - DNA, 140 bp, Artificial Sequence
  Synthetic
aggccctggctgctgatatgtgccaagaaatcaccaccgacgtgatgagacagagaggtctagagatatctgcacgtacggttgattcgctgctcttgaatggatgcaacagaccagtcggaccttttgggacagcggtg

SEQ ID NO: 4510 - DNA, 140 bp, Artificial Sequence
  Synthetic
caccgctgtcccaaaaggtccgactggtctgttgcatccattcaagagcagcgaatcaaccgtacgtgcagatatctctagacctctctgtctcatcacgtcggtggtgatttcttggcacatatcagcagccagggcct

SEQ ID NO: 4511 - DNA, 140 bp, Artificial Sequence
  Synthetic
atacgccatgctgggtctcctgcacgtacggttgattcgctgctcttgaatggatgcaacagaccagtcgacgtgttgtacgtagacgaggcgtttgcgtgccactctggaacgttacttcgtacttgggagtcggccat

SEQ ID NO: 4512 - DNA, 140 bp, Artificial Sequence
  Synthetic
atggccgactcccaagtacgaagtaacgttccagagtggcacgcaaacgcctcgtctacgtacaacacgtcgactggtctgttgcatccattcaagagcagcgaatcaaccgtacgtgcaggagacccagcatggcgtat

SEQ ID NO: 4513 - DNA, 140 bp, Artificial Sequence
  Synthetic
aggccctggctgctgatatggatatctgcacgtacggttgactcgctgctcttgaatggatgcaacagaccagtcgacgtgttgtacgtagacgaggcgtttgcgtgccactctggaacggaccttttgggacagcggtg

SEQ ID NO: 4514 - DNA, 140 bp, Artificial Sequence
  Synthetic
caccgctgtcccaaaaggtccgttccagagtggcacgcaaacgcctcgtctacgtacaacacgtcgactggtctgttgcatccattcaagagcagcgagtcaaccgtacgtgcagatatccatatcagcagccagggcct

SEQ ID NO: 4515 - DNA, 140 bp, Artificial Sequence
  Synthetic
atacgccatgctgggtctcccccgaagcagtgcggcttcttcaatatgatgcagatgaaagtcaattacaatcacaacatctgcacccaagtgtaccacaaaagtatctccaggcggtgtcgtacttgggagtcggccat

SEQ ID NO: 4516 - DNA, 140 bp, Artificial Sequence
  Synthetic
atggccgactcccaagtacgacaccgcctggagatacttttgtggtacacttgggtgcagatgttgtgattgtaattgactttcatctgcatcatattgaagaagccgcactgcttcgggggagacccagcatggcgtat

SEQ ID NO: 4517 - DNA, 140 bp, Artificial Sequence
  Synthetic
aggccctggctgctgatatgctacttgctttgatcgccttggtgagaccaaggcagaaagttgtactttgtggtgacccgaagcagtgcggcttcttcaatatgatgcagatgaaagtcagaccttttgggacagcggtg

SEQ ID NO: 4518 - DNA, 140 bp, Artificial Sequence
  Synthetic
caccgctgtcccaaaaggtctgactttcatctgcatcatattgaagaagccgcactgcttcgggtcaccacaaagtacaactttctgccttggtctcaccaaggcgatcaaagcaagtagcatatcagcagccagggcct

SEQ ID NO: 4519 - DNA, 140 bp, Artificial Sequence
  Synthetic
atacgccatgctgggtctccttaatgaaaacccgctctatgcatcaacgtcagagcacgttaacgtactcctaacacgaacggaaggtaaactagtatggaagacactttccggcgaccccgtacttgggagtcggccat

SEQ ID NO: 4520 - DNA, 140 bp, Artificial Sequence
  Synthetic
atggccgactcccaagtacggggtcgccggaaagtgtcttccatactagtttaccttccgttcgtgttaggagtacgttaacgtgctctgacgttgatgcatagagcgggttttcattaaggagacccagcatggcgtat

SEQ ID NO: 4521 - DNA, 140 bp, Artificial Sequence
  Synthetic
aggccctggctgctgatatgaaaaagttaatgaaaacccgctctatgcatcaacgtcagagcacgtcaacgtactcctaacgcgtacggaaggtaaactggtatggaagacactttccgggaccttttgggacagcggtg

SEQ ID NO: 4522 - DNA, 140 bp, Artificial Sequence
  Synthetic
caccgctgtcccaaaaggtcccggaaagtgtcttccataccagtttaccttccgtacgcgttaggagtacgttgacgtgctctgacgttgatgcatagagcgggttttcattaactttttcatatcagcagccagggcct

SEQ ID NO: 4523 - DNA, 140 bp, Artificial Sequence
  Synthetic
atacgccatgctgggtctcccaccaaatgacctttgatacattccaaaacaaagccaacgtttgttgggctaagagtttggtccctatcctcgaaacagcggggataaaactaaatgatacgtacttgggagtcggccat

SEQ ID NO: 4524 - DNA, 140 bp, Artificial Sequence
  Synthetic
atggccgactcccaagtacgtatcatttagttttatccccgctgtttcgaggatagggaccaaactcttagcccaacaaacgttggctttgttttggaatgtatcaaaggtcatttggtgggagacccagcatggcgtat

SEQ ID NO: 4525 - DNA, 140 bp, Artificial Sequence
  Synthetic
aggccctggctgctgatatgtaagagtttggtccctatcctcgaaacagcggggataaaactaaatgataggcagtggtcccagataattcaagccttcaaagaagacaaagcatactcagaccttttgggacagcggtg

SEQ ID NO: 4526 - DNA, 140 bp, Artificial Sequence
  Synthetic
caccgctgtcccaaaaggtctgagtatgctttgtcttctttgaaggcttgaattatctgggaccactgcctatcatttagttttatccccgctgtttcgaggatagggaccaaactcttacatatcagcagccagggcct

SEQ ID NO: 4527 - DNA, 140 bp, Artificial Sequence
  Synthetic
aggccctggctgctgatatgcaactattaaggagtgggaggtggagcatgcatcaataatggcgggcatctgcagtcaccaaatgaccttcgatacattccaaaataaagccaacgtttggaccttttgggacagcggtg

SEQ ID NO: 4528 - DNA, 140 bp, Artificial Sequence
  Synthetic
caccgctgtcccaaaaggtccaaacgttggctttattttggaatgtatcgaaggtcatttggtgactgcagatgcccgccattattgatgcatgctccacctcccactccttaatagttgcatatcagcagccagggcct

SEQ ID NO: 4529 - DNA, 140 bp, Artificial Sequence
  Synthetic
aggccctggctgctgatatgagacagcgggctattttctaaaccgttggtgtctgtgtattacgcggacaaccactgggataataggcctggagggaagacgttcggatttaaccctgaggaccttttgggacagcggtg

SEQ ID NO: 4530 - DNA, 140 bp, Artificial Sequence
  Synthetic
caccgctgtcccaaaaggtcctcagggttaaatccgaacgtcttccctccaggcctattatcccagtggttgtccgcgtaatacacagacaccaacggtttagaaaatagcccgctgtctcatatcagcagccagggcct

SEQ ID NO: 4531 - DNA, 140 bp, Artificial Sequence
  Synthetic
aggccctggctgctgatatgttgggctaagagcttggtccctatcctcgaaacagcggggataaaactaaatgataggcagtggtctcagataattcaagccttcaaagaagacaaagcagaccttttgggacagcggtg

SEQ ID NO: 4532 - DNA, 140 bp, Artificial Sequence
  Synthetic
caccgctgtcccaaaaggtctgctttgtcttctttgaaggcttgaattatctgagaccactgcctatcatttagttttatccccgctgtttcgaggatagggaccaagctcttagcccaacatatcagcagccagggcct

SEQ ID NO: 4533 - DNA, 140 bp, Artificial Sequence
  Synthetic
atacgccatgctgggtctccctaccaccaacattataccggtcaacaggagactaccacactcattagtggccgaacaccgcccagtaaaaggggaaagaatggaatggctggttaacaacgtacttgggagtcggccat

SEQ ID NO: 4534 - DNA, 140 bp, Artificial Sequence
  Synthetic
atggccgactcccaagtacgttgttaaccagccattccattctttccccttttactgggcggtgttcggccactaatgagtgtggtagtctcctgttgaccggtataatgttggtggtagggagacccagcatggcgtat

SEQ ID NO: 4535 - DNA, 140 bp, Artificial Sequence
  Synthetic
aggccctggctgctgatatggccgaacaccgcccagtaaaaggggaaagaatggaatggctggttaacaagataaacggtcaccacgtgctcctggtcagtggctataaccttgcactgcgaccttttgggacagcggtg

SEQ ID NO: 4536 - DNA, 140 bp, Artificial Sequence
  Synthetic
caccgctgtcccaaaaggtcgcagtgcaaggttatagccactgaccaggagcacgtggtgaccgtttatcttgttaaccagccattccattctttccccttttactgggcggtgttcggccatatcagcagccagggcct

SEQ ID NO: 4537 - DNA, 140 bp, Artificial Sequence
  Synthetic
atacgccatgctgggtctcccccgaggcagcatccattctagaaagaaagtacccattcacaaaagggaagtggaacatcaacaagcagatctgtgtgactaccaggaggatagaagactcgtacttgggagtcggccat

SEQ ID NO: 4538 - DNA, 140 bp, Artificial Sequence
  Synthetic
atggccgactcccaagtacgagtcttctatcctcctggtagtcacacagatctgcttgttgatgttccacttcccttttgtgaatgggtactttctttctagaatggatgctgcctcgggggagacccagcatggcgtat

SEQ ID NO: 4539 - DNA, 140 bp, Artificial Sequence
  Synthetic
atacgccatgctgggtctccctaaacgacaggcagtggtcccagataattcaagccttcaaagaagacaaagcatattcacccgaagtagccctgaatgaaatatgcacgcgcatgtatgcgtacttgggagtcggccat

SEQ ID NO: 4540 - DNA, 140 bp, Artificial Sequence
  Synthetic
atggccgactcccaagtacgcatacatgcgcgtgcatatttcattcagggctacttcgggtgaatatgctttgtcttctttgaaggcttgaattatctgggaccactgcctgtcgtttagggagacccagcatggcgtat

SEQ ID NO: 4541 - DNA, 140 bp, Artificial Sequence
  Synthetic
atacgccatgctgggtctccagtgcgtggaccacgcaatgaaactgcaaatgctcgggggtgactcattgagactgctcaaaccgggtggctctctactgatcagagcatatggctacgccgtacttgggagtcggccat

SEQ ID NO: 4542 - DNA, 140 bp, Artificial Sequence
  Synthetic
atggccgactcccaagtacggcgtagccatatgctctgatcagtagagagccacccggtttgagcagtctcaatgagtcacccccgagcatttgcagtttcattgcgtggtccacgcactggagacccagcatggcgtat

SEQ ID NO: 4543 - DNA, 140 bp, Artificial Sequence
  Synthetic
aggccctggctgctgatatgcactgcctactaagagagtcacttgggtagcgccgttaggtgtccgcggagcggactacacatacaacctagagttgggtctgccagcaacgcttggtaggaccttttgggacagcggtg

SEQ ID NO: 4544 - DNA, 140 bp, Artificial Sequence
  Synthetic
caccgctgtcccaaaaggtcctaccaagcgttgctggcagacccaactctaggttgtatgtgtagtccgctccgcggacacctaacggcgctacccaagtgactctcttagtaggcagtgcatatcagcagccagggcct

SEQ ID NO: 4545 - DNA, 140 bp, Artificial Sequence
  Synthetic
aggccctggctgctgatatgcgtctagagcgttgaaaccaccatgtgtcaccagcaacactgagatgtttttcctattcagcaactttgacaatggcagaaggaacttcacaactcatgtgaccttttgggacagcggtg

SEQ ID NO: 4546 - DNA, 140 bp, Artificial Sequence
  Synthetic
caccgctgtcccaaaaggtcacatgagttgtgaagttccttctgccattgtcaaagttgctgaataggaaaaacatctcagtgttgctggtgacacatggtggtttcaacgctctagacgcatatcagcagccagggcct

SEQ ID NO: 4547 - DNA, 140 bp, Artificial Sequence
  Synthetic
aggccctggctgctgatatggatgtgcaccgtcgtaccgggtaaaacgcatggacatcgcgaagaacgatgaagagtgcgtggtcaacgccgctaaccctcgcgggttaccgggtgacgggaccttttgggacagcggtg

SEQ ID NO: 4548 - DNA, 140 bp, Artificial Sequence
  Synthetic
caccgctgtcccaaaaggtcccgtcacccggtaacccgcgagggttagcggcgttgaccacgcactcttcatcgttcttcgcgatgtccatgcgttttacccggtacgacggtgcacatccatatcagcagccagggcct

SEQ ID NO: 4549 - DNA, 140 bp, Artificial Sequence
  Synthetic
atacgccatgctgggtctcccttgcactgcctactaagagagtcacttgggtagcgccactaggtgtccgcggagcggactatacatacaacctagagttgggtctgccagcaacgcttgcgtacttgggagtcggccat

SEQ ID NO: 4550 - DNA, 140 bp, Artificial Sequence
  Synthetic
atggccgactcccaagtacgcaagcgttgctggcagacccaactctaggttgtatgtatagtccgctccgcggacacctagtggcgctacccaagtgactctcttagtaggcagtgcaagggagacccagcatggcgtat

SEQ ID NO: 4551 - DNA, 140 bp, Artificial Sequence
  Synthetic
aggccctggctgctgatatggaagagtgcgtggtcaacgccgctaaccctcgcgggttaccgggtgacggtgtttgtaaggcagtatacaaaaaatggccggagtcctttaagaacagtggaccttttgggacagcggtg

SEQ ID NO: 4552 - DNA, 140 bp, Artificial Sequence
  Synthetic
caccgctgtcccaaaaggtccactgttcttaaaggactccggccattttttgtatactgccttacaaacaccgtcacccggtaacccgcgagggttagcggcgttgaccacgcactcttccatatcagcagccagggcct

SEQ ID NO: 4553 - DNA, 140 bp, Artificial Sequence
  Synthetic
atacgccatgctgggtctcccaacaccagtgggaaccgcaaaaacagtcatgtgcggtacgtacccagtaatccacgccgttggaccaaacttctctaattattcggagtctgaaggggacgtacttgggagtcggccat

SEQ ID NO: 4554 - DNA, 140 bp, Artificial Sequence
  Synthetic
atggccgactcccaagtacgtccccttcagactccgaataattagagaagtttggtccaacggcgtggattactgggtacgtaccgcacatgactgtttttgcggttcccactggtgttgggagacccagcatggcgtat

SEQ ID NO: 4555 - DNA, 140 bp, Artificial Sequence
  Synthetic
aggccctggctgctgatatggagcaggatgtgcaccgtcgtaccgggtaaaacgcatggacatcgcgaagaacgatgaagagtgcgtagtcaacgccgctaaccctcgcgggttaccggggaccttttgggacagcggtg

SEQ ID NO: 4556 - DNA, 140 bp, Artificial Sequence
  Synthetic
caccgctgtcccaaaaggtccccggtaacccgcgagggttagcggcgttgactacgcactcttcatcgttcttcgcgatgtccatgcgttttacccggtacgacggtgcacatcctgctccatatcagcagccagggcct

SEQ ID NO: 4557 - DNA, 140 bp, Artificial Sequence
  Synthetic
atacgccatgctgggtctccccgggaactggcagctgcctatcgagaagtcgcaaaggaagtaactagactgggagtaaacagtgtagctatacctctcctctccacaggtgtatactcacgtacttgggagtcggccat

SEQ ID NO: 4558 - DNA, 140 bp, Artificial Sequence
  Synthetic
atggccgactcccaagtacgtgagtatacacctgtggagaggagaggtatagctacactgtttactcccagtctagttacttcctttgcgacttctcgataggcagctgccagttcccggggagacccagcatggcgtat

SEQ ID NO: 4559 - DNA, 140 bp, Artificial Sequence
  Synthetic
aggccctggctgctgatatgaagtttagatcatctagagcgttgaaaccaccatgtgtcaccagcaacactgagatgttttttctattcagcaactttgacaatggcagaaggaatttcagaccttttgggacagcggtg

SEQ ID NO: 4560 - DNA, 140 bp, Artificial Sequence
  Synthetic
caccgctgtcccaaaaggtctgaaattccttctgccattgtcaaagttgctgaatagaaaaaacatctcagtgttgctggtgacacatggtggtttcaacgctctagatgatctaaacttcatatcagcagccagggcct

SEQ ID NO: 4561 - DNA, 140 bp, Artificial Sequence
  Synthetic
atacgccatgctgggtctccggagggaaagacaggctgatccagtcactgaaccacctttttacagccatggactcgacggatgcagacgtggtcatctactgccgcgacaaagaatgggcgtacttgggagtcggccat

SEQ ID NO: 4562 - DNA, 140 bp, Artificial Sequence
  Synthetic
atggccgactcccaagtacgcccattctttgtcgcggcagtagatgaccacgtctgcatccgtcgagtccatggctgtaaaaaggtggttcagtgactggatcagcctgtctttccctccggagacccagcatggcgtat

SEQ ID NO: 4563 - DNA, 140 bp, Artificial Sequence
  Synthetic
aggccctggctgctgatatgccagtaatccacgctgttggaccaaacttctctaattattcggagtctgaaggggaccgggaattggcagctgcctatcgagaggtcgcaaaggaagtaagaccttttgggacagcggtg

SEQ ID NO: 4564 - DNA, 140 bp, Artificial Sequence
  Synthetic
caccgctgtcccaaaaggtcttacttcctttgcgacctctcgataggcagctgccaattcccggtccccttcagactccgaataattagagaagtttggtccaacagcgtggattactggcatatcagcagccagggcct

SEQ ID NO: 4565 - DNA, 140 bp, Artificial Sequence
  Synthetic
atacgccatgctgggtctccgatgagcacatctccatagattgcgatattgttcgcgtgcaccctgacagcagcttggcaggcagaaaaggatacagcaccacggaaggcgtactgtactcgtacttgggagtcggccat

SEQ ID NO: 4566 - DNA, 140 bp, Artificial Sequence
  Synthetic
atggccgactcccaagtacgagtacagtacgccttccgtggtgctgtatccttttctgcctgccaagctgctgtcagggtgcacgcgaacaatatcgcaatctatggagatgtgctcatcggagacccagcatggcgtat

SEQ ID NO: 4567 - DNA, 140 bp, Artificial Sequence
  Synthetic
aggccctggctgctgatatgggactcgacggatgcagacgtggtcatctactgccgcgacaaagaatgggagaagaaaatatctgaggccatacagatgcggacccaagtggaactgctggaccttttgggacagcggtg

SEQ ID NO: 4568 - DNA, 140 bp, Artificial Sequence
  Synthetic
caccgctgtcccaaaaggtccagcagttccacttgggtccgcatctgtatggcctcagatattttcttctcccattctttgtcgcggcagtagatgaccacgtctgcatccgtcgagtcccatatcagcagccagggcct

SEQ ID NO: 4569 - DNA, 140 bp, Artificial Sequence
  Synthetic
atacgccatgctgggtctcccatatctagaagggacccgttttcaccagacggcagtggatatggcggagatatatactatgtggccaaaacaaacagaggccaacgagcaagtctgcctcgtacttgggagtcggccat

SEQ ID NO: 4570 - DNA, 140 bp, Artificial Sequence
  Synthetic
atggccgactcccaagtacgaggcagacttgctcgttggcctctgtttgttttggccacatagtatatatctccgccatatccactgccgtctggtgaaaacgggtcccttctagatatgggagacccagcatggcgtat

SEQ ID NO: 4571 - DNA, 140 bp, Artificial Sequence
  Synthetic
aggccctggctgctgatatgatatatactatgtggccaaaacaaacagaggccaacgagcaagtctgcctatatgccctgggggaaagtattgaatcgatcaggcagaaatgcccggtgggaccttttgggacagcggtg

SEQ ID NO: 4572 - DNA, 140 bp, Artificial Sequence
  Synthetic
caccgctgtcccaaaaggtcccaccgggcatttctgcctgatcgattcaatactttcccccagggcatataggcagacttgctcgttggcctctgtttgttttggccacatagtatatatcatatcagcagccagggcct

SEQ ID NO: 4573 - DNA, 140 bp, Artificial Sequence
  Synthetic
atacgccatgctgggtctccctgaaggggaccgagaattggcggctgcctatcgagaagtcgcaaaggaggtaactagactgggagtaaatagtgtagctatacctctcctctccacaggcgtacttgggagtcggccat

SEQ ID NO: 4574 - DNA, 140 bp, Artificial Sequence
  Synthetic
atggccgactcccaagtacgcctgtggagaggagaggtatagctacactatttactcccagtctagttacctcctttgcgacttctcgataggcagccgccaattctcggtccccttcagggagacccagcatggcgtat

SEQ ID NO: 4575 - DNA, 140 bp, Artificial Sequence
  Synthetic
atacgccatgctgggtctccatgacgcagatgcatcttctcccccaaaaactgtcccgtgcctttgccgttacgccatgactccagaacgcgtcacccgactccgcatgaaccacgtcaccgtacttgggagtcggccat

SEQ ID NO: 4576 - DNA, 140 bp, Artificial Sequence
  Synthetic
atggccgactcccaagtacggtgacgtggttcatgcggagtcgggtgacgcgttctggagtcatggcgtaacggcaaaggcacgggacagtttttgggggagaagatgcatctgcgtcatggagacccagcatggcgtat

SEQ ID NO: 4577 - DNA, 140 bp, Artificial Sequence
  Synthetic
aggccctggctgctgatatgctgctggatgagcacatctccatagactgcgatattgttcgcgtgcaccctgacagcagcttggcaggcagaaaaggatacagcaccacggaaggcgcacgaccttttgggacagcggtg

SEQ ID NO: 4578 - DNA, 140 bp, Artificial Sequence
  Synthetic
caccgctgtcccaaaaggtcgtgcgccttccgtggtgctgtatccttttctgcctgccaagctgctgtcagggtgcacgcgaacaatatcgcagtctatggagatgtgctcatccagcagcatatcagcagccagggcct

SEQ ID NO: 4579 - DNA, 140 bp, Artificial Sequence
  Synthetic
aggccctggctgctgatatggagtgcaaaaagtcaaatgctctaaggtaatgctatttgaccacaacgtgccatcgcgcgtaagtccaagggaatatagatcttccccggagtctgcacagaccttttgggacagcggtg

SEQ ID NO: 4580 - DNA, 140 bp, Artificial Sequence
  Synthetic
caccgctgtcccaaaaggtctgtgcagactccggggaagatctatattcccttggacttacgcgcgatggcacgttgtggtcaaatagcattaccttagagcatttgactttttgcactccatatcagcagccagggcct

SEQ ID NO: 4581 - DNA, 140 bp, Artificial Sequence
  Synthetic
aggccctggctgctgatatgccatcgcgcgtaagtccaagggaatatagatcttccccggagtctgcacaggaagcgagtacggctatgtcgctgacgcatagtcgattcgacctaagcggaccttttgggacagcggtg

SEQ ID NO: 4582 - DNA, 140 bp, Artificial Sequence
  Synthetic
caccgctgtcccaaaaggtccgcttaggtcgaatcgactatgcgtcagcgacatagccgtactcgcttcctgtgcagactccggggaagatctatattcccttggacttacgcgcgatggcatatcagcagccagggcct

SEQ ID NO: 4583 - DNA, 140 bp, Artificial Sequence
  Synthetic
aggccctggctgctgatatgtgccgttacgctatgactccagaacgcgtcacccggcttcgcatgaaccacgtcacaagcataattgtgtgttcttcgtttcccctcccaaagtacaaaagaccttttgggacagcggtg

SEQ ID NO: 4584 - DNA, 140 bp, Artificial Sequence
  Synthetic
caccgctgtcccaaaaggtcttttgtactttgggaggggaaacgaagaacacacaattatgcttgtgacgtggttcatgcgaagccgggtgacgcgttctggagtcatagcgtaacggcacatatcagcagccagggcct

SEQ ID NO: 4585 - DNA, 140 bp, Artificial Sequence
  Synthetic
atacgccatgctgggtctccttgacggcgagatactgcccgtcccgtcagacctggatgctgacgccccagccctagaaccagccctagacgacggggcgacacacatgttgccgtccaccgtacttgggagtcggccat

SEQ ID NO: 4586 - DNA, 140 bp, Artificial Sequence
  Synthetic
atggccgactcccaagtacggtggacggcaacatgtgtgtcgccccgtcgtctagggctggttctagggctggggcgtcagcatccaggtctgacgggacgggcagtatctcgccgtcaaggagacccagcatggcgtat

SEQ ID NO: 4587 - DNA, 140 bp, Artificial Sequence
  Synthetic
aggccctggctgctgatatggccctagaaccagccctagacgacggggcgacacacatgttgccgtccacaactggaaaccttgcggccgtgtctgactgggtaatgagcaccgtacctagaccttttgggacagcggtg

SEQ ID NO: 4588 - DNA, 140 bp, Artificial Sequence
  Synthetic
caccgctgtcccaaaaggtctaggtacggtgctcattacccagtcagacacggccgcaaggtttccagttgtggacggcaacatgtgtgtcgccccgtcgtctagggctggttctagggccatatcagcagccagggcct

SEQ ID NO: 4589 - DNA, 140 bp, Artificial Sequence
  Synthetic
aggccctggctgctgatatgaacgtgccatcgcgcgtaagtccaagggaatatagatcttcccaggagtctgcacaggaggcgagtacaatcacgtcactgacgcatagtcaattcgaccgaccttttgggacagcggtg

SEQ ID NO: 4590 - DNA, 140 bp, Artificial Sequence
  Synthetic
caccgctgtcccaaaaggtcggtcgaattgactatgcgtcagtgacgtgattgtactcgcctcctgtgcagactcctgggaagatctatattcccttggacttacgcgcgatggcacgttcatatcagcagccagggcct

SEQ ID NO: 4591 - DNA, 140 bp, Artificial Sequence
  Synthetic
atacgccatgctgggtctccgagagagaagggaatataacacccatggctagcgtccgattctttagggcagagctgtgtccggtcgtacgagaaacagcggagacgcgtgacacagcaacgtacttgggagtcggccat

SEQ ID NO: 4592 - DNA, 140 bp, Artificial Sequence
  Synthetic
atggccgactcccaagtacgttgctgtgtcacgcgtctccgctgtttctcgtacgaccggacacagctctgccctaaagaatcggacgctagccatgggtgttatattcccttctctctcggagacccagcatggcgtat

SEQ ID NO: 4593 - DNA, 140 bp, Artificial Sequence
  Synthetic
atacgccatgctgggtctccaactggaaaccttgcggccgtgtctgactgggtaatgagcaccgtacctatcgcgccgcccagacgaaggcgagggagaaacctaactgtgacatgcgaccgtacttgggagtcggccat

SEQ ID NO: 4594 - DNA, 140 bp, Artificial Sequence
  Synthetic
atggccgactcccaagtacggtcgcatgtcacagttaggtttctccctcgccttcgtctgggcggcgcgataggtacggtgctcattacccagtcagacacggccgcaaggtttccagttggagacccagcatggcgtat

SEQ ID NO: 4595 - DNA, 140 bp, Artificial Sequence
  Synthetic
atacgccatgctgggtctcccgtctcttcaggcaccgccgagtaccgccacggaactgaatcatccgccgacctccttcggagcaccaagcgagacgttccccattacatttggggacttcgtacttgggagtcggccat

SEQ ID NO: 4596 - DNA, 140 bp, Artificial Sequence
  Synthetic
atggccgactcccaagtacgaagtccccaaatgtaatggggaacgtctcgcttggtgctccgaaggaggtcggcggatgattcagttccgtggcggtactcggcggtgcctgaagagacgggagacccagcatggcgtat

SEQ ID NO: 4597 - DNA, 140 bp, Artificial Sequence
  Synthetic
aggccctggctgctgatatgtagaaggagtgcaaaaagtcaaatgctctaaggtaatgctatttgaccacaacgtgccatcgcgcgtaagtccaagggaatatagatcttcccaggagtcgaccttttgggacagcggtg

SEQ ID NO: 4598 - DNA, 140 bp, Artificial Sequence
  Synthetic
caccgctgtcccaaaaggtcgactcctgggaagatctatattcccttggacttacgcgcgatggcacgttgtggtcaaatagcattaccttagagcatttgactttttgcactccttctacatatcagcagccagggcct

SEQ ID NO: 4599 - DNA, 140 bp, Artificial Sequence
  Synthetic
atacgccatgctgggtctcccagcgaaggagaaattgaaagcttgtcttctgagctgctaactttcggagacttcctgcccggagaagtggatgacttgacagatagcgactggtccacgcgtacttgggagtcggccat

SEQ ID NO: 4600 - DNA, 140 bp, Artificial Sequence
  Synthetic
atggccgactcccaagtacgcgtggaccagtcgctatctgtcaagtcatccacttctccgggcaggaagtctccgaaagttagcagctcagaagacaagctttcaatttctccttcgctgggagacccagcatggcgtat

SEQ ID NO: 4601 - DNA, 140 bp, Artificial Sequence
  Synthetic
atacgccatgctgggtctccatccacaaccggaaaccttgcggccgtgtctgactgggtaataagcaccgtacctgtcgcgccacccagaagaaggcgagggagaaacctgactgtgacacgtacttgggagtcggccat

SEQ ID NO: 4602 - DNA, 140 bp, Artificial Sequence
  Synthetic
atggccgactcccaagtacgtgtcacagtcaggtttctccctcgccttcttctgggtggcgcgacaggtacggtgcttattacccagtcagacacggccgcaaggtttccggttgtggatggagacccagcatggcgtat

SEQ ID NO: 4603 - DNA, 140 bp, Artificial Sequence
  Synthetic
aggccctggctgctgatatgtagggcagagctgtgtccggtcgtacaagaaacagcggagacgcgtgacacagcaatgtctcttcaggcaccaccgagtaccgccacggaaccgaatcatgaccttttgggacagcggtg

SEQ ID NO: 4604 - DNA, 140 bp, Artificial Sequence
  Synthetic
caccgctgtcccaaaaggtcatgattcggttccgtggcggtactcggtggtgcctgaagagacattgctgtgtcacgcgtctccgctgtttcttgtacgaccggacacagctctgccctacatatcagcagccagggcct

SEQ ID NO: 4605 - DNA, 140 bp, Artificial Sequence
  Synthetic
atacgccatgctgggtctccattctcgtcggacaccggtccaggtcatttacaacagaagtcagtgcgccagtcagtgctgccggtgaacaccctggaggaagtccacgaggagaagtgtcgtacttgggagtcggccat

SEQ ID NO: 4606 - DNA, 140 bp, Artificial Sequence
  Synthetic
atggccgactcccaagtacgacacttctcctcgtggacttcctccagggtgttcaccggcagcactgactggcgcactgacttctgttgtaaatgacctggaccggtgtccgacgagaatggagacccagcatggcgtat

SEQ ID NO: 4607 - DNA, 140 bp, Artificial Sequence
  Synthetic
aggccctggctgctgatatgccaggagagtgcatccatggccaacagaagcaggtatcagtcgcgcaaagtagaaaacatgaaagcaacaatcatccagagactaaagagaggctgtagagaccttttgggacagcggtg

SEQ ID NO: 4608 - DNA, 140 bp, Artificial Sequence
  Synthetic
caccgctgtcccaaaaggtctctacagcctctctttagtctctggatgattgttgctttcatgttttctactttgcgcgactgatacctgcttctgttggccatggatgcactctcctggcatatcagcagccagggcct

SEQ ID NO: 4609 - DNA, 140 bp, Artificial Sequence
  Synthetic
atacgccatgctgggtctccctatacttaatgtcagagaccccaaaagtccctacttaccggaccatatatccggcgcctgtgtactcacctccgatcaacgtccgattgtccaaccccacgtacttgggagtcggccat

SEQ ID NO: 4610 - DNA, 140 bp, Artificial Sequence
  Synthetic
atggccgactcccaagtacgtggggttggacaatcggacgttgatcggaggtgagtacacaggcgccggatatatggtccggtaagtagggacttttggggtctctgacattaagtatagggagacccagcatggcgtat

SEQ ID NO: 4611 - DNA, 140 bp, Artificial Sequence
  Synthetic
aggccctggctgctgatatggtatatattctcgtcggacaccggtccaggtcatttacaacagaagtcagtacgccagtcagtgctgccggtgaacaccctggaggaagtccacgaggaggaccttttgggacagcggtg

SEQ ID NO: 4612 - DNA, 140 bp, Artificial Sequence
  Synthetic
caccgctgtcccaaaaggtcctcctcgtggacttcctccagggtgttcaccggcagcactgactggcgtactgacttctgttgtaaatgacctggaccggtgtccgacgagaatatataccatatcagcagccagggcct

SEQ ID NO: 4613 - DNA, 140 bp, Artificial Sequence
  Synthetic
atacgccatgctgggtctccagtcggcagtggcagcatgcaatgagttcttagctagaaactatccaactgtctcatcataccaaatcaccgacgagtatgatgcatatctagacatggtcgtacttgggagtcggccat

SEQ ID NO: 4614 - DNA, 140 bp, Artificial Sequence
  Synthetic
atggccgactcccaagtacgaccatgtctagatatgcatcatactcgtcggtgatttggtatgatgagacagttggatagtttctagctaagaactcattgcatgctgccactgccgactggagacccagcatggcgtat

SEQ ID NO: 4615 - DNA, 140 bp, Artificial Sequence
  Synthetic
aggccctggctgctgatatgcccactttggactcagcagtattcaacgtggagtgtttcaaaaaattcgcatgcaaccaagaatactgggaagaatttgctgccagccctatcaggataagaccttttgggacagcggtg

SEQ ID NO: 4616 - DNA, 140 bp, Artificial Sequence
  Synthetic
caccgctgtcccaaaaggtcttatcctgatagggctggcagcaaattcttcccagtattcttggttgcatgcgaattttttgaaacactccacgttgaatactgctgagtccaaagtgggcatatcagcagccagggcct

SEQ ID NO: 4617 - DNA, 140 bp, Artificial Sequence
  Synthetic
aggccctggctgctgatatgccgtcaaaacttaggagctacccaaaacagcacgcttaccacgcgccctccatcagaagcgctgtaccgtccccattccagaacacactacagaatgtacgaccttttgggacagcggtg

SEQ ID NO: 4618 - DNA, 140 bp, Artificial Sequence
  Synthetic
caccgctgtcccaaaaggtcgtacattctgtagtgtgttctggaatggggacggtacagcgcttctgatggagggcgcgtggtaagcgtgctgttttgggtagctcctaagttttgacggcatatcagcagccagggcct

SEQ ID NO: 4619 - DNA, 140 bp, Artificial Sequence
  Synthetic
atacgccatgctgggtctcccaactgagaatttaacaacctatgttactaaactaaaggggccaaaagcagcagcgctatttgcaaaaacccataatctgctgccactgcaggaagtgcccgtacttgggagtcggccat

SEQ ID NO: 4620 - DNA, 140 bp, Artificial Sequence
  Synthetic
atggccgactcccaagtacgggcacttcctgcagtggcagcagattatgggtttttgcaaatagcgctgctgcttttggcccctttagtttagtaacataggttgttaaattctcagttgggagacccagcatggcgtat

SEQ ID NO: 4621 - DNA, 140 bp, Artificial Sequence
  Synthetic
aggccctggctgctgatatggtctcatcataccaaatcaccgacgagtatgatgcatatctagacatggtggacgggtcggagagttgcctggatcgagcgacattcaatccgtcaaaacgaccttttgggacagcggtg

SEQ ID NO: 4622 - DNA, 140 bp, Artificial Sequence
  Synthetic
caccgctgtcccaaaaggtcgttttgacggattgaatgtcgctcgatccaggcaactctccgacccgtccaccatgtctagatatgcatcatactcgtcggtgatttggtatgatgagaccatatcagcagccagggcct

SEQ ID NO: 4623 - DNA, 140 bp, Artificial Sequence
  Synthetic
aggccctggctgctgatatgactcagcagtattcaacgtggagtgtttcaaaaatttcgcatgcaaccaagaatactgggaagaatttgctgccagccctatcaggataacaacagagaagaccttttgggacagcggtg

SEQ ID NO: 4624 - DNA, 140 bp, Artificial Sequence
  Synthetic
caccgctgtcccaaaaggtcttctctgttgttatcctgatagggctggcagcaaattcttcccagtattcttggttgcatgcgaaatttttgaaacactccacgttgaatactgctgagtcatatcagcagccagggcct

SEQ ID NO: 4625 - DNA, 140 bp, Artificial Sequence
  Synthetic
atacgccatgctgggtctccggacgggtcggagagttgcctggatcgagcgacattcaatccgtcaaaacttaggagctacccgaaacagcacgcctaccacgcgccctccatcagaagccgtacttgggagtcggccat

SEQ ID NO: 4626 - DNA, 140 bp, Artificial Sequence
  Synthetic
atggccgactcccaagtacggcttctgatggagggcgcgtggtaggcgtgctgtttcgggtagctcctaagttttgacggattgaatgtcgctcgatccaggcaactctccgacccgtccggagacccagcatggcgtat

SEQ ID NO: 4627 - DNA, 140 bp, Artificial Sequence
  Synthetic
atacgccatgctgggtctcctttaacaacctatgttactaaactaaaagggccaaaagcagcagcgctattcgcaaaaacccataatctgctgccactgcaggaagtaccaatggataggcgtacttgggagtcggccat

SEQ ID NO: 4628 - DNA, 140 bp, Artificial Sequence
  Synthetic
atggccgactcccaagtacgcctatccattggtacttcctgcagtggcagcagattatgggtttttgcgaatagcgctgctgcttttggcccttttagtttagtaacataggttgttaaaggagacccagcatggcgtat

SEQ ID NO: 4629 - DNA, 140 bp, Artificial Sequence
  Synthetic
aggccctggctgctgatatgcatggtggacgggtcggagagttgcctggaccgagcgacattcaatccgtcaaaactcaggagctacccgaaacagcacgcttaccacgcgccctccatcgaccttttgggacagcggtg

SEQ ID NO: 4630 - DNA, 140 bp, Artificial Sequence
  Synthetic
caccgctgtcccaaaaggtcgatggagggcgcgtggtaagcgtgctgtttcgggtagctcctgagttttgacggattgaatgtcgctcggtccaggcaactctccgacccgtccaccatgcatatcagcagccagggcct

SEQ ID NO: 4631 - DNA, 140 bp, Artificial Sequence
  Synthetic
aggccctggctgctgatatgcaaaactcaggagctacccgaaacagcacgcttaccacgcgccctccatcagaagcgctgtaccgtccccattccagaacacactacagaatgtactggcgaccttttgggacagcggtg

SEQ ID NO: 4632 - DNA, 140 bp, Artificial Sequence
  Synthetic
caccgctgtcccaaaaggtcgccagtacattctgtagtgtgttctggaatggggacggtacagcgcttctgatggagggcgcgtggtaagcgtgctgtttcgggtagctcctgagttttgcatatcagcagccagggcct

SEQ ID NO: 4633 - DNA, 140 bp, Artificial Sequence
  Synthetic
aggccctggctgctgatatggaacccttggcaacagcatacctatgtgggattcacagagagctggttaggaggctgaacgccgtcctcctacccaatgtacatacactatttgacatgtgaccttttgggacagcggtg

SEQ ID NO: 4634 - DNA, 140 bp, Artificial Sequence
  Synthetic
caccgctgtcccaaaaggtcacatgtcaaatagtgtatgtacattgggtaggaggacggcgttcagcctcctaaccagctctctgtgaatcccacataggtatgctgttgccaagggttccatatcagcagccagggcct

SEQ ID NO: 4635 - DNA, 140 bp, Artificial Sequence
  Synthetic
atacgccatgctgggtctccgccgtcctcctacccaatgtacatacactatttgacatgtctgccgaggatttcgatgccatcatagccgcgcactttaagccaggagacactgttttagcgtacttgggagtcggccat

SEQ ID NO: 4636 - DNA, 140 bp, Artificial Sequence
  Synthetic
atggccgactcccaagtacgctaaaacagtgtctcctggcttaaagtgcgcggctatgatggcatcgaaatcctcggcagacatgtcaaatagtgtatgtacattgggtaggaggacggcggagacccagcatggcgtat

SEQ ID NO: 4637 - DNA, 140 bp, Artificial Sequence
  Synthetic
aggccctggctgctgatatgctttggactcagcagtattcaacgtggagtgtttcaaaaaattcgcatgcaaccaagaatactgggaagaatttgctgccagccctattaggataacaacgaccttttgggacagcggtg

SEQ ID NO: 4638 - DNA, 140 bp, Artificial Sequence
  Synthetic
caccgctgtcccaaaaggtcgttgttatcctaatagggctggcagcaaattcttcccagtattcttggttgcatgcgaattttttgaaacactccacgttgaatactgctgagtccaaagcatatcagcagccagggcct

SEQ ID NO: 4639 - DNA, 140 bp, Artificial Sequence
  Synthetic
atacgccatgctgggtctccaaacggacatagcctcctttgataagagccaagatgattcacttgcgcttactgctttgatgctgttagaagatttgggggtggatcactccctgctggacgtacttgggagtcggccat

SEQ ID NO: 4640 - DNA, 140 bp, Artificial Sequence
  Synthetic
atggccgactcccaagtacgtccagcagggagtgatccacccccaaatcttctaacagcatcaaagcagtaagcgcaagtgaatcatcttggctcttatcaaaggaggctatgtccgtttggagacccagcatggcgtat

SEQ ID NO: 4641 - DNA, 140 bp, Artificial Sequence
  Synthetic
aggccctggctgctgatatgtgagaatttagcaacctatgttactaaactaaaagggccaaaagcagcagcgctattcgcaaaaacccataatctactgccactacaggaagtaccaatggaccttttgggacagcggtg

SEQ ID NO: 4642 - DNA, 140 bp, Artificial Sequence
  Synthetic
caccgctgtcccaaaaggtccattggtacttcctgtagtggcagtagattatgggtttttgcgaatagcgctgctgcttttggcccttttagtttagtaacataggttgctaaattctcacatatcagcagccagggcct

SEQ ID NO: 4643 - DNA, 140 bp, Artificial Sequence
  Synthetic
aggccctggctgctgatatggacgacaacataatacatggagtcgtctccgatgaattgatggcagccagatgcgccacttggatgaacatggaagtgaagatcatagatgcagttgtatgaccttttgggacagcggtg

SEQ ID NO: 4644 - DNA, 140 bp, Artificial Sequence
  Synthetic
caccgctgtcccaaaaggtcatacaactgcatctatgatcttcacttccatgttcatccaagtggcgcatctggctgccatcaattcatcggagacgactccatgtattatgttgtcgtccatatcagcagccagggcct

SEQ ID NO: 4645 - DNA, 140 bp, Artificial Sequence
  Synthetic
atacgccatgctgggtctcccttgatagaggctgctttcggagagatttccagctgtcatctaccgacaggtacgcgcttcaagttcggcgccatgatgaaatctggtatgttcttaactcgtacttgggagtcggccat

SEQ ID NO: 4646 - DNA, 140 bp, Artificial Sequence
  Synthetic
atggccgactcccaagtacgagttaagaacataccagatttcatcatggcgccgaacttgaagcgcgtacctgtcggtagatgacagctggaaatctctccgaaagcagcctctatcaagggagacccagcatggcgtat

SEQ ID NO: 4647 - DNA, 140 bp, Artificial Sequence
  Synthetic
aggccctggctgctgatatggtacgcgcttcaagttcggcgccatgatgaaatctggtatgttcttaactctgttcgtcaacacattgctaaacatcactatcgctagccgagtgctggagaccttttgggacagcggtg

SEQ ID NO: 4648 - DNA, 140 bp, Artificial Sequence
  Synthetic
caccgctgtcccaaaaggtctccagcactcggctagcgatagtgatgtttagcaatgtgttgacgaacagagttaagaacataccagatttcatcatggcgccgaacttgaagcgcgtaccatatcagcagccagggcct

SEQ ID NO: 4649 - DNA, 140 bp, Artificial Sequence
  Synthetic
atacgccatgctgggtctccacaggaacagcttgcagagtggcagacccgctaaaaaggctatttaaactgggcaaaccgctagcggcaggtgacgaacaagatgaggatagaagacgagcgtacttgggagtcggccat

SEQ ID NO: 4650 - DNA, 140 bp, Artificial Sequence
  Synthetic
atggccgactcccaagtacgctcgtcttctatcctcatcttgttcgtcacctgccgctagcggtttgcccagtttaaatagcctttttagcgggtctgccactctgcaagctgttcctgtggagacccagcatggcgtat

SEQ ID NO: 4651 - DNA, 140 bp, Artificial Sequence
  Synthetic
aggccctggctgctgatatgctgaacgccgtcctcctacccaatgtacatacactatttgacatgtctgccgaggatttcgatgccatcatagccgcacactttaagccaggagacactggaccttttgggacagcggtg

SEQ ID NO: 4652 - DNA, 140 bp, Artificial Sequence
  Synthetic
caccgctgtcccaaaaggtccagtgtctcctggcttaaagtgtgcggctatgatggcatcgaaatcctcggcagacatgtcaaatagtgtatgtacattgggtaggaggacggcgttcagcatatcagcagccagggcct

SEQ ID NO: 4653 - DNA, 140 bp, Artificial Sequence
  Synthetic
atacgccatgctgggtctcctggatgaacatggaagtgaagatcatagatgcagctgtctccttgaaagccccttacttttgcggagggtttatactgtatgatactgtgacgggaacagcgtacttgggagtcggccat

SEQ ID NO: 4654 - DNA, 140 bp, Artificial Sequence
  Synthetic
atggccgactcccaagtacgctgttcccgtcacagtatcatacagtataaaccctccgcaaaagtaaggggctttcaaggagacagctgcatctatgatcttcacttccatgttcatccaggagacccagcatggcgtat

SEQ ID NO: 4655 - DNA, 140 bp, Artificial Sequence
  Synthetic
aggccctggctgctgatatggcgcttactgctttgatgctgttagaggatttaggggtggatcactccctgctggacttgatagaggctgctttcggagagatttccagctgtcacctacgaccttttgggacagcggtg

SEQ ID NO: 4656 - DNA, 140 bp, Artificial Sequence
  Synthetic
caccgctgtcccaaaaggtcgtaggtgacagctggaaatctctccgaaagcagcctctatcaagtccagcagggagtgatccacccctaaatcctctaacagcatcaaagcagtaagcgccatatcagcagccagggcct

SEQ ID NO: 4657 - DNA, 140 bp, Artificial Sequence
  Synthetic
aggccctggctgctgatatgtcagaggacccgtcgtaactttgtacggcggtcctaaataggtacgcactacagctacctattttgcagaagccgacagtaagtacctaaacactaatcagaccttttgggacagcggtg

SEQ ID NO: 4658 - DNA, 140 bp, Artificial Sequence
  Synthetic
caccgctgtcccaaaaggtctgattagtgtttaggtacttactgtcggcttctgcaaaataggtagctgtagtgcgtacctatttaggaccgccgtacaaagttacgacgggtcctctgacatatcagcagccagggcct

SEQ ID NO: 4659 - DNA, 140 bp, Artificial Sequence
  Synthetic
atacgccatgctgggtctcccttgcagagtggcagacccgctaaaaaggctatttaaactgggcaaaccgctagcggcaggtgacgaacaagatgaagatagaagacgagcgctggctgacgtacttgggagtcggccat

SEQ ID NO: 4660 - DNA, 140 bp, Artificial Sequence
  Synthetic
atggccgactcccaagtacgtcagccagcgctcgtcttctatcttcatcttgttcgtcacctgccgctagcggtttgcccagtttaaatagcctttttagcgggtctgccactctgcaagggagacccagcatggcgtat

SEQ ID NO: 4661 - DNA, 140 bp, Artificial Sequence
  Synthetic
aggccctggctgctgatatgatggccacctttgcaagctccagatccaacttcgagaagctcagaggacccgttataactttgtacggcggtcctaaataggtacgcacgacagctacctgaccttttgggacagcggtg

SEQ ID NO: 4662 - DNA, 140 bp, Artificial Sequence
  Synthetic
caccgctgtcccaaaaggtcaggtagctgtcgtgcgtacctatttaggaccgccgtacaaagttataacgggtcctctgagcttctcgaagttggatctggagcttgcaaaggtggccatcatatcagcagccagggcct

SEQ ID NO: 4663 - DNA, 140 bp, Artificial Sequence
  Synthetic
atacgccatgctgggtctcccgttataactttgtacggcggtcctaaataggtacgcacgacagctacctattttgaggaagccgacagcaagtacctaaacactaatcagctacaatggcgtacttgggagtcggccat

SEQ ID NO: 4664 - DNA, 140 bp, Artificial Sequence
  Synthetic
atggccgactcccaagtacgccattgtagctgattagtgtttaggtacttgctgtcggcttcctcaaaataggtagctgtcgtgcgtacctatttaggaccgccgtacaaagttataacgggagacccagcatggcgtat

SEQ ID NO: 4665 - DNA, 140 bp, Artificial Sequence
  Synthetic
aggccctggctgctgatatgtggactccgcgccctactatccaagtcatcaggcccagaccgcgccctcagaggcaagctgggcaacttgcccagctgatctcagcagttaataaactgagaccttttgggacagcggtg

SEQ ID NO: 4666 - DNA, 140 bp, Artificial Sequence
  Synthetic
caccgctgtcccaaaaggtctcagtttattaactgctgagatcagctgggcaagttgcccagcttgcctctgagggcgcggtctgggcctgatgacttggatagtagggcgcggagtccacatatcagcagccagggcct

SEQ ID NO: 4667 - DNA, 140 bp, Artificial Sequence
  Synthetic
atacgccatgctgggtctcccaatgcgcgcggtaccccaacagaagccacgcaggaatcggaagaataagaagcaaaagcaaaagcaacaggcgccacaaaataacacaaaccaaaagaacgtacttgggagtcggccat

SEQ ID NO: 4668 - DNA, 140 bp, Artificial Sequence
  Synthetic
atggccgactcccaagtacgttcttttggtttgtgttattttgtggcgcctgttgcttttgcttttgcttcttattcttccgattcctgcgtggcttctgttggggtaccgcgcgcattgggagacccagcatggcgtat

SEQ ID NO: 4669 - DNA, 140 bp, Artificial Sequence
  Synthetic
atacgccatgctgggtctccgcagccacctaaaaagaaaccggctcaaaagaaaaagaagccgggccgtagagagaggatgtgcatgaaaatcgaaaatgattgtattttcgaagtcaagcgtacttgggagtcggccat

SEQ ID NO: 4670 - DNA, 140 bp, Artificial Sequence
  Synthetic
atggccgactcccaagtacgcttgacttcgaaaatacaatcattttcgattttcatgcacatcctctctctacggcccggcttctttttcttttgagccggtttctttttaggtggctgcggagacccagcatggcgtat

SEQ ID NO: 4671 - DNA, 140 bp, Artificial Sequence
  Synthetic
aggccctggctgctgatatgatgtccatggccacctttgcaagctccagatccaatttcgagaagctcagaggacccgtcataactttgtacggcggtcctaaataggtacgcactacaggaccttttgggacagcggtg

SEQ ID NO: 4672 - DNA, 140 bp, Artificial Sequence
  Synthetic
caccgctgtcccaaaaggtcctgtagtgcgtacctatttaggaccgccgtacaaagttatgacgggtcctctgagcttctcgaaattggatctggagcttgcaaaggtggccatggacatcatatcagcagccagggcct

SEQ ID NO: 4673 - DNA, 140 bp, Artificial Sequence
  Synthetic
aggccctggctgctgatatggagagaggatgtgcatgaaaatcgaaaatgattgtattttcgaagtcaagcatgaaggtagggtaacaggttacgcgtgcttggtgggggacaaagtaatgaccttttgggacagcggtg

SEQ ID NO: 4674 - DNA, 140 bp, Artificial Sequence
  Synthetic
caccgctgtcccaaaaggtcattactttgtcccccaccaagcacgcgtaacctgttaccctaccttcatgcttgacttcgaaaatacaatcattttcgattttcatgcacatcctctctccatatcagcagccagggcct

SEQ ID NO: 4675 - DNA, 140 bp, Artificial Sequence
  Synthetic
aggccctggctgctgatatggaaaccagcacacgtaaaggggaccatcgataacgcggacctggccaaactggcctttaagcggtcatctaagtatgaccttgaatgtgcgcagatacccgaccttttgggacagcggtg

SEQ ID NO: 4676 - DNA, 140 bp, Artificial Sequence
  Synthetic
caccgctgtcccaaaaggtcgggtatctgcgcacattcaaggtcatacttagatgaccgcttaaaggccagtttggccaggtccgcgttatcgatggtcccctttacgtgtgctggtttccatatcagcagccagggcct

SEQ ID NO: 4677 - DNA, 140 bp, Artificial Sequence
  Synthetic
aggccctggctgctgatatgattgtcactaaaatcacccctgagggagccgaagagtggagtcttgccatcccagttatgtgcctgttggcaaataccacgttcccctgctcccagccccgaccttttgggacagcggtg

SEQ ID NO: 4678 - DNA, 140 bp, Artificial Sequence
  Synthetic
caccgctgtcccaaaaggtcggggctgggagcaggggaacgtggtatttgccaacaggcacataactgggatggcaagactccactcttcggctccctcaggggtgattttagtgacaatcatatcagcagccagggcct

SEQ ID NO: 4679 - DNA, 140 bp, Artificial Sequence
  Synthetic
atacgccatgctgggtctccgtgcacatgaagtccgacgcttcgaagttcacccatgagaaaccggaggggtactacaactggcaccacggagcagtgcagtactcaggaggccggttcacgtacttgggagtcggccat

SEQ ID NO: 4680 - DNA, 140 bp, Artificial Sequence
  Synthetic
atggccgactcccaagtacgtgaaccggcctcctgagtactgcactgctccgtggtgccagttgtagtacccctccggtttctcatgggtgaacttcgaagcgtcggacttcatgtgcacggagacccagcatggcgtat

SEQ ID NO: 4681 - DNA, 140 bp, Artificial Sequence
  Synthetic
aggccctggctgctgatatggtactacaactggcaccacggagcagtgcagtactcaggaggccggttcaccatccctacaggtgctggcaaaccaggggacagcggcagaccaatcttcgaccttttgggacagcggtg

SEQ ID NO: 4682 - DNA, 140 bp, Artificial Sequence
  Synthetic
caccgctgtcccaaaaggtcgaagattggtctgccgctgtcccctggtttgccagcacctgtagggatggtgaaccggcctcctgagtactgcactgctccgtggtgccagttgtagtaccatatcagcagccagggcct

SEQ ID NO: 4683 - DNA, 140 bp, Artificial Sequence
  Synthetic
atacgccatgctgggtctcccttgaggacaacgtcatgagacctgggtactatcagctgctacaagcatcattaacatgttctccccaccgccagcgacgcagcaccaaggacaacttcacgtacttgggagtcggccat

SEQ ID NO: 4684 - DNA, 140 bp, Artificial Sequence
  Synthetic
atggccgactcccaagtacgtgaagttgtccttggtgctgcgtcgctggcggtggggagaacatgttaatgatgcttgtagcagctgatagtacccaggtctcatgacgttgtcctcaagggagacccagcatggcgtat

SEQ ID NO: 4685 - DNA, 140 bp, Artificial Sequence
  Synthetic
aggccctggctgctgatatgaactgacaatgcgcgcggtaccccaacagaagccacgcaggaatcggaagaataagaagcaaaagcaaaaacaacaggcgccacaaaacaacacaaatcagaccttttgggacagcggtg

SEQ ID NO: 4686 - DNA, 140 bp, Artificial Sequence
  Synthetic
caccgctgtcccaaaaggtctgatttgtgttgttttgtggcgcctgttgtttttgcttttgcttcttattcttccgattcctgcgtggcttctgttggggtaccgcgcgcattgtcagttcatatcagcagccagggcct

SEQ ID NO: 4687 - DNA, 140 bp, Artificial Sequence
  Synthetic
atacgccatgctgggtctccgacaacaagggacgcgtggtggccatagtcttgggaggagctaatgaaggagcccgtacggccctctcggtggtgacctggaataaagacattgtcactacgtacttgggagtcggccat

SEQ ID NO: 4688 - DNA, 140 bp, Artificial Sequence
  Synthetic
atggccgactcccaagtacgtagtgacaatgtctttattccaggtcaccaccgagagggccgtacgggctccttcattagctcctcccaagactatggccaccacgcgtcccttgttgtcggagacccagcatggcgtat

SEQ ID NO: 4689 - DNA, 140 bp, Artificial Sequence
  Synthetic
atacgccatgctgggtctcctgcctgttggcaaacaccaccttcccctgctcccagcccccttgcacaccttgctgctacgaaaaggaaccggaggaaaccctgcgcatgcttgaggacacgtacttgggagtcggccat

SEQ ID NO: 4690 - DNA, 140 bp, Artificial Sequence
  Synthetic
atggccgactcccaagtacgtgtcctcaagcatgcgcagggtttcctccggttccttttcgtagcagcaaggtgtgcaagggggctgggagcaggggaaggtggtgtttgccaacaggcaggagacccagcatggcgtat

SEQ ID NO: 4691 - DNA, 140 bp, Artificial Sequence
  Synthetic
atacgccatgctgggtctccgccgcagagagaggatgtgcatgaaaatcgaaaatgattgtattttcgaagtcaagcacgaaggtaaggtaacaggttacgcgtgcctagtgggagacaacgtacttgggagtcggccat

SEQ ID NO: 4692 - DNA, 140 bp, Artificial Sequence
  Synthetic
atggccgactcccaagtacgttgtctcccactaggcacgcgtaacctgttaccttaccttcgtgcttgacttcgaaaatacaatcattttcgattttcatgcacatcctctctctgcggcggagacccagcatggcgtat

SEQ ID NO: 4693 - DNA, 140 bp, Artificial Sequence
  Synthetic
aggccctggctgctgatatgtctccccaccgccagcgacgcagcaccaaggacaacttcaatgtctataaagccacaagaccatacttagctcactgtcccgactgcggagaagggcactgaccttttgggacagcggtg

SEQ ID NO: 4694 - DNA, 140 bp, Artificial Sequence
  Synthetic
caccgctgtcccaaaaggtcagtgcccttctccgcagtcgggacagtgagctaagtatggtcttgtggctttatagacattgaagttgtccttggtgctgcgtcgctggcggtggggagacatatcagcagccagggcct

SEQ ID NO: 4695 - DNA, 140 bp, Artificial Sequence
  Synthetic
aggccctggctgctgatatgccctcagaggcaagctgggcaacttgcccagctgatctcagcagttaataaactgacaatgcgcgcggtaccccaacagaagccacgcaggaatcggaaggaccttttgggacagcggtg

SEQ ID NO: 4696 - DNA, 140 bp, Artificial Sequence
  Synthetic
caccgctgtcccaaaaggtccttccgattcctgcgtggcttctgttggggtaccgcgcgcattgtcagtttattaactgctgagatcagctgggcaagttgcccagcttgcctctgagggcatatcagcagccagggcct

SEQ ID NO: 4697 - DNA, 140 bp, Artificial Sequence
  Synthetic
atacgccatgctgggtctcccgtgccatagtcccgtagcactagaacgcatcagaaatgaagcgacagacgggacgctaaaaatccaggtctctttgcaaatcggaataaagacggatgacgtacttgggagtcggccat

SEQ ID NO: 4698 - DNA, 140 bp, Artificial Sequence
  Synthetic
atggccgactcccaagtacgtcatccgtctttattccgatttgcaaagagacctggatttttagcgtcccgtctgtcgcttcatttctgatgcgttctagtgctacgggactatggcacgggagacccagcatggcgtat

SEQ ID NO: 4699 - DNA, 140 bp, Artificial Sequence
  Synthetic
aggccctggctgctgatatgtcatgtacgcacccatttcaccacgaccctcctgtgataggccgggaaaaattccattcccgaccgcagcacggtaaagagctaccttgcagcacgtacggaccttttgggacagcggtg

SEQ ID NO: 4700 - DNA, 140 bp, Artificial Sequence
  Synthetic
caccgctgtcccaaaaggtccgtacgtgctgcaaggtagctctttaccgtgctgcggtcgggaatggaatttttcccggcctatcacaggagggtcgtggtgaaatgggtgcgtacatgacatatcagcagccagggcct

SEQ ID NO: 4701 - DNA, 140 bp, Artificial Sequence
  Synthetic
aggccctggctgctgatatgatcttcgacaacaagggacgcgtggtggccatagtcttaggaggagctaatgaaggagcccgtacagccctctcggtggtgacctggaataaagacattggaccttttgggacagcggtg

SEQ ID NO: 4702 - DNA, 140 bp, Artificial Sequence
  Synthetic
caccgctgtcccaaaaggtccaatgtctttattccaggtcaccaccgagagggctgtacgggctccttcattagctcctcctaagactatggccaccacgcgtcccttgttgtcgaagatcatatcagcagccagggcct

SEQ ID NO: 4703 - DNA, 140 bp, Artificial Sequence
  Synthetic
atacgccatgctgggtctcctagccacgattggactaagctgcgttacatggacaaccacacgccagcagacgcagagagggcggggctatttgcaagaacatcagcaccgtgcacaattcgtacttgggagtcggccat

SEQ ID NO: 4704 - DNA, 140 bp, Artificial Sequence
  Synthetic
atggccgactcccaagtacgaattgtgcacggtgctgatgttcttgcaaatagccccgccctctctgcgtctgctggcgtgtggttgtccatgtaacgcagcttagtccaatcgtggctaggagacccagcatggcgtat

SEQ ID NO: 4705 - DNA, 140 bp, Artificial Sequence
  Synthetic
aggccctggctgctgatatgactggaacaatgggacacttcatcctggcccgatgtccgaaaggggaaactctgacggtgggattcactgacggtaggaagattagtcattcatgcacgcgaccttttgggacagcggtg

SEQ ID NO: 4706 - DNA, 140 bp, Artificial Sequence
  Synthetic
caccgctgtcccaaaaggtcgcgtgcatgaatgactaatcttcctaccgtcagtgaatcccaccgtcagagtttcccctttcggacatcgggccaggatgaagtgtcccattgttccagtcatatcagcagccagggcct

SEQ ID NO: 4707 - DNA, 140 bp, Artificial Sequence
  Synthetic
atacgccatgctgggtctcctcactaaaatcacccccgagggggccgaagagtggagtcttgccatcccagttatgtgcctgttggcaaacaccacgttcccctgcttccagcccccttgcgtacttgggagtcggccat

SEQ ID NO: 4708 - DNA, 140 bp, Artificial Sequence
  Synthetic
atggccgactcccaagtacgcaagggggctggaagcaggggaacgtggtgtttgccaacaggcacataactgggatggcaagactccactcttcggccccctcgggggtgattttagtgaggagacccagcatggcgtat

SEQ ID NO: 4709 - DNA, 140 bp, Artificial Sequence
  Synthetic
atacgccatgctgggtctccacccatttcaccacgatcctcctgtgataggccgggaaaaattccattcccgaccgcagcacggtagagagttaccttgcagcacgtacgtgcagagcaccgtacttgggagtcggccat

SEQ ID NO: 4710 - DNA, 140 bp, Artificial Sequence
  Synthetic
atggccgactcccaagtacggtgctctgcacgtacgtgctgcaaggtaactctctaccgtgctgcggtcgggaatggaatttttcccggcctatcacaggaggatcgtggtgaaatgggtggagacccagcatggcgtat

SEQ ID NO: 4711 - DNA, 140 bp, Artificial Sequence
  Synthetic
aggccctggctgctgatatggggacgctaaaaatccaggtctctttgcaaatcggaataaagacggatgatagccacgattggactaagctgcgttacatggacaaccacacgccagcaggaccttttgggacagcggtg

SEQ ID NO: 4712 - DNA, 140 bp, Artificial Sequence
  Synthetic
caccgctgtcccaaaaggtcctgctggcgtgtggttgtccatgtaacgcagcttagtccaatcgtggctatcatccgtctttattccgatttgcaaagagacctggatttttagcgtccccatatcagcagccagggcct

SEQ ID NO: 4713 - DNA, 140 bp, Artificial Sequence
  Synthetic
aggccctggctgctgatatgatcgcacattgatgtcacaacagtccggcaacgtaaagatcacagttaatggccagacggtgcggtacaagtgtaattgcggtggatcaaatgaaggacagaccttttgggacagcggtg

SEQ ID NO: 4714 - DNA, 140 bp, Artificial Sequence
  Synthetic
caccgctgtcccaaaaggtctgtccttcatttgatccaccgcaattacacttgtaccgcaccgtctggccattaactgtgatctttacgttgccggactgttgtgacatcaatgtgcgatcatatcagcagccagggcct

SEQ ID NO: 4715 - DNA, 140 bp, Artificial Sequence
  Synthetic
aggccctggctgctgatatgctataaagccacaagaccatacttagctcactgtcccgactgtggagaagggcactcgtgccatagtcccgtagcactagaacgcatcagaaatgaagcggaccttttgggacagcggtg

SEQ ID NO: 4716 - DNA, 140 bp, Artificial Sequence
  Synthetic
caccgctgtcccaaaaggtccgcttcatttctgatgcgttctagtgctacgggactatggcacgagtgcccttctccacagtcgggacagtgagctaagtatggtcttgtggctttatagcatatcagcagccagggcct

SEQ ID NO: 4717 - DNA, 140 bp, Artificial Sequence
  Synthetic
atacgccatgctgggtctccaacaactacagacaaagtgattaataactgcaagattgatcaatgtcatgccgcggtcaccaatcacaaaaagtggcagtataactcccctctggtcccgcgtacttgggagtcggccat

SEQ ID NO: 4718 - DNA, 140 bp, Artificial Sequence
  Synthetic
atggccgactcccaagtacgcgggaccagaggggagttatactgccactttttgtgattggtgaccgcggcatgacattgatcaatcttgcagttattaatcactttgtctgtagttgttggagacccagcatggcgtat

SEQ ID NO: 4719 - DNA, 140 bp, Artificial Sequence
  Synthetic
aggccctggctgctgatatgccgcggtcaccaatcacaaaaagtggcagtataactcccctctggtcccgcgtaatgatgaacttggggaccgaaaaggaaaaattcacatcccgtttccgaccttttgggacagcggtg

SEQ ID NO: 4720 - DNA, 140 bp, Artificial Sequence
  Synthetic
caccgctgtcccaaaaggtcggaaacgggatgtgaatttttccttttcggtccccaagttcatcattacgcgggaccagaggggagttatactgccactttttgtgattggtgaccgcggcatatcagcagccagggcct

SEQ ID NO: 4721 - DNA, 140 bp, Artificial Sequence
  Synthetic
aggccctggctgctgatatgcagcagacgcagagagggcggggctatttgtaagaacatcagcaccgtgtacgattactggaacaatgggacacttcatcctggcccgatgtccaaaagggaccttttgggacagcggtg

SEQ ID NO: 4722 - DNA, 140 bp, Artificial Sequence
  Synthetic
caccgctgtcccaaaaggtcccttttggacatcgggccaggatgaagtgtcccattgttccagtaatcgtacacggtgctgatgttcttacaaatagccccgccctctctgcgtctgctgcatatcagcagccagggcct

SEQ ID NO: 4723 - DNA, 140 bp, Artificial Sequence
  Synthetic
aggccctggctgctgatatgacgattactggaacaatgggacacttcatcctggcccgatgtccaaaaggggaaactctgacggtgggattcactgacagtaggaagattagtcattcatgaccttttgggacagcggtg

SEQ ID NO: 4724 - DNA, 140 bp, Artificial Sequence
  Synthetic
caccgctgtcccaaaaggtcatgaatgactaatcttcctactgtcagtgaatcccaccgtcagagtttccccttttggacatcgggccaggatgaagtgtcccattgttccagtaatcgtcatatcagcagccagggcct

SEQ ID NO: 4725 - DNA, 140 bp, Artificial Sequence
  Synthetic
aggccctggctgctgatatgcgtacgggaaaaaccaagtcatcatgctactgtaccctgaccacccaacattgctgtcctatcggaatatgggagaagaaccaaactatcaagaagagtggaccttttgggacagcggtg

SEQ ID NO: 4726 - DNA, 140 bp, Artificial Sequence
  Synthetic
caccgctgtcccaaaaggtccactcttcttgatagtttggttcttctcccatattccgataggacagcaatgttgggtggtcagggtacagtagcatgatgacttggtttttcccgtacgcatatcagcagccagggcct

SEQ ID NO: 4727 - DNA, 140 bp, Artificial Sequence
  Synthetic
aggccctggctgctgatatggccacataccaagaggctgcggtatacctgtggaacgagcagcaacctttgttttggctacaagcccttattccgctggcagccctgattgtcctatgcagaccttttgggacagcggtg

SEQ ID NO: 4728 - DNA, 140 bp, Artificial Sequence
  Synthetic
caccgctgtcccaaaaggtctgcataggacaatcagggctgccagcggaataagggcttgtagccaaaacaaaggttgctgctcgttccacaggtataccgcagcctcttggtatgtggccatatcagcagccagggcct

SEQ ID NO: 4729 - DNA, 140 bp, Artificial Sequence
  Synthetic
aggccctggctgctgatatggtcaatggccagacggtgcggtacaagtgtaattgcggtggctcaaatgaaggactaacaactacagacaaagtgattaataactgcaaggttgatcaatgaccttttgggacagcggtg

SEQ ID NO: 4730 - DNA, 140 bp, Artificial Sequence
  Synthetic
caccgctgtcccaaaaggtcattgatcaaccttgcagttattaatcactttgtctgtagttgttagtccttcatttgagccaccgcaattacacttgtaccgcaccgtctggccattgaccatatcagcagccagggcct

SEQ ID NO: 4731 - DNA, 140 bp, Artificial Sequence
  Synthetic
atacgccatgctgggtctcctgagctataccctactatgactgtagtagttgtgtcagtggcctcgttcatactcctgtcgatggtgggtatggcagtggggatgtgcatgtgtgcacgacgtacttgggagtcggccat

SEQ ID NO: 4732 - DNA, 140 bp, Artificial Sequence
  Synthetic
atggccgactcccaagtacgtcgtgcacacatgcacatccccactgccatacccaccatcgacaggagtatgaacgaggccactgacacaactactacagtcatagtagggtatagctcaggagacccagcatggcgtat

SEQ ID NO: 4733 - DNA, 140 bp, Artificial Sequence
  Synthetic
atacgccatgctgggtctcccgtagatgcatcacaccgtacgaactgacaccaggagctaccgtccctttcctgcttagcctactatgctgcatcagaacagctaaagcggccacatacccgtacttgggagtcggccat

SEQ ID NO: 4734 - DNA, 140 bp, Artificial Sequence
  Synthetic
atggccgactcccaagtacgggtatgtggccgctttagctgttctgatgcagcatagtaggctaagcaggaaagggacggtagctcctggtgtcagttcgtacggtgtgatgcatctacgggagacccagcatggcgtat

SEQ ID NO: 4735 - DNA, 140 bp, Artificial Sequence
  Synthetic
aggccctggctgctgatatgcctgcttagcctactatgctgcatcagaacagctaaagcggccacataccaagaggctgcggtgtacctgtggaatgagcagcagcctttgttctggctagaccttttgggacagcggtg

SEQ ID NO: 4736 - DNA, 140 bp, Artificial Sequence
  Synthetic
caccgctgtcccaaaaggtctagccagaacaaaggctgctgctcattccacaggtacaccgcagcctcttggtatgtggccgctttagctgttctgatgcagcatagtaggctaagcaggcatatcagcagccagggcct

SEQ ID NO: 4737 - DNA, 140 bp, Artificial Sequence
  Synthetic
aggccctggctgctgatatgactcttaccatgctgttgtaaaacgttggcttttttagccgtaatgagcgtcggtgcccacactgtgaacgcgtacgaacacgtaacagtgatcccgagcgaccttttgggacagcggtg

SEQ ID NO: 4738 - DNA, 140 bp, Artificial Sequence
  Synthetic
caccgctgtcccaaaaggtcgctcgggatcactgttacgtgttcgtacgcgttcacagtgtgggcaccgacgctcattacggctaaaaaagccaacgttttacaacagcatggtaagagtcatatcagcagccagggcct

SEQ ID NO: 4739 - DNA, 140 bp, Artificial Sequence
  Synthetic
atacgccatgctgggtctccgtctccgtacgtgaaatgctgcggtacagcagagtgcaaggacaaaaacctacctgactacagctgtaaggtcttcaccggcgtctacccatttatgtggcgtacttgggagtcggccat

SEQ ID NO: 4740 - DNA, 140 bp, Artificial Sequence
  Synthetic
atggccgactcccaagtacgccacataaatgggtagacgccggtgaagaccttacagctgtagtcaggtaggtttttgtccttgcactctgctgtaccgcagcatttcacgtacggagacggagacccagcatggcgtat

SEQ ID NO: 4741 - DNA, 140 bp, Artificial Sequence
  Synthetic
aggccctggctgctgatatgagagtgggtgatgcataagaaggaagtcgtgctaaccgtgccgactgaagggctcgaggtcacgtggggcaacaacgagccgtataagtattggccgcaggaccttttgggacagcggtg

SEQ ID NO: 4742 - DNA, 140 bp, Artificial Sequence
  Synthetic
caccgctgtcccaaaaggtcctgcggccaatacttatacggctcgttgttgccccacgtgacctcgagcccttcagtcggcacggttagcacgacttccttcttatgcatcacccactctcatatcagcagccagggcct

SEQ ID NO: 4743 - DNA, 140 bp, Artificial Sequence
  Synthetic
aggccctggctgctgatatgggctcgaggtcacgtggggcaacaacgagccgtataagtattggccgcagttatctacaaacggtacagcccatggccacccgcatgagataattctgtagaccttttgggacagcggtg

SEQ ID NO: 4744 - DNA, 140 bp, Artificial Sequence
  Synthetic
caccgctgtcccaaaaggtctacagaattatctcatgcgggtggccatgggctgtaccgtttgtagataactgcggccaatacttatacggctcgttgttgccccacgtgacctcgagcccatatcagcagccagggcct

SEQ ID NO: 4745 - DNA, 140 bp, Artificial Sequence
  Synthetic
atacgccatgctgggtctccacggtgggagtaccgtataagactctagtcaacagaccgggctacagtcccatggtattggagatggaactactgtcagtcattttggagccaacgctatcgtacttgggagtcggccat

SEQ ID NO: 4746 - DNA, 140 bp, Artificial Sequence
  Synthetic
atggccgactcccaagtacgatagcgttggctccaaaatgactgacagtagttccatctccaataccatgggactgtagcccggtctgttgactagagtcttatacggtactcccaccgtggagacccagcatggcgtat

SEQ ID NO: 4747 - DNA, 140 bp, Artificial Sequence
  Synthetic
atacgccatgctgggtctcccgcttgattacatcacgtgcgagtacaaaaccgtcatcccgtctccgtacgtgaaatgctgcggtacagcagagtgcaaggacaaaaatctacctgactacgtacttgggagtcggccat

SEQ ID NO: 4748 - DNA, 140 bp, Artificial Sequence
  Synthetic
atggccgactcccaagtacgtagtcaggtagatttttgtccttgcactctgctgtaccgcagcatttcacgtacggagacgggatgacggttttgtactcgcacgtgatgtaatcaagcgggagacccagcatggcgtat

SEQ ID NO: 4749 - DNA, 140 bp, Artificial Sequence
  Synthetic
aggccctggctgctgatatgtaaggacgccaaattcattgtggggccaatgtcttcagcctggacacctttcgacaacaaaatcgtggtgtacaaaggtgacgtttacaacatggactacgaccttttgggacagcggtg

SEQ ID NO: 4750 - DNA, 140 bp, Artificial Sequence
  Synthetic
caccgctgtcccaaaaggtcgtagtccatgttgtaaacgtcacctttgtacaccacgattttgttgtcgaaaggtgtccaggctgaagacattggccccacaatgaatttggcgtccttacatatcagcagccagggcct

SEQ ID NO: 4751 - DNA, 140 bp, Artificial Sequence
  Synthetic
atacgccatgctgggtctccactgcttctgcgacgctgaaaacacgcaattgagcgaagcacatgtggagaagtccgaatcatgcaaaacagaatttgcatcagcatacagggctcataccgtacttgggagtcggccat

SEQ ID NO: 4752 - DNA, 140 bp, Artificial Sequence
  Synthetic
atggccgactcccaagtacggtatgagccctgtatgctgatgcaaattctgttttgcatgattcggacttctccacatgtgcttcgctcaattgcgtgttttcagcgtcgcagaagcagtggagacccagcatggcgtat

SEQ ID NO: 4753 - DNA, 140 bp, Artificial Sequence
  Synthetic
aggccctggctgctgatatggtgaaatgctgcggtacagcagagtgcaaggacaaaaatctacctgactacagctgtaaggtcttcaccggcgtctacccatttatgtggggcggcgcttgaccttttgggacagcggtg

SEQ ID NO: 4754 - DNA, 140 bp, Artificial Sequence
  Synthetic
caccgctgtcccaaaaggtcaagcgccgccccacataaatgggtagacgccggtgaagaccttacagctgtagtcaggtagatttttgtccttgcactctgctgtaccgcagcatttcaccatatcagcagccagggcct

SEQ ID NO: 4755 - DNA, 140 bp, Artificial Sequence
  Synthetic
atacgccatgctgggtctccagcatccgcatcagctaagctccgcgtcctttaccaaggaaataacatcactgtaactgcctatgcaaacggcgaccatgccgtcacagtcaaggacgctcgtacttgggagtcggccat

SEQ ID NO: 4756 - DNA, 140 bp, Artificial Sequence
  Synthetic
atggccgactcccaagtacgagcgtccttgactgtgacggcatggtcgccgtttgcataggcagttacagtgatgttatttccttggtaaaggacgcggagcttagctgatgcggatgctggagacccagcatggcgtat

SEQ ID NO: 4757 - DNA, 140 bp, Artificial Sequence
  Synthetic
aggccctggctgctgatatgaagtccgaatcatgcaaaacagaatttgcatcagcatacagggctcatacagcatccgcatcagctaagctccgcgtcctttaccaaggaaataacatcagaccttttgggacagcggtg

SEQ ID NO: 4758 - DNA, 140 bp, Artificial Sequence
  Synthetic
caccgctgtcccaaaaggtctgatgttatttccttggtaaaggacgcggagcttagctgatgcggatgctgtatgagccctgtatgctgatgcaaattctgttttgcatgattcggacttcatatcagcagccagggcct

SEQ ID NO: 4759 - DNA, 140 bp, Artificial Sequence
  Synthetic
aggccctggctgctgatatgaattgtggtgtacaaaggtgacgtctataacatggactacccgccctttggcgcaggaagaccgggacaatttggcgacatccaaagtcgcacacctgaggaccttttgggacagcggtg

SEQ ID NO: 4760 - DNA, 140 bp, Artificial Sequence
  Synthetic
caccgctgtcccaaaaggtcctcaggtgtgcgactttggatgtcgccaaattgtcccggtcttcctgcgccaaagggcgggtagtccatgttatagacgtcacctttgtacaccacaattcatatcagcagccagggcct

SEQ ID NO: 4761 - DNA, 140 bp, Artificial Sequence
  Synthetic
aggccctggctgctgatatgcataccaagaggctgcgatatacctgtggaacgagcagcaacctttgttttggctacaagcccttattccgctggcagccctgattgttctatgcaactggaccttttgggacagcggtg

SEQ ID NO: 4762 - DNA, 140 bp, Artificial Sequence
  Synthetic
caccgctgtcccaaaaggtccagttgcatagaacaatcagggctgccagcggaataagggcttgtagccaaaacaaaggttgctgctcgttccacaggtatatcgcagcctcttggtatgcatatcagcagccagggcct

SEQ ID NO: 4763 - DNA, 140 bp, Artificial Sequence
  Synthetic
atacgccatgctgggtctccagtaaagacgtctatgctaatacacaactggtgctgcagagaccggctgtgggtacggtacatgtgccatactctcaggcaccgtctggctttaagtactcgtacttgggagtcggccat

SEQ ID NO: 4764 - DNA, 140 bp, Artificial Sequence
  Synthetic
atggccgactcccaagtacgagtacttaaagccagacggtgcctgagagtatggcacatgtaccgtacccacagccggtctctgcagcaccagttgtgtattagcatagacgtctttactggagacccagcatggcgtat

SEQ ID NO: 4765 - DNA, 140 bp, Artificial Sequence
  Synthetic
aggccctggctgctgatatggggtacggtacatgtgccatactctcaggcaccgtctggctttaagtactggctgaaggaacgaggggcgccgctgcagcacacagcaccatttggctgtgaccttttgggacagcggtg

SEQ ID NO: 4766 - DNA, 140 bp, Artificial Sequence
  Synthetic
caccgctgtcccaaaaggtcacagccaaatggtgctgtgtgctgcagcggcgcccctcgttccttcagccagtacttaaagccagacggtgcctgagagtatggcacatgtaccgtaccccatatcagcagccagggcct

SEQ ID NO: 4767 - DNA, 140 bp, Artificial Sequence
  Synthetic
atacgccatgctgggtctcccaaatagcaacaaacccggtaagagcggtgaactgcgccgtagggaacatgcccatttccattgatataccggatgcagccttcaccagggtcgtcgacgcgtacttgggagtcggccat

SEQ ID NO: 4768 - DNA, 140 bp, Artificial Sequence
  Synthetic
atggccgactcccaagtacgcgtcgacgaccctggtgaaggctgcatccggtatatcaatggaaatgggcatgttccctacggcgcagttcaccgctcttaccgggtttgttgctatttgggagacccagcatggcgtat

SEQ ID NO: 4769 - DNA, 140 bp, Artificial Sequence
  Synthetic
atacgccatgctgggtctccgcaagaaaggcaagtgtgcggtgcattcgatgaccaacgccgtcactatccgggaagctgagatagaagttgaagggaattctcagctgcaaatctctttcgtacttgggagtcggccat

SEQ ID NO: 4770 - DNA, 140 bp, Artificial Sequence
  Synthetic
atggccgactcccaagtacgaaagagatttgcagctgagaattcccttcaacttctatctcagcttcccggatagtgacggcgttggtcatcgaatgcaccgcacacttgcctttcttgcggagacccagcatggcgtat

SEQ ID NO: 4771 - DNA, 140 bp, Artificial Sequence
  Synthetic
aggccctggctgctgatatggcccatttccattgatataccggatgcagccttcaccagggtcgtcgacgcgccctctctaacggacatgtcgtgcgaagtaccagcctgcacacattccgaccttttgggacagcggtg

SEQ ID NO: 4772 - DNA, 140 bp, Artificial Sequence
  Synthetic
caccgctgtcccaaaaggtcggaatgtgtgcaggctggtacttcgcacgacatgtccgttagagagggcgcgtcgacgaccctggtgaaggctgcatccggtatatcaatggaaatgggccatatcagcagccagggcct

SEQ ID NO: 4773 - DNA, 140 bp, Artificial Sequence
  Synthetic
atacgccatgctgggtctccgtggagaagtccgaatcatgcaaaacagaatttgcatcagcatacagggctcataccgcatctgcatcagctaagctccgcgtcctttaccaaggaaatacgtacttgggagtcggccat

SEQ ID NO: 4774 - DNA, 140 bp, Artificial Sequence
  Synthetic
atggccgactcccaagtacgtatttccttggtaaaggacgcggagcttagctgatgcagatgcggtatgagccctgtatgctgatgcaaattctgttttgcatgattcggacttctccacggagacccagcatggcgtat

SEQ ID NO: 4775 - DNA, 140 bp, Artificial Sequence
  Synthetic
atacgccatgctgggtctcccaagtgtgcggtacactcgatgaccaacgccgtcactattcgggaagctgagatagaagttgaagggaattctcagctgcaaatctctttctcgacggcccgtacttgggagtcggccat

SEQ ID NO: 4776 - DNA, 140 bp, Artificial Sequence
  Synthetic
atggccgactcccaagtacgggccgtcgagaaagagatttgcagctgagaattcccttcaacttctatctcagcttcccgaatagtgacggcgttggtcatcgagtgtaccgcacacttgggagacccagcatggcgtat

SEQ ID NO: 4777 - DNA, 140 bp, Artificial Sequence
  Synthetic
aggccctggctgctgatatggatgtcatgggtgcagaagatcacgggaggtgtgggactggttgtcgctgttgcagcactgattctaatcgtggtgctatgcgtgtcgttcagcaggcacgaccttttgggacagcggtg

SEQ ID NO: 4778 - DNA, 140 bp, Artificial Sequence
  Synthetic
caccgctgtcccaaaaggtcgtgcctgctgaacgacacgcatagcaccacgattagaatcagtgctgcaacagcgacaaccagtcccacacctcccgtgatcttctgcacccatgacatccatatcagcagccagggcct

SEQ ID NO: 4779 - DNA, 140 bp, Artificial Sequence
  Synthetic
aggccctggctgctgatatggacgccaaattcattgtggggccaatgtcttcagcctggacacctttcgacaacaaaattgtggtgtacaaaggtgacgtctataacatggactacccgcgaccttttgggacagcggtg

SEQ ID NO: 4780 - DNA, 140 bp, Artificial Sequence
  Synthetic
caccgctgtcccaaaaggtcgcgggtagtccatgttatagacgtcacctttgtacaccacaattttgttgtcgaaaggtgtccaggctgaagacattggccccacaatgaatttggcgtccatatcagcagccagggcct

SEQ ID NO: 4781 - DNA, 140 bp, Artificial Sequence
  Synthetic
atacgccatgctgggtctccatggctgcgtgagacacacgtagcctactagtttcttactgctctactctgcaaagcaagagattaataacccatcatggattctgtgtacgtggatatacgtacttgggagtcggccat

SEQ ID NO: 4782 - DNA, 140 bp, Artificial Sequence
  Synthetic
atggccgactcccaagtacgtatatccacgtacacagaatccatgatgggttattaatctcttgctttgcagagtagagcagtaagaaactagtaggctacgtgtgtctcacgcagccatggagacccagcatggcgtat

SEQ ID NO: 4783 - DNA, 140 bp, Artificial Sequence
  Synthetic
aggccctggctgctgatatgagatagaagttgaagggaattctcagctgcaaatctctttctcgacggccttggccagcgccgaattccgcgtacaagtttgttctacacaagtacactggaccttttgggacagcggtg

SEQ ID NO: 4784 - DNA, 140 bp, Artificial Sequence
  Synthetic
caccgctgtcccaaaaggtccagtgtacttgtgtagaacaaacttgtacgcggaattcggcgctggccaaggccgtcgagaaagagatttgcagctgagaattcccttcaacttctatctcatatcagcagccagggcct

SEQ ID NO: 4785 - DNA, 140 bp, Artificial Sequence
  Synthetic
aggccctggctgctgatatgcaacaaaattgtggtgtacaaaggtgacgtctataacatggactacccgccctttggcgcaggaagaccaggacaatttggcgatatccaaagtcgcacagaccttttgggacagcggtg

SEQ ID NO: 4786 - DNA, 140 bp, Artificial Sequence
  Synthetic
caccgctgtcccaaaaggtctgtgcgactttggatatcgccaaattgtcctggtcttcctgcgccaaagggcgggtagtccatgttatagacgtcacctttgtacaccacaattttgttgcatatcagcagccagggcct

SEQ ID NO: 4787 - DNA, 140 bp, Artificial Sequence
  Synthetic
atacgccatgctgggtctccctaatccgccctaccacgaatttgcatacgaagggctaaaaattcgccccgcttgtccatataaaattgcagtcataggagtcttcggggtaccaggatccgtacttgggagtcggccat

SEQ ID NO: 4788 - DNA, 140 bp, Artificial Sequence
  Synthetic
atggccgactcccaagtacggatcctggtaccccgaagactcctatgactgcaattttatatggacaagcggggcgaatttttagcccttcgtatgcaaattcgtggtagggcggattagggagacccagcatggcgtat

SEQ ID NO: 4789 - DNA, 140 bp, Artificial Sequence
  Synthetic
aggccctggctgctgatatgaaagccaacgtttgctgggctaagagcttggtccctatcctcgaaacagcggggattaaactaaatgataggcagtggtcccagataattcaagctttcagaccttttgggacagcggtg

SEQ ID NO: 4790 - DNA, 140 bp, Artificial Sequence
  Synthetic
caccgctgtcccaaaaggtctgaaagcttgaattatctgggaccactgcctatcatttagtttaatccccgctgtttcgaggatagggaccaagctcttagcccagcaaacgttggctttcatatcagcagccagggcct

SEQ ID NO: 4791 - DNA, 140 bp, Artificial Sequence
  Synthetic
atacgccatgctgggtctccactaagtatgaaggtatatgtgtcccctaagagacacactgtacataactaataatctatagatcaaagggctacataacccctgaatagtaacaaaatacgtacttgggagtcggccat

SEQ ID NO: 4792 - DNA, 140 bp, Artificial Sequence
  Synthetic
atggccgactcccaagtacgtattttgttactattcaggggttatgtagccctttgatctatagattattagttatgtacagtgtgtctcttaggggacacatataccttcatacttagtggagacccagcatggcgtat

SEQ ID NO: 4793 - DNA, 140 bp, Artificial Sequence
  Synthetic
aggccctggctgctgatatgtggacatcgcgaagaacgatgaagagtgcgtggtcaacgccgccaaccctcgtgggttaccgggtgacggtgtttgcaaggcagtatataaaaaatggccgaccttttgggacagcggtg

SEQ ID NO: 4794 - DNA, 140 bp, Artificial Sequence
  Synthetic
caccgctgtcccaaaaggtcggccattttttatatactgccttgcaaacaccgtcacccggtaacccacgagggttggcggcgttgaccacgcactcttcatcgttcttcgcgatgtccacatatcagcagccagggcct

SEQ ID NO: 4795 - DNA, 140 bp, Artificial Sequence
  Synthetic
atacgccatgctgggtctcccaaaatcactaaaaattataaaaacagaaaaacacataaataggtatacgtgtcccctgagagacacattgtatgtaggtgataagtatagatcaaagggcgtacttgggagtcggccat

SEQ ID NO: 4796 - DNA, 140 bp, Artificial Sequence
  Synthetic
atggccgactcccaagtacgccctttgatctatacttatcacctacatacaatgtgtctctcaggggacacgtatacctatttatgtgtttttctgtttttataatttttagtgattttgggagacccagcatggcgtat

SEQ ID NO: 4797 - DNA, 140 bp, Artificial Sequence
  Synthetic
aggccctggctgctgatatgaaccacctctttacagccatggactcgacggatgcagacgtggtcatctactgccgagacaaggaatgggagaagaaaatatctgaggctatacagatgcgaccttttgggacagcggtg

SEQ ID NO: 4798 - DNA, 140 bp, Artificial Sequence
  Synthetic
caccgctgtcccaaaaggtcgcatctgtatagcctcagatattttcttctcccattccttgtctcggcagtagatgaccacgtctgcatccgtcgagtccatggctgtaaagaggtggttcatatcagcagccagggcct

SEQ ID NO: 4799 - DNA, 140 bp, Artificial Sequence
  Synthetic
aggccctggctgctgatatgaacataggattatgttcaacagacctgacagaaggtagacgaggcaaattgtctatcatgagaaggaaaaagctaaaaccgtgcgaccgtgtgctgttctgaccttttgggacagcggtg

SEQ ID NO: 4800 - DNA, 140 bp, Artificial Sequence
  Synthetic
caccgctgtcccaaaaggtcagaacagcacacggtcgcacggttttagctttttccttctcatgatagacaatttgcctcgtctaccttctgtcaggtctgttgaacataatcctatgttcatatcagcagccagggcct

SEQ ID NO: 4801 - DNA, 140 bp, Artificial Sequence
  Synthetic
aggccctggctgctgatatgaacataggattatgttcaacagacctgacagaaggtagacgaggcaaattgtctatcatgagatggaaaaagctaaaaccgtgcgaccgtgtgctgttctgaccttttgggacagcggtg

SEQ ID NO: 4802 - DNA, 140 bp, Artificial Sequence
  Synthetic
caccgctgtcccaaaaggtcagaacagcacacggtcgcacggttttagctttttccatctcatgatagacaatttgcctcgtctaccttctgtcaggtctgttgaacataatcctatgttcatatcagcagccagggcct

SEQ ID NO: 4803 - DNA, 140 bp, Artificial Sequence
  Synthetic
aggccctggctgctgatatgaacataggattatgttcaacagacctgacagaaggtagacgaggcaaattgtctatcatgagacggaaaaagctaaaaccgtgcgaccgtgtgctgttctgaccttttgggacagcggtg

SEQ ID NO: 4804 - DNA, 140 bp, Artificial Sequence
  Synthetic
caccgctgtcccaaaaggtcagaacagcacacggtcgcacggttttagctttttccgtctcatgatagacaatttgcctcgtctaccttctgtcaggtctgttgaacataatcctatgttcatatcagcagccagggcct

SEQ ID NO: 4805 - DNA, 140 bp, Artificial Sequence
  Synthetic
aggccctggctgctgatatgaacataggattatgttcaacagacctgacagaaggtagacgaggcaaattgtctatcatgagagggaaaaagctaaaaccgtgcgaccgtgtgctgttctgaccttttgggacagcggtg

SEQ ID NO: 4806 - DNA, 140 bp, Artificial Sequence
  Synthetic
caccgctgtcccaaaaggtcagaacagcacacggtcgcacggttttagctttttccctctcatgatagacaatttgcctcgtctaccttctgtcaggtctgttgaacataatcctatgttcatatcagcagccagggcct

SEQ ID NO: 4807 - DNA, 140 bp, Artificial Sequence
  Synthetic
aggccctggctgctgatatgccgtcccgtgcctttgccgttatgccatgactcctgaacgcgtcacccgacttcgcatgaaccatgtcacaaacataattgtgtgttcttcatttcccctgaccttttgggacagcggtg

SEQ ID NO: 4808 - DNA, 140 bp, Artificial Sequence
  Synthetic
caccgctgtcccaaaaggtcaggggaaatgaagaacacacaattatgtttgtgacatggttcatgcgaagtcgggtgacgcgttcaggagtcatggcataacggcaaaggcacgggacggcatatcagcagccagggcct

SEQ ID NO: 4809 - DNA, 140 bp, Artificial Sequence
  Synthetic
atacgccatgctgggtctccaaaatcaaatgaataccataattggcaaacggaagagatgtaggtacttaagcttcctaaaagcagccgaactcactttgagacgtaggcatagcatacccgtacttgggagtcggccat

SEQ ID NO: 4810 - DNA, 140 bp, Artificial Sequence
  Synthetic
atggccgactcccaagtacgggtatgctatgcctacgtctcaaagtgagttcggctgcttttaggaagcttaagtacctacatctcttccgtttgccaattatggtattcatttgattttggagacccagcatggcgtat

SEQ ID NO: 4811 - DNA, 140 bp, Artificial Sequence
  Synthetic
atacgccatgctgggtctcctaccagtttcttactgctctactctgcaaagcaagagattaataacccatcatggatccagtgtacgtggacatagacgctgacagcgcctttttgaaggcgtacttgggagtcggccat

SEQ ID NO: 4812 - DNA, 140 bp, Artificial Sequence
  Synthetic
atggccgactcccaagtacgccttcaaaaaggcgctgtcagcgtctatgtccacgtacactggatccatgatgggttattaatctcttgctttgcagagtagagcagtaagaaactggtaggagacccagcatggcgtat

SEQ ID NO: 4813 - DNA, 140 bp, Artificial Sequence
  Synthetic
aggccctggctgctgatatgtttcggagacttcctacccggtgaagtggatgatttgacagatagcgactggtccacgtgctcagacacggacgacgagttatgactagatagggcaggtgaccttttgggacagcggtg

SEQ ID NO: 4814 - DNA, 140 bp, Artificial Sequence
  Synthetic
caccgctgtcccaaaaggtcacctgccctatctagtcataactcgtcgtccgtgtctgagcacgtggaccagtcgctatctgtcaaatcatccacttcaccgggtaggaagtctccgaaacatatcagcagccagggcct

SEQ ID NO: 4815 - DNA, 140 bp, Artificial Sequence
  Synthetic
atacgccatgctgggtctccgggtatatattctcgtcggacactggtccaggccatttacaacagaagtcggtacgccagtcagtgctgccggtaaacaccctggaggaggttcacgaggcgtacttgggagtcggccat

SEQ ID NO: 4816 - DNA, 140 bp, Artificial Sequence
  Synthetic
atggccgactcccaagtacgcctcgtgaacctcctccagggtgtttaccggcagcactgactggcgtaccgacttctgttgtaaatggcctggaccagtgtccgacgagaatatatacccggagacccagcatggcgtat

SEQ ID NO: 4817 - DNA, 140 bp, Artificial Sequence
  Synthetic
aggccctggctgctgatatgaaatagaaaaaccataaacagaagtagttcaaagggctataaaacccctgaatagtaacaaaacgtaaaactaataaaaatcaaatgaataccataattggaccttttgggacagcggtg

SEQ ID NO: 4818 - DNA, 140 bp, Artificial Sequence
  Synthetic
caccgctgtcccaaaaggtccaattatggtattcatttgatttttattagttttacgttttgttactattcaggggttttatagccctttgaactacttctgtttatggtttttctatttcatatcagcagccagggcct

SEQ ID NO: 4819 - DNA, 140 bp, Artificial Sequence
  Synthetic
atacgccatgctgggtctccggagaaagcggtgtactctaggtacgaagtgcagggtatatcagttgctgtaatgtccatggccaccttcgcaagctccagatccaacttcgagaagctccgtacttgggagtcggccat

SEQ ID NO: 4820 - DNA, 140 bp, Artificial Sequence
  Synthetic
atggccgactcccaagtacggagcttctcgaagttggatctggagcttgcgaaggtggccatggacattacagcaactgatataccctgcacttcgtacctagagtacaccgctttctccggagacccagcatggcgtat

SEQ ID NO: 4821 - DNA, 140 bp, Artificial Sequence
  Synthetic
aggccctggctgctgatatgatccattctagaaagaaagtacccattcacaaaagggaagtggaacatcaacaagcagatctgcgtgactaccaggaggatagaagactttaaccctaccgaccttttgggacagcggtg

SEQ ID NO: 4822 - DNA, 140 bp, Artificial Sequence
  Synthetic
caccgctgtcccaaaaggtcggtagggttaaagtcttctatcctcctggtagtcacgcagatctgcttgttgatgttccacttcccttttgtgaatgggtactttctttctagaatggatcatatcagcagccagggcct

SEQ ID NO: 4823 - DNA, 140 bp, Artificial Sequence
  Synthetic
aggccctggctgctgatatgcgtccgcaaaggaaggccgggcaacttgcccagctgatctcagcagttaataaactgacaatgcgcgtggtacctcaacagaaaccgcgcaagaatcggagaccttttgggacagcggtg

SEQ ID NO: 4824 - DNA, 140 bp, Artificial Sequence
  Synthetic
caccgctgtcccaaaaggtctccgattcttgcgcggtttctgttgaggtaccacgcgcattgtcagtttattaactgctgagatcagctgggcaagttgcccggccttcctttgcggacgcatatcagcagccagggcct

SEQ ID NO: 4825 - DNA, 140 bp, Artificial Sequence
  Synthetic
atacgccatgctgggtctccaagacgtgcacgcacaacggacgagcagggaggtatgcggtcgaagcgtacgacggccgagtcctagtgccctcaggttatgcaatctcgcctgaagactcgtacttgggagtcggccat

SEQ ID NO: 4826 - DNA, 140 bp, Artificial Sequence
  Synthetic
atggccgactcccaagtacgagtcttcaggcgagattgcataacctgagggcactaggactcggccgtcgtacgcttcgaccgcatacctccctgctcgtccgttgtgcgtgcacgtcttggagacccagcatggcgtat

SEQ ID NO: 4827 - DNA, 140 bp, Artificial Sequence
  Synthetic
atacgccatgctgggtctccacccaacgctcctgtcctacaggaatatgggagaagaaccaaactatcaagaagagtgggtgacgcttaagaaggagatcaggttaaccgtgccgactgacgtacttgggagtcggccat

SEQ ID NO: 4828 - DNA, 140 bp, Artificial Sequence
  Synthetic
atggccgactcccaagtacgtcagtcggcacggttaacctgatctccttcttaagcgtcacccactcttcttgatagtttggttcttctcccatattcctgtaggacaggagcgttgggtggagacccagcatggcgtat

SEQ ID NO: 4829 - DNA, 140 bp, Artificial Sequence
  Synthetic
aggccctggctgctgatatgatcataaaatagaaaaaccataaacagaagtagtttaaagggctataaaacccctgaatagtaacaaaacataaagttaataaaaatcaaatgaataccagaccttttgggacagcggtg

SEQ ID NO: 4830 - DNA, 140 bp, Artificial Sequence
  Synthetic
caccgctgtcccaaaaggtctggtattcatttgatttttattaactttatgttttgttactattcaggggttttatagccctttaaactacttctgtttatggtttttctattttatgatcatatcagcagccagggcct

SEQ ID NO: 4831 - DNA, 140 bp, Artificial Sequence
  Synthetic
aggccctggctgctgatatgttaataaaaatcaaatgaataccataattggcaaacggaagagatgtaggtacttaagcttcctaaaagcagccgaactcactttgagaagtaggcataggaccttttgggacagcggtg

SEQ ID NO: 4832 - DNA, 140 bp, Artificial Sequence
  Synthetic
caccgctgtcccaaaaggtcctatgcctacttctcaaagtgagttcggctgcttttaggaagcttaagtacctacatctcttccgtttgccaattatggtattcatttgatttttattaacatatcagcagccagggcct

SEQ ID NO: 4833 - DNA, 140 bp, Artificial Sequence
  Synthetic
atacgccatgctgggtctccctgcaaagcaagagattaataacccatcatggatcctgtgtacgtggacatagacgccgacagcgcctttttgaaggccctgcaacgtgcgtaccccatgcgtacttgggagtcggccat

SEQ ID NO: 4834 - DNA, 140 bp, Artificial Sequence
  Synthetic
atggccgactcccaagtacgcatggggtacgcacgttgcagggccttcaaaaaggcgctgtcggcgtctatgtccacgtacacaggatccatgatgggttattaatctcttgctttgcagggagacccagcatggcgtat

SEQ ID NO: 4835 - DNA, 140 bp, Artificial Sequence
  Synthetic
atacgccatgctgggtctccttggctgcgtgagacacacgtagcctaccagtttcttactgctctactctgcaaagcaagagattaataacccatcatggatcctgtgtacgtggacatacgtacttgggagtcggccat

SEQ ID NO: 4836 - DNA, 140 bp, Artificial Sequence
  Synthetic
atggccgactcccaagtacgtatgtccacgtacacaggatccatgatgggttattaatctcttgctttgcagagtagagcagtaagaaactggtaggctacgtgtgtctcacgcagccaaggagacccagcatggcgtat

SEQ ID NO: 4837 - DNA, 140 bp, Artificial Sequence
  Synthetic
atacgccatgctgggtctccaacataggattatgttcaacagacctgacggaaggtagacgaggcaagttgtctatcatgagaaggaaaaagctaaaaccgtgcgaccgtgtgctgttctcgtacttgggagtcggccat

SEQ ID NO: 4838 - DNA, 140 bp, Artificial Sequence
  Synthetic
atggccgactcccaagtacgagaacagcacacggtcgcacggttttagctttttccttctcatgatagacaacttgcctcgtctaccttccgtcaggtctgttgaacataatcctatgttggagacccagcatggcgtat

SEQ ID NO: 4839 - DNA, 140 bp, Artificial Sequence
  Synthetic
aggccctggctgctgatatgagcgttctcgcatctagctataaaactaatagagcaggaaattgaccccgactcaaccatcctggatatcggcagtgcgccagcaaggaggatgatgtcggaccttttgggacagcggtg

SEQ ID NO: 4840 - DNA, 140 bp, Artificial Sequence
  Synthetic
caccgctgtcccaaaaggtccgacatcatcctccttgctggcgcactgccgatatccaggatggttgagtcggggtcaatttcctgctctattagttttatagctagatgcgagaacgctcatatcagcagccagggcct

SEQ ID NO: 4841 - DNA, 140 bp, Artificial Sequence
  Synthetic
aggccctggctgctgatatgtttgaggtggaaccaaggcaggtcacaccgaatgaccatgctaatgctagagcgttctcgcatctagctataaaactaatagagcaggaaattgaccccggaccttttgggacagcggtg

SEQ ID NO: 4842 - DNA, 140 bp, Artificial Sequence
  Synthetic
caccgctgtcccaaaaggtccggggtcaatttcctgctctattagttttatagctagatgcgagaacgctctagcattagcatggtcattcggtgtgacctgccttggttccacctcaaacatatcagcagccagggcct

SEQ ID NO: 4843 - DNA, 140 bp, Artificial Sequence
  Synthetic
aggccctggctgctgatatgaacataggattatgttcaacagacctgacggaaggtagacgaggtaaattgtctatcatgagagggaaaaagctgaaaccgtgcgaccgtgtgctgttctgaccttttgggacagcggtg

SEQ ID NO: 4844 - DNA, 140 bp, Artificial Sequence
  Synthetic
caccgctgtcccaaaaggtcagaacagcacacggtcgcacggtttcagctttttccctctcatgatagacaatttacctcgtctaccttccgtcaggtctgttgaacataatcctatgttcatatcagcagccagggcct

SEQ ID NO: 4845 - DNA, 140 bp, Artificial Sequence
  Synthetic
aggccctggctgctgatatggagactcgctaattatgcgagaaagctagcatctgccgcaggaaaagtcctggacagaaacatctctggaaagatcggggacttacaagcagtaatggccgaccttttgggacagcggtg

SEQ ID NO: 4846 - DNA, 140 bp, Artificial Sequence
  Synthetic
caccgctgtcccaaaaggtcggccattactgcttgtaagtccccgatctttccagagatgtttctgtccaggacttttcctgcggcagatgctagctttctcgcataattagcgagtctccatatcagcagccagggcct

SEQ ID NO: 4847 - DNA, 140 bp, Artificial Sequence
  Synthetic
aggccctggctgctgatatgtggacagaaacatctctggaaagatcggggacttacaagcagtaatggccgtgccagacaaggagacgccaacattctgcttacacacagacgtctcatggaccttttgggacagcggtg

SEQ ID NO: 4848 - DNA, 140 bp, Artificial Sequence
  Synthetic
caccgctgtcccaaaaggtccatgagacgtctgtgtgtaagcagaatgttggcgtctccttgtctggcacggccattactgcttgtaagtccccgatctttccagagatgtttctgtccacatatcagcagccagggcct

SEQ ID NO: 4849 - DNA, 140 bp, Artificial Sequence
  Synthetic
aggccctggctgctgatatgtgaccggcatccttgctacagaagtcacgccggaggacgcacagaagctgttggtggggctgaaccagagaatagtggttaacggcagaacgcaacggaagaccttttgggacagcggtg

SEQ ID NO: 4850 - DNA, 140 bp, Artificial Sequence
  Synthetic
caccgctgtcccaaaaggtcttccgttgcgttctgccgttaaccactattctctggttcagccccaccaacagcttctgtgcgtcctccggcgtgacttctgtagcaaggatgccggtcacatatcagcagccagggcct

SEQ ID NO: 4851 - DNA, 140 bp, Artificial Sequence
  Synthetic
aggccctggctgctgatatgactcaaccatcctggatatcggcagtgcgccagcaaggaggatgatgtcggacaggaagtaccactgcgtctgcccgatgcgcagtgcggaagatcccgagaccttttgggacagcggtg

SEQ ID NO: 4852 - DNA, 140 bp, Artificial Sequence
  Synthetic
caccgctgtcccaaaaggtctcgggatcttccgcactgcgcatcgggcagacgcagtggtacttcctgtccgacatcatcctccttgctggcgcactgccgatatccaggatggttgagtcatatcagcagccagggcct

SEQ ID NO: 4853 - DNA, 140 bp, Artificial Sequence
  Synthetic
aggccctggctgctgatatgcacccacgtcgctataccaccaggcgattaaaggggtccgagtggcgtactgggttgggttcgacacaaccccgttcatgtacaatgccatggcgggtgcgaccttttgggacagcggtg

SEQ ID NO: 4854 - DNA, 140 bp, Artificial Sequence
  Synthetic
caccgctgtcccaaaaggtcgcacccgccatggcattgtacatgaacggggttgtgtcgaacccaacccagtacgccactcggacccctttaatcgcctggtggtatagcgacgtgggtgcatatcagcagccagggcct

SEQ ID NO: 4855 - DNA, 140 bp, Artificial Sequence
  Synthetic
atacgccatgctgggtctccggctatgcaatttcgcctgaggacttccagagtctaagcgaaagcgcaacgatggtgtacaacgaaagagagttcgtaaacagaaagttacaccacattgcgtacttgggagtcggccat

SEQ ID NO: 4856 - DNA, 140 bp, Artificial Sequence
  Synthetic
atggccgactcccaagtacgcaatgtggtgtaactttctgtttacgaactctctttcgttgtacaccatcgttgcgctttcgcttagactctggaagtcctcaggcgaaattgcatagccggagacccagcatggcgtat

SEQ ID NO: 4857 - DNA, 140 bp, Artificial Sequence
  Synthetic
aggccctggctgctgatatgatgctgtaagaaggaagaagctgcaggattggtactggtgggcgacttgaccaatccgccctaccacgaatttgcatacgaagggctaaaaattcgccccgaccttttgggacagcggtg

SEQ ID NO: 4858 - DNA, 140 bp, Artificial Sequence
  Synthetic
caccgctgtcccaaaaggtcggggcgaatttttagcccttcgtatgcaaattcgtggtagggcggattggtcaagtcgcccaccagtaccaatcctgcagcttcttccttcttacagcatcatatcagcagccagggcct

SEQ ID NO: 4859 - DNA, 140 bp, Artificial Sequence
  Synthetic
atacgccatgctgggtctcccagagaggtctagaaatatctgcacgtacggttgattcactgctcttgaatggatgcaatagaccagtcgacgtgttatacgtagacgaggcgtttgcgtcgtacttgggagtcggccat

SEQ ID NO: 4860 - DNA, 140 bp, Artificial Sequence
  Synthetic
atggccgactcccaagtacgacgcaaacgcctcgtctacgtataacacgtcgactggtctattgcatccattcaagagcagtgaatcaaccgtacgtgcagatatttctagacctctctgggagacccagcatggcgtat

SEQ ID NO: 4861 - DNA, 140 bp, Artificial Sequence
  Synthetic
aggccctggctgctgatatgaaagttgtactttgtggtgacccgaagcagtgcggcttcttcaatatgatgcagatgaaagtcaactacaatcataacatctgcactcaagtgtacaacagaccttttgggacagcggtg

SEQ ID NO: 4862 - DNA, 140 bp, Artificial Sequence
  Synthetic
caccgctgtcccaaaaggtctgttgtacacttgagtgcagatgttatgattgtagttgactttcatctgcatcatattgaagaagccgcactgcttcgggtcaccacaaagtacaactttcatatcagcagccagggcct

SEQ ID NO: 4863 - DNA, 140 bp, Artificial Sequence
  Synthetic
aggccctggctgctgatatggatgagcccaggcctttatggaaaaaccacagggtatgcggtaacccaccacgcagacggattcctgatgtgcaagactaccgacacggttgacggcgaagaccttttgggacagcggtg

SEQ ID NO: 4864 - DNA, 140 bp, Artificial Sequence
  Synthetic
caccgctgtcccaaaaggtcttcgccgtcaaccgtgtcggtagtcttgcacatcaggaatccgtctgcgtggtgggttaccgcataccctgtggtttttccataaaggcctgggctcatccatatcagcagccagggcct

SEQ ID NO: 4865 - DNA, 140 bp, Artificial Sequence
  Synthetic
atacgccatgctgggtctcctaacgtgcttcagagggtgggttaaacagctgcaaattgactatcgtggacacgaggtcatgacagcagccgcatcccaagggctaaccagaaaaggagtcgtacttgggagtcggccat

SEQ ID NO: 4866 - DNA, 140 bp, Artificial Sequence
  Synthetic
atggccgactcccaagtacgactccttttctggttagcccttgggatgcggctgctgtcatgacctcgtgtccacgatagtcaatttgcagctgtttaacccaccctctgaagcacgttaggagacccagcatggcgtat

SEQ ID NO: 4867 - DNA, 140 bp, Artificial Sequence
  Synthetic
aggccctggctgctgatatgggtacttaagcttcctaaaagcagccgaactcactttgagaagtaggcatagcataccgaactcttccacgattctccgaacccacagggacgtaggagagaccttttgggacagcggtg

SEQ ID NO: 4868 - DNA, 140 bp, Artificial Sequence
  Synthetic
caccgctgtcccaaaaggtctctcctacgtccctgtgggttcggagaatcgtggaagagttcggtatgctatgcctacttctcaaagtgagttcggctgcttttaggaagcttaagtacccatatcagcagccagggcct

SEQ ID NO: 4869 - DNA, 140 bp, Artificial Sequence
  Synthetic
aggccctggctgctgatatgaatgaccggcatccttgctacagaagtcacgccggaggatgcacagaagctgttggtggggctgaaccagagaatagtggttaacggcagaacgcaacgggaccttttgggacagcggtg

SEQ ID NO: 4870 - DNA, 140 bp, Artificial Sequence
  Synthetic
caccgctgtcccaaaaggtcccgttgcgttctgccgttaaccactattctctggttcagccccaccaacagcttctgtgcatcctccggcgtgacttctgtagcaaggatgccggtcattcatatcagcagccagggcct

SEQ ID NO: 4871 - DNA, 140 bp, Artificial Sequence
  Synthetic
atacgccatgctgggtctccttacgcagtcaggcaaaaagttaacgaaaacccactctatgcatcaacatcagagcacgtcaacgtactcttaacgcgtacggaaggtaaactggtatggcgtacttgggagtcggccat

SEQ ID NO: 4872 - DNA, 140 bp, Artificial Sequence
  Synthetic
atggccgactcccaagtacgccataccagtttaccttccgtacgcgttaagagtacgttgacgtgctctgatgttgatgcatagagtgggttttcgttaactttttgcctgactgcgtaaggagacccagcatggcgtat

SEQ ID NO: 4873 - DNA, 140 bp, Artificial Sequence
  Synthetic
aggccctggctgctgatatgaagaagacaaagcatactcacccgaagtagccctgaatgaaatatgcacgcgcatgtatggggtggatctagacagcgggctattctctaaaccattggtgaccttttgggacagcggtg

SEQ ID NO: 4874 - DNA, 140 bp, Artificial Sequence
  Synthetic
caccgctgtcccaaaaggtcaccaatggtttagagaatagcccgctgtctagatccaccccatacatgcgcgtgcatatttcattcagggctacttcgggtgagtatgctttgtcttcttcatatcagcagccagggcct

SEQ ID NO: 4875 - DNA, 140 bp, Artificial Sequence
  Synthetic
aggccctggctgctgatatgcagtaagtgggcaaaggagtgccggaaagacatggaagatgaaaaactcctgggggtcagagaaagaacactgacctgctgctgtctatgggcattcaaggaccttttgggacagcggtg

SEQ ID NO: 4876 - DNA, 140 bp, Artificial Sequence
  Synthetic
caccgctgtcccaaaaggtccttgaatgcccatagacagcagcaggtcagtgttctttctctgacccccaggagtttttcatcttccatgtctttccggcactcctttgcccacttactgcatatcagcagccagggcct

SEQ ID NO: 4877 - DNA, 140 bp, Artificial Sequence
  Synthetic
aggccctggctgctgatatggaggatagaagacttcaaccctaccaccaacattataccggccaacaggagactaccacactcattagtggccgaacaccgcccggtaaaaggggaaagagaccttttgggacagcggtg

SEQ ID NO: 4878 - DNA, 140 bp, Artificial Sequence
  Synthetic
caccgctgtcccaaaaggtctctttccccttttaccgggcggtgttcggccactaatgagtgtggtagtctcctgttggccggtataatgttggtggtagggttgaagtcttctatcctccatatcagcagccagggcct

SEQ ID NO: 4879 - DNA, 140 bp, Artificial Sequence
  Synthetic
atacgccatgctgggtctccagaagctaaaaccgtgcgaccgtgtgctgttctcagtagggtcaacgctctacccggaaagccgcgagctacttaagagctggcacttaccatcggtgttcgtacttgggagtcggccat

SEQ ID NO: 4880 - DNA, 140 bp, Artificial Sequence
  Synthetic
atggccgactcccaagtacgaacaccgatggtaagtgccagctcttaagtagctcgcggctttccgggtagagcgttgaccctactgagaacagcacacggtcgcacggttttagcttctggagacccagcatggcgtat

SEQ ID NO: 4881 - DNA, 140 bp, Artificial Sequence
  Synthetic
aggccctggctgctgatatgaactgggcagatgagcaggtactgaaggctaagaacataggattatgttcaacagacctgacggaaggtagacgaggcaaattgtctatcatgagagggagaccttttgggacagcggtg

SEQ ID NO: 4882 - DNA, 140 bp, Artificial Sequence
  Synthetic
caccgctgtcccaaaaggtctccctctcatgatagacaatttgcctcgtctaccttccgtcaggtctgttgaacataatcctatgttcttagccttcagtacctgctcatctgcccagttcatatcagcagccagggcct

SEQ ID NO: 4883 - DNA, 140 bp, Artificial Sequence
  Synthetic
aggccctggctgctgatatgccgggttgtcaatccctttgaggactagaatcaaatggttgttaagcaaggtgccaaaaaccgacctgatcccatacagcggagacgcccgagaagcccggaccttttgggacagcggtg

SEQ ID NO: 4884 - DNA, 140 bp, Artificial Sequence
  Synthetic
caccgctgtcccaaaaggtccgggcttctcgggcgtctccgctgtatgggatcaggtcggtttttggcaccttgcttaacaaccatttgattctagtcctcaaagggattgacaacccggcatatcagcagccagggcct

SEQ ID NO: 4885 - DNA, 140 bp, Artificial Sequence
  Synthetic
aggccctggctgctgatatggtgccaaaaaccgacctgatcccatacagcggagacgcccgagaagcccgggacgcagaaaaagaagcagaggaagaacgagaagcagaactgactcgcggaccttttgggacagcggtg

SEQ ID NO: 4886 - DNA, 140 bp, Artificial Sequence
  Synthetic
caccgctgtcccaaaaggtccgcgagtcagttctgcttctcgttcttcctctgcttctttttctgcgtcccgggcttctcgggcgtctccgctgtatgggatcaggtcggtttttggcaccatatcagcagccagggcct

SEQ ID NO: 4887 - DNA, 140 bp, Artificial Sequence
  Synthetic
aggccctggctgctgatatgactgggacgtaagtttagatcatccagagcattgaaaccaccatgtatcaccagtaatactgagatgtttttcctattcagcagttttgacaatggcagagaccttttgggacagcggtg

SEQ ID NO: 4888 - DNA, 140 bp, Artificial Sequence
  Synthetic
caccgctgtcccaaaaggtctctgccattgtcaaaactgctgaataggaaaaacatctcagtattactggtgatacatggtggtttcaatgctctggatgatctaaacttacgtcccagtcatatcagcagccagggcct

SEQ ID NO: 4889 - DNA, 140 bp, Artificial Sequence
  Synthetic
atacgccatgctgggtctccgtacatacgtgccggcgaccatttgtgatcaaatgaccggcatccttgctacagaagtcacgccggaggatgcacagaaactattggtggggctgaaccacgtacttgggagtcggccat

SEQ ID NO: 4890 - DNA, 140 bp, Artificial Sequence
  Synthetic
atggccgactcccaagtacgtggttcagccccaccaatagtttctgtgcatcctccggcgtgacttctgtagcaaggatgccggtcatttgatcacaaatggtcgccggcacgtatgtacggagacccagcatggcgtat

SEQ ID NO: 4891 - DNA, 140 bp, Artificial Sequence
  Synthetic
atacgccatgctgggtctccgcaacacttggtaggtatgacctagtggtcataaacatccatacaccttttcgcatacaccattaccaacagtgcgtagatcacgcaatgaaactgcaaacgtacttgggagtcggccat

SEQ ID NO: 4892 - DNA, 140 bp, Artificial Sequence
  Synthetic
atggccgactcccaagtacgtttgcagtttcattgcgtgatctacgcactgttggtaatggtgtatgcgaaaaggtgtatggatgtttatgaccactaggtcatacctaccaagtgttgcggagacccagcatggcgtat

SEQ ID NO: 4893 - DNA, 140 bp, Artificial Sequence
  Synthetic
atacgccatgctgggtctcctctacaagaggcctgatacccagtcaattcagaaggttcaggccgagtttgacagctttgtggtaccgagcctgtggtcgtccgggttgtcgatccctttcgtacttgggagtcggccat

SEQ ID NO: 4894 - DNA, 140 bp, Artificial Sequence
  Synthetic
atggccgactcccaagtacgaaagggatcgacaacccggacgaccacaggctcggtaccacaaagctgtcaaactcggcctgaaccttctgaattgactgggtatcaggcctcttgtagaggagacccagcatggcgtat

SEQ ID NO: 4895 - DNA, 140 bp, Artificial Sequence
  Synthetic
atacgccatgctgggtctcctggacatcgcgaagaacgatgaagagtgcgtggtcaacgctgccaaccctcgcgggttaccgggtgacggtgtttgcaaggcagtatataaaaaatggcccgtacttgggagtcggccat

SEQ ID NO: 4896 - DNA, 140 bp, Artificial Sequence
  Synthetic
atggccgactcccaagtacgggccattttttatatactgccttgcaaacaccgtcacccggtaacccgcgagggttggcagcgttgaccacgcactcttcatcgttcttcgcgatgtccaggagacccagcatggcgtat

SEQ ID NO: 4897 - DNA, 140 bp, Artificial Sequence
  Synthetic
atacgccatgctgggtctccgaggactagaatcaaatggttgttaagcaaggtgccaaaaaccgacctgatcccatatagcggggacgcccaagaagcccgggacgcagaaaaagaagcacgtacttgggagtcggccat

SEQ ID NO: 4898 - DNA, 140 bp, Artificial Sequence
  Synthetic
atggccgactcccaagtacgtgcttctttttctgcgtcccgggcttcttgggcgtccccgctatatgggatcaggtcggtttttggcaccttgcttaacaaccatttgattctagtcctcggagacccagcatggcgtat

SEQ ID NO: 4899 - DNA, 140 bp, Artificial Sequence
  Synthetic
aggccctggctgctgatatgtactcggagtccgaaggggaccgggaattggcggctgcctatcgagaagtcgcaaaagaagtaactagactgggagtaaatagcgtagctatacctctccgaccttttgggacagcggtg

SEQ ID NO: 4900 - DNA, 140 bp, Artificial Sequence
  Synthetic
caccgctgtcccaaaaggtcggagaggtatagctacgctatttactcccagtctagttacttcttttgcgacttctcgataggcagccgccaattcccggtccccttcggactccgagtacatatcagcagccagggcct

SEQ ID NO: 4901 - DNA, 140 bp, Artificial Sequence
  Synthetic
atacgccatgctgggtctcctgccggaaagacatggaagatgaaaaactcctgggggtcagagaaagaacactgacctgctgctgtctatgggcattcaagaagcagaaaatacacacggcgtacttgggagtcggccat

SEQ ID NO: 4902 - DNA, 140 bp, Artificial Sequence
  Synthetic
atggccgactcccaagtacgccgtgtgtattttctgcttcttgaatgcccatagacagcagcaggtcagtgttctttctctgacccccaggagtttttcatcttccatgtctttccggcaggagacccagcatggcgtat

SEQ ID NO: 4903 - DNA, 140 bp, Artificial Sequence
  Synthetic
aggccctggctgctgatatggacgtggaacagcttgaggacagagcgggcgcaggaataatagagactccgagaggagctatcaaagttactgcccaaccaacagaccacgtcgtgggaggaccttttgggacagcggtg

SEQ ID NO: 4904 - DNA, 140 bp, Artificial Sequence
  Synthetic
caccgctgtcccaaaaggtcctcccacgacgtggtctgttggttgggcagtaactttgatagctcctctcggagtctctattattcctgcgcccgctctgtcctcaagctgttccacgtccatatcagcagccagggcct

SEQ ID NO: 4905 - DNA, 140 bp, Artificial Sequence
  Synthetic
atacgccatgctgggtctccgctcaacaaaacctgaccctggagacctcgtgctaacgtgcttcagagggtgggttaaacaactgcaaattgactaccgtggatacgaagtcatgacagccgtacttgggagtcggccat

SEQ ID NO: 4906 - DNA, 140 bp, Artificial Sequence
  Synthetic
atggccgactcccaagtacggctgtcatgacttcgtatccacggtagtcaatttgcagttgtttaacccaccctctgaagcacgttagcacgaggtctccagggtcaggttttgttgagcggagacccagcatggcgtat

SEQ ID NO: 4907 - DNA, 140 bp, Artificial Sequence
  Synthetic
aggccctggctgctgatatgcgcgccgcctagaagaaggagagggagaaacctgaccgtggtatgtgacgagagagaagggaatataacacccatggctagcgtccgattctttagagcagaccttttgggacagcggtg

SEQ ID NO: 4908 - DNA, 140 bp, Artificial Sequence
  Synthetic
caccgctgtcccaaaaggtctgctctaaagaatcggacgctagccatgggtgttatattcccttctctctcgtcacataccacggtcaggtttctccctctccttcttctaggcggcgcgcatatcagcagccagggcct

SEQ ID NO: 4909 - DNA, 140 bp, Artificial Sequence
  Synthetic
aggccctggctgctgatatgagagagaagggaatataacacccatggctagcgtccgattctttagagcagagcagtgtccggccgtacaagaaacagcggagacgcgtgacacagctatgaccttttgggacagcggtg

SEQ ID NO: 4910 - DNA, 140 bp, Artificial Sequence
  Synthetic
caccgctgtcccaaaaggtcatagctgtgtcacgcgtctccgctgtttcttgtacggccggacactgctctgctctaaagaatcggacgctagccatgggtgttatattcccttctctctcatatcagcagccagggcct

SEQ ID NO: 4911 - DNA, 140 bp, Artificial Sequence
  Synthetic
aggccctggctgctgatatggactaatccgccctaccacgaattcgcatatgaagggctaaaaatccgccctgcctgcccatacaaaattgcagtcataggagtcttcggagtaccgggagaccttttgggacagcggtg

SEQ ID NO: 4912 - DNA, 140 bp, Artificial Sequence
  Synthetic
caccgctgtcccaaaaggtctcccggtactccgaagactcctatgactgcaattttgtatgggcaggcagggcggatttttagcccttcatatgcgaattcgtggtagggcggattagtccatatcagcagccagggcct

SEQ ID NO: 4913 - DNA, 140 bp, Artificial Sequence
  Synthetic
atacgccatgctgggtctccctcccttcgggcaccgccaagtaccaccgtggaactgagccatccaccgatctccttcggagcaccaagcgagacgttccccatcacatttggggacttccgtacttgggagtcggccat

SEQ ID NO: 4914 - DNA, 140 bp, Artificial Sequence
  Synthetic
atggccgactcccaagtacggaagtccccaaatgtgatggggaacgtctcgcttggtgctccgaaggagatcggtggatggctcagttccacggtggtacttggcggtgcccgaagggagggagacccagcatggcgtat

SEQ ID NO: 4915 - DNA, 140 bp, Artificial Sequence
  Synthetic
atacgccatgctgggtctccaccctaccaccaacattataccggccaacaggagactaccacactcattagtggccgaacatcgcccagtaaaaggggaaagaatggaatggctggttaacgtacttgggagtcggccat

SEQ ID NO: 4916 - DNA, 140 bp, Artificial Sequence
  Synthetic
atggccgactcccaagtacgttaaccagccattccattctttccccttttactgggcgatgttcggccactaatgagtgtggtagtctcctgttggccggtataatgttggtggtagggtggagacccagcatggcgtat

SEQ ID NO: 4917 - DNA, 140 bp, Artificial Sequence
  Synthetic
aggccctggctgctgatatgctattaaggagtgggaggtggagcatgcatcaataatggcgggcatctgcagtcaccagatgacctttgatacattccaaaacaaagccaatgtttgttggaccttttgggacagcggtg

SEQ ID NO: 4918 - DNA, 140 bp, Artificial Sequence
  Synthetic
caccgctgtcccaaaaggtccaacaaacattggctttgttttggaatgtatcaaaggtcatctggtgactgcagatgcccgccattattgatgcatgctccacctcccactccttaatagcatatcagcagccagggcct

SEQ ID NO: 4919 - DNA, 140 bp, Artificial Sequence
  Synthetic
atacgccatgctgggtctccaatggatgcaacagaccagtcgacgtgttgtacgtagacgaggcgtttgcgtgccactctggaacgctacttgctttgatcgccttggtgagaccaaggccgtacttgggagtcggccat

SEQ ID NO: 4920 - DNA, 140 bp, Artificial Sequence
  Synthetic
atggccgactcccaagtacggccttggtctcaccaaggcgatcaaagcaagtagcgttccagagtggcacgcaaacgcctcgtctacgtacaacacgtcgactggtctgttgcatccattggagacccagcatggcgtat

SEQ ID NO: 4921 - DNA, 140 bp, Artificial Sequence
  Synthetic
aggccctggctgctgatatgtctagacagcgggctattttctaaaccgttggtgtctgtgtattacgcggataaccactgggataataggcctggagggaagatgttcgggtttaaccccgaccttttgggacagcggtg

SEQ ID NO: 4922 - DNA, 140 bp, Artificial Sequence
  Synthetic
caccgctgtcccaaaaggtcggggttaaacccgaacatcttccctccaggcctattatcccagtggttatccgcgtaatacacagacaccaacggtttagaaaatagcccgctgtctagacatatcagcagccagggcct

SEQ ID NO: 4923 - DNA, 140 bp, Artificial Sequence
  Synthetic
aggccctggctgctgatatggactacacatacaacctagagttgggtctgccagcaacgcttggcaggtatgacctagtggtcataaacatccacacaccttttcgcatccaccattaccgaccttttgggacagcggtg

SEQ ID NO: 4924 - DNA, 140 bp, Artificial Sequence
  Synthetic
caccgctgtcccaaaaggtcggtaatggtggatgcgaaaaggtgtgtggatgtttatgaccactaggtcatacctgccaagcgttgctggcagacccaactctaggttgtatgtgtagtccatatcagcagccagggcct

SEQ ID NO: 4925 - DNA, 140 bp, Artificial Sequence
  Synthetic
atacgccatgctgggtctccaacagtgcgtagaccacgcaatgaaactgcaaatgctcgggggtgactcattgagactgctcaaaccgggtggctctctattgatcagagcatacggttacgtacttgggagtcggccat

SEQ ID NO: 4926 - DNA, 140 bp, Artificial Sequence
  Synthetic
atggccgactcccaagtacgtaaccgtatgctctgatcaatagagagccacccggtttgagcagtctcaatgagtcacccccgagcatttgcagtttcattgcgtggtctacgcactgttggagacccagcatggcgtat

SEQ ID NO: 4927 - DNA, 140 bp, Artificial Sequence
  Synthetic
aggccctggctgctgatatgttgagactgctcaaaccgggtggctctctattgatcagagcatacggttacgcagatagaaccagtgaacgagtcatctgcgtgttgggacgcaagtttagaccttttgggacagcggtg

SEQ ID NO: 4928 - DNA, 140 bp, Artificial Sequence
  Synthetic
caccgctgtcccaaaaggtctaaacttgcgtcccaacacgcagatgactcgttcactggttctatctgcgtaaccgtatgctctgatcaatagagagccacccggtttgagcagtctcaacatatcagcagccagggcct

SEQ ID NO: 4929 - DNA, 140 bp, Artificial Sequence
  Synthetic
atacgccatgctgggtctccggaaaatatgaaagcaacaatcattcagagactaaagagaggctgtaaactgtatttaatggcagagaccccgaaagtcccgacttatcggaccgtataccgtacttgggagtcggccat

SEQ ID NO: 4930 - DNA, 140 bp, Artificial Sequence
  Synthetic
atggccgactcccaagtacggtatacggtccgataagtcgggactttcggggtctctgccattaaatacagtttacagcctctctttagtctctgaatgattgttgctttcatattttccggagacccagcatggcgtat

SEQ ID NO: 4931 - DNA, 140 bp, Artificial Sequence
  Synthetic
atacgccatgctgggtctccgatcgtctagagcgttgaaaccaccatgtgtcaccagcaacactgagatgttttttctattcagcaactttgacaatggcagaaggaatttcacaactcacgtacttgggagtcggccat

SEQ ID NO: 4932 - DNA, 140 bp, Artificial Sequence
  Synthetic
atggccgactcccaagtacgtgagttgtgaaattccttctgccattgtcaaagttgctgaatagaaaaaacatctcagtgttgctggtgacacatggtggtttcaacgctctagacgatcggagacccagcatggcgtat

SEQ ID NO: 4933 - DNA, 140 bp, Artificial Sequence
  Synthetic
aggccctggctgctgatatgtgtatttaatggcagagaccccgaaagtcccgacttatcggaccgtatacccggcacctgtgtactcgcctccgatcaatgtccgattgtccaatcccgagaccttttgggacagcggtg

SEQ ID NO: 4934 - DNA, 140 bp, Artificial Sequence
  Synthetic
caccgctgtcccaaaaggtctcgggattggacaatcggacattgatcggaggcgagtacacaggtgccgggtatacggtccgataagtcgggactttcggggtctctgccattaaatacacatatcagcagccagggcct

SEQ ID NO: 4935 - DNA, 140 bp, Artificial Sequence
  Synthetic
aggccctggctgctgatatggatacgaggtcatgacagcagccgcatcccaagggttaaccagaaaaggagtttacgcagttagacaaaaagttaatgaaaacccgctctatgcatcaacgaccttttgggacagcggtg

SEQ ID NO: 4936 - DNA, 140 bp, Artificial Sequence
  Synthetic
caccgctgtcccaaaaggtcgttgatgcatagagcgggttttcattaactttttgtctaactgcgtaaactccttttctggttaacccttgggatgcggctgctgtcatgacctcgtatccatatcagcagccagggcct

SEQ ID NO: 4937 - DNA, 140 bp, Artificial Sequence
  Synthetic
aggccctggctgctgatatggtcagagcacgtcaacgtactcctaacgcgtacggaaggtaaactggtatggaagacactttccggcgacccgtggataaagacgctgcagaacccaccggaccttttgggacagcggtg

SEQ ID NO: 4938 - DNA, 140 bp, Artificial Sequence
  Synthetic
caccgctgtcccaaaaggtccggtgggttctgcagcgtctttatccacgggtcgccggaaagtgtcttccataccagtttaccttccgtacgcgttaggagtacgttgacgtgctctgaccatatcagcagccagggcct

SEQ ID NO: 4939 - DNA, 140 bp, Artificial Sequence
  Synthetic
aggccctggctgctgatatgttttttctattcagcaactttgacaatggcagaaggaatttcacaactcatgttatgaacaatcaactgaatgcagcctttgtaggacaggccacccgaggaccttttgggacagcggtg

SEQ ID NO: 4940 - DNA, 140 bp, Artificial Sequence
  Synthetic
caccgctgtcccaaaaggtcctcgggtggcctgtcctacaaaggctgcattcagttgattgttcataacatgagttgtgaaattccttctgccattgtcaaagttgctgaatagaaaaaacatatcagcagccagggcct

SEQ ID NO: 4941 - DNA, 140 bp, Artificial Sequence
  Synthetic
aggccctggctgctgatatgaaaggaaacttcaaagcaactattaaggagtgggaggtggagcatgcatcaataatggcgggcatctgcagtcaccaaatgaccttcgatacattccaaagaccttttgggacagcggtg

SEQ ID NO: 4942 - DNA, 140 bp, Artificial Sequence
  Synthetic
caccgctgtcccaaaaggtctttggaatgtatcgaaggtcatttggtgactgcagatgcccgccattattgatgcatgctccacctcccactccttaatagttgctttgaagtttcctttcatatcagcagccagggcct

SEQ ID NO: 4943 - DNA, 140 bp, Artificial Sequence
  Synthetic
aggccctggctgctgatatgcagcagcttggcaggcagaaaaggatacagcaccacggaaggcgcactgtactcatatctagaagggacccgttttcaccagacggcagtggacatggcggaccttttgggacagcggtg

SEQ ID NO: 4944 - DNA, 140 bp, Artificial Sequence
  Synthetic
caccgctgtcccaaaaggtccgccatgtccactgccgtctggtgaaaacgggtcccttctagatatgagtacagtgcgccttccgtggtgctgtatccttttctgcctgccaagctgctgcatatcagcagccagggcct

SEQ ID NO: 4945 - DNA, 140 bp, Artificial Sequence
  Synthetic
aggccctggctgctgatatgacgaaaaggaactgcaacgtcacacagatgagggaattacccactttggactcagcagtattcaacgtggagtgttttaaaaaatttgcatgcaaccgaggaccttttgggacagcggtg

SEQ ID NO: 4946 - DNA, 140 bp, Artificial Sequence
  Synthetic
caccgctgtcccaaaaggtcctcggttgcatgcaaattttttaaaacactccacgttgaatactgctgagtccaaagtgggtaattccctcatctgtgtgacgttgcagttccttttcgtcatatcagcagccagggcct

SEQ ID NO: 4947 - DNA, 140 bp, Artificial Sequence
  Synthetic
atacgccatgctgggtctccgcggggataaaactaaatgataggcagtggtctcagataattcaagccttcaaagaagacaaagcatactcacctgaagtagccctgaatgaaatatgtacgtacttgggagtcggccat

SEQ ID NO: 4948 - DNA, 140 bp, Artificial Sequence
  Synthetic
atggccgactcccaagtacgtacatatttcattcagggctacttcaggtgagtatgctttgtcttctttgaaggcttgaattatctgagaccactgcctatcatttagttttatccccgcggagacccagcatggcgtat

SEQ ID NO: 4949 - DNA, 140 bp, Artificial Sequence
  Synthetic
atacgccatgctgggtctcccgcgcatgtatggggtggatctagacagcgggctattttctaaaccgttggtgtctgtgtattacgcggataaccactgggataataggcctggagggaacgtacttgggagtcggccat

SEQ ID NO: 4950 - DNA, 140 bp, Artificial Sequence
  Synthetic
atggccgactcccaagtacgttccctccaggcctattatcccagtggttatccgcgtaatacacagacaccaacggtttagaaaatagcccgctgtctagatccaccccatacatgcgcgggagacccagcatggcgtat

SEQ ID NO: 4951 - DNA, 140 bp, Artificial Sequence
  Synthetic
aggccctggctgctgatatgcattcacaaaagggaagtggaacatcaacaagcagatctgcgtgactaccaggaggatagaagactttaaccctaccaccaacatcataccggccaacaggaccttttgggacagcggtg

SEQ ID NO: 4952 - DNA, 140 bp, Artificial Sequence
  Synthetic
caccgctgtcccaaaaggtcctgttggccggtatgatgttggtggtagggttaaagtcttctatcctcctggtagtcacgcagatctgcttgttgatgttccacttcccttttgtgaatgcatatcagcagccagggcct

SEQ ID NO: 4953 - DNA, 140 bp, Artificial Sequence
  Synthetic
aggccctggctgctgatatgacagaggaaaggcctaaggtgcaggttatacaggcggctgaacccttggcaacagcgtatctatgtggaattcacagagaattggttaggagattgaacggaccttttgggacagcggtg

SEQ ID NO: 4954 - DNA, 140 bp, Artificial Sequence
  Synthetic
caccgctgtcccaaaaggtccgttcaatctcctaaccaattctctgtgaattccacatagatacgctgttgccaagggttcagccgcctgtataacctgcaccttaggcctttcctctgtcatatcagcagccagggcct

SEQ ID NO: 4955 - DNA, 140 bp, Artificial Sequence
  Synthetic
aggccctggctgctgatatgaggaggatagaagactttaaccctaccaccaacatcataccggccaacaggagactaccacactcattagtggccgaacaccgcccagtaaaaggggaaagaccttttgggacagcggtg

SEQ ID NO: 4956 - DNA, 140 bp, Artificial Sequence
  Synthetic
caccgctgtcccaaaaggtctttccccttttactgggcggtgttcggccactaatgagtgtggtagtctcctgttggccggtatgatgttggtggtagggttaaagtcttctatcctcctcatatcagcagccagggcct

SEQ ID NO: 4957 - DNA, 140 bp, Artificial Sequence
  Synthetic
aggccctggctgctgatatggaatggaatggctggttaacaagataaacggccaccacgtgctcctggtcagtggctataaccttgcactgcctactaagagagtcacttgggtagcgccgaccttttgggacagcggtg

SEQ ID NO: 4958 - DNA, 140 bp, Artificial Sequence
  Synthetic
caccgctgtcccaaaaggtcggcgctacccaagtgactctcttagtaggcagtgcaaggttatagccactgaccaggagcacgtggtggccgtttatcttgttaaccagccattccattccatatcagcagccagggcct

SEQ ID NO: 4959 - DNA, 140 bp, Artificial Sequence
  Synthetic
aggccctggctgctgatatgttcgatgccattatagccgcacactttaagccaggagacgccgttttagaaacggacatagcctcctttgataagagccaggatgattcacttgcgctcagaccttttgggacagcggtg

SEQ ID NO: 4960 - DNA, 140 bp, Artificial Sequence
  Synthetic
caccgctgtcccaaaaggtctgagcgcaagtgaatcatcctggctcttatcaaaggaggctatgtccgtttctaaaacggcgtctcctggcttaaagtgtgcggctataatggcatcgaacatatcagcagccagggcct

SEQ ID NO: 4961 - DNA, 140 bp, Artificial Sequence
  Synthetic
atacgccatgctgggtctccccgccttaatgctgttagaagatttgggagtggatcactccttgttggacctgatagaggctgcttttggagagatttccagctgtcacctgccgacaggcgtacttgggagtcggccat

SEQ ID NO: 4962 - DNA, 140 bp, Artificial Sequence
  Synthetic
atggccgactcccaagtacgcctgtcggcaggtgacagctggaaatctctccaaaagcagcctctatcaggtccaacaaggagtgatccactcccaaatcttctaacagcattaaggcggggagacccagcatggcgtat

SEQ ID NO: 4963 - DNA, 140 bp, Artificial Sequence
  Synthetic
atacgccatgctgggtctccggtggacgggtcggagagttgcctggatcgagcgacattcaatccgtcaaaacttaggagctacccgaaacagtacgcttaccacgcgccctccatcagacgtacttgggagtcggccat

SEQ ID NO: 4964 - DNA, 140 bp, Artificial Sequence
  Synthetic
atggccgactcccaagtacgtctgatggagggcgcgtggtaagcgtactgtttcgggtagctcctaagttttgacggattgaatgtcgctcgatccaggcaactctccgacccgtccaccggagacccagcatggcgtat

SEQ ID NO: 4965 - DNA, 140 bp, Artificial Sequence
  Synthetic
aggccctggctgctgatatgaatgctcgggggtgactcattgagactgctcaaaccgggcggctctctattgatcagagcatatggttacgcagatagaaccagtgaacgagtcatctgcgaccttttgggacagcggtg

SEQ ID NO: 4966 - DNA, 140 bp, Artificial Sequence
  Synthetic
caccgctgtcccaaaaggtcgcagatgactcgttcactggttctatctgcgtaaccatatgctctgatcaatagagagccgcccggtttgagcagtctcaatgagtcacccccgagcattcatatcagcagccagggcct

SEQ ID NO: 4967 - DNA, 140 bp, Artificial Sequence
  Synthetic
aggccctggctgctgatatggaatttaacaacctatgttactaaactaaaagggccaaaagcagcagcgctattcgcaaaaacccataatctgcagccactgcaggaagtaccaatggatgaccttttgggacagcggtg

SEQ ID NO: 4968 - DNA, 140 bp, Artificial Sequence
  Synthetic
caccgctgtcccaaaaggtcatccattggtacttcctgcagtggctgcagattatgggtttttgcgaatagcgctgctgcttttggcccttttagtttagtaacataggttgttaaattccatatcagcagccagggcct

SEQ ID NO: 4969 - DNA, 140 bp, Artificial Sequence
  Synthetic
atacgccatgctgggtctcctagaaacggacatagcctcctttgataagagccaagatgattcacttgcgcttactgctttgatgttgttagaagatttaggggtggatcactccctgttcgtacttgggagtcggccat

SEQ ID NO: 4970 - DNA, 140 bp, Artificial Sequence
  Synthetic
atggccgactcccaagtacgaacagggagtgatccacccctaaatcttctaacaacatcaaagcagtaagcgcaagtgaatcatcttggctcttatcaaaggaggctatgtccgtttctaggagacccagcatggcgtat

SEQ ID NO: 4971 - DNA, 140 bp, Artificial Sequence
  Synthetic
atacgccatgctgggtctccggacttgatagaggctgctttcggagagatttccagctgtcatctaccgacaggtacgcgcttcaagttcggcgccatgatgaaatccggtatgttcctacgtacttgggagtcggccat

SEQ ID NO: 4972 - DNA, 140 bp, Artificial Sequence
  Synthetic
atggccgactcccaagtacgtaggaacataccggatttcatcatggcgccgaacttgaagcgcgtacctgtcggtagatgacagctggaaatctctccgaaagcagcctctatcaagtccggagacccagcatggcgtat

SEQ ID NO: 4973 - DNA, 140 bp, Artificial Sequence
  Synthetic
atacgccatgctgggtctccacactgttcgtcaacacattgctaaacatcaccatcgctagccgagtgctggaagatcgtctgacaaaatctgcgtgcgcggccttcatcggcgacgacacgtacttgggagtcggccat

SEQ ID NO: 4974 - DNA, 140 bp, Artificial Sequence
  Synthetic
atggccgactcccaagtacgtgtcgtcgccgatgaaggccgcgcacgcagattttgtcagacgatcttccagcactcggctagcgatggtgatgtttagcaatgtgttgacgaacagtgtggagacccagcatggcgtat

SEQ ID NO: 4975 - DNA, 140 bp, Artificial Sequence
  Synthetic
aggccctggctgctgatatgccggagtcctttaagaacagtgcaacaccagtgggaaccgcaaaaacagttatgtgcggtacgtatccagtaatccacgctgttggaccaaacttctctagaccttttgggacagcggtg

SEQ ID NO: 4976 - DNA, 140 bp, Artificial Sequence
  Synthetic
caccgctgtcccaaaaggtctagagaagtttggtccaacagcgtggattactggatacgtaccgcacataactgtttttgcggttcccactggtgttgcactgttcttaaaggactccggcatatcagcagccagggcct

SEQ ID NO: 4977 - DNA, 140 bp, Artificial Sequence
  Synthetic
aggccctggctgctgatatgctcgcgggttaccgggtgacggtgtttgcaaggcagtatacaaaaaatggccggagtcctttaagaacagtgcaacaccagtgggaaccgcaaaaacagtgaccttttgggacagcggtg

SEQ ID NO: 4978 - DNA, 140 bp, Artificial Sequence
  Synthetic
caccgctgtcccaaaaggtcactgtttttgcggttcccactggtgttgcactgttcttaaaggactccggccattttttgtatactgccttgcaaacaccgtcacccggtaacccgcgagcatatcagcagccagggcct

SEQ ID NO: 4979 - DNA, 140 bp, Artificial Sequence
  Synthetic
aggccctggctgctgatatgcctattttgcagaagccgacagcaagtacctaaacactaatcaactacaatggagttcatcccaacccaaactttctacaataggaggtatcagcctcgagaccttttgggacagcggtg

SEQ ID NO: 4980 - DNA, 140 bp, Artificial Sequence
  Synthetic
caccgctgtcccaaaaggtctcgaggctgatacctcctattgtagaaagtttgggttgggatgaactccattgtagttgattagtgtttaggtacttgctgtcggcttctgcaaaataggcatatcagcagccagggcct

SEQ ID NO: 4981 - DNA, 140 bp, Artificial Sequence
  Synthetic
aggccctggctgctgatatgtgacaatgcgcgcggtacctcaacagaagccacgcaggaatcggaagaataagaagcaaaagcaaaagcaacaggcgccacaaaacaacacaaaccaaaagaccttttgggacagcggtg

SEQ ID NO: 4982 - DNA, 140 bp, Artificial Sequence
  Synthetic
caccgctgtcccaaaaggtcttttggtttgtgttgttttgtggcgcctgttgcttttgcttttgcttcttattcttccgattcctgcgtggcttctgttgaggtaccgcgcgcattgtcacatatcagcagccagggcct

SEQ ID NO: 4983 - DNA, 140 bp, Artificial Sequence
  Synthetic
atacgccatgctgggtctcctaaagccacaagaccgtacttagctcactgtcccgactgtggagaagggcactcgtgccacagtcccgtagcactagagcgcatcagaaatgaagcgacacgtacttgggagtcggccat

SEQ ID NO: 4984 - DNA, 140 bp, Artificial Sequence
  Synthetic
atggccgactcccaagtacgtgtcgcttcatttctgatgcgctctagtgctacgggactgtggcacgagtgcccttctccacagtcgggacagtgagctaagtacggtcttgtggctttaggagacccagcatggcgtat

SEQ ID NO: 4985 - DNA, 140 bp, Artificial Sequence
  Synthetic
aggccctggctgctgatatgaggccaatgagcaagtctgcctatatgccctgggggaaagtattgaatcgatcaggcagaaatgcccggtggatgatgcagacgcatcatctccccccaagaccttttgggacagcggtg

SEQ ID NO: 4986 - DNA, 140 bp, Artificial Sequence
  Synthetic
caccgctgtcccaaaaggtcttggggggagatgatgcgtctgcatcatccaccgggcatttctgcctgatcgattcaatactttcccccagggcatataggcagacttgctcattggcctcatatcagcagccagggcct

SEQ ID NO: 4987 - DNA, 140 bp, Artificial Sequence
  Synthetic
aggccctggctgctgatatgatcaggcagaaatgcccggtggatgatgcagacgcatcatctccccccaaaactgtcccgtgcctttgccgttacgctatgactccagaacgcgtcacccgaccttttgggacagcggtg

SEQ ID NO: 4988 - DNA, 140 bp, Artificial Sequence
  Synthetic
caccgctgtcccaaaaggtcgggtgacgcgttctggagtcatagcgtaacggcaaaggcacgggacagttttggggggagatgatgcgtctgcatcatccaccgggcatttctgcctgatcatatcagcagccagggcct

SEQ ID NO: 4989 - DNA, 140 bp, Artificial Sequence
  Synthetic
aggccctggctgctgatatgaagccagcacacgtaaaggggaccatcgataacgcggacctggccaaattggccttcaagcgatcatctaagtacgaccttgaatgcgcgcagatacccggaccttttgggacagcggtg

SEQ ID NO: 4990 - DNA, 140 bp, Artificial Sequence
  Synthetic
caccgctgtcccaaaaggtccgggtatctgcgcgcattcaaggtcgtacttagatgatcgcttgaaggccaatttggccaggtccgcgttatcgatggtcccctttacgtgtgctggcttcatatcagcagccagggcct

SEQ ID NO: 4991 - DNA, 140 bp, Artificial Sequence
  Synthetic
atacgccatgctgggtctccggcttcgcatgaaccacgtcacaagcataattgtgtgttcttcgtttcccctcccaaagtacaaaatagaaggagtgcaaaaagtcaaatgctctaaggtcgtacttgggagtcggccat

SEQ ID NO: 4992 - DNA, 140 bp, Artificial Sequence
  Synthetic
atggccgactcccaagtacgaccttagagcatttgactttttgcactccttctattttgtactttgggaggggaaacgaagaacacacaattatgcttgtgacgtggttcatgcgaagccggagacccagcatggcgtat

SEQ ID NO: 4993 - DNA, 140 bp, Artificial Sequence
  Synthetic
aggccctggctgctgatatgcaccgccgcaactaccgaggagatagaggtacacatgcccccagacacccctgatcgcacattgatgtcacaacagtccggcaatgtaaagatcacagttgaccttttgggacagcggtg

SEQ ID NO: 4994 - DNA, 140 bp, Artificial Sequence
  Synthetic
caccgctgtcccaaaaggtcaactgtgatctttacattgccggactgttgtgacatcaatgtgcgatcaggggtgtctgggggcatgtgtacctctatctcctcggtagttgcggcggtgcatatcagcagccagggcct

SEQ ID NO: 4995 - DNA, 140 bp, Artificial Sequence
  Synthetic
aggccctggctgctgatatgcatccctacaggtgcgggcaaaccaggggatagtggtagaccgatcttcgacaacaaggggcgcgtggtggccatagttttaggaggagctaatgaaggagaccttttgggacagcggtg

SEQ ID NO: 4996 - DNA, 140 bp, Artificial Sequence
  Synthetic
caccgctgtcccaaaaggtctccttcattagctcctcctaaaactatggccaccacgcgccccttgttgtcgaagatcggtctaccactatcccctggtttgcccgcacctgtagggatgcatatcagcagccagggcct

SEQ ID NO: 4997 - DNA, 140 bp, Artificial Sequence
  Synthetic
aggccctggctgctgatatgcatagtcaattcgacctaagcgttgatggcgagatactgcccgtcccgtcagacctggatgctgacgccccagccctagaaccagcactagacgacgggggaccttttgggacagcggtg

SEQ ID NO: 4998 - DNA, 140 bp, Artificial Sequence
  Synthetic
caccgctgtcccaaaaggtcccccgtcgtctagtgctggttctagggctggggcgtcagcatccaggtctgacgggacgggcagtatctcgccatcaacgcttaggtcgaattgactatgcatatcagcagccagggcct

SEQ ID NO: 4999 - DNA, 140 bp, Artificial Sequence
  Synthetic
aggccctggctgctgatatgcgacgcagatgcatcacaccgtacgaactgacaccaggagctaccgtccctttcctgcttagcctaatatgctgtatcagaacagctaaagcggccacatgaccttttgggacagcggtg

SEQ ID NO: 5000 - DNA, 140 bp, Artificial Sequence
  Synthetic
caccgctgtcccaaaaggtcatgtggccgctttagctgttctgatacagcatattaggctaagcaggaaagggacggtagctcctggtgtcagttcgtacggtgtgatgcatctgcgtcgcatatcagcagccagggcct

SEQ ID NO: 5001 - DNA, 140 bp, Artificial Sequence
  Synthetic
aggccctggctgctgatatgcgacacacacgctgccatccacaaccggaaaccttgcggccgtgtctgactgggtaatgagcaccgtacctgtcgcgccgcccagaagaaggcgagggaggaccttttgggacagcggtg

SEQ ID NO: 5002 - DNA, 140 bp, Artificial Sequence
  Synthetic
caccgctgtcccaaaaggtcctccctcgccttcttctgggcggcgcgacaggtacggtgctcattacccagtcagacacggccgcaaggtttccggttgtggatggcagcgtgtgtgtcgcatatcagcagccagggcct

SEQ ID NO: 5003 - DNA, 140 bp, Artificial Sequence
  Synthetic
aggccctggctgctgatatgtgggtaatgagcaccgtacctgtcgcgccgcccagaagaaggcgagggagaaacctgactgtgacatgtgacgagagagaagggaatataacacccatgggaccttttgggacagcggtg

SEQ ID NO: 5004 - DNA, 140 bp, Artificial Sequence
  Synthetic
caccgctgtcccaaaaggtcccatgggtgttatattcccttctctctcgtcacatgtcacagtcaggtttctccctcgccttcttctgggcggcgcgacaggtacggtgctcattacccacatatcagcagccagggcct

SEQ ID NO: 5005 - DNA, 140 bp, Artificial Sequence
  Synthetic
aggccctggctgctgatatgtcccatggtattggagatggaactactgtcagtcactttggagccaacgctatcgcttgattacatcacgtgcgagtacaaaaccgttatcccgtctccggaccttttgggacagcggtg

SEQ ID NO: 5006 - DNA, 140 bp, Artificial Sequence
  Synthetic
caccgctgtcccaaaaggtccggagacgggataacggttttgtactcgcacgtgatgtaatcaagcgatagcgttggctccaaagtgactgacagtagttccatctccaataccatgggacatatcagcagccagggcct

SEQ ID NO: 5007 - DNA, 140 bp, Artificial Sequence
  Synthetic
aggccctggctgctgatatggccacaagaccgtacctagctcactgccccgactgtggagaagggcactcgtgccatagtcccgtagcgctagaacgcatcagaaatgaagcgacagacggaccttttgggacagcggtg

SEQ ID NO: 5008 - DNA, 140 bp, Artificial Sequence
  Synthetic
caccgctgtcccaaaaggtccgtctgtcgcttcatttctgatgcgttctagcgctacgggactatggcacgagtgcccttctccacagtcggggcagtgagctaggtacggtcttgtggccatatcagcagccagggcct

SEQ ID NO: 5009 - DNA, 140 bp, Artificial Sequence
  Synthetic
aggccctggctgctgatatgattggctaaaagaacgaggggcgtcgctgcagcatacagcaccatttggctgccaaatagcaacaaacccggtaagagcggtgaactgcgccgtagggaagaccttttgggacagcggtg

SEQ ID NO: 5010 - DNA, 140 bp, Artificial Sequence
  Synthetic
caccgctgtcccaaaaggtcttccctacggcgcagttcaccgctcttaccgggtttgttgctatttggcagccaaatggtgctgtatgctgcagcgacgcccctcgttcttttagccaatcatatcagcagccagggcct

SEQ ID NO: 5011 - DNA, 140 bp, Artificial Sequence
  Synthetic
atacgccatgctgggtctcctcctcagatttcgggggcgtcgccattattaaatatgcagccagcaagaaaggcaagtgcgcggtgcattcgatgaccaacgccgtcactattcgggaagcgtacttgggagtcggccat

SEQ ID NO: 5012 - DNA, 140 bp, Artificial Sequence
  Synthetic
atggccgactcccaagtacgcttcccgaatagtgacggcgttggtcatcgaatgcaccgcgcacttgcctttcttgctggctgcatatttaataatggcgacgcccccgaaatctgaggaggagacccagcatggcgtat

SEQ ID NO: 5013 - DNA, 140 bp, Artificial Sequence
  Synthetic
aggccctggctgctgatatgcacggaaccgaatcatccgccgatctccttcggagcatcaagcgagacgttccccattacatttggggacttcaacgaaggagaaatcgaaagcttgtctgaccttttgggacagcggtg

SEQ ID NO: 5014 - DNA, 140 bp, Artificial Sequence
  Synthetic
caccgctgtcccaaaaggtcagacaagctttcgatttctccttcgttgaagtccccaaatgtaatggggaacgtctcgcttgatgctccgaaggagatcggcggatgattcggttccgtgcatatcagcagccagggcct

SEQ ID NO: 5015 - DNA, 140 bp, Artificial Sequence
  Synthetic
atacgccatgctgggtctccctggaacaatgggacacttcattttggcccgatgtccgaaaggagaaactctgacggtggggttcactgacggtagaaagatcagtcactcatgtacgcacgtacttgggagtcggccat

SEQ ID NO: 5016 - DNA, 140 bp, Artificial Sequence
  Synthetic
atggccgactcccaagtacgtgcgtacatgagtgactgatctttctaccgtcagtgaaccccaccgtcagagtttctcctttcggacatcgggccaaaatgaagtgtcccattgttccagggagacccagcatggcgtat

SEQ ID NO: 5017 - DNA, 140 bp, Artificial Sequence
  Synthetic
aggccctggctgctgatatgactgattctaatcgtggtgctatgcgtgtcgtttagcaggcactaacttgacaactaagtatgaaggtatatgtgtcccctaagagacacactgtatatagaccttttgggacagcggtg

SEQ ID NO: 5018 - DNA, 140 bp, Artificial Sequence
  Synthetic
caccgctgtcccaaaaggtctatatacagtgtgtctcttaggggacacatataccttcatacttagttgtcaagttagtgcctgctaaacgacacgcatagcaccacgattagaatcagtcatatcagcagccagggcct

SEQ ID NO: 5019 - DNA, 140 bp, Artificial Sequence
  Synthetic
atacgccatgctgggtctccgctaataatctatagatcaaagggctatacaacccctgaatagtaacaaaatacaaaatcactaaaaattataaaaacagaaaaatacataaataggtatcgtacttgggagtcggccat

SEQ ID NO: 5020 - DNA, 140 bp, Artificial Sequence
  Synthetic
atggccgactcccaagtacgatacctatttatgtatttttctgtttttataatttttagtgattttgtattttgttactattcaggggttgtatagccctttgatctatagattattagcggagacccagcatggcgtat

SEQ ID NO: 5021 - DNA, 140 bp, Artificial Sequence
  Synthetic
aggccctggctgctgatatgtcgcacattaatgtcacaacagtccggcaatgtaaagatcacagtcaatagtcagacggtgcgatacaagtgcaattgtggtgattcaagcgaaggattagaccttttgggacagcggtg

SEQ ID NO: 5022 - DNA, 140 bp, Artificial Sequence
  Synthetic
caccgctgtcccaaaaggtctaatccttcgcttgaatcaccacaattgcacttgtatcgcaccgtctgactattgactgtgatctttacattgccggactgttgtgacattaatgtgcgacatatcagcagccagggcct

SEQ ID NO: 5023 - DNA, 140 bp, Artificial Sequence
  Synthetic
aggccctggctgctgatatgtacagaatgtactggcagcagccacgaaaagaaactgcaacgtcacacagatgagggaattacccactttggactcagcagtattcaacgtggagtgtttgaccttttgggacagcggtg

SEQ ID NO: 5024 - DNA, 140 bp, Artificial Sequence
  Synthetic
caccgctgtcccaaaaggtcaaacactccacgttgaatactgctgagtccaaagtgggtaattccctcatctgtgtgacgttgcagtttcttttcgtggctgctgccagtacattctgtacatatcagcagccagggcct

SEQ ID NO: 5025 - DNA, 140 bp, Artificial Sequence
  Synthetic
atacgccatgctgggtctcctcctgtcctacaggaatatgggagaagaaccaaactatcgagaagagtgggtgacgcataagaaggagatcaggttaaccgtgccgactgaagggctcgacgtacttgggagtcggccat

SEQ ID NO: 5026 - DNA, 140 bp, Artificial Sequence
  Synthetic
atggccgactcccaagtacgtcgagcccttcagtcggcacggttaacctgatctccttcttatgcgtcacccactcttctcgatagtttggttcttctcccatattcctgtaggacaggaggagacccagcatggcgtat

SEQ ID NO: 5027 - DNA, 140 bp, Artificial Sequence
  Synthetic
aggccctggctgctgatatgatagaggctgctttcggagagatttccagctgtcacctaccgacaagtacgcgcttcaagttcggcgccatgatgaaatcaggtatgttcctaactctgtgaccttttgggacagcggtg

SEQ ID NO: 5028 - DNA, 140 bp, Artificial Sequence
  Synthetic
caccgctgtcccaaaaggtcacagagttaggaacatacctgatttcatcatggcgccgaacttgaagcgcgtacttgtcggtaggtgacagctggaaatctctccgaaagcagcctctatcatatcagcagccagggcct

SEQ ID NO: 5029 - DNA, 140 bp, Artificial Sequence
  Synthetic
atacgccatgctgggtctccactcctgtcgatggtgggtgtggcagtggggatgtgcatgtgtgcacgacgcagatgcattacaccgtacgaactgacaccaggagctaccgtccctttccgtacttgggagtcggccat

SEQ ID NO: 5030 - DNA, 140 bp, Artificial Sequence
  Synthetic
atggccgactcccaagtacggaaagggacggtagctcctggtgtcagttcgtacggtgtaatgcatctgcgtcgtgcacacatgcacatccccactgccacacccaccatcgacaggagtggagacccagcatggcgtat

SEQ ID NO: 5031 - DNA, 140 bp, Artificial Sequence
  Synthetic
aggccctggctgctgatatgaggtgactcctggtacaaagcatacagaggaaagacctaaggtgcaggttatacaggcggctgaacccttggcgacagcatacctatgtgggattcacaggaccttttgggacagcggtg

SEQ ID NO: 5032 - DNA, 140 bp, Artificial Sequence
  Synthetic
caccgctgtcccaaaaggtcctgtgaatcccacataggtatgctgtcgccaagggttcagccgcctgtataacctgcaccttaggtctttcctctgtatgctttgtaccaggagtcacctcatatcagcagccagggcct

SEQ ID NO: 5033 - DNA, 140 bp, Artificial Sequence
  Synthetic
aggccctggctgctgatatgataaaattaataaaaatcaaatgaataccataattggcaaacggaagagatgtaggtacttaagcttcctaaaagcagccgaactcactttgagaagtaggaccttttgggacagcggtg

SEQ ID NO: 5034 - DNA, 140 bp, Artificial Sequence
  Synthetic
caccgctgtcccaaaaggtcctacttctcaaagtgagttcggctgcttttaggaagcttaagtacctacatctcttccgtttgccaattatggtattcatttgatttttattaattttatcatatcagcagccagggcct

SEQ ID NO: 5035 - DNA, 140 bp, Artificial Sequence
  Synthetic
atacgccatgctgggtctccggaggccgcggtatacctgtggaacgagcagcagcccttattttggctgcaagcccttattccgctggcagccctgattgtcctatgtaactgtctgagacgtacttgggagtcggccat

SEQ ID NO: 5036 - DNA, 140 bp, Artificial Sequence
  Synthetic
atggccgactcccaagtacgtctcagacagttacataggacaatcagggctgccagcggaataagggcttgcagccaaaataagggctgctgctcgttccacaggtataccgcggcctccggagacccagcatggcgtat

SEQ ID NO: 5037 - DNA, 140 bp, Artificial Sequence
  Synthetic
aggccctggctgctgatatgtatttgacatgtctgccgaggatttcgatgccatcatagccgcacactttaagccaggagacactgttttggaaacggacatagcctcctttgataagaggaccttttgggacagcggtg

SEQ ID NO: 5038 - DNA, 140 bp, Artificial Sequence
  Synthetic
caccgctgtcccaaaaggtcctcttatcaaaggaggctatgtccgtttccaaaacagtgtctcctggcttaaagtgtgcggctatgatggcatcgaaatcctcggcagacatgtcaaatacatatcagcagccagggcct

SEQ ID NO: 5039 - DNA, 140 bp, Artificial Sequence
  Synthetic
atacgccatgctgggtctccctcctaccatgctgttgtaaaatgttgacttttttagccgtactgagcgtcggtgcccacactgtgagcgcgtacgaacacgtaacagtgatcccgaacacgtacttgggagtcggccat

SEQ ID NO: 5040 - DNA, 140 bp, Artificial Sequence
  Synthetic
atggccgactcccaagtacgtgttcgggatcactgttacgtgttcgtacgcgctcacagtgtgggcaccgacgctcagtacggctaaaaaagtcaacattttacaacagcatggtaggagggagacccagcatggcgtat

SEQ ID NO: 5041 - DNA, 140 bp, Artificial Sequence
  Synthetic
aggccctggctgctgatatgtttcctattcagcaactttgacaatggcagaaggaatttcacaactcatgtcatgaacaatcaactgaatgcagccttcgtgggacaggtcacccgagcagaccttttgggacagcggtg

SEQ ID NO: 5042 - DNA, 140 bp, Artificial Sequence
  Synthetic
caccgctgtcccaaaaggtctgctcgggtgacctgtcccacgaaggctgcattcagttgattgttcatgacatgagttgtgaaattccttctgccattgtcaaagttgctgaataggaaacatatcagcagccagggcct

SEQ ID NO: 5043 - DNA, 140 bp, Artificial Sequence
  Synthetic
aggccctggctgctgatatgcgctgtaccgtccccattccagaacacactacagaatgtactggcagcagccacgaaaagaaactgcaacgtcacacagatgagggaattgcccactttggaccttttgggacagcggtg

SEQ ID NO: 5044 - DNA, 140 bp, Artificial Sequence
  Synthetic
caccgctgtcccaaaaggtccaaagtgggcaattccctcatctgtgtgacgttgcagtttcttttcgtggctgctgccagtacattctgtagtgtgttctggaatggggacggtacagcgcatatcagcagccagggcct

SEQ ID NO: 5045 - DNA, 140 bp, Artificial Sequence
  Synthetic
atacgccatgctgggtctccgactcagcagtattcaacgtggagtgtttcaaaaaattcgcatgcaaccaagaatactgggaagaattcgctgccagccctattaggataacaactgagacgtacttgggagtcggccat

SEQ ID NO: 5046 - DNA, 140 bp, Artificial Sequence
  Synthetic
atggccgactcccaagtacgtctcagttgttatcctaatagggctggcagcgaattcttcccagtattcttggttgcatgcgaattttttgaaacactccacgttgaatactgctgagtcggagacccagcatggcgtat

SEQ ID NO: 5047 - DNA, 140 bp, Artificial Sequence
  Synthetic
aggccctggctgctgatatgagtccgaatcatgcaaaacagaatttgcatcagcatatagggctcataccgcatccgcatcagctaagctccgcgttctttaccaaggaaataatatcacgaccttttgggacagcggtg

SEQ ID NO: 5048 - DNA, 140 bp, Artificial Sequence
  Synthetic
caccgctgtcccaaaaggtcgtgatattatttccttggtaaagaacgcggagcttagctgatgcggatgcggtatgagccctatatgctgatgcaaattctgttttgcatgattcggactcatatcagcagccagggcct

SEQ ID NO: 5049 - DNA, 140 bp, Artificial Sequence
  Synthetic
aggccctggctgctgatatgatgcagttgtatccttgaaagccccttacttttgtggagggtttatactgcacgatactgtgacaggaacagcttgcagagtggcagacccgctaaaaaggaccttttgggacagcggtg

SEQ ID NO: 5050 - DNA, 140 bp, Artificial Sequence
  Synthetic
caccgctgtcccaaaaggtcctttttagcgggtctgccactctgcaagctgttcctgtcacagtatcgtgcagtataaaccctccacaaaagtaaggggctttcaaggatacaactgcatcatatcagcagccagggcct

SEQ ID NO: 5051 - DNA, 140 bp, Artificial Sequence
  Synthetic
atacgccatgctgggtctccgttcacagtagatatgaaaagggacgtgaaggtgactcctggtacaaagcatacagaggaaagacctaaagtgcaggttatacaggcggctgaacccttgcgtacttgggagtcggccat

SEQ ID NO: 5052 - DNA, 140 bp, Artificial Sequence
  Synthetic
atggccgactcccaagtacgcaagggttcagccgcctgtataacctgcactttaggtctttcctctgtatgctttgtaccaggagtcaccttcacgtcccttttcatatctactgtgaacggagacccagcatggcgtat

SEQ ID NO: 5053 - DNA, 140 bp, Artificial Sequence
  Synthetic
aggccctggctgctgatatgaattcatagtggggccaatgtcttcagcctggacacctttcgacaataaaatcgtggtgtacaaaggcgacgtctacaacatggactacccgcccttcgggaccttttgggacagcggtg

SEQ ID NO: 5054 - DNA, 140 bp, Artificial Sequence
  Synthetic
caccgctgtcccaaaaggtcccgaagggcgggtagtccatgttgtagacgtcgcctttgtacaccacgattttattgtcgaaaggtgtccaggctgaagacattggccccactatgaattcatatcagcagccagggcct

SEQ ID NO: 5055 - DNA, 140 bp, Artificial Sequence
  Synthetic
aggccctggctgctgatatgctaattgatgagctggagaaagcggtatactctaggtacgaagtgcagggtatatcagttgtggtaatgtccatggccacctttgcaagctccagatccagaccttttgggacagcggtg

SEQ ID NO: 5056 - DNA, 140 bp, Artificial Sequence
  Synthetic
caccgctgtcccaaaaggtctggatctggagcttgcaaaggtggccatggacattaccacaactgatataccctgcacttcgtacctagagtataccgctttctccagctcatcaattagcatatcagcagccagggcct

SEQ ID NO: 5057 - DNA, 140 bp, Artificial Sequence
  Synthetic
aggccctggctgctgatatgggtacggtgcacgtgccgtactctcaggcaccatctggcttcaagtattggctaaaagaacgaggggcgtcgctgcagcatacagcaccatttggctgtcgaccttttgggacagcggtg

SEQ ID NO: 5058 - DNA, 140 bp, Artificial Sequence
  Synthetic
caccgctgtcccaaaaggtcgacagccaaatggtgctgtatgctgcagcgacgcccctcgttcttttagccaatacttgaagccagatggtgcctgagagtacggcacgtgcaccgtacccatatcagcagccagggcct

SEQ ID NO: 5059 - DNA, 140 bp, Artificial Sequence
  Synthetic
atacgccatgctgggtctccactcctgtcctaccggaatatgggagaagaaccaaactatcaagaagagtgggtgatgcataagaagaaagtcgtgctaaccgtgccgactgaagggctccgtacttgggagtcggccat

SEQ ID NO: 5060 - DNA, 140 bp, Artificial Sequence
  Synthetic
atggccgactcccaagtacggagcccttcagtcggcacggttagcacgactttcttcttatgcatcacccactcttcttgatagtttggttcttctcccatattccggtaggacaggagtggagacccagcatggcgtat

SEQ ID NO: 5061 - DNA, 140 bp, Artificial Sequence
  Synthetic
atacgccatgctgggtctcctactgcttctgcgacgctgaaaacacgcagttgagcgaagcacatgtggagaagtccgaatcatgcaaaacaggatttgcatcagcatacagggctcatacgtacttgggagtcggccat

SEQ ID NO: 5062 - DNA, 140 bp, Artificial Sequence
  Synthetic
atggccgactcccaagtacgtatgagccctgtatgctgatgcaaatcctgttttgcatgattcggacttctccacatgtgcttcgctcaactgcgtgttttcagcgtcgcagaagcagtaggagacccagcatggcgtat

SEQ ID NO: 5063 - DNA, 140 bp, Artificial Sequence
  Synthetic
aggccctggctgctgatatggccatctttaacggatatgtcgtgtgaggtgtcagcctgcacccattcctcagactttgggggcgtagccatcattaaatatacagccagtaagaaaggcgaccttttgggacagcggtg

SEQ ID NO: 5064 - DNA, 140 bp, Artificial Sequence
  Synthetic
caccgctgtcccaaaaggtcgcctttcttactggctgtatatttaatgatggctacgcccccaaagtctgaggaatgggtgcaggctgacacctcacacgacatatccgttaaagatggccatatcagcagccagggcct

SEQ ID NO: 5065 - DNA, 140 bp, Artificial Sequence
  Synthetic
atacgccatgctgggtctccgcagccgagtgccacccaccgaaagaccatatagtcaattacccggcgtcacacaccacccccggggttcaagacatttccgctacggcgatgtcatgggcgtacttgggagtcggccat

SEQ ID NO: 5066 - DNA, 140 bp, Artificial Sequence
  Synthetic
atggccgactcccaagtacgcccatgacatcgccgtagcggaaatgtcttgaaccccgggggtggtgtgtgacgccgggtaattgactatatggtctttcggtgggtggcactcggctgcggagacccagcatggcgtat

SEQ ID NO: 5067 - DNA, 140 bp, Artificial Sequence
  Synthetic
aggccctggctgctgatatggtgcagctgagtgccaccccccaaaggaccacatagtcaactacccggcgtcacataccgccctcggggtccaggacatctccgctacggcgatgtcatggaccttttgggacagcggtg

SEQ ID NO: 5068 - DNA, 140 bp, Artificial Sequence
  Synthetic
caccgctgtcccaaaaggtccatgacatcgccgtagcggagatgtcctggaccccgagggcggtatgtgacgccgggtagttgactatgtggtcctttggggggtggcactcagctgcaccatatcagcagccagggcct

SEQ ID NO: 5069 - DNA, 140 bp, Artificial Sequence
  Synthetic
aggccctggctgctgatatgccttgaatgcgcgcagatacccgtgcacatgaagtccgacgcttcgaagttcacccatgagaaaccggaggggtactacaactggcaccacggagcagtagaccttttgggacagcggtg

SEQ ID NO: 5070 - DNA, 140 bp, Artificial Sequence
  Synthetic
caccgctgtcccaaaaggtctactgctccgtggtgccagttgtagtacccctccggtttctcatgggtgaacttcgaagcgtcggacttcatgtgcacgggtatctgcgcgcattcaaggcatatcagcagccagggcct

SEQ ID NO: 5071 - DNA, 140 bp, Artificial Sequence
  Synthetic
aggccctggctgctgatatgggttgggttcgacacaaccccgttcatgtacaatgccatggcgggtgcctacccctcgtactcgacaaactgggcagatgagcaggtactgaaggctaaggaccttttgggacagcggtg

SEQ ID NO: 5072 - DNA, 140 bp, Artificial Sequence
  Synthetic
caccgctgtcccaaaaggtccttagccttcagtacctgctcatctgcccagtttgtcgagtacgaggggtaggcacccgccatggcattgtacatgaacggggttgtgtcgaacccaacccatatcagcagccagggcct

SEQ ID NO: 5073 - DNA, 140 bp, Artificial Sequence
  Synthetic
aggccctggctgctgatatgcagtactcaggaggccggttcaccatccctacaggtgctggcaaaccaggggacagcggcagaccgatcttcgacaacaagggacgcgtggtggccataggaccttttgggacagcggtg

SEQ ID NO: 5074 - DNA, 140 bp, Artificial Sequence
  Synthetic
caccgctgtcccaaaaggtcctatggccaccacgcgtcccttgttgtcgaagatcggtctgccgctgtcccctggtttgccagcacctgtagggatggtgaaccggcctcctgagtactgcatatcagcagccagggcct

SEQ ID NO: 5075 - DNA, 140 bp, Artificial Sequence
  Synthetic
atacgccatgctgggtctccagaatcaatagataagtatagtaacaaaatataaaaatcaacaaaaatcataaaatagaaaactagaaacagaagtaggtaagaaggtatatgtgtcccccgtacttgggagtcggccat

SEQ ID NO: 5076 - DNA, 140 bp, Artificial Sequence
  Synthetic
atggccgactcccaagtacgggggacacatataccttcttacctacttctgtttctagttttctattttatgatttttgttgatttttatattttgttactatacttatctattgattctggagacccagcatggcgtat

SEQ ID NO: 5077 - DNA, 140 bp, Artificial Sequence
  Synthetic
aggccctggctgctgatatgtcacccatgagaaaccggaggggtactacaactggcaccacggagcagtacagtactcaggaggccggttcaccatccctacaggtgctggcaaaccagggaccttttgggacagcggtg

SEQ ID NO: 5078 - DNA, 140 bp, Artificial Sequence
  Synthetic
caccgctgtcccaaaaggtccctggtttgccagcacctgtagggatggtgaaccggcctcctgagtactgtactgctccgtggtgccagttgtagtacccctccggtttctcatgggtgacatatcagcagccagggcct

SEQ ID NO: 5079 - DNA, 140 bp, Artificial Sequence
  Synthetic
aggccctggctgctgatatgtgagagacacaccatatatagctaagaatcaatagataagcatagatcaaagggctgaataacccctgaatagtaacaaaatataaaaaccaataaaaatgaccttttgggacagcggtg

SEQ ID NO: 5080 - DNA, 140 bp, Artificial Sequence
  Synthetic
caccgctgtcccaaaaggtcatttttattggtttttatattttgttactattcaggggttattcagccctttgatctatgcttatctattgattcttagctatatatggtgtgtctctcacatatcagcagccagggcct

SEQ ID NO: 5081 - DNA, 140 bp, Artificial Sequence
  Synthetic
atacgccatgctgggtctccataactcccctctggtcccgcgtaatgctgaacttggggaccgacaaggaaaaattcacatcccgtttccgctggcaaatgtaacatgtagggtgcctaacgtacttgggagtcggccat

SEQ ID NO: 5082 - DNA, 140 bp, Artificial Sequence
  Synthetic
atggccgactcccaagtacgttaggcaccctacatgttacatttgccagcggaaacgggatgtgaatttttccttgtcggtccccaagttcagcattacgcgggaccagaggggagttatggagacccagcatggcgtat

SEQ ID NO: 5083 - DNA, 140 bp, Artificial Sequence
  Synthetic
atacgccatgctgggtctccagcaaggaaccccaccgtgacgtacgggaaaaaccaagtcatcatgctactgtatcctgaccacccaacactcctgtcctaccggaacatgggagaagaacgtacttgggagtcggccat

SEQ ID NO: 5084 - DNA, 140 bp, Artificial Sequence
  Synthetic
atggccgactcccaagtacgttcttctcccatgttccggtaggacaggagtgttgggtggtcaggatacagtagcatgatgacttggtttttcccgtacgtcacggtggggttccttgctggagacccagcatggcgtat

SEQ ID NO: 5085 - DNA, 140 bp, Artificial Sequence
  Synthetic
atacgccatgctgggtctcccataaaatagaaaaccataaacagaagtagttcaaagggctataaaacccctgaatagtaacaaaatataaaactaacaaaaatcaaacgaataccataacgtacttgggagtcggccat

SEQ ID NO: 5086 - DNA, 140 bp, Artificial Sequence
  Synthetic
atggccgactcccaagtacgttatggtattcgtttgatttttgttagttttatattttgttactattcaggggttttatagccctttgaactacttctgtttatggttttctattttatgggagacccagcatggcgtat

SEQ ID NO: 5087 - DNA, 140 bp, Artificial Sequence
  Synthetic
aggccctggctgctgatatgggacagcggcagaccgatcttcgacaacaagggacgcgtggtggccatagtcttaggaggagctaatgaaggagcccgtacagccctctcggtggtgaccgaccttttgggacagcggtg

SEQ ID NO: 5088 - DNA, 140 bp, Artificial Sequence
  Synthetic
caccgctgtcccaaaaggtcggtcaccaccgagagggctgtacgggctccttcattagctcctcctaagactatggccaccacgcgtcccttgttgtcgaagatcggtctgccgctgtcccatatcagcagccagggcct

SEQ ID NO: 5089 - DNA, 140 bp, Artificial Sequence
  Synthetic
aggccctggctgctgatatgctcgctttgagatgtaggcgtagcacaccgaactcttccataattctccgaacccacagggacgtaggagatgttcaaagtgactataaaaaccctgaacgaccttttgggacagcggtg

SEQ ID NO: 5090 - DNA, 140 bp, Artificial Sequence
  Synthetic
caccgctgtcccaaaaggtcgttcagggtttttatagtcactttgaacatctcctacgtccctgtgggttcggagaattatggaagagttcggtgtgctacgcctacatctcaaagcgagcatatcagcagccagggcct

SEQ ID NO: 5091 - DNA, 140 bp, Artificial Sequence
  Synthetic
aggccctggctgctgatatgcccgactgtggagaagggcactcgtgccatagtcccgtagcactagaacgcatcagaaatgaagcgacagacgggacgctgaaaatccaggtctccttgcgaccttttgggacagcggtg

SEQ ID NO: 5092 - DNA, 140 bp, Artificial Sequence
  Synthetic
caccgctgtcccaaaaggtcgcaaggagacctggattttcagcgtcccgtctgtcgcttcatttctgatgcgttctagtgctacgggactatggcacgagtgcccttctccacagtcgggcatatcagcagccagggcct

SEQ ID NO: 5093 - DNA, 140 bp, Artificial Sequence
  Synthetic
aggccctggctgctgatatgagtaataaaacataaaattaataatgagtaccataattggcaaacggaagagacgtaggtactaagcttcctaaaagcagccgaactcactttgagatgtgaccttttgggacagcggtg

SEQ ID NO: 5094 - DNA, 140 bp, Artificial Sequence
  Synthetic
caccgctgtcccaaaaggtcacatctcaaagtgagttcggctgcttttaggaagcttagtacctacgtctcttccgtttgccaattatggtactcattattaattttatgttttattactcatatcagcagccagggcct

SEQ ID NO: 5095 - DNA, 140 bp, Artificial Sequence
  Synthetic
aggccctggctgctgatatgaggacaacttcaatgtctataaagccacaagaccatacttagctcactgtcccgactgtggagaagggcactcgtgccatagtcccgtagcactagaacggaccttttgggacagcggtg

SEQ ID NO: 5096 - DNA, 140 bp, Artificial Sequence
  Synthetic
caccgctgtcccaaaaggtccgttctagtgctacgggactatggcacgagtgcccttctccacagtcgggacagtgagctaagtatggtcttgtggctttatagacattgaagttgtcctcatatcagcagccagggcct

SEQ ID NO: 5097 - DNA, 140 bp, Artificial Sequence
  Synthetic
aggccctggctgctgatatggccgaactcactttgagatgtaggcatagcataccgaactcttccacaattctccgaacccatagggacgtaggagatgttattttgtttttaatatttcgaccttttgggacagcggtg

SEQ ID NO: 5098 - DNA, 140 bp, Artificial Sequence
  Synthetic
caccgctgtcccaaaaggtcgaaatattaaaaacaaaataacatctcctacgtccctatgggttcggagaattgtggaagagttcggtatgctatgcctacatctcaaagtgagttcggccatatcagcagccagggcct

SEQ ID NO: 5099 - DNA, 140 bp, Artificial Sequence
  Synthetic
atacgccatgctgggtctccaaaaaaacagaaaaatacataaataggtatacgtgtcccctaagagacacattgtatgtaggtgataagtatagatcaaagggccgaataacccctgaatcgtacttgggagtcggccat

SEQ ID NO: 5100 - DNA, 140 bp, Artificial Sequence
  Synthetic
atggccgactcccaagtacgattcaggggttattcggccctttgatctatacttatcacctacatacaatgtgtctcttaggggacacgtatacctatttatgtatttttctgtttttttggagacccagcatggcgtat

SEQ ID NO: 5101 - DNA, 140 bp, Artificial Sequence
  Synthetic
aggccctggctgctgatatgtttgaaggccctgcaacgtgcgtaccccatgtttgaggtggaacctaggcaggtcacaccgaatgaccatgctaatgctagagcgttttcgcatctagctgaccttttgggacagcggtg

SEQ ID NO: 5102 - DNA, 140 bp, Artificial Sequence
  Synthetic
caccgctgtcccaaaaggtcagctagatgcgaaaacgctctagcattagcatggtcattcggtgtgacctgcctaggttccacctcaaacatggggtacgcacgttgcagggccttcaaacatatcagcagccagggcct

SEQ ID NO: 5103 - DNA, 140 bp, Artificial Sequence
  Synthetic
atacgccatgctgggtctccaaatcggaataaagacggatgacagccacgattggaccaagctgcgttatatggacaaccacatgccagcagacgcagagagggcggggctatttgtaagcgtacttgggagtcggccat

SEQ ID NO: 5104 - DNA, 140 bp, Artificial Sequence
  Synthetic
atggccgactcccaagtacgcttacaaatagccccgccctctctgcgtctgctggcatgtggttgtccatataacgcagcttggtccaatcgtggctgtcatccgtctttattccgatttggagacccagcatggcgtat

SEQ ID NO: 5105 - DNA, 140 bp, Artificial Sequence
  Synthetic
aggccctggctgctgatatgaggtcgggaaaaattccattcccgaccgcagcacggtaaagagctaccttgcagcacgtacgtgcagagtaccgccgcaactaccgaggagatagaggtagaccttttgggacagcggtg

SEQ ID NO: 5106 - DNA, 140 bp, Artificial Sequence
  Synthetic
caccgctgtcccaaaaggtctacctctatctcctcggtagttgcggcggtactctgcacgtacgtgctgcaaggtagctctttaccgtgctgcggtcgggaatggaatttttcccgacctcatatcagcagccagggcct

SEQ ID NO: 5107 - DNA, 140 bp, Artificial Sequence
  Synthetic
atacgccatgctgggtctccagaaagctagcatctgccgcaggaaaagtcctggacagaaacatatctggaaagatcggggacttacaagcagtaatggccgtgccagacacggagacaccgtacttgggagtcggccat

SEQ ID NO: 5108 - DNA, 140 bp, Artificial Sequence
  Synthetic
atggccgactcccaagtacggtgtctccgtgtctggcacggccattactgcttgtaagtccccgatctttccagatatgtttctgtccaggacttttcctgcggcagatgctagctttctggagacccagcatggcgtat

SEQ ID NO: 5109 - DNA, 140 bp, Artificial Sequence
  Synthetic
atacgccatgctgggtctccagaaagctagcatctgccgcaggaaaagtcctggacagaaacatttctggaaagatcggggacttacaagcagtaatggccgtgccagacacggagacaccgtacttgggagtcggccat

SEQ ID NO: 5110 - DNA, 140 bp, Artificial Sequence
  Synthetic
atggccgactcccaagtacggtgtctccgtgtctggcacggccattactgcttgtaagtccccgatctttccagaaatgtttctgtccaggacttttcctgcggcagatgctagctttctggagacccagcatggcgtat

SEQ ID NO: 5111 - DNA, 140 bp, Artificial Sequence
  Synthetic
atacgccatgctgggtctccagaaagctagcatctgccgcaggaaaagtcctggacagaaacatctctggaaagatcggggacttacaagcagtaatggccgtgccagacacggagacaccgtacttgggagtcggccat

SEQ ID NO: 5112 - DNA, 140 bp, Artificial Sequence
  Synthetic
atggccgactcccaagtacggtgtctccgtgtctggcacggccattactgcttgtaagtccccgatctttccagagatgtttctgtccaggacttttcctgcggcagatgctagctttctggagacccagcatggcgtat

SEQ ID NO: 5113 - DNA, 140 bp, Artificial Sequence
  Synthetic
atacgccatgctgggtctccagaaagctagcatctgccgcaggaaaagtcctggacagaaacatgtctggaaagatcggggacttacaagcagtaatggccgtgccagacacggagacaccgtacttgggagtcggccat

SEQ ID NO: 5114 - DNA, 140 bp, Artificial Sequence
  Synthetic
atggccgactcccaagtacggtgtctccgtgtctggcacggccattactgcttgtaagtccccgatctttccagacatgtttctgtccaggacttttcctgcggcagatgctagctttctggagacccagcatggcgtat

SEQ ID NO: 5115 - DNA, 140 bp, Artificial Sequence
  Synthetic
atacgccatgctgggtctcccaacattctgcttacacacagatgtctcatgtagacagagagcagacgttgcgatatatcaagacgtctacgctgtacacgcacccacgtcgctataccacgtacttgggagtcggccat

SEQ ID NO: 5116 - DNA, 140 bp, Artificial Sequence
  Synthetic
atggccgactcccaagtacgtggtatagcgacgtgggtgcgtgtacagcgtagacgtcttgatatatcgcaacgtctgctctctgtctacatgagacatctgtgtgtaagcagaatgttgggagacccagcatggcgtat

SEQ ID NO: 5117 - DNA, 140 bp, Artificial Sequence
  Synthetic
aggccctggctgctgatatgaaagatcggggacttacaagcagtaatggccgtgccagacacggagacaccaacattctgcttacacacagatgtctcatgtagacagagagcagacgttgaccttttgggacagcggtg

SEQ ID NO: 5118 - DNA, 140 bp, Artificial Sequence
  Synthetic
caccgctgtcccaaaaggtcaacgtctgctctctgtctacatgagacatctgtgtgtaagcagaatgttggtgtctccgtgtctggcacggccattactgcttgtaagtccccgatctttcatatcagcagccagggcct

SEQ ID NO: 5119 - DNA, 140 bp, Artificial Sequence
  Synthetic
atacgccatgctgggtctccgcggtggctcaaatgaaggactaacgactacagacaaagtgattaataactgcaagattgatcaatgtcatgccgcggtcaccaatcacaaaaaatggcacgtacttgggagtcggccat

SEQ ID NO: 5120 - DNA, 140 bp, Artificial Sequence
  Synthetic
atggccgactcccaagtacgtgccattttttgtgattggtgaccgcggcatgacattgatcaatcttgcagttattaatcactttgtctgtagtcgttagtccttcatttgagccaccgcggagacccagcatggcgtat

SEQ ID NO: 5121 - DNA, 140 bp, Artificial Sequence
  Synthetic
atacgccatgctgggtctcccgtgcgaaggctacgtcgtcaagagaataacgatgagcccaggcctttacggaaaaaccacagggtatgcggtaacccaccacgcagacggatttctgatcgtacttgggagtcggccat

SEQ ID NO: 5122 - DNA, 140 bp, Artificial Sequence
  Synthetic
atggccgactcccaagtacgatcagaaatccgtctgcgtggtgggttaccgcataccctgtggtttttccgtaaaggcctgggctcatcgttattctcttgacgacgtagccttcgcacgggagacccagcatggcgtat

SEQ ID NO: 5123 - DNA, 140 bp, Artificial Sequence
  Synthetic
atacgccatgctgggtctccaagaagacaaagcatactcacctgaagtagccctgaatgaaatatgcacgcgcatgtatggggtggatctagacagcgggctattttctaaaccgttggtcgtacttgggagtcggccat

SEQ ID NO: 5124 - DNA, 140 bp, Artificial Sequence
  Synthetic
atggccgactcccaagtacgaccaacggtttagaaaatagcccgctgtctagatccaccccatacatgcgcgtgcatatttcattcagggctacttcaggtgagtatgctttgtcttcttggagacccagcatggcgtat

SEQ ID NO: 5125 - DNA, 140 bp, Artificial Sequence
  Synthetic
aggccctggctgctgatatggcacgtacgtgccggcgaccatttgtgatcaaatgaccggcatccttgctacagaagtcacgccggaggatgcacagaagctgctggtggggctgaaccagaccttttgggacagcggtg

SEQ ID NO: 5126 - DNA, 140 bp, Artificial Sequence
  Synthetic
caccgctgtcccaaaaggtctggttcagccccaccagcagcttctgtgcatcctccggcgtgacttctgtagcaaggatgccggtcatttgatcacaaatggtcgccggcacgtacgtgccatatcagcagccagggcct

SEQ ID NO: 5127 - DNA, 140 bp, Artificial Sequence
  Synthetic
aggccctggctgctgatatgcctacgcatgcttgaggacaacgtcatgagacctgggtactatcagctgctacaagtatccttaacatgttctccccaccgccagcgacgcagcaccaaggaccttttgggacagcggtg

SEQ ID NO: 5128 - DNA, 140 bp, Artificial Sequence
  Synthetic
caccgctgtcccaaaaggtccttggtgctgcgtcgctggcggtggggagaacatgttaaggatacttgtagcagctgatagtacccaggtctcatgacgttgtcctcaagcatgcgtaggcatatcagcagccagggcct

SEQ ID NO: 5129 - DNA, 140 bp, Artificial Sequence
  Synthetic
aggccctggctgctgatatgactatctgcttcccgtggtcgcccaagccttcagtaagtgggcaaaggagtgccggaaagacatggaagatgaaaaacccctgggggtcagagaaagaacgaccttttgggacagcggtg

SEQ ID NO: 5130 - DNA, 140 bp, Artificial Sequence
  Synthetic
caccgctgtcccaaaaggtcgttctttctctgacccccaggggtttttcatcttccatgtctttccggcactcctttgcccacttactgaaggcttgggcgaccacgggaagcagatagtcatatcagcagccagggcct

SEQ ID NO: 5131 - DNA, 140 bp, Artificial Sequence
  Synthetic
atacgccatgctgggtctccatcagaataaagacggatgacagccacgattggaccaagctgcgttatatggacaatcacatgccagcagacgcagagagggcggggctatttgtaagaacgtacttgggagtcggccat

SEQ ID NO: 5132 - DNA, 140 bp, Artificial Sequence
  Synthetic
atggccgactcccaagtacgttcttacaaatagccccgccctctctgcgtctgctggcatgtgattgtccatataacgcagcttggtccaatcgtggctgtcatccgtctttattctgatggagacccagcatggcgtat

SEQ ID NO: 5133 - DNA, 140 bp, Artificial Sequence
  Synthetic
aggccctggctgctgatatgactgacctgctgctgtctatgggcatttaagaagcagaaaacacacacggtctacaaaaggcctgatacccagtcaattcagaaggttcaggccgagtttgaccttttgggacagcggtg

SEQ ID NO: 5134 - DNA, 140 bp, Artificial Sequence
  Synthetic
caccgctgtcccaaaaggtcaaactcggcctgaaccttctgaattgactgggtatcaggccttttgtagaccgtgtgtgttttctgcttcttaaatgcccatagacagcagcaggtcagtcatatcagcagccagggcct

SEQ ID NO: 5135 - DNA, 140 bp, Artificial Sequence
  Synthetic
aggccctggctgctgatatgaccgtgccgactgaagggctcgaggtcacgtggggcaacaacgagccgtataagtattggccgcagttatctacaaatggtacagcccatggccacccgcgaccttttgggacagcggtg

SEQ ID NO: 5136 - DNA, 140 bp, Artificial Sequence
  Synthetic
caccgctgtcccaaaaggtcgcgggtggccatgggctgtaccatttgtagataactgcggccaatacttatacggctcgttgttgccccacgtgacctcgagcccttcagtcggcacggtcatatcagcagccagggcct

SEQ ID NO: 5137 - DNA, 140 bp, Artificial Sequence
  Synthetic
aggccctggctgctgatatgaccccatgtttgaggtggaaccaaggcaggtcacaccgaatgaccatgctaatgctagagcgttctcgcatctagctataaaactaatagagcaggaaatgaccttttgggacagcggtg

SEQ ID NO: 5138 - DNA, 140 bp, Artificial Sequence
  Synthetic
caccgctgtcccaaaaggtcatttcctgctctattagttttatagctagatgcgagaacgctctagcattagcatggtcattcggtgtgacctgccttggttccacctcaaacatggggtcatatcagcagccagggcct

SEQ ID NO: 5139 - DNA, 140 bp, Artificial Sequence
  Synthetic
aggccctggctgctgatatgaatgctagagcgttctcgcatctagctataaaactaatagagcaggaaattgaccccgactcaaccatcctggatatcggcagtgcgccagcaaggaggagaccttttgggacagcggtg

SEQ ID NO: 5140 - DNA, 140 bp, Artificial Sequence
  Synthetic
caccgctgtcccaaaaggtctcctccttgctggcgcactgccgatatccaggatggttgagtcggggtcaatttcctgctctattagttttatagctagatgcgagaacgctctagcattcatatcagcagccagggcct

SEQ ID NO: 5141 - DNA, 140 bp, Artificial Sequence
  Synthetic
atacgccatgctgggtctccgacagcttcgtggtaccgagcctgtggtcgtccgggctgtcaatcccgctgaggactagaatcaaatggttgttaagcaaggtgccaaaaaccgacctgacgtacttgggagtcggccat

SEQ ID NO: 5142 - DNA, 140 bp, Artificial Sequence
  Synthetic
atggccgactcccaagtacgtcaggtcggtttttggcaccttgcttaacaaccatttgattctagtcctcagcgggattgacagcccggacgaccacaggctcggtaccacgaagctgtcggagacccagcatggcgtat

SEQ ID NO: 5143 - DNA, 140 bp, Artificial Sequence
  Synthetic
aggccctggctgctgatatgacagctaaagcggccacataccaagaggctgcgatatacctgtggaacgagcagcaacctttgttttggctacaagcccttattccgctggcagccctgagaccttttgggacagcggtg

SEQ ID NO: 5144 - DNA, 140 bp, Artificial Sequence
  Synthetic
caccgctgtcccaaaaggtctcagggctgccagcggaataagggcttgtagccaaaacaaaggttgctgctcgttccacaggtatatcgcagcctcttggtatgtggccgctttagctgtcatatcagcagccagggcct

SEQ ID NO: 5145 - DNA, 140 bp, Artificial Sequence
  Synthetic
atacgccatgctgggtctccgaggaagaacgagaagcagaactgactcgtgaagccctaccacctcttcaggcagcacaggaagatgttcaggtcgaaatcgacgtggaacagcttgaggcgtacttgggagtcggccat

SEQ ID NO: 5146 - DNA, 140 bp, Artificial Sequence
  Synthetic
atggccgactcccaagtacgcctcaagctgttccacgtcgatttcgacctgaacatcttcctgtgctgcctgaagaggtggtagggcttcacgagtcagttctgcttctcgttcttcctcggagacccagcatggcgtat

SEQ ID NO: 5147 - DNA, 140 bp, Artificial Sequence
  Synthetic
atacgccatgctgggtctccggggatgtgcatgtgtgcacgacgcagatgcatcacaccgtatgaactgacaccaggagctaccgttcctttcctgcttagcctaatatgctgcatcagacgtacttgggagtcggccat

SEQ ID NO: 5148 - DNA, 140 bp, Artificial Sequence
  Synthetic
atggccgactcccaagtacgtctgatgcagcatattaggctaagcaggaaaggaacggtagctcctggtgtcagttcatacggtgtgatgcatctgcgtcgtgcacacatgcacatccccggagacccagcatggcgtat

SEQ ID NO: 5149 - DNA, 140 bp, Artificial Sequence
  Synthetic
aggccctggctgctgatatggaggactagaatcaaatggttgttaagcaaggtgccaaaaaccgacctgaccccatacagcggggacgcccaagaagcgcgggacgcagaaaaagaagcagaccttttgggacagcggtg

SEQ ID NO: 5150 - DNA, 140 bp, Artificial Sequence
  Synthetic
caccgctgtcccaaaaggtctgcttctttttctgcgtcccgcgcttcttgggcgtccccgctgtatggggtcaggtcggtttttggcaccttgcttaacaaccatttgattctagtcctccatatcagcagccagggcct

SEQ ID NO: 5151 - DNA, 140 bp, Artificial Sequence
  Synthetic
aggccctggctgctgatatgactgcccaaccaacagaccacgtcgtgggagagtacttggttctttccccgcagaccgtactacgtagccaaaagcttagtctgattcacgctttggcgggaccttttgggacagcggtg

SEQ ID NO: 5152 - DNA, 140 bp, Artificial Sequence
  Synthetic
caccgctgtcccaaaaggtcccgccaaagcgtgaatcagactaagcttttggctacgtagtacggtctgcggggaaagaaccaagtactctcccacgacgtggtctgttggttgggcagtcatatcagcagccagggcct

SEQ ID NO: 5153 - DNA, 140 bp, Artificial Sequence
  Synthetic
atacgccatgctgggtctccgaattcgcatatgaagggctaaaaatccgccctgcctgcccatacaaaattgcagtcataggagtctttggagtaccaggatctggcaagtcagctattacgtacttgggagtcggccat

SEQ ID NO: 5154 - DNA, 140 bp, Artificial Sequence
  Synthetic
atggccgactcccaagtacgtaatagctgacttgccagatcctggtactccaaagactcctatgactgcaattttgtatgggcaggcagggcggatttttagcccttcatatgcgaattcggagacccagcatggcgtat

SEQ ID NO: 5155 - DNA, 140 bp, Artificial Sequence
  Synthetic
aggccctggctgctgatatggtcactttggagccaacactatcgcttgattacatcacgtgcgagtacaaaaccgtcatcccgtctccgtacgtgaagtgctgcggtacagcagagtgcagaccttttgggacagcggtg

SEQ ID NO: 5156 - DNA, 140 bp, Artificial Sequence
  Synthetic
caccgctgtcccaaaaggtctgcactctgctgtaccgcagcacttcacgtacggagacgggatgacggttttgtactcgcacgtgatgtaatcaagcgatagtgttggctccaaagtgaccatatcagcagccagggcct

SEQ ID NO: 5157 - DNA, 140 bp, Artificial Sequence
  Synthetic
aggccctggctgctgatatgtggcgtactgggttgggttcgacacaaccccgttcatgtacaatgccatggcgggtgcctacccctcatactcgacaaactgggcagatgagcaggtactgaccttttgggacagcggtg

SEQ ID NO: 5158 - DNA, 140 bp, Artificial Sequence
  Synthetic
caccgctgtcccaaaaggtcagtacctgctcatctgcccagtttgtcgagtatgaggggtaggcacccgccatggcattgtacatgaacggggttgtgtcgaacccaacccagtacgccacatatcagcagccagggcct

SEQ ID NO: 5159 - DNA, 140 bp, Artificial Sequence
  Synthetic
atacgccatgctgggtctcctcaagaacctagttaccaggcaagacctggtgactagcggaaagaaagaaaactgccaagaaattaccaccgacgtgatgagacagagaggtctagagatcgtacttgggagtcggccat

SEQ ID NO: 5160 - DNA, 140 bp, Artificial Sequence
  Synthetic
atggccgactcccaagtacgatctctagacctctctgtctcatcacgtcggtggtaatttcttggcagttttctttctttccgctagtcaccaggtcttgcctggtaactaggttcttgaggagacccagcatggcgtat

SEQ ID NO: 5161 - DNA, 140 bp, Artificial Sequence
  Synthetic
aggccctggctgctgatatggatcccgagagactcgctaattatgcgagaaagctagcatctgccgcaggaaaagtcctggacagaaacatctctggaaagatcggggacttacaagcaggaccttttgggacagcggtg

SEQ ID NO: 5162 - DNA, 140 bp, Artificial Sequence
  Synthetic
caccgctgtcccaaaaggtcctgcttgtaagtccccgatctttccagagatgtttctgtccaggacttttcctgcggcagatgctagctttctcgcataattagcgagtctctcgggatccatatcagcagccagggcct

SEQ ID NO: 5163 - DNA, 140 bp, Artificial Sequence
  Synthetic
aggccctggctgctgatatgaatgcgcactacgaatgagtacaacaagccgattgtagtggatactacaggctcaacaaaacctgaccctggagacctcgtgttaacgtgcttcagaggagaccttttgggacagcggtg

SEQ ID NO: 5164 - DNA, 140 bp, Artificial Sequence
  Synthetic
caccgctgtcccaaaaggtctcctctgaagcacgttaacacgaggtctccagggtcaggttttgttgagcctgtagtatccactacaatcggcttgttgtactcattcgtagtgcgcattcatatcagcagccagggcct

SEQ ID NO: 5165 - DNA, 140 bp, Artificial Sequence
  Synthetic
atacgccatgctgggtctccaagttaacgaaaacccgctttatgcatcaatgtcagagcacgtcaacgtactcctaacgcgtacggaaggtaaactggtatggaagacactctccggtgacgtacttgggagtcggccat

SEQ ID NO: 5166 - DNA, 140 bp, Artificial Sequence
  Synthetic
atggccgactcccaagtacgtcaccggagagtgtcttccataccagtttaccttccgtacgcgttaggagtacgttgacgtgctctgacattgatgcataaagcgggttttcgttaacttggagacccagcatggcgtat

SEQ ID NO: 5167 - DNA, 140 bp, Artificial Sequence
  Synthetic
aggccctggctgctgatatgtcacatgccgctgtgatacagtggtttcgtgtgagggctacgtcgttaagagaataacgatgagcccaggcctttatggaaaaaccacagggtatgcggtgaccttttgggacagcggtg

SEQ ID NO: 5168 - DNA, 140 bp, Artificial Sequence
  Synthetic
caccgctgtcccaaaaggtcaccgcataccctgtggtttttccataaaggcctgggctcatcgttattctcttaacgacgtagccctcacacgaaaccactgtatcacagcggcatgtgacatatcagcagccagggcct

SEQ ID NO: 5169 - DNA, 140 bp, Artificial Sequence
  Synthetic
aggccctggctgctgatatgtcacccgaagtagccctgaatgaaatatgcacgcgcatgtatggggtggacctagacagcgggctattttctaaaccgttggtgtctgtgtattacgcgggaccttttgggacagcggtg

SEQ ID NO: 5170 - DNA, 140 bp, Artificial Sequence
  Synthetic
caccgctgtcccaaaaggtcccgcgtaatacacagacaccaacggtttagaaaatagcccgctgtctaggtccaccccatacatgcgcgtgcatatttcattcagggctacttcgggtgacatatcagcagccagggcct

SEQ ID NO: 5171 - DNA, 140 bp, Artificial Sequence
  Synthetic
aggccctggctgctgatatggaggcagcatccattctagaaagaaagtatccatttacaaaagggaagtggaatatcaacaagcagatctgcgtgactaccaggaggatagaagacttcagaccttttgggacagcggtg

SEQ ID NO: 5172 - DNA, 140 bp, Artificial Sequence
  Synthetic
caccgctgtcccaaaaggtctgaagtcttctatcctcctggtagtcacgcagatctgcttgttgatattccacttcccttttgtaaatggatactttctttctagaatggatgctgcctccatatcagcagccagggcct

SEQ ID NO: 5173 - DNA, 140 bp, Artificial Sequence
  Synthetic
atacgccatgctgggtctcccaagataaacggccaccacgtactcctggtcagtggctataaccttgcactgcctactaagagagttacttgggtagcgccactaggtgtccgcggagcgcgtacttgggagtcggccat

SEQ ID NO: 5174 - DNA, 140 bp, Artificial Sequence
  Synthetic
atggccgactcccaagtacgcgctccgcggacacctagtggcgctacccaagtaactctcttagtaggcagtgcaaggttatagccactgaccaggagtacgtggtggccgtttatcttgggagacccagcatggcgtat

SEQ ID NO: 5175 - DNA, 140 bp, Artificial Sequence
  Synthetic
aggccctggctgctgatatgaacagtgcgtagaccacgcaatgaaactgcaaatgctcgggggtgactcattgagactgctcaaaccgggcggctctctactgatcagagcatatggttagaccttttgggacagcggtg

SEQ ID NO: 5176 - DNA, 140 bp, Artificial Sequence
  Synthetic
caccgctgtcccaaaaggtctaaccatatgctctgatcagtagagagccgcccggtttgagcagtctcaatgagtcacccccgagcatttgcagtttcattgcgtggtctacgcactgttcatatcagcagccagggcct

SEQ ID NO: 5177 - DNA, 140 bp, Artificial Sequence
  Synthetic
aggccctggctgctgatatggatcatctagagcgttgaaaccaccatgtgtcaccagcaacactgagatgttttttttattcagcaactttgacaatggcagaaggaatttcacaacccagaccttttgggacagcggtg

SEQ ID NO: 5178 - DNA, 140 bp, Artificial Sequence
  Synthetic
caccgctgtcccaaaaggtctgggttgtgaaattccttctgccattgtcaaagttgctgaataaaaaaaacatctcagtgttgctggtgacacatggtggtttcaacgctctagatgatccatatcagcagccagggcct

SEQ ID NO: 5179 - DNA, 140 bp, Artificial Sequence
  Synthetic
aggccctggctgctgatatggaagcccgggacgcagaaaaagaagcagaggaagaacgagaagcagaactgactcgcgaagccctaccacctctacaggcagcacaggaagatgttcagggaccttttgggacagcggtg

SEQ ID NO: 5180 - DNA, 140 bp, Artificial Sequence
  Synthetic
caccgctgtcccaaaaggtccctgaacatcttcctgtgctgcctgtagaggtggtagggcttcgcgagtcagttctgcttctcgttcttcctctgcttctttttctgcgtcccgggcttccatatcagcagccagggcct

SEQ ID NO: 5181 - DNA, 140 bp, Artificial Sequence
  Synthetic
aggccctggctgctgatatgcacatagtcaactacccggcgtcacataccaccctcggggtccaggacatctccgctacggcgatgtcatgggtgcagaagatcacgggaggtgtgggacgaccttttgggacagcggtg

SEQ ID NO: 5182 - DNA, 140 bp, Artificial Sequence
  Synthetic
caccgctgtcccaaaaggtcgtcccacacctcccgtgatcttctgcacccatgacatcgccgtagcggagatgtcctggaccccgagggtggtatgtgacgccgggtagttgactatgtgcatatcagcagccagggcct

SEQ ID NO: 5183 - DNA, 140 bp, Artificial Sequence
  Synthetic
aggccctggctgctgatatggacgaagagtgcgtagtcaacgccgccaaccctcgcgggttaccaggtgacggtgtttgcaaggcagtatacaaaaaatggccggagtcctttaagaacagaccttttgggacagcggtg

SEQ ID NO: 5184 - DNA, 140 bp, Artificial Sequence
  Synthetic
caccgctgtcccaaaaggtctgttcttaaaggactccggccattttttgtatactgccttgcaaacaccgtcacctggtaacccgcgagggttggcggcgttgactacgcactcttcgtccatatcagcagccagggcct

SEQ ID NO: 5185 - DNA, 140 bp, Artificial Sequence
  Synthetic
aggccctggctgctgatatggactgggagtaaatagtgtagctatacctctcctctccacaggtgtatactcaggagggaaagacaggctgacccaatcactgaaccacctctttacagcgaccttttgggacagcggtg

SEQ ID NO: 5186 - DNA, 140 bp, Artificial Sequence
  Synthetic
caccgctgtcccaaaaggtcgctgtaaagaggtggttcagtgattgggtcagcctgtctttccctcctgagtatacacctgtggagaggagaggtatagctacactatttactcccagtccatatcagcagccagggcct

SEQ ID NO: 5187 - DNA, 140 bp, Artificial Sequence
  Synthetic
aggccctggctgctgatatgtcgaaatcgacgtggaacagcttgaggacagagcgggcgcaggaataatagagactccgagaggagctatcaaagttactgcccaaccaacagaccacgtgaccttttgggacagcggtg

SEQ ID NO: 5188 - DNA, 140 bp, Artificial Sequence
  Synthetic
caccgctgtcccaaaaggtcacgtggtctgttggttgggcagtaactttgatagctcctctcggagtctctattattcctgcgcccgctctgtcctcaagctgttccacgtcgatttcgacatatcagcagccagggcct

SEQ ID NO: 5189 - DNA, 140 bp, Artificial Sequence
  Synthetic
aggccctggctgctgatatgacccctgaatagtaacaaaatacaaaatcactaaaaattataaaaacagaaaaatacataaataggtatacgtgtcccctaagagacacattgtatgtaggaccttttgggacagcggtg

SEQ ID NO: 5190 - DNA, 140 bp, Artificial Sequence
  Synthetic
caccgctgtcccaaaaggtcctacatacaatgtgtctcttaggggacacgtatacctatttatgtatttttctgtttttataatttttagtgattttgtattttgttactattcaggggtcatatcagcagccagggcct

SEQ ID NO: 5191 - DNA, 140 bp, Artificial Sequence
  Synthetic
atacgccatgctgggtctccaaagcgcggcgatggtgtataacgaaagagcgttcgtaaacagaaagctacaccatattgcgatgcacggaccagccctgaacaccgacgaagagtcgtacgtacttgggagtcggccat

SEQ ID NO: 5192 - DNA, 140 bp, Artificial Sequence
  Synthetic
atggccgactcccaagtacgtacgactcttcgtcggtgttcagggctggtccgtgcatcgcaatatggtgtagctttctgtttacgaacgctctttcgttatacaccatcgccgcgctttggagacccagcatggcgtat

SEQ ID NO: 5193 - DNA, 140 bp, Artificial Sequence
  Synthetic
aggccctggctgctgatatgggcagagctgtgtccagtcgtacaagaaacagcggagacgcgtgacacagctatgtctcttcaggcaccgccaagtaccgccacggaactgagtcacccggaccttttgggacagcggtg

SEQ ID NO: 5194 - DNA, 140 bp, Artificial Sequence
  Synthetic
caccgctgtcccaaaaggtccgggtgactcagttccgtggcggtacttggcggtgcctgaagagacatagctgtgtcacgcgtctccgctgtttcttgtacgactggacacagctctgcccatatcagcagccagggcct

SEQ ID NO: 5195 - DNA, 140 bp, Artificial Sequence
  Synthetic
aggccctggctgctgatatgacgtagcctaccagtttcttactgctctactctgcaaagcaagagattaataacccatcatggattctgtgtacgtggacatagacgctgacagcgccttgaccttttgggacagcggtg

SEQ ID NO: 5196 - DNA, 140 bp, Artificial Sequence
  Synthetic
caccgctgtcccaaaaggtcaaggcgctgtcagcgtctatgtccacgtacacagaatccatgatgggttattaatctcttgctttgcagagtagagcagtaagaaactggtaggctacgtcatatcagcagccagggcct

SEQ ID NO: 5197 - DNA, 140 bp, Artificial Sequence
  Synthetic
atacgccatgctgggtctccgccagtcagtgctgccggtgaacaccctggaggaagtccacgaggagaagtgttacccacccaagctggatgaagcaaaggagcaactactacttaagaacgtacttgggagtcggccat

SEQ ID NO: 5198 - DNA, 140 bp, Artificial Sequence
  Synthetic
atggccgactcccaagtacgttcttaagtagtagttgctcctttgcttcatccagcttgggtgggtaacacttctcctcgtggacttcctccagggtgttcaccggcagcactgactggcggagacccagcatggcgtat

SEQ ID NO: 5199 - DNA, 140 bp, Artificial Sequence
  Synthetic
aggccctggctgctgatatggacctggtgactagcggaaagaaagaaaactgccaagaaatcaccaccgacgtgatgagacagagaggtctagagatatctgcacgtacggttgactcgcgaccttttgggacagcggtg

SEQ ID NO: 5200 - DNA, 140 bp, Artificial Sequence
  Synthetic
caccgctgtcccaaaaggtcgcgagtcaaccgtacgtgcagatatctctagacctctctgtctcatcacgtcggtggtgatttcttggcagttttctttctttccgctagtcaccaggtccatatcagcagccagggcct

SEQ ID NO: 5201 - DNA, 140 bp, Artificial Sequence
  Synthetic
aggccctggctgctgatatgtttgaaggccctgcaacgtgcgtaccccatgtttgaggtggaacctaggcaggtcacatcgaatgaccatgctaatgctagagcgttctcgcatctagccgaccttttgggacagcggtg

SEQ ID NO: 5202 - DNA, 140 bp, Artificial Sequence
  Synthetic
caccgctgtcccaaaaggtcggctagatgcgagaacgctctagcattagcatggtcattcgatgtgacctgcctaggttccacctcaaacatggggtacgcacgttgcagggccttcaaacatatcagcagccagggcct

SEQ ID NO: 5203 - DNA, 140 bp, Artificial Sequence
  Synthetic
aggccctggctgctgatatgataaaactaatagagcaggaaattgatcccgactcaaccatcctggatataggtagtgcgccagcaaggaggatgatgtcggacaggaagtaccactgcggaccttttgggacagcggtg

SEQ ID NO: 5204 - DNA, 140 bp, Artificial Sequence
  Synthetic
caccgctgtcccaaaaggtccgcagtggtacttcctgtccgacatcatcctccttgctggcgcactacctatatccaggatggttgagtcgggatcaatttcctgctctattagttttatcatatcagcagccagggcct

SEQ ID NO: 5205 - DNA, 140 bp, Artificial Sequence
  Synthetic
atacgccatgctgggtctcctggcaacagcatacctatgtgggattcacagagagctggttaggaggctgaatgccgtcctcctacccaatgtacatacactatttgacatgtctgctgacgtacttgggagtcggccat

SEQ ID NO: 5206 - DNA, 140 bp, Artificial Sequence
  Synthetic
atggccgactcccaagtacgtcagcagacatgtcaaatagtgtatgtacattgggtaggaggacggcattcagcctcctaaccagctctctgtgaatcccacataggtatgctgttgccaggagacccagcatggcgtat

SEQ ID NO: 5207 - DNA, 140 bp, Artificial Sequence
  Synthetic
aggccctggctgctgatatgggaagatcgtctgacaaaatccgcgtgcgcagccttcatcggcgacgacaacataatacatggagtcgtctccgatggattgatggcagccagatgcgccgaccttttgggacagcggtg

SEQ ID NO: 5208 - DNA, 140 bp, Artificial Sequence
  Synthetic
caccgctgtcccaaaaggtcggcgcatctggctgccatcaatccatcggagacgactccatgtattatgttgtcgtcgccgatgaaggctgcgcacgcggattttgtcagacgatcttcccatatcagcagccagggcct

SEQ ID NO: 5209 - DNA, 140 bp, Artificial Sequence
  Synthetic
aggccctggctgctgatatgcgtgatgagacagagaggtctagagatatctgcacgtacggttgactcgctgctcttgaatggatgcaacagaccagtcgacgtgttgtacgtagacgaggaccttttgggacagcggtg

SEQ ID NO: 5210 - DNA, 140 bp, Artificial Sequence
  Synthetic
caccgctgtcccaaaaggtcctcgtctacgtacaacacgtcgactggtctgttgcatccattcaagagcagcgagtcaaccgtacgtgcagatatctctagacctctctgtctcatcacgcatatcagcagccagggcct

SEQ ID NO: 5211 - DNA, 140 bp, Artificial Sequence
  Synthetic
aggccctggctgctgatatgatatccggcgcctgtgtactcgcctccgattaacgtccgactgtccaaccccgagtccgcagtggcagcatgcaatgagttcttggctaggaactatccagaccttttgggacagcggtg

SEQ ID NO: 5212 - DNA, 140 bp, Artificial Sequence
  Synthetic
caccgctgtcccaaaaggtctggatagttcctagccaagaactcattgcatgctgccactgcggactcggggttggacagtcggacgttaatcggaggcgagtacacaggcgccggatatcatatcagcagccagggcct

SEQ ID NO: 5213 - DNA, 140 bp, Artificial Sequence
  Synthetic
aggccctggctgctgatatgacttggatgaacatggaagtgaagatcatagatgcagttgtatcccagaaagccccttacttttgtggagggtttatactgcacgataccgtgacaggtagaccttttgggacagcggtg

SEQ ID NO: 5214 - DNA, 140 bp, Artificial Sequence
  Synthetic
caccgctgtcccaaaaggtctacctgtcacggtatcgtgcagtataaaccctccacaaaagtaaggggctttctgggatacaactgcatctatgatcttcacttccatgttcatccaagtcatatcagcagccagggcct

SEQ ID NO: 5215 - DNA, 140 bp, Artificial Sequence
  Synthetic
atacgccatgctgggtctccacccgtcataactttgtacggcggtcctaaataggtacgcactacagctacctattttgcagaagccgacagcaagtacccaaacactaatcagctacaacgtacttgggagtcggccat

SEQ ID NO: 5216 - DNA, 140 bp, Artificial Sequence
  Synthetic
atggccgactcccaagtacgttgtagctgattagtgtttgggtacttgctgtcggcttctgcaaaataggtagctgtagtgcgtacctatttaggaccgccgtacaaagttatgacgggtggagacccagcatggcgtat

SEQ ID NO: 5217 - DNA, 140 bp, Artificial Sequence
  Synthetic
aggccctggctgctgatatgccaggcgattaaaggagtccgagtggcgtactgggtagggttcgacacaaccccgttcatgtacaacgctatggcgggtgcctacccctcatactcgacagaccttttgggacagcggtg

SEQ ID NO: 5218 - DNA, 140 bp, Artificial Sequence
  Synthetic
caccgctgtcccaaaaggtctgtcgagtatgaggggtaggcacccgccatagcgttgtacatgaacggggttgtgtcgaaccctacccagtacgccactcggactcctttaatcgcctggcatatcagcagccagggcct

SEQ ID NO: 5219 - DNA, 140 bp, Artificial Sequence
  Synthetic
atacgccatgctgggtctccgacctcgtgttaacgtgcttcagagggtgggttaaacaactgcaaattgactatcgtggatacgaggtcatgacagcaaccgcatcccaagggttaaccacgtacttgggagtcggccat

SEQ ID NO: 5220 - DNA, 140 bp, Artificial Sequence
  Synthetic
atggccgactcccaagtacgtggttaacccttgggatgcggttgctgtcatgacctcgtatccacgatagtcaatttgcagttgtttaacccaccctctgaagcacgttaacacgaggtcggagacccagcatggcgtat

SEQ ID NO: 5221 - DNA, 140 bp, Artificial Sequence
  Synthetic
atacgccatgctgggtctccggggtattacaactggcaccacggagcagtacagtactcaggaggccggttcaccatccctacaggtgcgggcaaaccaggggacagcggtagaccgatccgtacttgggagtcggccat

SEQ ID NO: 5222 - DNA, 140 bp, Artificial Sequence
  Synthetic
atggccgactcccaagtacggatcggtctaccgctgtcccctggtttgcccgcacctgtagggatggtgaaccggcctcctgagtactgtactgctccgtggtgccagttgtaataccccggagacccagcatggcgtat

SEQ ID NO: 5223 - DNA, 140 bp, Artificial Sequence
  Synthetic
atacgccatgctgggtctccaacagacctgacggaaggtagacgaggcaaattgtctattatgagagggaaaaagctaaaaccgtgcgaccgtgtgctgttctcagtagggtcaacgcttcgtacttgggagtcggccat

SEQ ID NO: 5224 - DNA, 140 bp, Artificial Sequence
  Synthetic
atggccgactcccaagtacgaagcgttgaccctactgagaacagcacacggtcgcacggttttagctttttccctctcataatagacaatttgcctcgtctaccttccgtcaggtctgttggagacccagcatggcgtat

SEQ ID NO: 5225 - DNA, 140 bp, Artificial Sequence
  Synthetic
aggccctggctgctgatatgaaaagctaaaaccgtgcgaccgtgtgctgttctcagtagggtcaacgctttacccggaaagccgcacgctacttaagagttggcacctaccatcggtgttgaccttttgggacagcggtg

SEQ ID NO: 5226 - DNA, 140 bp, Artificial Sequence
  Synthetic
caccgctgtcccaaaaggtcaacaccgatggtaggtgccaactcttaagtagcgtgcggctttccgggtaaagcgttgaccctactgagaacagcacacggtcgcacggttttagcttttcatatcagcagccagggcct

SEQ ID NO: 5227 - DNA, 140 bp, Artificial Sequence
  Synthetic
atacgccatgctgggtctccaggagctcgtacagccctctcagtggtgacctggaataaagacattgtcactaaaatcaccccagagggagccgaagagtggagtcttgccatcccagttcgtacttgggagtcggccat

SEQ ID NO: 5228 - DNA, 140 bp, Artificial Sequence
  Synthetic
atggccgactcccaagtacgaactgggatggcaagactccactcttcggctccctctggggtgattttagtgacaatgtctttattccaggtcaccactgagagggctgtacgagctcctggagacccagcatggcgtat

SEQ ID NO: 5229 - DNA, 140 bp, Artificial Sequence
  Synthetic
aggccctggctgctgatatgtcaccatccctacaggtgcgggcaaaccaggggacagcggtagaccgatcttcgacaacaagggacgcgtggtagccatagtcttaggaggagctaatgagaccttttgggacagcggtg

SEQ ID NO: 5230 - DNA, 140 bp, Artificial Sequence
  Synthetic
caccgctgtcccaaaaggtctcattagctcctcctaagactatggctaccacgcgtcccttgttgtcgaagatcggtctaccgctgtcccctggtttgcccgcacctgtagggatggtgacatatcagcagccagggcct

SEQ ID NO: 5231 - DNA, 140 bp, Artificial Sequence
  Synthetic
atacgccatgctgggtctccccatctaaagggcaagcttagcttcacatgccgctgtgacacagtggtttcgtgtgagggctacgtcgttaagagaataacgatgagcccaggcctttatcgtacttgggagtcggccat

SEQ ID NO: 5232 - DNA, 140 bp, Artificial Sequence
  Synthetic
atggccgactcccaagtacgataaaggcctgggctcatcgttattctcttaacgacgtagccctcacacgaaaccactgtgtcacagcggcatgtgaagctaagcttgccctttagatggggagacccagcatggcgtat

SEQ ID NO: 5233 - DNA, 140 bp, Artificial Sequence
  Synthetic
atacgccatgctgggtctccggaaaaaccacagggtatgcggtaacccaccacgcagacggattcttgatgtgcaagactaccgacacggttgacggcgaaagagtgtcattctcggtgtcgtacttgggagtcggccat

SEQ ID NO: 5234 - DNA, 140 bp, Artificial Sequence
  Synthetic
atggccgactcccaagtacgacaccgagaatgacactctttcgccgtcaaccgtgtcggtagtcttgcacatcaagaatccgtctgcgtggtgggttaccgcataccctgtggtttttccggagacccagcatggcgtat

SEQ ID NO: 5235 - DNA, 140 bp, Artificial Sequence
  Synthetic
atacgccatgctgggtctcctgatagccatgattggaccaagctgcgttacatggacaatcacatgccagcagacgcagagagggccgggctatttgtaagaacatcagcaccatgcacgcgtacttgggagtcggccat

SEQ ID NO: 5236 - DNA, 140 bp, Artificial Sequence
  Synthetic
atggccgactcccaagtacgcgtgcatggtgctgatgttcttacaaatagcccggccctctctgcgtctgctggcatgtgattgtccatgtaacgcagcttggtccaatcatggctatcaggagacccagcatggcgtat

SEQ ID NO: 5237 - DNA, 140 bp, Artificial Sequence
  Synthetic
atacgccatgctgggtctccattactggaacaatgggacacttcatcctggcccgatgtccgaaaggagaaactctgacggtgggatttactgacagtaggaagattagtcactcatgtacgtacttgggagtcggccat

SEQ ID NO: 5238 - DNA, 140 bp, Artificial Sequence
  Synthetic
atggccgactcccaagtacgtacatgagtgactaatcttcctactgtcagtaaatcccaccgtcagagtttctcctttcggacatcgggccaggatgaagtgtcccattgttccagtaatggagacccagcatggcgtat

SEQ ID NO: 5239 - DNA, 140 bp, Artificial Sequence
  Synthetic
aggccctggctgctgatatgaaccgtcggtgtctgtgtattacgcggataaccactgggataataggcctggagggaaaatgttcggatttaaccccgaggcagcatccattctagaaaggaccttttgggacagcggtg

SEQ ID NO: 5240 - DNA, 140 bp, Artificial Sequence
  Synthetic
caccgctgtcccaaaaggtcctttctagaatggatgctgcctcggggttaaatccgaacattttccctccaggcctattatcccagtggttatccgcgtaatacacagacaccgacggttcatatcagcagccagggcct

SEQ ID NO: 5241 - DNA, 140 bp, Artificial Sequence
  Synthetic
aggccctggctgctgatatggagaatagtggttaacggcagaacgcaacggaacacgaacaccatgaagaactacctgcttcccgtggtcgcccaggccttcagtaagtgggcaaaggaggaccttttgggacagcggtg

SEQ ID NO: 5242 - DNA, 140 bp, Artificial Sequence
  Synthetic
caccgctgtcccaaaaggtcctcctttgcccacttactgaaggcctgggcgaccacgggaagcaggtagttcttcatggtgttcgtgttccgttgcgttctgccgttaaccactattctccatatcagcagccagggcct

SEQ ID NO: 5243 - DNA, 140 bp, Artificial Sequence
  Synthetic
atacgccatgctgggtctcccgcacccatttcaccacgaccctcctgtgataggccgggaaaaattccattcccgaccgcagcacggtaaagagctaccttgcagcacgaacgtgcagaacgtacttgggagtcggccat

SEQ ID NO: 5244 - DNA, 140 bp, Artificial Sequence
  Synthetic
atggccgactcccaagtacgttctgcacgttcgtgctgcaaggtagctctttaccgtgctgcggtcgggaatggaatttttcccggcctatcacaggagggtcgtggtgaaatgggtgcgggagacccagcatggcgtat

SEQ ID NO: 5245 - DNA, 140 bp, Artificial Sequence
  Synthetic
atacgccatgctgggtctcccgcacccatttcaccacgaccctcctgtgataggccgggaaaaattccattcccgaccgcagcacggtaaagagctaccttgcagcacgtacgtgcagaacgtacttgggagtcggccat

SEQ ID NO: 5246 - DNA, 140 bp, Artificial Sequence
  Synthetic
atggccgactcccaagtacgttctgcacgtacgtgctgcaaggtagctctttaccgtgctgcggtcgggaatggaatttttcccggcctatcacaggagggtcgtggtgaaatgggtgcgggagacccagcatggcgtat

SEQ ID NO: 5247 - DNA, 140 bp, Artificial Sequence
  Synthetic
atacgccatgctgggtctcccgcacccatttcaccacgaccctcctgtgataggccgggaaaaattccattcccgaccgcagcacggtaaagagctaccttgcagcacgcacgtgcagaacgtacttgggagtcggccat

SEQ ID NO: 5248 - DNA, 140 bp, Artificial Sequence
  Synthetic
atggccgactcccaagtacgttctgcacgtgcgtgctgcaaggtagctctttaccgtgctgcggtcgggaatggaatttttcccggcctatcacaggagggtcgtggtgaaatgggtgcgggagacccagcatggcgtat

SEQ ID NO: 5249 - DNA, 140 bp, Artificial Sequence
  Synthetic
atacgccatgctgggtctcccgcacccatttcaccacgaccctcctgtgataggccgggaaaaattccattcccgaccgcagcacggtaaagagctaccttgcagcacggacgtgcagaacgtacttgggagtcggccat

SEQ ID NO: 5250 - DNA, 140 bp, Artificial Sequence
  Synthetic
atggccgactcccaagtacgttctgcacgtccgtgctgcaaggtagctctttaccgtgctgcggtcgggaatggaatttttcccggcctatcacaggagggtcgtggtgaaatgggtgcgggagacccagcatggcgtat

SEQ ID NO: 5251 - DNA, 140 bp, Artificial Sequence
  Synthetic
aggccctggctgctgatatgtgccggaaggacatggaagatgagaagcttctgggggtcagagaaagaacactaacctgctgctgtctatgggcatttaagaagcagaaaacacacacgggaccttttgggacagcggtg

SEQ ID NO: 5252 - DNA, 140 bp, Artificial Sequence
  Synthetic
caccgctgtcccaaaaggtcccgtgtgtgttttctgcttcttaaatgcccatagacagcagcaggttagtgttctttctctgacccccagaagcttctcatcttccatgtccttccggcacatatcagcagccagggcct

SEQ ID NO: 5253 - DNA, 140 bp, Artificial Sequence
  Synthetic
atacgccatgctgggtctccccgcgtaacgctgaactcggggaccgaaaaggaaaaattcacatcccgtttccgctggcaaatgaaacatgcagggtgcctaaagcaaggaaccccaccgcgtacttgggagtcggccat

SEQ ID NO: 5254 - DNA, 140 bp, Artificial Sequence
  Synthetic
atggccgactcccaagtacgcggtggggttccttgctttaggcaccctgcatgtttcatttgccagcggaaacgggatgtgaatttttccttttcggtccccgagttcagcgttacgcggggagacccagcatggcgtat

SEQ ID NO: 5255 - DNA, 140 bp, Artificial Sequence
  Synthetic
atacgccatgctgggtctccccgcgtaacgctgaactcggggaccgaaaaggaaaaattcacatcccgtttccgctggcaaatgtaacatgcagggtgcctaaagcaaggaaccccaccgcgtacttgggagtcggccat

SEQ ID NO: 5256 - DNA, 140 bp, Artificial Sequence
  Synthetic
atggccgactcccaagtacgcggtggggttccttgctttaggcaccctgcatgttacatttgccagcggaaacgggatgtgaatttttccttttcggtccccgagttcagcgttacgcggggagacccagcatggcgtat

SEQ ID NO: 5257 - DNA, 140 bp, Artificial Sequence
  Synthetic
atacgccatgctgggtctccccgcgtaacgctgaactcggggaccgaaaaggaaaaattcacatcccgtttccgctggcaaatgcaacatgcagggtgcctaaagcaaggaaccccaccgcgtacttgggagtcggccat

SEQ ID NO: 5258 - DNA, 140 bp, Artificial Sequence
  Synthetic
atggccgactcccaagtacgcggtggggttccttgctttaggcaccctgcatgttgcatttgccagcggaaacgggatgtgaatttttccttttcggtccccgagttcagcgttacgcggggagacccagcatggcgtat

SEQ ID NO: 5259 - DNA, 140 bp, Artificial Sequence
  Synthetic
atacgccatgctgggtctccccgcgtaacgctgaactcggggaccgaaaaggaaaaattcacatcccgtttccgctggcaaatggaacatgcagggtgcctaaagcaaggaaccccaccgcgtacttgggagtcggccat

SEQ ID NO: 5260 - DNA, 140 bp, Artificial Sequence
  Synthetic
atggccgactcccaagtacgcggtggggttccttgctttaggcaccctgcatgttccatttgccagcggaaacgggatgtgaatttttccttttcggtccccgagttcagcgttacgcggggagacccagcatggcgtat

SEQ ID NO: 5261 - DNA, 140 bp, Artificial Sequence
  Synthetic
aggccctggctgctgatatgtctacaagaggcctgatacccagtcaatccagaaggttcaggccgaatttgacagctttgtagtaccgggcctgtggtcgtccgggttgtcaatcccgttgaccttttgggacagcggtg

SEQ ID NO: 5262 - DNA, 140 bp, Artificial Sequence
  Synthetic
caccgctgtcccaaaaggtcaacgggattgacaacccggacgaccacaggcccggtactacaaagctgtcaaattcggcctgaaccttctggattgactgggtatcaggcctcttgtagacatatcagcagccagggcct

SEQ ID NO: 5263 - DNA, 140 bp, Artificial Sequence
  Synthetic
atacgccatgctgggtctccgaggaccagaatcaagtggttgttacgcaaggtgccgaaaaccgacctgatcccatacagcgggaatgcccaagaagcccaggatgcagaaaaagaagcacgtacttgggagtcggccat

SEQ ID NO: 5264 - DNA, 140 bp, Artificial Sequence
  Synthetic
atggccgactcccaagtacgtgcttctttttctgcatcctgggcttcttgggcattcccgctgtatgggatcaggtcggttttcggcaccttgcgtaacaaccacttgattctggtcctcggagacccagcatggcgtat

SEQ ID NO: 5265 - DNA, 140 bp, Artificial Sequence
  Synthetic
atacgccatgctgggtctccgtagcgccgttaggtgtgcgcggagcggactacacatacaacctagagttgggtctgccagcaacgcttgttaggtacgactttgtgttcataaacatcccgtacttgggagtcggccat

SEQ ID NO: 5266 - DNA, 140 bp, Artificial Sequence
  Synthetic
atggccgactcccaagtacgggatgtttatgaacacaaagtcgtacctaacaagcgttgctggcagacccaactctaggttgtatgtgtagtccgctccgcgcacacctaacggcgctacggagacccagcatggcgtat

SEQ ID NO: 5267 - DNA, 140 bp, Artificial Sequence
  Synthetic
atacgccatgctgggtctccgaggaagaacgagaagcagaactgactcatgaggccctaccacccctacaggcagcacaggaagatgtccaggtcgaaatcgacgtggaacagcttgaggcgtacttgggagtcggccat

SEQ ID NO: 5268 - DNA, 140 bp, Artificial Sequence
  Synthetic
atggccgactcccaagtacgcctcaagctgttccacgtcgatttcgacctggacatcttcctgtgctgcctgtaggggtggtagggcctcatgagtcagttctgcttctcgttcttcctcggagacccagcatggcgtat

SEQ ID NO: 5269 - DNA, 140 bp, Artificial Sequence
  Synthetic
atacgccatgctgggtctcctcatactcctgtcgatggtgggtatggcggtggggatgtgcatgtgtgcgcgacgcagatgcatcacaccgtacgaactgacaccaggagctaccgtccccgtacttgggagtcggccat

SEQ ID NO: 5270 - DNA, 140 bp, Artificial Sequence
  Synthetic
atggccgactcccaagtacggggacggtagctcctggtgtcagttcgtacggtgtgatgcatctgcgtcgcgcacacatgcacatccccaccgccatacccaccatcgacaggagtatgaggagacccagcatggcgtat

SEQ ID NO: 5271 - DNA, 140 bp, Artificial Sequence
  Synthetic
aggccctggctgctgatatgcgacgcagatgcatcacaccgtacgaactgacaccaggagctaccgtccctttcctgcttagcctaatatgctgcttcagaacagctaaagcggccacatgaccttttgggacagcggtg

SEQ ID NO: 5272 - DNA, 140 bp, Artificial Sequence
  Synthetic
caccgctgtcccaaaaggtcatgtggccgctttagctgttctgaagcagcatattaggctaagcaggaaagggacggtagctcctggtgtcagttcgtacggtgtgatgcatctgcgtcgcatatcagcagccagggcct

SEQ ID NO: 5273 - DNA, 140 bp, Artificial Sequence
  Synthetic
aggccctggctgctgatatgacactcctgtcctaccggaatatgggagaagaaccaaactatcaagaagagtgggtgacgtacaagaaggaggtcgtgctaaccgtgccgactgaagggcgaccttttgggacagcggtg

SEQ ID NO: 5274 - DNA, 140 bp, Artificial Sequence
  Synthetic
caccgctgtcccaaaaggtcgcccttcagtcggcacggttagcacgacctccttcttgtacgtcacccactcttcttgatagtttggttcttctcccatattccggtaggacaggagtgtcatatcagcagccagggcct

SEQ ID NO: 5275 - DNA, 140 bp, Artificial Sequence
  Synthetic
aggccctggctgctgatatgactgcccaactaacagaccacgtcgtgggggagtacctggtactttccccgcagaccgtactacgcagccagaagctcagcctgatccacgctttggcgggaccttttgggacagcggtg

SEQ ID NO: 5276 - DNA, 140 bp, Artificial Sequence
  Synthetic
caccgctgtcccaaaaggtcccgccaaagcgtggatcaggctgagcttctggctgcgtagtacggtctgcggggaaagtaccaggtactcccccacgacgtggtctgttagttgggcagtcatatcagcagccagggcct

SEQ ID NO: 5277 - DNA, 140 bp, Artificial Sequence
  Synthetic
aggccctggctgctgatatgtaccgcatccgcatcagctaagcttcgcgtcctttaccaaggaaataacatcactgtaactgcctatgcaaacggcgaccacgccgtcacagttaaggacgaccttttgggacagcggtg

SEQ ID NO: 5278 - DNA, 140 bp, Artificial Sequence
  Synthetic
caccgctgtcccaaaaggtcgtccttaactgtgacggcgtggtcgccgtttgcataggcagttacagtgatgttatttccttggtaaaggacgcgaagcttagctgatgcggatgcggtacatatcagcagccagggcct

SEQ ID NO: 5279 - DNA, 140 bp, Artificial Sequence
  Synthetic
atacgccatgctgggtctcccaatggcagaaggaatttcacaactcatgtcatgaacaatcaactgaacgcagcctttgtaggaccggtcacccgagcaggatgtgcaccgtcgtaccggcgtacttgggagtcggccat

SEQ ID NO: 5280 - DNA, 140 bp, Artificial Sequence
  Synthetic
atggccgactcccaagtacgccggtacgacggtgcacatcctgctcgggtgaccggtcctacaaaggctgcgttcagttgattgttcatgacatgagttgtgaaattccttctgccattgggagacccagcatggcgtat

SEQ ID NO: 5281 - DNA, 140 bp, Artificial Sequence
  Synthetic
atacgccatgctgggtctcctgaagacttccagagtctaagcgaaagcgcaacgatggtgtacaacgaaagagagttcgtaaacagaaagttacaccacattgcgatgcacggaccagcccgtacttgggagtcggccat

SEQ ID NO: 5282 - DNA, 140 bp, Artificial Sequence
  Synthetic
atggccgactcccaagtacgggctggtccgtgcatcgcaatgtggtgtaactttctgtttacgaactctctttcgttgtacaccatcgttgcgctttcgcttagactctggaagtcttcaggagacccagcatggcgtat

SEQ ID NO: 5283 - DNA, 140 bp, Artificial Sequence
  Synthetic
atacgccatgctgggtctcctgcgggtacggtacacgtgccatactctcaggcaccatctggctttaagtactggttaaaagaacgaggggcgtcgctacagcacacagcaccatttggccgtacttgggagtcggccat

SEQ ID NO: 5284 - DNA, 140 bp, Artificial Sequence
  Synthetic
atggccgactcccaagtacggccaaatggtgctgtgtgctgtagcgacgcccctcgttcttttaaccagtacttaaagccagatggtgcctgagagtatggcacgtgtaccgtacccgcaggagacccagcatggcgtat

SEQ ID NO: 5285 - DNA, 140 bp, Artificial Sequence
  Synthetic
atacgccatgctgggtctccctgaacactgacgaagagtcgtatgagctggtgagggcagagaggacagaacacgagtacgtctacgacgtggaccaaagaagatgctgtaagaaggaagcgtacttgggagtcggccat

SEQ ID NO: 5286 - DNA, 140 bp, Artificial Sequence
  Synthetic
atggccgactcccaagtacgcttccttcttacagcatcttctttggtccacgtcgtagacgtactcgtgttctgtcctctctgccctcaccagctcatacgactcttcgtcagtgttcagggagacccagcatggcgtat

SEQ ID NO: 5287 - DNA, 140 bp, Artificial Sequence
  Synthetic
aggccctggctgctgatatgacacgagtacgtctacgacgtggaccaaagaagatgctgtaagaaggaagaagctgcaggactggtactggtgggcgacttgactaatccgccctaccacgaccttttgggacagcggtg

SEQ ID NO: 5288 - DNA, 140 bp, Artificial Sequence
  Synthetic
caccgctgtcccaaaaggtcgtggtagggcggattagtcaagtcgcccaccagtaccagtcctgcagcttcttccttcttacagcatcttctttggtccacgtcgtagacgtactcgtgtcatatcagcagccagggcct

SEQ ID NO: 5289 - DNA, 140 bp, Artificial Sequence
  Synthetic
atacgccatgctgggtctccaagctgcaggactggtactggtgggcgacttgactaatccgccctaccacgaattcgcatatgaagggctaaaaattcgccccgcctgcccatacaaaaccgtacttgggagtcggccat

SEQ ID NO: 5290 - DNA, 140 bp, Artificial Sequence
  Synthetic
atggccgactcccaagtacggttttgtatgggcaggcggggcgaatttttagcccttcatatgcgaattcgtggtagggcggattagtcaagtcgcccaccagtaccagtcctgcagcttggagacccagcatggcgtat

SEQ ID NO: 5291 - DNA, 140 bp, Artificial Sequence
  Synthetic
aggccctggctgctgatatgcgtcacataccaccctcggggtccaggacatttccgctacggcgatgtcatgggtgcagaagattacgggaggtgtgggtttggtcgttgctgttgcagcgaccttttgggacagcggtg

SEQ ID NO: 5292 - DNA, 140 bp, Artificial Sequence
  Synthetic
caccgctgtcccaaaaggtcgctgcaacagcaacgaccaaacccacacctcccgtaatcttctgcacccatgacatcgccgtagcggaaatgtcctggaccccgagggtggtatgtgacgcatatcagcagccagggcct

SEQ ID NO: 5293 - DNA, 140 bp, Artificial Sequence
  Synthetic
aggccctggctgctgatatgcatgcccatctccatcgacataccggatgcggccttcactagggtcgtcgacgcgccctccttaacggacatgtcatgcgaggtaccagcctgcacccatgaccttttgggacagcggtg

SEQ ID NO: 5294 - DNA, 140 bp, Artificial Sequence
  Synthetic
caccgctgtcccaaaaggtcatgggtgcaggctggtacctcgcatgacatgtccgttaaggagggcgcgtcgacgaccctagtgaaggccgcatccggtatgtcgatggagatgggcatgcatatcagcagccagggcct

SEQ ID NO: 5295 - DNA, 140 bp, Artificial Sequence
  Synthetic
atacgccatgctgggtctccactgattctaatcgtggtgctatgcgtgtcgttcagcaggcactgacttgacgactaagcatgaaggtatatgtgtcccctaagagacacaccgtatatacgtacttgggagtcggccat

SEQ ID NO: 5296 - DNA, 140 bp, Artificial Sequence
  Synthetic
atggccgactcccaagtacgtatatacggtgtgtctcttaggggacacatataccttcatgcttagtcgtcaagtcagtgcctgctgaacgacacgcatagcaccacgattagaatcagtggagacccagcatggcgtat

SEQ ID NO: 5297 - DNA, 140 bp, Artificial Sequence
  Synthetic
aggccctggctgctgatatgacgactaagcatgaaggtatatgtgtcccctaagagacacaccgtatatagctaataatctataggtatacgtgtcccctaagagacacattgtatgtaggaccttttgggacagcggtg

SEQ ID NO: 5298 - DNA, 140 bp, Artificial Sequence
  Synthetic
caccgctgtcccaaaaggtcctacatacaatgtgtctcttaggggacacgtatacctatagattattagctatatacggtgtgtctcttaggggacacatataccttcatgcttagtcgtcatatcagcagccagggcct

SEQ ID NO: 5299 - DNA, 140 bp, Artificial Sequence
  Synthetic
aggccctggctgctgatatgtcaagaacctagttaccaggcaagacctggtgactagcggaaagaaagaaaactgccaagaaatcagcaccgacgtgatgagacagagaggtctagagatgaccttttgggacagcggtg

SEQ ID NO: 5300 - DNA, 140 bp, Artificial Sequence
  Synthetic
caccgctgtcccaaaaggtcatctctagacctctctgtctcatcacgtcggtgctgatttcttggcagttttctttctttccgctagtcaccaggtcttgcctggtaactaggttcttgacatatcagcagccagggcct

SEQ ID NO: 5301 - DNA, 140 bp, Artificial Sequence
  Synthetic
aggccctggctgctgatatgtcgacgtgttgtacgtagacgaggcgtttgcgtgccactctggaacgttacttgctttgatcgccttggtgagaccaagacagaaagttgtactttgtgggaccttttgggacagcggtg

SEQ ID NO: 5302 - DNA, 140 bp, Artificial Sequence
  Synthetic
caccgctgtcccaaaaggtcccacaaagtacaactttctgtcttggtctcaccaaggcgatcaaagcaagtaacgttccagagtggcacgcaaacgcctcgtctacgtacaacacgtcgacatatcagcagccagggcct

SEQ ID NO: 5303 - DNA, 140 bp, Artificial Sequence
  Synthetic
aggccctggctgctgatatgtgcagtcataggagtcttcggggtaccaggatctggcaagtcagccattatcaagaacctagttaccaggcaagacctggtgactagcggaaagaaagaagaccttttgggacagcggtg

SEQ ID NO: 5304 - DNA, 140 bp, Artificial Sequence
  Synthetic
caccgctgtcccaaaaggtcttctttctttccgctagtcaccaggtcttgcctggtaactaggttcttgataatggctgacttgccagatcctggtaccccgaagactcctatgactgcacatatcagcagccagggcct

SEQ ID NO: 5305 - DNA, 140 bp, Artificial Sequence
  Synthetic
atacgccatgctgggtctccacaatcataacatctgcacccaagtgtaccacaaaagtatctccaggcggtgtacactgcctgtgactgccattgtgtcatcgttgcattacgaaggcaacgtacttgggagtcggccat

SEQ ID NO: 5306 - DNA, 140 bp, Artificial Sequence
  Synthetic
atggccgactcccaagtacgttgccttcgtaatgcaacgatgacacaatggcagtcacaggcagtgtacaccgcctggagatacttttgtggtacacttgggtgcagatgttatgattgtggagacccagcatggcgtat

SEQ ID NO: 5307 - DNA, 140 bp, Artificial Sequence
  Synthetic
aggccctggctgctgatatgatgtaggtacttaagcttcctaaaagcagccgaactcactttgagatgtaggcatagcataccgaactcttccacgattctccgaacccacagggacgtagaccttttgggacagcggtg

SEQ ID NO: 5308 - DNA, 140 bp, Artificial Sequence
  Synthetic
caccgctgtcccaaaaggtctacgtccctgtgggttcggagaatcgtggaagagttcggtatgctatgcctacatctcaaagtgagttcggctgcttttaggaagcttaagtacctacatcatatcagcagccagggcct

SEQ ID NO: 5309 - DNA, 140 bp, Artificial Sequence
  Synthetic
atacgccatgctgggtctccaatgcgcactacgaatgagtacaacatgccgattgtagtggacactacaggctcaacgaaacctgaccctggagacctcgtgttaacgtgcttcagagggcgtacttgggagtcggccat

SEQ ID NO: 5310 - DNA, 140 bp, Artificial Sequence
  Synthetic
atggccgactcccaagtacgccctctgaagcacgttaacacgaggtctccagggtcaggtttcgttgagcctgtagtgtccactacaatcggcatgttgtactcattcgtagtgcgcattggagacccagcatggcgtat

SEQ ID NO: 5311 - DNA, 140 bp, Artificial Sequence
  Synthetic
aggccctggctgctgatatggctcaacgaaacctgaccctggagacctcgtgttaacgtgcttcagagggtgggttaaacaattgcaaattgactatcgtggacacgaggtcatgacagcgaccttttgggacagcggtg

SEQ ID NO: 5312 - DNA, 140 bp, Artificial Sequence
  Synthetic
caccgctgtcccaaaaggtcgctgtcatgacctcgtgtccacgatagtcaatttgcaattgtttaacccaccctctgaagcacgttaacacgaggtctccagggtcaggtttcgttgagccatatcagcagccagggcct

SEQ ID NO: 5313 - DNA, 140 bp, Artificial Sequence
  Synthetic
aggccctggctgctgatatgcgtgtgagggctacgtcgttaagagaataacgatgagcccaggcctttatggaaaaaccacagggtatgcggtaacccaccacgcagatggattcttgatgaccttttgggacagcggtg

SEQ ID NO: 5314 - DNA, 140 bp, Artificial Sequence
  Synthetic
caccgctgtcccaaaaggtcatcaagaatccatctgcgtggtgggttaccgcataccctgtggtttttccataaaggcctgggctcatcgttattctcttaacgacgtagccctcacacgcatatcagcagccagggcct

SEQ ID NO: 5315 - DNA, 140 bp, Artificial Sequence
  Synthetic
atacgccatgctgggtctcctctaaggtaatgctatttgaccataacgtgccatcgcgcgtaagtccaaggggatatagatcttcacaggagtctgcacaggaggcgagtacaatcacgtcgtacttgggagtcggccat

SEQ ID NO: 5316 - DNA, 140 bp, Artificial Sequence
  Synthetic
atggccgactcccaagtacgacgtgattgtactcgcctcctgtgcagactcctgtgaagatctatatccccttggacttacgcgcgatggcacgttatggtcaaatagcattaccttagaggagacccagcatggcgtat

SEQ ID NO: 5317 - DNA, 140 bp, Artificial Sequence
  Synthetic
atacgccatgctgggtctccactacctgcttcccgtggtcgcccaggccttcagtaagtgggcaaaggagtgccggaaggatatggaagatgagaagcttctgggggtcagagaaagaaccgtacttgggagtcggccat

SEQ ID NO: 5318 - DNA, 140 bp, Artificial Sequence
  Synthetic
atggccgactcccaagtacggttctttctctgacccccagaagcttctcatcttccatatccttccggcactcctttgcccacttactgaaggcctgggcgaccacgggaagcaggtagtggagacccagcatggcgtat

SEQ ID NO: 5319 - DNA, 140 bp, Artificial Sequence
  Synthetic
aggccctggctgctgatatgcactgacgcatagtcaattcgacctaagcgttgatggcgagatactgcccgtcccgtcagacctggatgctgacgccccagccctagaaccagcactagagaccttttgggacagcggtg

SEQ ID NO: 5320 - DNA, 140 bp, Artificial Sequence
  Synthetic
caccgctgtcccaaaaggtctctagtgctggttctagggctggggcgtcagcatccaggtctgacgggacgggcagtatctcgccatcaacgcttaggtcgaattgactatgcgtcagtgcatatcagcagccagggcct

SEQ ID NO: 5321 - DNA, 140 bp, Artificial Sequence
  Synthetic
aggccctggctgctgatatgcccgtggataaagacgctgcagaacccaccgaaaggaaacttcaaagcaactattaaggagtgggaggtggagcacgcatcgataatggcgggcatctgcgaccttttgggacagcggtg

SEQ ID NO: 5322 - DNA, 140 bp, Artificial Sequence
  Synthetic
caccgctgtcccaaaaggtcgcagatgcccgccattatcgatgcgtgctccacctcccactccttaatagttgctttgaagtttcctttcggtgggttctgcagcgtctttatccacgggcatatcagcagccagggcct

SEQ ID NO: 5323 - DNA, 140 bp, Artificial Sequence
  Synthetic
atacgccatgctgggtctccctattaaggagtgggaggtggagcacgcatcgataatggcgggcatctgcagtcaccaagtgacctttgatacattccaaaacaaagccaacgtttgctgcgtacttgggagtcggccat

SEQ ID NO: 5324 - DNA, 140 bp, Artificial Sequence
  Synthetic
atggccgactcccaagtacgcagcaaacgttggctttgttttggaatgtatcaaaggtcacttggtgactgcagatgcccgccattatcgatgcgtgctccacctcccactccttaatagggagacccagcatggcgtat

SEQ ID NO: 5325 - DNA, 140 bp, Artificial Sequence
  Synthetic
aggccctggctgctgatatgtgccggaaggatatggaagatgagaagcttctgggggtcagagaaagaacactaacctgctgctgtctatgggcattcaagaagcagaaaacacacacgggaccttttgggacagcggtg

SEQ ID NO: 5326 - DNA, 140 bp, Artificial Sequence
  Synthetic
caccgctgtcccaaaaggtcccgtgtgtgttttctgcttcttgaatgcccatagacagcagcaggttagtgttctttctctgacccccagaagcttctcatcttccatatccttccggcacatatcagcagccagggcct

SEQ ID NO: 5327 - DNA, 140 bp, Artificial Sequence
  Synthetic
atacgccatgctgggtctccggctaagagcttggtccctatcctcgaaacagcggggataaaactaaatgataggcagtggtcccagataattcaagccttcaaagaagacaaagcataccgtacttgggagtcggccat

SEQ ID NO: 5328 - DNA, 140 bp, Artificial Sequence
  Synthetic
atggccgactcccaagtacggtatgctttgtcttctttgaaggcttgaattatctgggaccactgcctatcatttagttttatccccgctgtttcgaggatagggaccaagctcttagccggagacccagcatggcgtat

SEQ ID NO: 5329 - DNA, 140 bp, Artificial Sequence
  Synthetic
aggccctggctgctgatatgataggcagtggtcccagataattcaagccttcaaagaagacaaagcatactcacccgaagtagccctgaatgaaatatgcacgcgcatgtatggggtggagaccttttgggacagcggtg

SEQ ID NO: 5330 - DNA, 140 bp, Artificial Sequence
  Synthetic
caccgctgtcccaaaaggtctccaccccatacatgcgcgtgcatatttcattcagggctacttcgggtgagtatgctttgtcttctttgaaggcttgaattatctgggaccactgcctatcatatcagcagccagggcct

SEQ ID NO: 5331 - DNA, 140 bp, Artificial Sequence
  Synthetic
atacgccatgctgggtctcctcacccgaagtagccctgaatgaaatatgcacgcgcatgtatggggtggatctagacagcgggctattttctaaaccgttggtatctgtgtattacgcggcgtacttgggagtcggccat

SEQ ID NO: 5332 - DNA, 140 bp, Artificial Sequence
  Synthetic
atggccgactcccaagtacgccgcgtaatacacagataccaacggtttagaaaatagcccgctgtctagatccaccccatacatgcgcgtgcatatttcattcagggctacttcgggtgaggagacccagcatggcgtat

SEQ ID NO: 5333 - DNA, 140 bp, Artificial Sequence
  Synthetic
aggccctggctgctgatatgtctagacagcgggctattttctaaaccgttggtatctgtgtattacgcggataaccattgggataataggccgggagggaagatgttcggattcaaccctgaccttttgggacagcggtg

SEQ ID NO: 5334 - DNA, 140 bp, Artificial Sequence
  Synthetic
caccgctgtcccaaaaggtcagggttgaatccgaacatcttccctcccggcctattatcccaatggttatccgcgtaatacacagataccaacggtttagaaaatagcccgctgtctagacatatcagcagccagggcct

SEQ ID NO: 5335 - DNA, 140 bp, Artificial Sequence
  Synthetic
atacgccatgctgggtctcctgaagacttccagagtctaagcgaaagcgcaacgatggtgtacaacgaaagagagttcgtaaatagaaagttacaccacattgcgatgcacggaccagcccgtacttgggagtcggccat

SEQ ID NO: 5336 - DNA, 140 bp, Artificial Sequence
  Synthetic
atggccgactcccaagtacgggctggtccgtgcatcgcaatgtggtgtaactttctatttacgaactctctttcgttgtacaccatcgttgcgctttcgcttagactctggaagtcttcaggagacccagcatggcgtat

SEQ ID NO: 5337 - DNA, 140 bp, Artificial Sequence
  Synthetic
aggccctggctgctgatatgtcccatacagcgggaatgcccaagaagcccaggatgcagaaaaagaagcagaggaagaacgagaagcagaactgactcatgaagccctaccacccctacagaccttttgggacagcggtg

SEQ ID NO: 5338 - DNA, 140 bp, Artificial Sequence
  Synthetic
caccgctgtcccaaaaggtctgtaggggtggtagggcttcatgagtcagttctgcttctcgttcttcctctgcttctttttctgcatcctgggcttcttgggcattcccgctgtatgggacatatcagcagccagggcct

SEQ ID NO: 5339 - DNA, 140 bp, Artificial Sequence
  Synthetic
aggccctggctgctgatatgcgagggagaaacctgactgtgacatgtgacgagagagaagggaatataacacccatggctagcgtccgactctttagggcagagctgtgtccggtcgtacgaccttttgggacagcggtg

SEQ ID NO: 5340 - DNA, 140 bp, Artificial Sequence
  Synthetic
caccgctgtcccaaaaggtcgtacgaccggacacagctctgccctaaagagtcggacgctagccatgggtgttatattcccttctctctcgtcacatgtcacagtcaggtttctccctcgcatatcagcagccagggcct

SEQ ID NO: 5341 - DNA, 140 bp, Artificial Sequence
  Synthetic
aggccctggctgctgatatgtctacaagaggcctgatacccagtcaatccagaaggttcaggccgaatttgacagctttgtagtaccgggcctgtggtcgtccgggttatcaatcccgttgaccttttgggacagcggtg

SEQ ID NO: 5342 - DNA, 140 bp, Artificial Sequence
  Synthetic
caccgctgtcccaaaaggtcaacgggattgataacccggacgaccacaggcccggtactacaaagctgtcaaattcggcctgaaccttctggattgactgggtatcaggcctcttgtagacatatcagcagccagggcct

SEQ ID NO: 5343 - DNA, 140 bp, Artificial Sequence
  Synthetic
atacgccatgctgggtctccaagctgcaggactggtactggtgggcgacttgactaatccgccctaccacgaattcgcatatgaagggctaaaaatccgccccgcctgcccatacaaaaccgtacttgggagtcggccat

SEQ ID NO: 5344 - DNA, 140 bp, Artificial Sequence
  Synthetic
atggccgactcccaagtacggttttgtatgggcaggcggggcggatttttagcccttcatatgcgaattcgtggtagggcggattagtcaagtcgcccaccagtaccagtcctgcagcttggagacccagcatggcgtat

SEQ ID NO: 5345 - DNA, 140 bp, Artificial Sequence
  Synthetic
aggccctggctgctgatatgcaagataaacggacaccacgtgctcctggttagcggctataaccttgcactgcctactaagagagtcacctgggtagcgccactaggtgtccgcggagcggaccttttgggacagcggtg

SEQ ID NO: 5346 - DNA, 140 bp, Artificial Sequence
  Synthetic
caccgctgtcccaaaaggtccgctccgcggacacctagtggcgctacccaggtgactctcttagtaggcagtgcaaggttatagccgctaaccaggagcacgtggtgtccgtttatcttgcatatcagcagccagggcct

SEQ ID NO: 5347 - DNA, 140 bp, Artificial Sequence
  Synthetic
atacgccatgctgggtctccctattaaggagtgggaggtggagcacgcatcgataatggcgggcatctgcagtcaccaagtgacctttgatacattccaaaacaaagctaacgtttgctgcgtacttgggagtcggccat

SEQ ID NO: 5348 - DNA, 140 bp, Artificial Sequence
  Synthetic
atggccgactcccaagtacgcagcaaacgttagctttgttttggaatgtatcaaaggtcacttggtgactgcagatgcccgccattatcgatgcgtgctccacctcccactccttaatagggagacccagcatggcgtat

SEQ ID NO: 5349 - DNA, 140 bp, Artificial Sequence
  Synthetic
atacgccatgctgggtctccaccctggaggaagtccacgaggagaactgttatccacctaagctggatgaagccaaggagcaactagtacttaagaaactccaggagagtgcatccatggcgtacttgggagtcggccat

SEQ ID NO: 5350 - DNA, 140 bp, Artificial Sequence
  Synthetic
atggccgactcccaagtacgccatggatgcactctcctggagtttcttaagtactagttgctccttggcttcatccagcttaggtggataacagttctcctcgtggacttcctccagggtggagacccagcatggcgtat

SEQ ID NO: 5351 - DNA, 140 bp, Artificial Sequence
  Synthetic
aggccctggctgctgatatggaggcagcgtccattctagaaagaaagtacccatttacaaaaggaaagtggaacatcaacaagcagatctgcgtgaccaccaggaggatagaagacttcagaccttttgggacagcggtg

SEQ ID NO: 5352 - DNA, 140 bp, Artificial Sequence
  Synthetic
caccgctgtcccaaaaggtctgaagtcttctatcctcctggtggtcacgcagatctgcttgttgatgttccactttccttttgtaaatgggtactttctttctagaatggacgctgcctccatatcagcagccagggcct

SEQ ID NO: 5353 - DNA, 140 bp, Artificial Sequence
  Synthetic
atacgccatgctgggtctccaacagtgcgtagatcacgcaatgaaactgcaaatgctagggggtgactcactgagactgctcaaaccgggtggctctctattgatcagagcatacggttacgtacttgggagtcggccat

SEQ ID NO: 5354 - DNA, 140 bp, Artificial Sequence
  Synthetic
atggccgactcccaagtacgtaaccgtatgctctgatcaatagagagccacccggtttgagcagtctcagtgagtcaccccctagcatttgcagtttcattgcgtgatctacgcactgttggagacccagcatggcgtat

SEQ ID NO: 5355 - DNA, 140 bp, Artificial Sequence
  Synthetic
atacgccatgctgggtctccctgagactgctcaaaccgggtggctctctattgatcagagcatacggttacgcagatagaaccagtgaacgagtcatctgcgtactgggacgcaagtttacgtacttgggagtcggccat

SEQ ID NO: 5356 - DNA, 140 bp, Artificial Sequence
  Synthetic
atggccgactcccaagtacgtaaacttgcgtcccagtacgcagatgactcgttcactggttctatctgcgtaaccgtatgctctgatcaatagagagccacccggtttgagcagtctcagggagacccagcatggcgtat

SEQ ID NO: 5357 - DNA, 140 bp, Artificial Sequence
  Synthetic
aggccctggctgctgatatgtctagacagcgggctattttctaaaccgttggtatctgtgtattacgcggataaccattgggataacaggccgggagggaagatgttcggattcaaccctgaccttttgggacagcggtg

SEQ ID NO: 5358 - DNA, 140 bp, Artificial Sequence
  Synthetic
caccgctgtcccaaaaggtcagggttgaatccgaacatcttccctcccggcctgttatcccaatggttatccgcgtaatacacagataccaacggtttagaaaatagcccgctgtctagacatatcagcagccagggcct

SEQ ID NO: 5359 - DNA, 140 bp, Artificial Sequence
  Synthetic
atacgccatgctgggtctccgatcgtctagagcattgaaaccaccatgtgtcaccagtaatactgagatgtttttcctatttagcaattttgacaatggcagaaggaattttacaacgcacgtacttgggagtcggccat

SEQ ID NO: 5360 - DNA, 140 bp, Artificial Sequence
  Synthetic
atggccgactcccaagtacgtgcgttgtaaaattccttctgccattgtcaaaattgctaaataggaaaaacatctcagtattactggtgacacatggtggtttcaatgctctagacgatcggagacccagcatggcgtat

SEQ ID NO: 5361 - DNA, 140 bp, Artificial Sequence
  Synthetic
aggccctggctgctgatatgtttttcctatttagcaattttgacaatggcagaaggaattttacaacgcatgtcatgaacaatcaactgaatgcagcctttgtaggacaggccacccgaggaccttttgggacagcggtg

SEQ ID NO: 5362 - DNA, 140 bp, Artificial Sequence
  Synthetic
caccgctgtcccaaaaggtcctcgggtggcctgtcctacaaaggctgcattcagttgattgttcatgacatgcgttgtaaaattccttctgccattgtcaaaattgctaaataggaaaaacatatcagcagccagggcct

SEQ ID NO: 5363 - DNA, 140 bp, Artificial Sequence
  Synthetic
atacgccatgctgggtctccaccctactaccaacattataccggtcaacaggagactaccacactcattagtggccgaacaccgcccagtaaaaggggaaagaatggaatggctggttaacgtacttgggagtcggccat

SEQ ID NO: 5364 - DNA, 140 bp, Artificial Sequence
  Synthetic
atggccgactcccaagtacgttaaccagccattccattctttccccttttactgggcggtgttcggccactaatgagtgtggtagtctcctgttgaccggtataatgttggtagtagggtggagacccagcatggcgtat

SEQ ID NO: 5365 - DNA, 140 bp, Artificial Sequence
  Synthetic
aggccctggctgctgatatgtttttcctatttagcaattttgacaatggcagaaggaattttacaacgcatgtcatgaataatcaactgaatgcagcctttgtaggacaggccacccgaggaccttttgggacagcggtg

SEQ ID NO: 5366 - DNA, 140 bp, Artificial Sequence
  Synthetic
caccgctgtcccaaaaggtcctcgggtggcctgtcctacaaaggctgcattcagttgattattcatgacatgcgttgtaaaattccttctgccattgtcaaaattgctaaataggaaaaacatatcagcagccagggcct

SEQ ID NO: 5367 - DNA, 140 bp, Artificial Sequence
  Synthetic
aggccctggctgctgatatgcggtgtttgcaaggcagtatataaaaagtggccggagtcctttaaaaacagtgcaacaccagtaggaaccgcaaaaacagttatgtgcggtacgtatccagaccttttgggacagcggtg

SEQ ID NO: 5368 - DNA, 140 bp, Artificial Sequence
  Synthetic
caccgctgtcccaaaaggtctggatacgtaccgcacataactgtttttgcggttcctactggtgttgcactgtttttaaaggactccggccactttttatatactgccttgcaaacaccgcatatcagcagccagggcct

SEQ ID NO: 5369 - DNA, 140 bp, Artificial Sequence
  Synthetic
atacgccatgctgggtctccgtaatccacgctgtaggaccaaacttctcaaattattcggagtctgaaggggaccgggaattggcggctgcctatcgagaagtcgcaaaggaagtaactacgtacttgggagtcggccat

SEQ ID NO: 5370 - DNA, 140 bp, Artificial Sequence
  Synthetic
atggccgactcccaagtacgtagttacttcctttgcgacttctcgataggcagccgccaattcccggtccccttcagactccgaataatttgagaagtttggtcctacagcgtggattacggagacccagcatggcgtat

SEQ ID NO: 5371 - DNA, 140 bp, Artificial Sequence
  Synthetic
atacgccatgctgggtctccgagatatacactatgtggccaaagcaaatagaggccaatgagcaagtctgcctatatgccctgggggaaaatattgaatcaatcaggcagaaatgcccggcgtacttgggagtcggccat

SEQ ID NO: 5372 - DNA, 140 bp, Artificial Sequence
  Synthetic
atggccgactcccaagtacgccgggcatttctgcctgattgattcaatattttcccccagggcatataggcagacttgctcattggcctctatttgctttggccacatagtgtatatctcggagacccagcatggcgtat

SEQ ID NO: 5373 - DNA, 140 bp, Artificial Sequence
  Synthetic
aggccctggctgctgatatgtgcaggttatacaggcggctgaacccttggcgacagcatacctatgtgggattcacagagagctggttaggaggctgaacgccgtcctcctacccaatgtgaccttttgggacagcggtg

SEQ ID NO: 5374 - DNA, 140 bp, Artificial Sequence
  Synthetic
caccgctgtcccaaaaggtcacattgggtaggaggacggcgttcagcctcctaaccagctctctgtgaatcccacataggtatgctgtcgccaagggttcagccgcctgtataacctgcacatatcagcagccagggcct

SEQ ID NO: 5375 - DNA, 140 bp, Artificial Sequence
  Synthetic
atacgccatgctgggtctccaaggagtgcaaaaagtcaaatgctccaaggtaatgttattcgatcacaatgtgccatcgcgagtaagtccaagggaatacagatcttcccaggaatctgtcgtacttgggagtcggccat

SEQ ID NO: 5376 - DNA, 140 bp, Artificial Sequence
  Synthetic
atggccgactcccaagtacgacagattcctgggaagatctgtattcccttggacttactcgcgatggcacattgtgatcgaataacattaccttggagcatttgactttttgcactccttggagacccagcatggcgtat

SEQ ID NO: 5377 - DNA, 140 bp, Artificial Sequence
  Synthetic
aggccctggctgctgatatggactgggagtaaatagcgtagctatacctctcctctccacaggtgtatactcaggagggaaagacaggctaacccagtcactgaaccacctctttacagcgaccttttgggacagcggtg

SEQ ID NO: 5378 - DNA, 140 bp, Artificial Sequence
  Synthetic
caccgctgtcccaaaaggtcgctgtaaagaggtggttcagtgactgggttagcctgtctttccctcctgagtatacacctgtggagaggagaggtatagctacgctatttactcccagtccatatcagcagccagggcct

SEQ ID NO: 5379 - DNA, 140 bp, Artificial Sequence
  Synthetic
aggccctggctgctgatatggcgccgatggcgagacactgcctgtcccgtcagacctggatgctgacgccccggccccagaaccggccctagacgacggggcggtacacacattaccaacgaccttttgggacagcggtg

SEQ ID NO: 5380 - DNA, 140 bp, Artificial Sequence
  Synthetic
caccgctgtcccaaaaggtcgttggtaatgtgtgtaccgccccgtcgtctagggccggttctggggccggggcgtcagcatccaggtctgacgggacaggcagtgtctcgccatcggcgccatatcagcagccagggcct

SEQ ID NO: 5381 - DNA, 140 bp, Artificial Sequence
  Synthetic
atacgccatgctgggtctcccagtagcttggcaggcagaaaaggatacagcaccacggaaggcgcactgtattcatatctagaagggacacgttttcaccagacggcagtggatatggcacgtacttgggagtcggccat

SEQ ID NO: 5382 - DNA, 140 bp, Artificial Sequence
  Synthetic
atggccgactcccaagtacgtgccatatccactgccgtctggtgaaaacgtgtcccttctagatatgaatacagtgcgccttccgtggtgctgtatccttttctgcctgccaagctactgggagacccagcatggcgtat

SEQ ID NO: 5383 - DNA, 140 bp, Artificial Sequence
  Synthetic
atacgccatgctgggtctcccacaatcggaaaccttgcggccgtgtctgactgggtaatgagcaccgtacctgtcgcgccgcctagaagaagaagagggagaaacctgactgtgacatgtcgtacttgggagtcggccat

SEQ ID NO: 5384 - DNA, 140 bp, Artificial Sequence
  Synthetic
atggccgactcccaagtacgacatgtcacagtcaggtttctccctcttcttcttctaggcggcgcgacaggtacggtgctcattacccagtcagacacggccgcaaggtttccgattgtgggagacccagcatggcgtat

SEQ ID NO: 5385 - DNA, 140 bp, Artificial Sequence
  Synthetic
aggccctggctgctgatatgctgtcgcgccgcctagaagaagaagagggagaaacctgactgtgacatgtgatgagagagaagggaatataacacccatggctagcgtccgattctttaggaccttttgggacagcggtg

SEQ ID NO: 5386 - DNA, 140 bp, Artificial Sequence
  Synthetic
caccgctgtcccaaaaggtcctaaagaatcggacgctagccatgggtgttatattcccttctctctcatcacatgtcacagtcaggtttctccctcttcttcttctaggcggcgcgacagcatatcagcagccagggcct

SEQ ID NO: 5387 - DNA, 140 bp, Artificial Sequence
  Synthetic
aggccctggctgctgatatgattcatatctagaagggacacgttttcaccagacggcagtggatatggcagagatatatactatgtggccaaagcaaatagaggccaatgagcaagtctggaccttttgggacagcggtg

SEQ ID NO: 5388 - DNA, 140 bp, Artificial Sequence
  Synthetic
caccgctgtcccaaaaggtccagacttgctcattggcctctatttgctttggccacatagtatatatctctgccatatccactgccgtctggtgaaaacgtgtcccttctagatatgaatcatatcagcagccagggcct

SEQ ID NO: 5389 - DNA, 140 bp, Artificial Sequence
  Synthetic
aggccctggctgctgatatgtggatgatgcagacgcatcatctcccccgaaaactgtcccgtgcctttgccgttatgccatgactcctgaacgcgtcacccgacttcgcatgaaccatgtgaccttttgggacagcggtg

SEQ ID NO: 5390 - DNA, 140 bp, Artificial Sequence
  Synthetic
caccgctgtcccaaaaggtcacatggttcatgcgaagtcgggtgacgcgttcaggagtcatggcataacggcaaaggcacgggacagttttcgggggagatgatgcgtctgcatcatccacatatcagcagccagggcct

SEQ ID NO: 5391 - DNA, 140 bp, Artificial Sequence
  Synthetic
aggccctggctgctgatatgcttcgacgaaggagaaatcgaaagcttgtcttctgagctactaactttcggggacttcctacccggtgaagtggatgacttgacagatagtgactggtccgaccttttgggacagcggtg

SEQ ID NO: 5392 - DNA, 140 bp, Artificial Sequence
  Synthetic
caccgctgtcccaaaaggtcggaccagtcactatctgtcaagtcatccacttcaccgggtaggaagtccccgaaagttagtagctcagaagacaagctttcgatttctccttcgtcgaagcatatcagcagccagggcct

SEQ ID NO: 5393 - DNA, 140 bp, Artificial Sequence
  Synthetic
atacgccatgctgggtctccaaggagtgcaaaaagtcaaatgctccaaggtaatgttattcgatcacaatgtgccatcgcgcgtaagtccaagggaatacagatcttcccaggaatctgtcgtacttgggagtcggccat

SEQ ID NO: 5394 - DNA, 140 bp, Artificial Sequence
  Synthetic
atggccgactcccaagtacgacagattcctgggaagatctgtattcccttggacttacgcgcgatggcacattgtgatcgaataacattaccttggagcatttgactttttgcactccttggagacccagcatggcgtat

SEQ ID NO: 5395 - DNA, 140 bp, Artificial Sequence
  Synthetic
atacgccatgctgggtctccacaggaagtgagtacggcaacgtcattgacgcatagccagtttgatctaagcgccgatggcgagacactgcctgtcccgtcagacctggatgctgacgcccgtacttgggagtcggccat

SEQ ID NO: 5396 - DNA, 140 bp, Artificial Sequence
  Synthetic
atggccgactcccaagtacgggcgtcagcatccaggtctgacgggacaggcagtgtctcgccatcggcgcttagatcaaactggctatgcgtcaatgacgttgccgtactcacttcctgtggagacccagcatggcgtat

SEQ ID NO: 5397 - DNA, 140 bp, Artificial Sequence
  Synthetic
aggccctggctgctgatatggcgccgatggcgagacactgcctgtcccgtcagacctggatgctgacgccccagccccagaaccggccctagacgacggggcggtacacacattaccaacgaccttttgggacagcggtg

SEQ ID NO: 5398 - DNA, 140 bp, Artificial Sequence
  Synthetic
caccgctgtcccaaaaggtcgttggtaatgtgtgtaccgccccgtcgtctagggccggttctggggctggggcgtcagcatccaggtctgacgggacaggcagtgtctcgccatcggcgccatatcagcagccagggcct

SEQ ID NO: 5399 - DNA, 140 bp, Artificial Sequence
  Synthetic
aggccctggctgctgatatgagcgctgtaccttccccattccagaacacactacagaatgtactggcagcagccacgaaaaggaactgcaacgtcacacagatgagggaactacccacttgaccttttgggacagcggtg

SEQ ID NO: 5400 - DNA, 140 bp, Artificial Sequence
  Synthetic
caccgctgtcccaaaaggtcaagtgggtagttccctcatctgtgtgacgttgcagttccttttcgtggctgctgccagtacattctgtagtgtgttctggaatggggaaggtacagcgctcatatcagcagccagggcct

SEQ ID NO: 5401 - DNA, 140 bp, Artificial Sequence
  Synthetic
aggccctggctgctgatatgctgtcgcgccgcctagaagaaggagagggagaaacctgactgtgacatgtgatgagagagaagggaatataacacccatggctagcgtccgattctttaggaccttttgggacagcggtg

SEQ ID NO: 5402 - DNA, 140 bp, Artificial Sequence
  Synthetic
caccgctgtcccaaaaggtcctaaagaatcggacgctagccatgggtgttatattcccttctctctcatcacatgtcacagtcaggtttctccctctccttcttctaggcggcgcgacagcatatcagcagccagggcct

SEQ ID NO: 5403 - DNA, 140 bp, Artificial Sequence
  Synthetic
aggccctggctgctgatatgcgagaatactgggaagaatttgctgccagccctattaggataacaactgagaatctaacaacctatgtcactaaattaaaggggccgaaagcagcagcgtgaccttttgggacagcggtg

SEQ ID NO: 5404 - DNA, 140 bp, Artificial Sequence
  Synthetic
caccgctgtcccaaaaggtcacgctgctgctttcggcccctttaatttagtgacataggttgttagattctcagttgttatcctaatagggctggcagcaaattcttcccagtattctcgcatatcagcagccagggcct

SEQ ID NO: 5405 - DNA, 140 bp, Artificial Sequence
  Synthetic
aggccctggctgctgatatgtagaaacggacatagcctcctttgataagagccaagatgactcacttgcgcttactgccttaatgctgttagaagatttgggagtggatcactccctgttgaccttttgggacagcggtg

SEQ ID NO: 5406 - DNA, 140 bp, Artificial Sequence
  Synthetic
caccgctgtcccaaaaggtcaacagggagtgatccactcccaaatcttctaacagcattaaggcagtaagcgcaagtgagtcatcttggctcttatcaaaggaggctatgtccgtttctacatatcagcagccagggcct

SEQ ID NO: 5407 - DNA, 140 bp, Artificial Sequence
  Synthetic
atacgccatgctgggtctccccgatctccttcggagcaccaagcgagacgttccccatcacatttggggacttcgacgaaggagaaatcgaaagcttgtcttctgagctactaactttcgcgtacttgggagtcggccat

SEQ ID NO: 5408 - DNA, 140 bp, Artificial Sequence
  Synthetic
atggccgactcccaagtacgcgaaagttagtagctcagaagacaagctttcgatttctccttcgtcgaagtccccaaatgtgatggggaacgtctcgcttggtgctccgaaggagatcggggagacccagcatggcgtat

SEQ ID NO: 5409 - DNA, 140 bp, Artificial Sequence
  Synthetic
atacgccatgctgggtctcctgatgaagtaatcagatggcaacgaacagggctaatagaagagctggagaaagcagtgtactctaggtacgaagtgcagggtatatcagttgcggtaatgcgtacttgggagtcggccat

SEQ ID NO: 5410 - DNA, 140 bp, Artificial Sequence
  Synthetic
atggccgactcccaagtacgcattaccgcaactgatataccctgcacttcgtacctagagtacactgctttctccagctcttctattagccctgttcgttgccatctgattacttcatcaggagacccagcatggcgtat

SEQ ID NO: 5411 - DNA, 140 bp, Artificial Sequence
  Synthetic
atacgccatgctgggtctccgggacttcctacccggtgaagtggatgacttgacagatagcgactggtccacgtgcccagacacggacgacgagttatgactagacagggcaggtgggtacgtacttgggagtcggccat

SEQ ID NO: 5412 - DNA, 140 bp, Artificial Sequence
  Synthetic
atggccgactcccaagtacgtacccacctgccctgtctagtcataactcgtcgtccgtgtctgggcacgtggaccagtcgctatctgtcaagtcatccacttcaccgggtaggaagtcccggagacccagcatggcgtat

SEQ ID NO: 5413 - DNA, 140 bp, Artificial Sequence
  Synthetic
aggccctggctgctgatatgacgtgcccagacacggacgacgagttatgactagacagggcaggtgggtatatattctcgtcggacactggtccaggtcatttacaacagaagtcggtacgaccttttgggacagcggtg

SEQ ID NO: 5414 - DNA, 140 bp, Artificial Sequence
  Synthetic
caccgctgtcccaaaaggtcgtaccgacttctgttgtaaatgacctggaccagtgtccgacgagaatatatacccacctgccctgtctagtcataactcgtcgtccgtgtctgggcacgtcatatcagcagccagggcct

SEQ ID NO: 5415 - DNA, 140 bp, Artificial Sequence
  Synthetic
atacgccatgctgggtctcctggagtttatcccaacccaaactttctacaataggagataccagcctcgaccttggactccgcgccctactatccaagttatcagacccagactgcgtcccgtacttgggagtcggccat

SEQ ID NO: 5416 - DNA, 140 bp, Artificial Sequence
  Synthetic
atggccgactcccaagtacgggacgcagtctgggtctgataacttggatagtagggcgcggagtccaaggtcgaggctggtatctcctattgtagaaagtttgggttgggataaactccaggagacccagcatggcgtat

SEQ ID NO: 5417 - DNA, 140 bp, Artificial Sequence
  Synthetic
atacgccatgctgggtctccgcaaaggaaagccgggcaacttgcccagctgatctcagcagttaataaattgacaatgcgcgcggtacctcaacagaagccgcgcaagaatcggaagaatcgtacttgggagtcggccat

SEQ ID NO: 5418 - DNA, 140 bp, Artificial Sequence
  Synthetic
atggccgactcccaagtacgattcttccgattcttgcgcggcttctgttgaggtaccgcgcgcattgtcaatttattaactgctgagatcagctgggcaagttgcccggctttcctttgcggagacccagcatggcgtat

SEQ ID NO: 5419 - DNA, 140 bp, Artificial Sequence
  Synthetic
atacgccatgctgggtctccactccaggagagtgcgtccatggccaatagaagcaggtatcagtcacgcaaagtagaaaatatgaaagcaacaatcatccagagactaaagagaggctgtcgtacttgggagtcggccat

SEQ ID NO: 5420 - DNA, 140 bp, Artificial Sequence
  Synthetic
atggccgactcccaagtacgacagcctctctttagtctctggatgattgttgctttcatattttctactttgcgtgactgatacctgcttctattggccatggacgcactctcctggagtggagacccagcatggcgtat

SEQ ID NO: 5421 - DNA, 140 bp, Artificial Sequence
  Synthetic
aggccctggctgctgatatgaatgaagccagcacacgtaaaggggaccatcgataatgcggacctggccaaattggccttcaagcgatcatctaagtacgaccttgaatgcgcgcagatagaccttttgggacagcggtg

SEQ ID NO: 5422 - DNA, 140 bp, Artificial Sequence
  Synthetic
caccgctgtcccaaaaggtctatctgcgcgcattcaaggtcgtacttagatgatcgcttgaaggccaatttggccaggtccgcattatcgatggtcccctttacgtgtgctggcttcattcatatcagcagccagggcct

SEQ ID NO: 5423 - DNA, 140 bp, Artificial Sequence
  Synthetic
atacgccatgctgggtctccaaactgtacttaatggcagagaccccgaaagtcccgacttatcggaccatatacccggcgcctgtgtactcgcctccgatcaatgtccgattgtccaacccgtacttgggagtcggccat

SEQ ID NO: 5424 - DNA, 140 bp, Artificial Sequence
  Synthetic
atggccgactcccaagtacgggttggacaatcggacattgatcggaggcgagtacacaggcgccgggtatatggtccgataagtcgggactttcggggtctctgccattaagtacagtttggagacccagcatggcgtat

SEQ ID NO: 5425 - DNA, 140 bp, Artificial Sequence
  Synthetic
aggccctggctgctgatatgatacccggcgcctgtgtactcgcctccgatcaatgtccgattgtccaaccccgagtccgcagtggcagcctgtaatgagttcttagctagaaactacccagaccttttgggacagcggtg

SEQ ID NO: 5426 - DNA, 140 bp, Artificial Sequence
  Synthetic
caccgctgtcccaaaaggtctgggtagtttctagctaagaactcattacaggctgccactgcggactcggggttggacaatcggacattgatcggaggcgagtacacaggcgccgggtatcatatcagcagccagggcct

SEQ ID NO: 5427 - DNA, 140 bp, Artificial Sequence
  Synthetic
atacgccatgctgggtctcccgaaaatcacccctgagggggccgaagagtggagtcttgccattccagttatgtgtctgctggcaaacaccacgttcccctgctcccagcccccttgcgccgtacttgggagtcggccat

SEQ ID NO: 5428 - DNA, 140 bp, Artificial Sequence
  Synthetic
atggccgactcccaagtacggcgcaagggggctgggagcaggggaacgtggtgtttgccagcagacacataactggaatggcaagactccactcttcggccccctcaggggtgattttcgggagacccagcatggcgtat

SEQ ID NO: 5429 - DNA, 140 bp, Artificial Sequence
  Synthetic
atacgccatgctgggtctccactgtttcatcataccaaatcaccgacgagtatgatgcatatctagacatggtggacgggtcggagagttgtctggaccgagcgacattcaatccgtcaacgtacttgggagtcggccat

SEQ ID NO: 5430 - DNA, 140 bp, Artificial Sequence
  Synthetic
atggccgactcccaagtacgttgacggattgaatgtcgctcggtccagacaactctccgacccgtccaccatgtctagatatgcatcatactcgtcggtgatttggtatgatgaaacagtggagacccagcatggcgtat

SEQ ID NO: 5431 - DNA, 140 bp, Artificial Sequence
  Synthetic
atacgccatgctgggtctccgacgggacgctgaaaatccaggtttccttgcaaatcggaataaagacggatgatagccatgattggaccaagctgcgttacatggataatcacatgccagcgtacttgggagtcggccat

SEQ ID NO: 5432 - DNA, 140 bp, Artificial Sequence
  Synthetic
atggccgactcccaagtacgctggcatgtgattatccatgtaacgcagcttggtccaatcatggctatcatccgtctttattccgatttgcaaggaaacctggattttcagcgtcccgtcggagacccagcatggcgtat

SEQ ID NO: 5433 - DNA, 140 bp, Artificial Sequence
  Synthetic
aggccctggctgctgatatggaagagtggagtcttgtcatcccagttatgtgcctgttggcaaacaccacgttcccgtgctcccagcccccttgcacgccctgctgctacgaaaaggaacgaccttttgggacagcggtg

SEQ ID NO: 5434 - DNA, 140 bp, Artificial Sequence
  Synthetic
caccgctgtcccaaaaggtcgttccttttcgtagcagcagggcgtgcaagggggctgggagcacgggaacgtggtgtttgccaacaggcacataactgggatgacaagactccactcttccatatcagcagccagggcct

SEQ ID NO: 5435 - DNA, 140 bp, Artificial Sequence
  Synthetic
aggccctggctgctgatatggaaactccaggagagtgcatccatggccaacagaagcaggtatcagtcgcgcaaagtagaaaacatgaaagcagcaatcatccagagactaaagagaggcgaccttttgggacagcggtg

SEQ ID NO: 5436 - DNA, 140 bp, Artificial Sequence
  Synthetic
caccgctgtcccaaaaggtcgcctctctttagtctctggatgattgctgctttcatgttttctactttgcgcgactgatacctgcttctgttggccatggatgcactctcctggagtttccatatcagcagccagggcct

SEQ ID NO: 5437 - DNA, 140 bp, Artificial Sequence
  Synthetic
atacgccatgctgggtctcctcccgaccgcagcacggtagagaattaccttgcagcacatacgcgcagagtaccgctgcaactgccgaggagatagaggtacatatgcccccagacaccccgtacttgggagtcggccat

SEQ ID NO: 5438 - DNA, 140 bp, Artificial Sequence
  Synthetic
atggccgactcccaagtacggggtgtctgggggcatatgtacctctatctcctcggcagttgcagcggtactctgcgcgtatgtgctgcaaggtaattctctaccgtgctgcggtcgggaggagacccagcatggcgtat

SEQ ID NO: 5439 - DNA, 140 bp, Artificial Sequence
  Synthetic
atacgccatgctgggtctcctggactcggcagtattcaacgtggagtgttttaaaaaattcgcatgcaaccgagaatactgggaagaatttgctgccagccctattaggataacaactgacgtacttgggagtcggccat

SEQ ID NO: 5440 - DNA, 140 bp, Artificial Sequence
  Synthetic
atggccgactcccaagtacgtcagttgttatcctaatagggctggcagcaaattcttcccagtattctcggttgcatgcgaattttttaaaacactccacgttgaatactgccgagtccaggagacccagcatggcgtat

SEQ ID NO: 5441 - DNA, 140 bp, Artificial Sequence
  Synthetic
aggccctggctgctgatatgcgagaatactgggaagaatttgctgccagccctattaggataacaactgagaatctaacaacctatgtcactaaattaaaggggccaaaagcagcagcgtgaccttttgggacagcggtg

SEQ ID NO: 5442 - DNA, 140 bp, Artificial Sequence
  Synthetic
caccgctgtcccaaaaggtcacgctgctgcttttggcccctttaatttagtgacataggttgttagattctcagttgttatcctaatagggctggcagcaaattcttcccagtattctcgcatatcagcagccagggcct

SEQ ID NO: 5443 - DNA, 140 bp, Artificial Sequence
  Synthetic
atacgccatgctgggtctcctcctctggcaaatgtgacatgcagggtgcctaaagcaaggaaccccaccgtgacgtacgggaaaaaccaagtcaccatgctgctgtatcctgaccacccacgtacttgggagtcggccat

SEQ ID NO: 5444 - DNA, 140 bp, Artificial Sequence
  Synthetic
atggccgactcccaagtacgtgggtggtcaggatacagcagcatggtgacttggtttttcccgtacgtcacggtggggttccttgctttaggcaccctgcatgtcacatttgccagaggaggagacccagcatggcgtat

SEQ ID NO: 5445 - DNA, 140 bp, Artificial Sequence
  Synthetic
atacgccatgctgggtctcctgtttgcaaaaacccataatctgctgccactgcaggatgtaccaatggataggttcacagtagacatgaaaagggatgtgaaggtaactcctggtacaaacgtacttgggagtcggccat

SEQ ID NO: 5446 - DNA, 140 bp, Artificial Sequence
  Synthetic
atggccgactcccaagtacgtttgtaccaggagttaccttcacatcccttttcatgtctactgtgaacctatccattggtacatcctgcagtggcagcagattatgggtttttgcaaacaggagacccagcatggcgtat

SEQ ID NO: 5447 - DNA, 140 bp, Artificial Sequence
  Synthetic
aggccctggctgctgatatgctccttgcaaatcggaataaagacggatgacagccacgattggaccaagctgcgttatatggacaaccacatgccagcagacgcagagagggcggggctagaccttttgggacagcggtg

SEQ ID NO: 5448 - DNA, 140 bp, Artificial Sequence
  Synthetic
caccgctgtcccaaaaggtctagccccgccctctctgcgtctgctggcatgtggttgtccatataacgcagcttggtccaatcgtggctgtcatccgtctttattccgatttgcaaggagcatatcagcagccagggcct

SEQ ID NO: 5449 - DNA, 140 bp, Artificial Sequence
  Synthetic
atacgccatgctgggtctccgcacacagaggaaagacctaaggtgcaggttatacaggcggctgaacccttggcaacagcgtacctatgtggaattcacagagagctggttaggagattgcgtacttgggagtcggccat

SEQ ID NO: 5450 - DNA, 140 bp, Artificial Sequence
  Synthetic
atggccgactcccaagtacgcaatctcctaaccagctctctgtgaattccacataggtacgctgttgccaagggttcagccgcctgtataacctgcaccttaggtctttcctctgtgtgcggagacccagcatggcgtat

SEQ ID NO: 5451 - DNA, 140 bp, Artificial Sequence
  Synthetic
aggccctggctgctgatatgtctacaaacggtacagcccacggccacccgcatgagataattttgtattattatgagctgtaccctaccatgactgtggtagttgtgtcagtggcctcgtgaccttttgggacagcggtg

SEQ ID NO: 5452 - DNA, 140 bp, Artificial Sequence
  Synthetic
caccgctgtcccaaaaggtcacgaggccactgacacaactaccacagtcatggtagggtacagctcataataatacaaaattatctcatgcgggtggccgtgggctgtaccgtttgtagacatatcagcagccagggcct

SEQ ID NO: 5453 - DNA, 140 bp, Artificial Sequence
  Synthetic
atacgccatgctgggtctccaccaagaggccgcggcatacctgtggaacgagcagcagcctttgttttggctgcaagcccttattccgctggcagccctgattgtcctatgcaactgtctcgtacttgggagtcggccat

SEQ ID NO: 5454 - DNA, 140 bp, Artificial Sequence
  Synthetic
atggccgactcccaagtacgagacagttgcataggacaatcagggctgccagcggaataagggcttgcagccaaaacaaaggctgctgctcgttccacaggtatgccgcggcctcttggtggagacccagcatggcgtat

SEQ ID NO: 5455 - DNA, 140 bp, Artificial Sequence
  Synthetic
aggccctggctgctgatatgtggcaacagcgtacctatgtggaattcacagagagctggttaggagattgaacgccgttctcctacccaatgtgcatacactatttgacatgtctgccgagaccttttgggacagcggtg

SEQ ID NO: 5456 - DNA, 140 bp, Artificial Sequence
  Synthetic
caccgctgtcccaaaaggtctcggcagacatgtcaaatagtgtatgcacattgggtaggagaacggcgttcaatctcctaaccagctctctgtgaattccacataggtacgctgttgccacatatcagcagccagggcct

SEQ ID NO: 5457 - DNA, 140 bp, Artificial Sequence
  Synthetic
aggccctggctgctgatatgctgcaagcccttattccgctggcagccctgattgtcctatgcaactgtctgagactcttaccatgttgttgtaaaacgttgatttttttagccgtaatgagaccttttgggacagcggtg

SEQ ID NO: 5458 - DNA, 140 bp, Artificial Sequence
  Synthetic
caccgctgtcccaaaaggtctcattacggctaaaaaaatcaacgttttacaacaacatggtaagagtctcagacagttgcataggacaatcagggctgccagcggaataagggcttgcagcatatcagcagccagggcct

SEQ ID NO: 5459 - DNA, 140 bp, Artificial Sequence
  Synthetic
atacgccatgctgggtctccccccatggtactggagatggagcttctgtcagtcactttggagccaactctatcgcttgattacatcacgtgcgagtataaaaccgtcaccccgtctccgcgtacttgggagtcggccat

SEQ ID NO: 5460 - DNA, 140 bp, Artificial Sequence
  Synthetic
atggccgactcccaagtacgcggagacggggtgacggttttatactcgcacgtgatgtaatcaagcgatagagttggctccaaagtgactgacagaagctccatctccagtaccatggggggagacccagcatggcgtat

SEQ ID NO: 5461 - DNA, 140 bp, Artificial Sequence
  Synthetic
aggccctggctgctgatatgggacttcgatgccattatagccgcacacttcaagccaggagacgctgttttagaaacggacatagcctcctttgataagagccaagatgactcacttgcggaccttttgggacagcggtg

SEQ ID NO: 5462 - DNA, 140 bp, Artificial Sequence
  Synthetic
caccgctgtcccaaaaggtccgcaagtgagtcatcttggctcttatcaaaggaggctatgtccgtttctaaaacagcgtctcctggcttgaagtgtgcggctataatggcatcgaagtcccatatcagcagccagggcct

SEQ ID NO: 5463 - DNA, 140 bp, Artificial Sequence
  Synthetic
aggccctggctgctgatatgcaggtacgcgcttcaagttcggcgctatgatgaaatccggtatgttcctaactctgttcgtcaacacattgttaaatatcaccatcgctagccgggtgttgaccttttgggacagcggtg

SEQ ID NO: 5464 - DNA, 140 bp, Artificial Sequence
  Synthetic
caccgctgtcccaaaaggtcaacacccggctagcgatggtgatatttaacaatgtgttgacgaacagagttaggaacataccggatttcatcatagcgccgaacttgaagcgcgtacctgcatatcagcagccagggcct

SEQ ID NO: 5465 - DNA, 140 bp, Artificial Sequence
  Synthetic
atacgccatgctgggtctccacaactaggtatgaaagtatatgtgtcccctaagagacacaccacatatagctaagactcaatagataagtatagatcaaagggctgaacaacccctgaacgtacttgggagtcggccat

SEQ ID NO: 5466 - DNA, 140 bp, Artificial Sequence
  Synthetic
atggccgactcccaagtacgttcaggggttgttcagccctttgatctatacttatctattgagtcttagctatatgtggtgtgtctcttaggggacacatatactttcatacctagttgtggagacccagcatggcgtat

SEQ ID NO: 5467 - DNA, 140 bp, Artificial Sequence
  Synthetic
aggccctggctgctgatatgccaactgtctcatcataccaaattaccgacgagtatgatgcatatctagacatggtggacgggtcggagagttgcctggaccgagcgacattcaatccgtgaccttttgggacagcggtg

SEQ ID NO: 5468 - DNA, 140 bp, Artificial Sequence
  Synthetic
caccgctgtcccaaaaggtcacggattgaatgtcgctcggtccaggcaactctccgacccgtccaccatgtctagatatgcatcatactcgtcggtaatttggtatgatgagacagttggcatatcagcagccagggcct

SEQ ID NO: 5469 - DNA, 140 bp, Artificial Sequence
  Synthetic
atacgccatgctgggtctccagctccttacttttgtggagggtttatactgcacgatactgtgacaggaacagcttgcagagtggcggacccgctaaaaaggttatttaaactgggcaaacgtacttgggagtcggccat

SEQ ID NO: 5470 - DNA, 140 bp, Artificial Sequence
  Synthetic
atggccgactcccaagtacgtttgcccagtttaaataacctttttagcgggtccgccactctgcaagctgttcctgtcacagtatcgtgcagtataaaccctccacaaaagtaaggagctggagacccagcatggcgtat

SEQ ID NO: 5471 - DNA, 140 bp, Artificial Sequence
  Synthetic
aggccctggctgctgatatgacagaagtaggtaagaaggtatatgtgtcccctaagagacacaccatatatagctaagaatcaatagataagtatagatcaaagggccgaataacccctggaccttttgggacagcggtg

SEQ ID NO: 5472 - DNA, 140 bp, Artificial Sequence
  Synthetic
caccgctgtcccaaaaggtccaggggttattcggccctttgatctatacttatctattgattcttagctatatatggtgtgtctcttaggggacacatataccttcttacctacttctgtcatatcagcagccagggcct

SEQ ID NO: 5473 - DNA, 140 bp, Artificial Sequence
  Synthetic
atacgccatgctgggtctcctagcacaccgaactcttccataattctccgaacccacagggacgtaggagatgttcaaagtggctataaaaccctgaatagtaataaaatataaaattaacgtacttgggagtcggccat

SEQ ID NO: 5474 - DNA, 140 bp, Artificial Sequence
  Synthetic
atggccgactcccaagtacgttaattttatattttattactattcagggttttatagccactttgaacatctcctacgtccctgtgggttcggagaattatggaagagttcggtgtgctaggagacccagcatggcgtat

SEQ ID NO: 5475 - DNA, 140 bp, Artificial Sequence
  Synthetic
aggccctggctgctgatatgtgatgaagtaatcagatggcaacgaacagggctaatagatgagctggagaaagcggtgtactctaggtacgaagtgcagggtatatcagttgcggtaatggaccttttgggacagcggtg

SEQ ID NO: 5476 - DNA, 140 bp, Artificial Sequence
  Synthetic
caccgctgtcccaaaaggtccattaccgcaactgatataccctgcacttcgtacctagagtacaccgctttctccagctcatctattagccctgttcgttgccatctgattacttcatcacatatcagcagccagggcct

SEQ ID NO: 5477 - DNA, 140 bp, Artificial Sequence
  Synthetic
aggccctggctgctgatatgtccatggccacctttgcaagctccagatccaacttcgagaagctcagaggacccgtcataactttgtacggcggtcctaaataggtacgcactacagctagaccttttgggacagcggtg

SEQ ID NO: 5478 - DNA, 140 bp, Artificial Sequence
  Synthetic
caccgctgtcccaaaaggtctagctgtagtgcgtacctatttaggaccgccgtacaaagttatgacgggtcctctgagcttctcgaagttggatctggagcttgcaaaggtggccatggacatatcagcagccagggcct

SEQ ID NO: 5479 - DNA, 140 bp, Artificial Sequence
  Synthetic
atacgccatgctgggtctccgtaggctacgtgtgacacacgtagcctaccagtttcttactgctctactctgcaaagcaagagattaataacccatcatggattctgtgtacgtggatatcgtacttgggagtcggccat

SEQ ID NO: 5480 - DNA, 140 bp, Artificial Sequence
  Synthetic
atggccgactcccaagtacgatatccacgtacacagaatccatgatgggttattaatctcttgctttgcagagtagagcagtaagaaactggtaggctacgtgtgtcacacgtagcctacggagacccagcatggcgtat

SEQ ID NO: 5481 - DNA, 140 bp, Artificial Sequence
  Synthetic
aggccctggctgctgatatgcgatggtgtacaacgaaagagagttcgtaaacagaaagttacaccacattgcgatgcaaggaccagctctgaacactgacgaagagtcgtatgagcttgtgaccttttgggacagcggtg

SEQ ID NO: 5482 - DNA, 140 bp, Artificial Sequence
  Synthetic
caccgctgtcccaaaaggtcacaagctcatacgactcttcgtcagtgttcagagctggtccttgcatcgcaatgtggtgtaactttctgtttacgaactctctttcgttgtacaccatcgcatatcagcagccagggcct

SEQ ID NO: 5483 - DNA, 140 bp, Artificial Sequence
  Synthetic
atacgccatgctgggtctccgaagacactctctggtgacccgtggataaagacgctgcagaacccaccgaaaggaaacttcaaggcaactattaaggagtgggaggtggagcacgcatcgcgtacttgggagtcggccat

SEQ ID NO: 5484 - DNA, 140 bp, Artificial Sequence
  Synthetic
atggccgactcccaagtacgcgatgcgtgctccacctcccactccttaatagttgccttgaagtttcctttcggtgggttctgcagcgtctttatccacgggtcaccagagagtgtcttcggagacccagcatggcgtat

SEQ ID NO: 5485 - DNA, 140 bp, Artificial Sequence
  Synthetic
atacgccatgctgggtctccagccctgattgttctatgcaactgtctgagactcttaccatgctgctgtaaaacgttggcttttttagccgtaatgagagtcggtgcacagattgcgagccgtacttgggagtcggccat

SEQ ID NO: 5486 - DNA, 140 bp, Artificial Sequence
  Synthetic
atggccgactcccaagtacggctcgcaatctgtgcaccgactctcattacggctaaaaaagccaacgttttacagcagcatggtaagagtctcagacagttgcatagaacaatcagggctggagacccagcatggcgtat

SEQ ID NO: 5487 - DNA, 140 bp, Artificial Sequence
  Synthetic
aggccctggctgctgatatggcgtacgaacacgtaacagtgatcccgaacacggtgggagtaccgtataagactctagtcaatagacctggctacagccccatggtattggagatggaacgaccttttgggacagcggtg

SEQ ID NO: 5488 - DNA, 140 bp, Artificial Sequence
  Synthetic
caccgctgtcccaaaaggtcgttccatctccaataccatggggctgtagccaggtctattgactagagtcttatacggtactcccaccgtgttcgggatcactgttacgtgttcgtacgccatatcagcagccagggcct

SEQ ID NO: 5489 - DNA, 140 bp, Artificial Sequence
  Synthetic
aggccctggctgctgatatggatcagagcatacggttatgcagatagaaccagtgaacgagtaatctgcgtactgggacgtaagtttagatcgtccagagcattgaaaccaccatgtatcgaccttttgggacagcggtg

SEQ ID NO: 5490 - DNA, 140 bp, Artificial Sequence
  Synthetic
caccgctgtcccaaaaggtcgatacatggtggtttcaatgctctggacgatctaaacttacgtcccagtacgcagattactcgttcactggttctatctgcataaccgtatgctctgatccatatcagcagccagggcct

SEQ ID NO: 5491 - DNA, 140 bp, Artificial Sequence
  Synthetic
aggccctggctgctgatatgaatgaagccagcacacgtaaaggggaccatcgataatgcggacctggccaaattggccttcaagcggtcatctaagtacgaccttgaatgcgcgcagatagaccttttgggacagcggtg

SEQ ID NO: 5492 - DNA, 140 bp, Artificial Sequence
  Synthetic
caccgctgtcccaaaaggtctatctgcgcgcattcaaggtcgtacttagatgaccgcttgaaggccaatttggccaggtccgcattatcgatggtcccctttacgtgtgctggcttcattcatatcagcagccagggcct

SEQ ID NO: 5493 - DNA, 140 bp, Artificial Sequence
  Synthetic
aggccctggctgctgatatgggctgtaaactgtatttaatggcagagaccccgaaagtcccgacttatcggaccgtatacccggcacctgtgtactcgcctccgatcaacgtccgattgtgaccttttgggacagcggtg

SEQ ID NO: 5494 - DNA, 140 bp, Artificial Sequence
  Synthetic
caccgctgtcccaaaaggtcacaatcggacgttgatcggaggcgagtacacaggtgccgggtatacggtccgataagtcgggactttcggggtctctgccattaaatacagtttacagcccatatcagcagccagggcct

SEQ ID NO: 5495 - DNA, 140 bp, Artificial Sequence
  Synthetic
atacgccatgctgggtctcctcaccatccctacaggtgcgggcaaaccaggggacagcggtagaccgatcttcgacaacaaggggcgcgtggtggccatagttttaggaggagctaatgacgtacttgggagtcggccat

SEQ ID NO: 5496 - DNA, 140 bp, Artificial Sequence
  Synthetic
atggccgactcccaagtacgtcattagctcctcctaaaactatggccaccacgcgccccttgttgtcgaagatcggtctaccgctgtcccctggtttgcccgcacctgtagggatggtgaggagacccagcatggcgtat

SEQ ID NO: 5497 - DNA, 140 bp, Artificial Sequence
  Synthetic
atacgccatgctgggtctccacctgattacagctgtaaggtcttcaccggcgtctacccatttatgtggggcggcgcctactgcttctgcgacaccgaaaatacgcaattgagcgaagcacgtacttgggagtcggccat

SEQ ID NO: 5498 - DNA, 140 bp, Artificial Sequence
  Synthetic
atggccgactcccaagtacgtgcttcgctcaattgcgtattttcggtgtcgcagaagcagtaggcgccgccccacataaatgggtagacgccggtgaagaccttacagctgtaatcaggtggagacccagcatggcgtat

SEQ ID NO: 5499 - DNA, 140 bp, Artificial Sequence
  Synthetic
aggccctggctgctgatatgcaacaaaaatcataaaatagaaaactagaaatagaagtaggtaagaaggtatatgtgtcccctaagagacacaccatatatagctaagaatcaatagatagaccttttgggacagcggtg

SEQ ID NO: 5500 - DNA, 140 bp, Artificial Sequence
  Synthetic
caccgctgtcccaaaaggtctatctattgattcttagctatatatggtgtgtctcttaggggacacatataccttcttacctacttctatttctagttttctattttatgatttttgttgcatatcagcagccagggcct

SEQ ID NO: 5501 - DNA, 140 bp, Artificial Sequence
  Synthetic
atacgccatgctgggtctcccgaaaatcacccctgagggggccgaagagtggagtcttgccattccagttatgtgcctgctggcaaacaccacgttcccctgctcccagcccccttgcgccgtacttgggagtcggccat

SEQ ID NO: 5502 - DNA, 140 bp, Artificial Sequence
  Synthetic
atggccgactcccaagtacggcgcaagggggctgggagcaggggaacgtggtgtttgccagcaggcacataactggaatggcaagactccactcttcggccccctcaggggtgattttcgggagacccagcatggcgtat

SEQ ID NO: 5503 - DNA, 140 bp, Artificial Sequence
  Synthetic
atacgccatgctgggtctccagcatagatcaaagggctgaacaacccctgaataataacaaaatataaaaaccaataaaaatcataaaatagaaaaccacaaatagaagtagttcaaaggcgtacttgggagtcggccat

SEQ ID NO: 5504 - DNA, 140 bp, Artificial Sequence
  Synthetic
atggccgactcccaagtacgcctttgaactacttctatttgtggttttctattttatgatttttattggtttttatattttgttattattcaggggttgttcagccctttgatctatgctggagacccagcatggcgtat

SEQ ID NO: 5505 - DNA, 140 bp, Artificial Sequence
  Synthetic
atacgccatgctgggtctccaccctgctgctacgaaaaagagccggagaaaaccctgcgcatgcttgaagacaacgtcatgagccccgggtactatcagctgctacaagcatccttaacacgtacttgggagtcggccat

SEQ ID NO: 5506 - DNA, 140 bp, Artificial Sequence
  Synthetic
atggccgactcccaagtacgtgttaaggatgcttgtagcagctgatagtacccggggctcatgacgttgtcttcaagcatgcgcagggttttctccggctctttttcgtagcagcagggtggagacccagcatggcgtat

SEQ ID NO: 5507 - DNA, 140 bp, Artificial Sequence
  Synthetic
atacgccatgctgggtctccgctataaaacccctgaatagtaacaaaatataaaactaataaaaatcaaacgaataccataattggcaatcggaagagatgtaggtacttaagcttcttacgtacttgggagtcggccat

SEQ ID NO: 5508 - DNA, 140 bp, Artificial Sequence
  Synthetic
atggccgactcccaagtacgtaagaagcttaagtacctacatctcttccgattgccaattatggtattcgtttgatttttattagttttatattttgttactattcaggggttttatagcggagacccagcatggcgtat

SEQ ID NO: 5509 - DNA, 140 bp, Artificial Sequence
  Synthetic
aggccctggctgctgatatgacaacgtcatgagccccgggtactatcagctgctacaagcatccttaacatgttctccccgccgccagcgacgcagtattaaggacaacttcaatgtctagaccttttgggacagcggtg

SEQ ID NO: 5510 - DNA, 140 bp, Artificial Sequence
  Synthetic
caccgctgtcccaaaaggtctagacattgaagttgtccttaatactgcgtcgctggcggcggggagaacatgttaaggatgcttgtagcagctgatagtacccggggctcatgacgttgtcatatcagcagccagggcct

SEQ ID NO: 5511 - DNA, 140 bp, Artificial Sequence
  Synthetic
atacgccatgctgggtctcctaaagccacaagaccgtacctagctcactgtcccgactgtggagaagggcactcgtgccatagtcccgtagcgctagaacgcatcagaaacgaagcgacacgtacttgggagtcggccat

SEQ ID NO: 5512 - DNA, 140 bp, Artificial Sequence
  Synthetic
atggccgactcccaagtacgtgtcgcttcgtttctgatgcgttctagcgctacgggactatggcacgagtgcccttctccacagtcgggacagtgagctaggtacggtcttgtggctttaggagacccagcatggcgtat

SEQ ID NO: 5513 - DNA, 140 bp, Artificial Sequence
  Synthetic
atacgccatgctgggtctccaaagcagccgaactcgctttgagatgtaggcgtagcacaccgaactcttccataattctccgaacccacagggacgtaggagatgttcaaagtgactatacgtacttgggagtcggccat

SEQ ID NO: 5514 - DNA, 140 bp, Artificial Sequence
  Synthetic
atggccgactcccaagtacgtatagtcactttgaacatctcctacgtccctgtgggttcggagaattatggaagagttcggtgtgctacgcctacatctcaaagcgagttcggctgctttggagacccagcatggcgtat

SEQ ID NO: 5515 - DNA, 140 bp, Artificial Sequence
  Synthetic
aggccctggctgctgatatgactcgtgccatagtcccgtagcgctagaacgcatcagaaacgaagcgacagacgggacgctgaaaatccaggtttccttgcaaatcggaataaagacggagaccttttgggacagcggtg

SEQ ID NO: 5516 - DNA, 140 bp, Artificial Sequence
  Synthetic
caccgctgtcccaaaaggtctccgtctttattccgatttgcaaggaaacctggattttcagcgtcccgtctgtcgcttcgtttctgatgcgttctagcgctacgggactatggcacgagtcatatcagcagccagggcct

SEQ ID NO: 5517 - DNA, 140 bp, Artificial Sequence
  Synthetic
aggccctggctgctgatatgagccgaactcactttgagatgtaggcatagcataccgaactcttccacaattctccgtacccatagggacgtaggagatgttattttgtttttaatatttgaccttttgggacagcggtg

SEQ ID NO: 5518 - DNA, 140 bp, Artificial Sequence
  Synthetic
caccgctgtcccaaaaggtcaaatattaaaaacaaaataacatctcctacgtccctatgggtacggagaattgtggaagagttcggtatgctatgcctacatctcaaagtgagttcggctcatatcagcagccagggcct

SEQ ID NO: 5519 - DNA, 140 bp, Artificial Sequence
  Synthetic
atacgccatgctgggtctcctcccgaccgcagcacggtagagaactaccttgcagcacgtacgcgcagagtaccgctgcaactgccgaggagatagaggtacatatgcccccagacaccccgtacttgggagtcggccat

SEQ ID NO: 5520 - DNA, 140 bp, Artificial Sequence
  Synthetic
atggccgactcccaagtacggggtgtctgggggcatatgtacctctatctcctcggcagttgcagcggtactctgcgcgtacgtgctgcaaggtagttctctaccgtgctgcggtcgggaggagacccagcatggcgtat

SEQ ID NO: 5521 - DNA, 140 bp, Artificial Sequence
  Synthetic
aggccctggctgctgatatgactaaccactacagacaaagtgattaataactgcaaggttgatcaatgccatgccgcggtcaccaatcacaaaaaatggcagtataattcccctctggtcgaccttttgggacagcggtg

SEQ ID NO: 5522 - DNA, 140 bp, Artificial Sequence
  Synthetic
caccgctgtcccaaaaggtcgaccagaggggaattatactgccattttttgtgattggtgaccgcggcatggcattgatcaaccttgcagttattaatcactttgtctgtagtggttagtcatatcagcagccagggcct

SEQ ID NO: 5523 - DNA, 140 bp, Artificial Sequence
  Synthetic
atacgccatgctgggtctccccgcgtaatgttgaactcggggaccgaaaaggaaaaattcacattccgtttcctctggcaaatgtgacatgcagggtgcctaaagcaaggaaccccaccgcgtacttgggagtcggccat

SEQ ID NO: 5524 - DNA, 140 bp, Artificial Sequence
  Synthetic
atggccgactcccaagtacgcggtggggttccttgctttaggcaccctgcatgtcacatttgccagaggaaacggaatgtgaatttttccttttcggtccccgagttcaacattacgcggggagacccagcatggcgtat

SEQ ID NO: 5525 - DNA, 140 bp, Artificial Sequence
  Synthetic
aggccctggctgctgatatgtcctctggcaaatgtgacatgcagggtgcctaaagcaaggaaccccaccgtgacgtacgggaaaaaccaagtcatcatgctgctgtatcctgaccacccagaccttttgggacagcggtg

SEQ ID NO: 5526 - DNA, 140 bp, Artificial Sequence
  Synthetic
caccgctgtcccaaaaggtctgggtggtcaggatacagcagcatgatgacttggtttttcccgtacgtcacggtggggttccttgctttaggcaccctgcatgtcacatttgccagaggacatatcagcagccagggcct

SEQ ID NO: 5527 - DNA, 140 bp, Artificial Sequence
  Synthetic
atacgccatgctgggtctccacgctcctgtcctaccggaatatgggagaagaaccaaactatcaagaagagtgggtgacgcataagaaggaggtcaggttaaccgtgccgactgaggggccgtacttgggagtcggccat

SEQ ID NO: 5528 - DNA, 140 bp, Artificial Sequence
  Synthetic
atggccgactcccaagtacggcccctcagtcggcacggttaacctgacctccttcttatgcgtcacccactcttcttgatagtttggttcttctcccatattccggtaggacaggagcgtggagacccagcatggcgtat

SEQ ID NO: 5529 - DNA, 140 bp, Artificial Sequence
  Synthetic
atacgccatgctgggtctccgcaaacggaagagatgtaggtacttaagcttcctaaaagcagccgaactcactttgagaagtagccatagcataccgaactcttccacgattctccgaaacgtacttgggagtcggccat

SEQ ID NO: 5530 - DNA, 140 bp, Artificial Sequence
  Synthetic
atggccgactcccaagtacgtttcggagaatcgtggaagagttcggtatgctatggctacttctcaaagtgagttcggctgcttttaggaagcttaagtacctacatctcttccgtttgcggagacccagcatggcgtat

SEQ ID NO: 5531 - DNA, 140 bp, Artificial Sequence
  Synthetic
atacgccatgctgggtctccttcgagaagctcagaggacccgtcataactttgtacggcggtcctaaataggtacacactacagctacctattttgcagaagccgacagcaagtatctaacgtacttgggagtcggccat

SEQ ID NO: 5532 - DNA, 140 bp, Artificial Sequence
  Synthetic
atggccgactcccaagtacgttagatacttgctgtcggcttctgcaaaataggtagctgtagtgtgtacctatttaggaccgccgtacaaagttatgacgggtcctctgagcttctcgaaggagacccagcatggcgtat

SEQ ID NO: 5533 - DNA, 140 bp, Artificial Sequence
  Synthetic
aggccctggctgctgatatgcgacgcagatgcattacaccgtacgaactgacaccaggagctaccgtccctttcctgcttagcctaatatgctgcattagaacagctaaagcggccacatgaccttttgggacagcggtg

SEQ ID NO: 5534 - DNA, 140 bp, Artificial Sequence
  Synthetic
caccgctgtcccaaaaggtcatgtggccgctttagctgttctaatgcagcatattaggctaagcaggaaagggacggtagctcctggtgtcagttcgtacggtgtaatgcatctgcgtcgcatatcagcagccagggcct

SEQ ID NO: 5535 - DNA, 140 bp, Artificial Sequence
  Synthetic
atacgccatgctgggtctccaccaagaggccgcggtatacctgtggaacgagcagcagcctttgttttggctgcaagcccttattccgctggcagccctgattgtcctatgcaactgtctcgtacttgggagtcggccat

SEQ ID NO: 5536 - DNA, 140 bp, Artificial Sequence
  Synthetic
atggccgactcccaagtacgagacagttgcataggacaatcagggctgccagcggaataagggcttgcagccaaaacaaaggctgctgctcgttccacaggtataccgcggcctcttggtggagacccagcatggcgtat

SEQ ID NO: 5537 - DNA, 140 bp, Artificial Sequence
  Synthetic
aggccctggctgctgatatgctgcaagcccttattccgctggcagccctgattgtcctatgcaactgtctgagactcttaccatgttgttgtaaaacgttgacttttttagccgtaatgagaccttttgggacagcggtg

SEQ ID NO: 5538 - DNA, 140 bp, Artificial Sequence
  Synthetic
caccgctgtcccaaaaggtctcattacggctaaaaaagtcaacgttttacaacaacatggtaagagtctcagacagttgcataggacaatcagggctgccagcggaataagggcttgcagcatatcagcagccagggcct

SEQ ID NO: 5539 - DNA, 140 bp, Artificial Sequence
  Synthetic
aggccctggctgctgatatggcgtcggtgcccacactgtgagcgcgtacgaacacgtaacagtgatcccgaacacggtgggagtaccgtataagactctagtcaacagaccgggctacaggaccttttgggacagcggtg

SEQ ID NO: 5540 - DNA, 140 bp, Artificial Sequence
  Synthetic
caccgctgtcccaaaaggtcctgtagcccggtctgttgactagagtcttatacggtactcccaccgtgttcgggatcactgttacgtgttcgtacgcgctcacagtgtgggcaccgacgccatatcagcagccagggcct

SEQ ID NO: 5541 - DNA, 140 bp, Artificial Sequence
  Synthetic
atacgccatgctgggtctcccagggaggtatgcggtcgaagcgtacgacggccgagtcctagtgccctcaggctatgcaatctcgtctgaagacttccagagtctaagcgaaagcgcaaccgtacttgggagtcggccat

SEQ ID NO: 5542 - DNA, 140 bp, Artificial Sequence
  Synthetic
atggccgactcccaagtacggttgcgctttcgcttagactctggaagtcttcagacgagattgcatagcctgagggcactaggactcggccgtcgtacgcttcgaccgcatacctccctgggagacccagcatggcgtat

SEQ ID NO: 5543 - DNA, 140 bp, Artificial Sequence
  Synthetic
atacgccatgctgggtctcctatcgcttgattacatcacgtgcgagtataaaaccgtcatcccgtctccgtacgtgaaatgctgcggtacagcagagtgcaaggacaagagcctacctgacgtacttgggagtcggccat

SEQ ID NO: 5544 - DNA, 140 bp, Artificial Sequence
  Synthetic
atggccgactcccaagtacgtcaggtaggctcttgtccttgcactctgctgtaccgcagcatttcacgtacggagacgggatgacggttttatactcgcacgtgatgtaatcaagcgataggagacccagcatggcgtat

SEQ ID NO: 5545 - DNA, 140 bp, Artificial Sequence
  Synthetic
aggccctggctgctgatatgtacgtgaaatgctgcggtacagcagagtgcaaggacaagagcctacctgattacagctgtaaggtcttcaccggcgtctacccattcatgtggggcggcggaccttttgggacagcggtg

SEQ ID NO: 5546 - DNA, 140 bp, Artificial Sequence
  Synthetic
caccgctgtcccaaaaggtccgccgccccacatgaatgggtagacgccggtgaagaccttacagctgtaatcaggtaggctcttgtccttgcactctgctgtaccgcagcatttcacgtacatatcagcagccagggcct

SEQ ID NO: 5547 - DNA, 140 bp, Artificial Sequence
  Synthetic
aggccctggctgctgatatggcaaagtagaaaacatgaaagcaacaatcatccagagactaaagagaggctgtagactatacttaatgtcagagaccccaaaagtccctacttaccggacgaccttttgggacagcggtg

SEQ ID NO: 5548 - DNA, 140 bp, Artificial Sequence
  Synthetic
caccgctgtcccaaaaggtcgtccggtaagtagggacttttggggtctctgacattaagtatagtctacagcctctctttagtctctggatgattgttgctttcatgttttctactttgccatatcagcagccagggcct

SEQ ID NO: 5549 - DNA, 140 bp, Artificial Sequence
  Synthetic
aggccctggctgctgatatgcccattacatttggggacttcaacgaaggagaaatcgaaagcttgtcttctgagctactaacttttggagacttcttaccaggagaagtggatgacttgagaccttttgggacagcggtg

SEQ ID NO: 5550 - DNA, 140 bp, Artificial Sequence
  Synthetic
caccgctgtcccaaaaggtctcaagtcatccacttctcctggtaagaagtctccaaaagttagtagctcagaagacaagctttcgatttctccttcgttgaagtccccaaatgtaatgggcatatcagcagccagggcct

SEQ ID NO: 5551 - DNA, 140 bp, Artificial Sequence
  Synthetic
aggccctggctgctgatatggagaagtccgaatcatgcaaaacagaatttgcatcagcatatagggctcataccgcatccgcatcagctaagctccgcgtcctttaccaaggaaataatggaccttttgggacagcggtg

SEQ ID NO: 5552 - DNA, 140 bp, Artificial Sequence
  Synthetic
caccgctgtcccaaaaggtccattatttccttggtaaaggacgcggagcttagctgatgcggatgcggtatgagccctatatgctgatgcaaattctgttttgcatgattcggacttctccatatcagcagccagggcct

SEQ ID NO: 5553 - DNA, 140 bp, Artificial Sequence
  Synthetic
atacgccatgctgggtctccgccaggagacactgttctggaaacggacatagcctcctttgataagagccaagacgattcgcttgcgcttactgctttgatgctgttagaggatttagggcgtacttgggagtcggccat

SEQ ID NO: 5554 - DNA, 140 bp, Artificial Sequence
  Synthetic
atggccgactcccaagtacgccctaaatcctctaacagcatcaaagcagtaagcgcaagcgaatcgtcttggctcttatcaaaggaggctatgtccgtttccagaacagtgtctcctggcggagacccagcatggcgtat

SEQ ID NO: 5555 - DNA, 140 bp, Artificial Sequence
  Synthetic
aggccctggctgctgatatgtaaaatcgtggtgtacaaaggcgacgtctacaacatggactacccgcccttcggcgcaggaagaccaggacaatttggcgacatccaaagtcgcacgcctgaccttttgggacagcggtg

SEQ ID NO: 5556 - DNA, 140 bp, Artificial Sequence
  Synthetic
caccgctgtcccaaaaggtcaggcgtgcgactttggatgtcgccaaattgtcctggtcttcctgcgccgaagggcgggtagtccatgttgtagacgtcgcctttgtacaccacgattttacatatcagcagccagggcct

SEQ ID NO: 5557 - DNA, 140 bp, Artificial Sequence
  Synthetic
atacgccatgctgggtctccaacaacacaaaccaaaagaagcagccacctaaaaagaaaccggctcaaaagaaaaagaagccgggccgcagagagaggatgtgcatgaaaatcgaaaatgcgtacttgggagtcggccat

SEQ ID NO: 5558 - DNA, 140 bp, Artificial Sequence
  Synthetic
atggccgactcccaagtacgcattttcgattttcatgcacatcctctctctgcggcccggcttctttttcttttgagccggtttctttttaggtggctgcttcttttggtttgtgttgttggagacccagcatggcgtat

SEQ ID NO: 5559 - DNA, 140 bp, Artificial Sequence
  Synthetic
atacgccatgctgggtctccgagagcgaagacgtctatgctaacacacaactggtactgcagagaccgtccgcgggtacggtgcacgtgccgtactctcaggcaccatctggcttcaagtcgtacttgggagtcggccat

SEQ ID NO: 5560 - DNA, 140 bp, Artificial Sequence
  Synthetic
atggccgactcccaagtacgacttgaagccagatggtgcctgagagtacggcacgtgcaccgtacccgcggacggtctctgcagtaccagttgtgtgttagcatagacgtcttcgctctcggagacccagcatggcgtat

SEQ ID NO: 5561 - DNA, 140 bp, Artificial Sequence
  Synthetic
aggccctggctgctgatatggtcaagcacgaaggtaaggtaacaggttacgcgtgcctggtgggggacaaagtaatgaaaccagcacacgtaaaggggaccatcgataacgcggacctgggaccttttgggacagcggtg

SEQ ID NO: 5562 - DNA, 140 bp, Artificial Sequence
  Synthetic
caccgctgtcccaaaaggtcccaggtccgcgttatcgatggtcccctttacgtgtgctggtttcattactttgtcccccaccaggcacgcgtaacctgttaccttaccttcgtgcttgaccatatcagcagccagggcct

SEQ ID NO: 5563 - DNA, 140 bp, Artificial Sequence
  Synthetic
aggccctggctgctgatatgcatgcctatctccatcgacataccggacgcggccttcactagggtcgtcgacgcgccatctttaacggacatgtcgtgtgaggtaccagcctgcacccatgaccttttgggacagcggtg

SEQ ID NO: 5564 - DNA, 140 bp, Artificial Sequence
  Synthetic
caccgctgtcccaaaaggtcatgggtgcaggctggtacctcacacgacatgtccgttaaagatggcgcgtcgacgaccctagtgaaggccgcgtccggtatgtcgatggagataggcatgcatatcagcagccagggcct

SEQ ID NO: 5565 - DNA, 140 bp, Artificial Sequence
  Synthetic
atacgccatgctgggtctcctcctcagactttgggggcgcagccatcattaaatatgcagccagcaagaaaggcaagtgtgcggtgcattcgatgactaacgccgtcactattcgggaagcgtacttgggagtcggccat

SEQ ID NO: 5566 - DNA, 140 bp, Artificial Sequence
  Synthetic
atggccgactcccaagtacgcttcccgaatagtgacggcgttagtcatcgaatgcaccgcacacttgcctttcttgctggctgcatatttaatgatggctgcgcccccaaagtctgaggaggagacccagcatggcgtat

SEQ ID NO: 5567 - DNA, 140 bp, Artificial Sequence
  Synthetic
atacgccatgctgggtctccctgaaatagaagtagaagggaactctcagttgcaaatctctttttcgacggccctagccagcgccgaattccgcgtacaagtctgttctacacaagtacacgtacttgggagtcggccat

SEQ ID NO: 5568 - DNA, 140 bp, Artificial Sequence
  Synthetic
atggccgactcccaagtacgtgtacttgtgtagaacagacttgtacgcggaattcggcgctggctagggccgtcgaaaaagagatttgcaactgagagttcccttctacttctatttcagggagacccagcatggcgtat

SEQ ID NO: 5569 - DNA, 140 bp, Artificial Sequence
  Synthetic
aggccctggctgctgatatggccctagccagcgccgaattccgcgtacaagtctgttctacacaagtacactgtgcagccgagtgccatccaccgaaagaccatatagtcaattacccgggaccttttgggacagcggtg

SEQ ID NO: 5570 - DNA, 140 bp, Artificial Sequence
  Synthetic
caccgctgtcccaaaaggtcccgggtaattgactatatggtctttcggtggatggcactcggctgcacagtgtacttgtgtagaacagacttgtacgcggaattcggcgctggctagggccatatcagcagccagggcct

SEQ ID NO: 5571 - DNA, 140 bp, Artificial Sequence
  Synthetic
aggccctggctgctgatatgcgtcacacaccaccctcggggtccaagacatttccgctacggcgatgtcatgggtgcagaagatcacgggaggtgtgggactggttgtcgctgttgcagcgaccttttgggacagcggtg

SEQ ID NO: 5572 - DNA, 140 bp, Artificial Sequence
  Synthetic
caccgctgtcccaaaaggtcgctgcaacagcgacaaccagtcccacacctcccgtgatcttctgcacccatgacatcgccgtagcggaaatgtcttggaccccgagggtggtgtgtgacgcatatcagcagccagggcct

SEQ ID NO: 5573 - DNA, 140 bp, Artificial Sequence
  Synthetic
aggccctggctgctgatatgtgggtgcagaagatcacgggaggtgtgggactggttgtcgctgttgcagcactgatcctaatcgtggtgctatgcgtgtcgtttagcaggcactaacttggaccttttgggacagcggtg

SEQ ID NO: 5574 - DNA, 140 bp, Artificial Sequence
  Synthetic
caccgctgtcccaaaaggtccaagttagtgcctgctaaacgacacgcatagcaccacgattaggatcagtgctgcaacagcgacaaccagtcccacacctcccgtgatcttctgcacccacatatcagcagccagggcct

SEQ ID NO: 5575 - DNA, 140 bp, Artificial Sequence
  Synthetic
atacgccatgctgggtctccacaactaggtatgaaagtatatgtgtcccctaagagacacaccacatatagctaagaatcaatagataagtatagatcaaagggctgaacaacccctgaacgtacttgggagtcggccat

SEQ ID NO: 5576 - DNA, 140 bp, Artificial Sequence
  Synthetic
atggccgactcccaagtacgttcaggggttgttcagccctttgatctatacttatctattgattcttagctatatgtggtgtgtctcttaggggacacatatactttcatacctagttgtggagacccagcatggcgtat

SEQ ID NO: 5577 - DNA, 140 bp, Artificial Sequence
  Synthetic
aggccctggctgctgatatgtaattggcaaacggaagagatgtaggtacttaagcttcctaaaagcagccgaactcactttgagaagtaggcatagcataccgaactcttccacgattctgaccttttgggacagcggtg

SEQ ID NO: 5578 - DNA, 140 bp, Artificial Sequence
  Synthetic
caccgctgtcccaaaaggtcagaatcgtggaagagttcggtatgctatgcctacttctcaaagtgagttcggctgcttttaggaagcttaagtacctacatctcttccgtttgccaattacatatcagcagccagggcct

SEQ ID NO: 5579 - DNA, 140 bp, Artificial Sequence
  Synthetic
atacgccatgctgggtctcctagtaacaaaatataaaaatcaataaaaatcataaaatagaaaaccagaaacagaagtaggtaagaaggtatatgtgtcccctaagagacacaccatatacgtacttgggagtcggccat

SEQ ID NO: 5580 - DNA, 140 bp, Artificial Sequence
  Synthetic
atggccgactcccaagtacgtatatggtgtgtctcttaggggacacatataccttcttacctacttctgtttctggttttctattttatgatttttattgatttttatattttgttactaggagacccagcatggcgtat

SEQ ID NO: 5581 - DNA, 140 bp, Artificial Sequence
  Synthetic
aggccctggctgctgatatgacagaagtaggtaagaaggtatatgtgtcccctaagagacacaccatatatagctaagaatcaatagataagtatagatcaaagggctgaataacccctggaccttttgggacagcggtg

SEQ ID NO: 5582 - DNA, 140 bp, Artificial Sequence
  Synthetic
caccgctgtcccaaaaggtccaggggttattcagccctttgatctatacttatctattgattcttagctatatatggtgtgtctcttaggggacacatataccttcttacctacttctgtcatatcagcagccagggcct

SEQ ID NO: 5583 - DNA, 140 bp, Artificial Sequence
  Synthetic
aggccctggctgctgatatgaataataacaaaatataaaaatcaataaaaatcataaaatagaaaaccataaacagaagtagttcaaagggctataaaacccctgaatagtaacaaaacagaccttttgggacagcggtg

SEQ ID NO: 5584 - DNA, 140 bp, Artificial Sequence
  Synthetic
caccgctgtcccaaaaggtctgttttgttactattcaggggttttatagccctttgaactacttctgtttatggttttctattttatgatttttattgatttttatattttgttattattcatatcagcagccagggcct

SEQ ID NO: 5585 - DNA, 140 bp, Artificial Sequence
  Synthetic
atacgccatgctgggtctccgaccgtattacgtagccagaagctcagtctgattcacgctttggcggagcaagtgaagacgtgcacgcacaacggacgagcagggacgtatgcggtcgaacgtacttgggagtcggccat

SEQ ID NO: 5586 - DNA, 140 bp, Artificial Sequence
  Synthetic
atggccgactcccaagtacgttcgaccgcatacgtccctgctcgtccgttgtgcgtgcacgtcttcacttgctccgccaaagcgtgaatcagactgagcttctggctacgtaatacggtcggagacccagcatggcgtat

SEQ ID NO: 5587 - DNA, 140 bp, Artificial Sequence
  Synthetic
atacgccatgctgggtctcccctaacgcgtacggaaggtaaactagtatggaagacactttccggcgacccgtggataaagacgctgcagaacccaccgaaaggaaacttcaaagcaactcgtacttgggagtcggccat

SEQ ID NO: 5588 - DNA, 140 bp, Artificial Sequence
  Synthetic
atggccgactcccaagtacgagttgctttgaagtttcctttcggtgggttctgcagcgtctttatccacgggtcgccggaaagtgtcttccatactagtttaccttccgtacgcgttaggggagacccagcatggcgtat

SEQ ID NO: 5589 - DNA, 140 bp, Artificial Sequence
  Synthetic
aggccctggctgctgatatgacctgaagtagccctgaatgaaatatgtacgcgcatgtatggggtggatctagacagcgggctattttctaaaccgctggtgtctgtgtattacgcggatgaccttttgggacagcggtg

SEQ ID NO: 5590 - DNA, 140 bp, Artificial Sequence
  Synthetic
caccgctgtcccaaaaggtcatccgcgtaatacacagacaccagcggtttagaaaatagcccgctgtctagatccaccccatacatgcgcgtacatatttcattcagggctacttcaggtcatatcagcagccagggcct

SEQ ID NO: 5591 - DNA, 140 bp, Artificial Sequence
  Synthetic
atacgccatgctgggtctcccatagcacaccgaactcttccataattctccgaacccacagggacgtaggagatgttcaaagtggctataaaaccctgaatagtaataaaacataaaattcgtacttgggagtcggccat

SEQ ID NO: 5592 - DNA, 140 bp, Artificial Sequence
  Synthetic
atggccgactcccaagtacgaattttatgttttattactattcagggttttatagccactttgaacatctcctacgtccctgtgggttcggagaattatggaagagttcggtgtgctatgggagacccagcatggcgtat

SEQ ID NO: 5593 - DNA, 140 bp, Artificial Sequence
  Synthetic
aggccctggctgctgatatggcaacaccagtgggaaccgcaaaaacagttacgtgcggtacgtatccagtaatccacgctgttggaccaaacttctctaattattcggagtctgaagggggaccttttgggacagcggtg

SEQ ID NO: 5594 - DNA, 140 bp, Artificial Sequence
  Synthetic
caccgctgtcccaaaaggtcccccttcagactccgaataattagagaagtttggtccaacagcgtggattactggatacgtaccgcacgtaactgtttttgcggttcccactggtgttgccatatcagcagccagggcct

SEQ ID NO: 5595 - DNA, 140 bp, Artificial Sequence
  Synthetic
atacgccatgctgggtctccgccatcgcgcgtaagtccaagggaatatagatcttcccaggagtctgcacaggaggcgagtacaatcatgtcactgacgcatagtcaattcgacctaagccgtacttgggagtcggccat

SEQ ID NO: 5596 - DNA, 140 bp, Artificial Sequence
  Synthetic
atggccgactcccaagtacggcttaggtcgaattgactatgcgtcagtgacatgattgtactcgcctcctgtgcagactcctgggaagatctatattcccttggacttacgcgcgatggcggagacccagcatggcgtat

SEQ ID NO: 5597 - DNA, 140 bp, Artificial Sequence
  Synthetic
aggccctggctgctgatatgtggcaaacggaagagacgtaggtacttaagcttcctaaaagcagccgaactcactttgagatgtaggcatagcataccgaactcttccacaattctccgtgaccttttgggacagcggtg

SEQ ID NO: 5598 - DNA, 140 bp, Artificial Sequence
  Synthetic
caccgctgtcccaaaaggtcacggagaattgtggaagagttcggtatgctatgcctacatctcaaagtgagttcggctgcttttaggaagcttaagtacctacgtctcttccgtttgccacatatcagcagccagggcct

SEQ ID NO: 5599 - DNA, 140 bp, Artificial Sequence
  Synthetic
atacgccatgctgggtctccatggctgcgtgagacacacgtagcctaccagtttcttactgctctactctgcaaagcaagagattaataacccatcatggatcctgtgtacgtggacatacgtacttgggagtcggccat

SEQ ID NO: 5600 - DNA, 140 bp, Artificial Sequence
  Synthetic
atggccgactcccaagtacgtatgtccacgtacacaggatccatgatgggttattaatctcttgctttgcagagtagagcagtaagaaactggtaggctacgtgtgtctcacgcagccatggagacccagcatggcgtat

SEQ ID NO: 5601 - DNA, 140 bp, Artificial Sequence
  Synthetic
aggccctggctgctgatatgaataaggatcaaatgagtaccataattggcaaacggaagagacgtaggtacttaagcttcctaaaagcagccgaactcactttgagatgtaggcatagcagaccttttgggacagcggtg

SEQ ID NO: 5602 - DNA, 140 bp, Artificial Sequence
  Synthetic
caccgctgtcccaaaaggtctgctatgcctacatctcaaagtgagttcggctgcttttaggaagcttaagtacctacgtctcttccgtttgccaattatggtactcatttgatccttattcatatcagcagccagggcct

SEQ ID NO: 5603 - DNA, 140 bp, Artificial Sequence
  Synthetic
aggccctggctgctgatatgactatacttaatgtcagagaccccaaaagtccctacttaccggactacgtatccggcgcctgtatactcgcctccgatcaacgtccgattgtccaatcccgaccttttgggacagcggtg

SEQ ID NO: 5604 - DNA, 140 bp, Artificial Sequence
  Synthetic
caccgctgtcccaaaaggtcgggattggacaatcggacgttgatcggaggcgagtatacaggcgccggatacgtagtccggtaagtagggacttttggggtctctgacattaagtatagtcatatcagcagccagggcct

SEQ ID NO: 5605 - DNA, 140 bp, Artificial Sequence
  Synthetic
aggccctggctgctgatatgggacgggtcggagagttgcctggaccgagcgacattcaatccgtcaaaactcaggagctacccgaaacggcaagcttaccacgcgccctccatcagaagcgaccttttgggacagcggtg

SEQ ID NO: 5606 - DNA, 140 bp, Artificial Sequence
  Synthetic
caccgctgtcccaaaaggtcgcttctgatggagggcgcgtggtaagcttgccgtttcgggtagctcctgagttttgacggattgaatgtcgctcggtccaggcaactctccgacccgtcccatatcagcagccagggcct

SEQ ID NO: 5607 - DNA, 140 bp, Artificial Sequence
  Synthetic
atacgccatgctgggtctcctggccagacggtgcggtacaagtgtaattgcggtggctcaaatgaaggacaaacaactacagacaaagtgattaataactgcaaggttgatcaatgtcatcgtacttgggagtcggccat

SEQ ID NO: 5608 - DNA, 140 bp, Artificial Sequence
  Synthetic
atggccgactcccaagtacgatgacattgatcaaccttgcagttattaatcactttgtctgtagttgtttgtccttcatttgagccaccgcaattacacttgtaccgcaccgtctggccaggagacccagcatggcgtat

SEQ ID NO: 5609 - DNA, 140 bp, Artificial Sequence
  Synthetic
atacgccatgctgggtctccaactgggcagatgagcaggtactgaaggctaagaacataggattatgttcaacagacctgacggaaggtagacgaggcaaactgtctattatgagaaggacgtacttgggagtcggccat

SEQ ID NO: 5610 - DNA, 140 bp, Artificial Sequence
  Synthetic
atggccgactcccaagtacgtccttctcataatagacagtttgcctcgtctaccttccgtcaggtctgttgaacataatcctatgttcttagccttcagtacctgctcatctgcccagttggagacccagcatggcgtat

SEQ ID NO: 5611 - DNA, 140 bp, Artificial Sequence
  Synthetic
aggccctggctgctgatatgaacagacctgacggaaggtagacgaggcaaactgtctattatgagaaggaaaaagctaaaaccgtgcgaccgtgtgctgttctcagtagggtcaacgctcgaccttttgggacagcggtg

SEQ ID NO: 5612 - DNA, 140 bp, Artificial Sequence
  Synthetic
caccgctgtcccaaaaggtcgagcgttgaccctactgagaacagcacacggtcgcacggttttagctttttccttctcataatagacagtttgcctcgtctaccttccgtcaggtctgttcatatcagcagccagggcct

SEQ ID NO: 5613 - DNA, 140 bp, Artificial Sequence
  Synthetic
atacgccatgctgggtctccggggtcagagaaagaacactgacctgctgctgtctatgggcattcaagaagcagaaaacacacacggtctacaagaggccggatacccagtcaattcagacgtacttgggagtcggccat

SEQ ID NO: 5614 - DNA, 140 bp, Artificial Sequence
  Synthetic
atggccgactcccaagtacgtctgaattgactgggtatccggcctcttgtagaccgtgtgtgttttctgcttcttgaatgcccatagacagcagcaggtcagtgttctttctctgaccccggagacccagcatggcgtat

SEQ ID NO: 5615 - DNA, 140 bp, Artificial Sequence
  Synthetic
atacgccatgctgggtctcctacccggaaagtcgcaagctacttaagagctggcatttaccatcggtgttccatctaaagggcaaaatcagcttcacatgccgctgtgatacagtggtttcgtacttgggagtcggccat

SEQ ID NO: 5616 - DNA, 140 bp, Artificial Sequence
  Synthetic
atggccgactcccaagtacgaaaccactgtatcacagcggcatgtgaagctgattttgccctttagatggaacaccgatggtaaatgccagctcttaagtagcttgcgactttccgggtaggagacccagcatggcgtat

SEQ ID NO: 5617 - DNA, 140 bp, Artificial Sequence
  Synthetic
atacgccatgctgggtctcctacccggaaagtcgcaagctacttaagagctggcatttaccatcggtgttccatctaaagggcaaattcagcttcacatgccgctgtgatacagtggtttcgtacttgggagtcggccat

SEQ ID NO: 5618 - DNA, 140 bp, Artificial Sequence
  Synthetic
atggccgactcccaagtacgaaaccactgtatcacagcggcatgtgaagctgaatttgccctttagatggaacaccgatggtaaatgccagctcttaagtagcttgcgactttccgggtaggagacccagcatggcgtat

SEQ ID NO: 5619 - DNA, 140 bp, Artificial Sequence
  Synthetic
atacgccatgctgggtctcctacccggaaagtcgcaagctacttaagagctggcatttaccatcggtgttccatctaaagggcaaactcagcttcacatgccgctgtgatacagtggtttcgtacttgggagtcggccat

SEQ ID NO: 5620 - DNA, 140 bp, Artificial Sequence
  Synthetic
atggccgactcccaagtacgaaaccactgtatcacagcggcatgtgaagctgagtttgccctttagatggaacaccgatggtaaatgccagctcttaagtagcttgcgactttccgggtaggagacccagcatggcgtat

SEQ ID NO: 5621 - DNA, 140 bp, Artificial Sequence
  Synthetic
atacgccatgctgggtctcctacccggaaagtcgcaagctacttaagagctggcatttaccatcggtgttccatctaaagggcaaagtcagcttcacatgccgctgtgatacagtggtttcgtacttgggagtcggccat

SEQ ID NO: 5622 - DNA, 140 bp, Artificial Sequence
  Synthetic
atggccgactcccaagtacgaaaccactgtatcacagcggcatgtgaagctgactttgccctttagatggaacaccgatggtaaatgccagctcttaagtagcttgcgactttccgggtaggagacccagcatggcgtat

SEQ ID NO: 5623 - DNA, 140 bp, Artificial Sequence
  Synthetic
atacgccatgctgggtctcccgtgcgagggctacgtcgttaagagaataacgatgagtccaggcctttatggaaaaaccacagggtatgcggtaacccaccacgcagacggattcctggtcgtacttgggagtcggccat

SEQ ID NO: 5624 - DNA, 140 bp, Artificial Sequence
  Synthetic
atggccgactcccaagtacgaccaggaatccgtctgcgtggtgggttaccgcataccctgtggtttttccataaaggcctggactcatcgttattctcttaacgacgtagccctcgcacgggagacccagcatggcgtat

SEQ ID NO: 5625 - DNA, 140 bp, Artificial Sequence
  Synthetic
aggccctggctgctgatatgtcgtcggacaccggtccaggtcatttacaacagaagtcagtacgccagtcagtgctgccggtgaataccctggaggaagtccacgaggaaaagtgttaccgaccttttgggacagcggtg

SEQ ID NO: 5626 - DNA, 140 bp, Artificial Sequence
  Synthetic
caccgctgtcccaaaaggtcggtaacacttttcctcgtggacttcctccagggtattcaccggcagcactgactggcgtactgacttctgttgtaaatgacctggaccggtgtccgacgacatatcagcagccagggcct

SEQ ID NO: 5627 - DNA, 140 bp, Artificial Sequence
  Synthetic
atacgccatgctgggtctccagacggtgcggtataagtgtaattgcggtggctcaaatgaaggactaacaactacagacaaagtgattaataactgcagggttgatcaatgccatgccgccgtacttgggagtcggccat

SEQ ID NO: 5628 - DNA, 140 bp, Artificial Sequence
  Synthetic
atggccgactcccaagtacggcggcatggcattgatcaaccctgcagttattaatcactttgtctgtagttgttagtccttcatttgagccaccgcaattacacttataccgcaccgtctggagacccagcatggcgtat

SEQ ID NO: 5629 - DNA, 140 bp, Artificial Sequence
  Synthetic
aggccctggctgctgatatgactgacctgctgctgtctatgggcattcaagaagcaaaaaacacacacggtctacaagaggcctgatacccagtcaattcagaaggttcaggccgagtttgaccttttgggacagcggtg

SEQ ID NO: 5630 - DNA, 140 bp, Artificial Sequence
  Synthetic
caccgctgtcccaaaaggtcaaactcggcctgaaccttctgaattgactgggtatcaggcctcttgtagaccgtgtgtgttttttgcttcttgaatgcccatagacagcagcaggtcagtcatatcagcagccagggcct

SEQ ID NO: 5631 - DNA, 140 bp, Artificial Sequence
  Synthetic
atacgccatgctgggtctccgcaaatgtaacatgcagggtgcctaaagcaaggaaccccaccgtgacgtacggaaaaaaccaagtcatcatgctactgtatcctgaccacccaacactcccgtacttgggagtcggccat

SEQ ID NO: 5632 - DNA, 140 bp, Artificial Sequence
  Synthetic
atggccgactcccaagtacgggagtgttgggtggtcaggatacagtagcatgatgacttggttttttccgtacgtcacggtggggttccttgctttaggcaccctgcatgttacatttgcggagacccagcatggcgtat

SEQ ID NO: 5633 - DNA, 140 bp, Artificial Sequence
  Synthetic
aggccctggctgctgatatggatggtgtataacgaaagagagttcgtaaacagaaagctacaccatattgcgatgcacggaccagccctgaacaccgacgaagagtcgtatgagctggtggaccttttgggacagcggtg

SEQ ID NO: 5634 - DNA, 140 bp, Artificial Sequence
  Synthetic
caccgctgtcccaaaaggtccaccagctcatacgactcttcgtcggtgttcagggctggtccgtgcatcgcaatatggtgtagctttctgtttacgaactctctttcgttatacaccatccatatcagcagccagggcct

SEQ ID NO: 5635 - DNA, 140 bp, Artificial Sequence
  Synthetic
aggccctggctgctgatatgcgatgcacggaccagccctgaacaccgacgaagagtcgtatgagctggtgagggcagagaggacagaacacgagtacgtctacgacgtagatcagagaaggaccttttgggacagcggtg

SEQ ID NO: 5636 - DNA, 140 bp, Artificial Sequence
  Synthetic
caccgctgtcccaaaaggtccttctctgatctacgtcgtagacgtactcgtgttctgtcctctctgccctcaccagctcatacgactcttcgtcggtgttcagggctggtccgtgcatcgcatatcagcagccagggcct

SEQ ID NO: 5637 - DNA, 140 bp, Artificial Sequence
  Synthetic
aggccctggctgctgatatgatgcataagaaggaagtcgtgctaaccgtgccgactgaagggctcgaggtcacgtggggcaacaacgagccgtacaggtattggccgcagttatctacaagaccttttgggacagcggtg

SEQ ID NO: 5638 - DNA, 140 bp, Artificial Sequence
  Synthetic
caccgctgtcccaaaaggtcttgtagataactgcggccaatacctgtacggctcgttgttgccccacgtgacctcgagcccttcagtcggcacggttagcacgacttccttcttatgcatcatatcagcagccagggcct

SEQ ID NO: 5639 - DNA, 140 bp, Artificial Sequence
  Synthetic
aggccctggctgctgatatggaggaagaacgagaagcagaactgactcgtgaagccctaccacctctacaggcagcacaggaagatgttcaggtcgaaatcgacgtggaacagctcgagggaccttttgggacagcggtg

SEQ ID NO: 5640 - DNA, 140 bp, Artificial Sequence
  Synthetic
caccgctgtcccaaaaggtccctcgagctgttccacgtcgatttcgacctgaacatcttcctgtgctgcctgtagaggtggtagggcttcacgagtcagttctgcttctcgttcttcctccatatcagcagccagggcct

SEQ ID NO: 5641 - DNA, 140 bp, Artificial Sequence
  Synthetic
aggccctggctgctgatatgacagagcgggtgcaggaataatagagactccgagaggagctatcaaagttactgcccaaccaacagaccacgtcgtgggagagtacctggtactttccccgaccttttgggacagcggtg

SEQ ID NO: 5642 - DNA, 140 bp, Artificial Sequence
  Synthetic
caccgctgtcccaaaaggtcggggaaagtaccaggtactctcccacgacgtggtctgttggttgggcagtaactttgatagctcctctcggagtctctattattcctgcacccgctctgtcatatcagcagccagggcct

SEQ ID NO: 5643 - DNA, 140 bp, Artificial Sequence
  Synthetic
aggccctggctgctgatatgactgcccaaccaacagaccacgtcgtgggagagtacctggtactttccccgcagaccgtactacgtagccagaagctcagcctaattcacgctttggcgggaccttttgggacagcggtg

SEQ ID NO: 5644 - DNA, 140 bp, Artificial Sequence
  Synthetic
caccgctgtcccaaaaggtcccgccaaagcgtgaattaggctgagcttctggctacgtagtacggtctgcggggaaagtaccaggtactctcccacgacgtggtctgttggttgggcagtcatatcagcagccagggcct

SEQ ID NO: 5645 - DNA, 140 bp, Artificial Sequence
  Synthetic
atacgccatgctgggtctccgaggactagaatcaaatggttgttaagcaaggtgccaaaaaccgacctgatcccatacagcggggacgcccaagaagcccgggacgcagaaaaagaagcacgtacttgggagtcggccat

SEQ ID NO: 5646 - DNA, 140 bp, Artificial Sequence
  Synthetic
atggccgactcccaagtacgtgcttctttttctgcgtcccgggcttcttgggcgtccccgctgtatgggatcaggtcggtttttggcaccttgcttaacaaccatttgattctagtcctcggagacccagcatggcgtat

SEQ ID NO: 5647 - DNA, 140 bp, Artificial Sequence
  Synthetic
aggccctggctgctgatatgagcaagtgaagacgtgcacgcacagcggacgagcagggaggtatgcggtcgaagcgtacgacggccgagtcctagtgccctcaggctatgcaatctcgccgaccttttgggacagcggtg

SEQ ID NO: 5648 - DNA, 140 bp, Artificial Sequence
  Synthetic
caccgctgtcccaaaaggtcggcgagattgcatagcctgagggcactaggactcggccgtcgtacgcttcgaccgcatacctccctgctcgtccgctgtgcgtgcacgtcttcacttgctcatatcagcagccagggcct

SEQ ID NO: 5649 - DNA, 140 bp, Artificial Sequence
  Synthetic
atacgccatgctgggtctccaaagtatctccaggcggtgtacactgcctgtgaccgccattgtgtcatcgttgcattacgaaggcaaaatgcgcactacgaatgagtacaacaagccgatcgtacttgggagtcggccat

SEQ ID NO: 5650 - DNA, 140 bp, Artificial Sequence
  Synthetic
atggccgactcccaagtacgatcggcttgttgtactcattcgtagtgcgcattttgccttcgtaatgcaacgatgacacaatggcggtcacaggcagtgtacaccgcctggagatactttggagacccagcatggcgtat

SEQ ID NO: 5651 - DNA, 140 bp, Artificial Sequence
  Synthetic
atacgccatgctgggtctccattctgcttacacacagacgtctcatgtagacagagagcagacgtcgctatatatcaagacgtctatgctgtacacgcacccacgtcgctataccaccagcgtacttgggagtcggccat

SEQ ID NO: 5652 - DNA, 140 bp, Artificial Sequence
  Synthetic
atggccgactcccaagtacgctggtggtatagcgacgtgggtgcgtgtacagcatagacgtcttgatatatagcgacgtctgctctctgtctacatgagacgtctgtgtgtaagcagaatggagacccagcatggcgtat

SEQ ID NO: 5653 - DNA, 140 bp, Artificial Sequence
  Synthetic
aggccctggctgctgatatgtaacgtgcttcagagggtgggttaaacaactgcaaattgactatcgtggatacgaggtcatgacagcagccgcatcccaagggttaaccagaaaaggagtgaccttttgggacagcggtg

SEQ ID NO: 5654 - DNA, 140 bp, Artificial Sequence
  Synthetic
caccgctgtcccaaaaggtcactccttttctggttaacccttgggatgcggctgctgtcatgacctcgtatccacgatagtcaatttgcagttgtttaacccaccctctgaagcacgttacatatcagcagccagggcct

SEQ ID NO: 5655 - DNA, 140 bp, Artificial Sequence
  Synthetic
atacgccatgctgggtctcctcgacgtgttgtacgtagacgaggcgtttgcgtgccactctggaacgttacttgctttgatcgcattggttagaccaaggcagaaagttgtactttgtggcgtacttgggagtcggccat

SEQ ID NO: 5656 - DNA, 140 bp, Artificial Sequence
  Synthetic
atggccgactcccaagtacgccacaaagtacaactttctgccttggtctaaccaatgcgatcaaagcaagtaacgttccagagtggcacgcaaacgcctcgtctacgtacaacacgtcgaggagacccagcatggcgtat

SEQ ID NO: 5657 - DNA, 140 bp, Artificial Sequence
  Synthetic
atacgccatgctgggtctccaagttaatgaaaacccgctctatgcatcaacgtcagagcacgtcaacgtactcctaacacgtacggaaggtaaactggtatggaagacactttccggtgacgtacttgggagtcggccat

SEQ ID NO: 5658 - DNA, 140 bp, Artificial Sequence
  Synthetic
atggccgactcccaagtacgtcaccggaaagtgtcttccataccagtttaccttccgtacgtgttaggagtacgttgacgtgctctgacgttgatgcatagagcgggttttcattaacttggagacccagcatggcgtat

SEQ ID NO: 5659 - DNA, 140 bp, Artificial Sequence
  Synthetic
aggccctggctgctgatatgctcctaacacgtacggaaggtaaactggtatggaagacactttccggtgacccgtggataaagacgctgcagaacccaccgaaaggaaactttaaagcaagaccttttgggacagcggtg

SEQ ID NO: 5660 - DNA, 140 bp, Artificial Sequence
  Synthetic
caccgctgtcccaaaaggtcttgctttaaagtttcctttcggtgggttctgcagcgtctttatccacgggtcaccggaaagtgtcttccataccagtttaccttccgtacgtgttaggagcatatcagcagccagggcct

SEQ ID NO: 5661 - DNA, 140 bp, Artificial Sequence
  Synthetic
aggccctggctgctgatatgtctagacagcgggctattttctaaaccgttggtgtctgtgtattacgcggataaccactgggataataggccaggagggaagatgttcggatttaaccccgaccttttgggacagcggtg

SEQ ID NO: 5662 - DNA, 140 bp, Artificial Sequence
  Synthetic
caccgctgtcccaaaaggtcggggttaaatccgaacatcttccctcctggcctattatcccagtggttatccgcgtaatacacagacaccaacggtttagaaaatagcccgctgtctagacatatcagcagccagggcct

SEQ ID NO: 5663 - DNA, 140 bp, Artificial Sequence
  Synthetic
aggccctggctgctgatatgaataagaagcaaaagcaaaaacaacaggcgccacaaaacaacacaaatcaaaagaagcagccacctaaaaagaaaccggctcaaaagaaaaagaagccgggaccttttgggacagcggtg

SEQ ID NO: 5664 - DNA, 140 bp, Artificial Sequence
  Synthetic
caccgctgtcccaaaaggtcccggcttctttttcttttgagccggtttctttttaggtggctgcttcttttgatttgtgttgttttgtggcgcctgttgtttttgcttttgcttcttattcatatcagcagccagggcct

SEQ ID NO: 5665 - DNA, 140 bp, Artificial Sequence
  Synthetic
aggccctggctgctgatatggtggccgaacaccgcccagtaaaaggggaaagaatggaatggctggttaacaagataaacggacaccacgtgctcctggtcagtggctataaccttgcacgaccttttgggacagcggtg

SEQ ID NO: 5666 - DNA, 140 bp, Artificial Sequence
  Synthetic
caccgctgtcccaaaaggtcgtgcaaggttatagccactgaccaggagcacgtggtgtccgtttatcttgttaaccagccattccattctttccccttttactgggcggtgttcggccaccatatcagcagccagggcct

SEQ ID NO: 5667 - DNA, 140 bp, Artificial Sequence
  Synthetic
atacgccatgctgggtctcctgcctactaagagagtcacttgggtagcgccactaggtgtccgcggagcggactacacatacaacctagagttgggtctgccagcaacgcttggtaggtacgtacttgggagtcggccat

SEQ ID NO: 5668 - DNA, 140 bp, Artificial Sequence
  Synthetic
atggccgactcccaagtacgtacctaccaagcgttgctggcagacccaactctaggttgtatgtgtagtccgctccgcggacacctagtggcgctacccaagtgactctcttagtaggcaggagacccagcatggcgtat

SEQ ID NO: 5669 - DNA, 140 bp, Artificial Sequence
  Synthetic
aggccctggctgctgatatggactacacatacaacctagagttgggtctgccagcaacgcttggtaggtatgacctagtggtcataaacatccacacaccttttcgcatacaccattaccgaccttttgggacagcggtg

SEQ ID NO: 5670 - DNA, 140 bp, Artificial Sequence
  Synthetic
caccgctgtcccaaaaggtcggtaatggtgtatgcgaaaaggtgtgtggatgtttatgaccactaggtcatacctaccaagcgttgctggcagacccaactctaggttgtatgtgtagtccatatcagcagccagggcct

SEQ ID NO: 5671 - DNA, 140 bp, Artificial Sequence
  Synthetic
atacgccatgctgggtctccaacagtgcgtagaccacgcaatgaaactgcaaatgctcgggggtgactctttgagactgctcaaaccgggtggctctctattgatcagagcatatggttacgtacttgggagtcggccat

SEQ ID NO: 5672 - DNA, 140 bp, Artificial Sequence
  Synthetic
atggccgactcccaagtacgtaaccatatgctctgatcaatagagagccacccggtttgagcagtctcaaagagtcacccccgagcatttgcagtttcattgcgtggtctacgcactgttggagacccagcatggcgtat

SEQ ID NO: 5673 - DNA, 140 bp, Artificial Sequence
  Synthetic
aggccctggctgctgatatggatcgtctagagcgttgaaaccaccatgtgtcaccagcaacactgagatgtttttcctatttagcaactttgacaatggcagaaggaatttcacaactcagaccttttgggacagcggtg

SEQ ID NO: 5674 - DNA, 140 bp, Artificial Sequence
  Synthetic
caccgctgtcccaaaaggtctgagttgtgaaattccttctgccattgtcaaagttgctaaataggaaaaacatctcagtgttgctggtgacacatggtggtttcaacgctctagacgatccatatcagcagccagggcct

SEQ ID NO: 5675 - DNA, 140 bp, Artificial Sequence
  Synthetic
aggccctggctgctgatatgtattcggagtctgaaggggaccgggaattggcagctgcctatcgagaagtcgcaaaggaagtaactaggctgggagtaaatagtgtagctatacctctccgaccttttgggacagcggtg

SEQ ID NO: 5676 - DNA, 140 bp, Artificial Sequence
  Synthetic
caccgctgtcccaaaaggtcggagaggtatagctacactatttactcccagcctagttacttcctttgcgacttctcgataggcagctgccaattcccggtccccttcagactccgaatacatatcagcagccagggcct

SEQ ID NO: 5677 - DNA, 140 bp, Artificial Sequence
  Synthetic
aggccctggctgctgatatggtgcaacaccagtgggaaccgcaaaaacagttatgtgcggtacgtatccagtaatccacgccgttggaccaaacttctctaattattcggagtctgaagggaccttttgggacagcggtg

SEQ ID NO: 5678 - DNA, 140 bp, Artificial Sequence
  Synthetic
caccgctgtcccaaaaggtcccttcagactccgaataattagagaagtttggtccaacggcgtggattactggatacgtaccgcacataactgtttttgcggttcccactggtgttgcaccatatcagcagccagggcct

SEQ ID NO: 5679 - DNA, 140 bp, Artificial Sequence
  Synthetic
aggccctggctgctgatatgtcgcatatgaagggctaaaaatccgccctgcctgcccatacaaaattgcagtcataggagtcttcggagtaccgggatctggcaagtcagctattatcaagaccttttgggacagcggtg

SEQ ID NO: 5680 - DNA, 140 bp, Artificial Sequence
  Synthetic
caccgctgtcccaaaaggtcttgataatagctgacttgccagatcccggtactccgaagactcctatgactgcaattttgtatgggcaggcagggcggatttttagcccttcatatgcgacatatcagcagccagggcct

SEQ ID NO: 5681 - DNA, 140 bp, Artificial Sequence
  Synthetic
aggccctggctgctgatatgggaccgggaattggcagctgcctatcgagaagtcgcaaaggaagtaactagactgggagtaaatagtgtagctatacctctcctctccacaggtgtatacgaccttttgggacagcggtg

SEQ ID NO: 5682 - DNA, 140 bp, Artificial Sequence
  Synthetic
caccgctgtcccaaaaggtcgtatacacctgtggagaggagaggtatagctacactatttactcccagtctagttacttcctttgcgacttctcgataggcagctgccaattcccggtcccatatcagcagccagggcct

SEQ ID NO: 5683 - DNA, 140 bp, Artificial Sequence
  Synthetic
aggccctggctgctgatatggactgggagtaaatagtgtagctatacctctcctctccacaggtgtatactcaggagggaaagacaggctgacccagtcactgaaccacctttttacagcgaccttttgggacagcggtg

SEQ ID NO: 5684 - DNA, 140 bp, Artificial Sequence
  Synthetic
caccgctgtcccaaaaggtcgctgtaaaaaggtggttcagtgactgggtcagcctgtctttccctcctgagtatacacctgtggagaggagaggtatagctacactatttactcccagtccatatcagcagccagggcct

SEQ ID NO: 5685 - DNA, 140 bp, Artificial Sequence
  Synthetic
atacgccatgctgggtctcccatggactcgacggacgcagacgtggtcatctactgccgcgacaaagaatgggagaagaaaatatctgaagccatacagatgcggacccaagtggagctgcgtacttgggagtcggccat

SEQ ID NO: 5686 - DNA, 140 bp, Artificial Sequence
  Synthetic
atggccgactcccaagtacgcagctccacttgggtccgcatctgtatggcttcagatattttcttctcccattctttgtcgcggcagtagatgaccacgtctgcgtccgtcgagtccatgggagacccagcatggcgtat

SEQ ID NO: 5687 - DNA, 140 bp, Artificial Sequence
  Synthetic
aggccctggctgctgatatgcggctgtggatatggcggagatacatactatgtggccaaagcaaacagaggccaatgagcaagtctgcctatatgccctgggggaaagtattgaatcgatgaccttttgggacagcggtg

SEQ ID NO: 5688 - DNA, 140 bp, Artificial Sequence
  Synthetic
caccgctgtcccaaaaggtcatcgattcaatactttcccccagggcatataggcagacttgctcattggcctctgtttgctttggccacatagtatgtatctccgccatatccacagccgcatatcagcagccagggcct

SEQ ID NO: 5689 - DNA, 140 bp, Artificial Sequence
  Synthetic
atacgccatgctgggtctcctggatgatgcagatgcatcatctcccccaaaaactgtcccgtgcctttgccgttacgccatgactccagaacgcgtcacccgacttcgcatgaaccacgtcgtacttgggagtcggccat

SEQ ID NO: 5690 - DNA, 140 bp, Artificial Sequence
  Synthetic
atggccgactcccaagtacgacgtggttcatgcgaagtcgggtgacgcgttctggagtcatggcgtaacggcaaaggcacgggacagtttttgggggagatgatgcatctgcatcatccaggagacccagcatggcgtat

SEQ ID NO: 5691 - DNA, 140 bp, Artificial Sequence
  Synthetic
aggccctggctgctgatatgtcttcccaggagtctgcacaggaggcgagtacaatcacgtcactgacgcatagtcaattcgacctaagcgttgatggcgagatactgcccgtcccgtcaggaccttttgggacagcggtg

SEQ ID NO: 5692 - DNA, 140 bp, Artificial Sequence
  Synthetic
caccgctgtcccaaaaggtcctgacgggacgggcagtatctcgccatcaacgcttaggtcgaattgactatgcgtcagtgacgtgattgtactcgcctcctgtgcagactcctgggaagacatatcagcagccagggcct

SEQ ID NO: 5693 - DNA, 140 bp, Artificial Sequence
  Synthetic
aggccctggctgctgatatgcgttacgccatgactccagaacgcgtcacccgacttcgcatgaaccacgtcacgagcataattgtgtgttcttcgtttccccttccaaagtacaaaataggaccttttgggacagcggtg

SEQ ID NO: 5694 - DNA, 140 bp, Artificial Sequence
  Synthetic
caccgctgtcccaaaaggtcctattttgtactttggaaggggaaacgaagaacacacaattatgctcgtgacgtggttcatgcgaagtcgggtgacgcgttctggagtcatggcgtaacgcatatcagcagccagggcct

SEQ ID NO: 5695 - DNA, 140 bp, Artificial Sequence
  Synthetic
aggccctggctgctgatatgtgctatttgaccataacgtgccatcgcgcgtaagtccaagggaatatagatcttcccaggagtctgcacaggaggcgagtacaatcacgtcactgacgcagaccttttgggacagcggtg

SEQ ID NO: 5696 - DNA, 140 bp, Artificial Sequence
  Synthetic
caccgctgtcccaaaaggtctgcgtcagtgacgtgattgtactcgcctcctgtgcagactcctgggaagatctatattcccttggacttacgcgcgatggcacgttatggtcaaatagcacatatcagcagccagggcct

SEQ ID NO: 5697 - DNA, 140 bp, Artificial Sequence
  Synthetic
aggccctggctgctgatatgtggataaagacgctgcagaacccaccgaaaggaaacttcaaagcaactatgaaggagtgggaggtggagcatgcatcaataatggcgggcatctgcagtcgaccttttgggacagcggtg

SEQ ID NO: 5698 - DNA, 140 bp, Artificial Sequence
  Synthetic
caccgctgtcccaaaaggtcgactgcagatgcccgccattattgatgcatgctccacctcccactccttcatagttgctttgaagtttcctttcggtgggttctgcagcgtctttatccacatatcagcagccagggcct

SEQ ID NO: 5699 - DNA, 140 bp, Artificial Sequence
  Synthetic
atacgccatgctgggtctccacaggaagcgagtgcaaccacgtcactgacgcatagccaattcgacctaagcgttgacggcgagatactgcccgtcccgtcagacctggatgctgacgcccgtacttgggagtcggccat

SEQ ID NO: 5700 - DNA, 140 bp, Artificial Sequence
  Synthetic
atggccgactcccaagtacgggcgtcagcatccaggtctgacgggacgggcagtatctcgccgtcaacgcttaggtcgaattggctatgcgtcagtgacgtggttgcactcgcttcctgtggagacccagcatggcgtat

SEQ ID NO: 5701 - DNA, 140 bp, Artificial Sequence
  Synthetic
aggccctggctgctgatatgaagagcttggtccctatcctcgaaacagcggggataaaactaaatgataggcagtggtctcagataattcaagccttcaaagaagacaaagcatactcacgaccttttgggacagcggtg

SEQ ID NO: 5702 - DNA, 140 bp, Artificial Sequence
  Synthetic
caccgctgtcccaaaaggtcgtgagtatgctttgtcttctttgaaggcttgaattatctgagaccactgcctatcatttagttttatccccgctgtttcgaggatagggaccaagctcttcatatcagcagccagggcct

SEQ ID NO: 5703 - DNA, 140 bp, Artificial Sequence
  Synthetic
atacgccatgctgggtctccccagccctagaaccagccctagacgacggggcgacacacacgttgccatccacaactggaaactttgcggccgtgtctgactgggtaatgagcaccgtaccgtacttgggagtcggccat

SEQ ID NO: 5704 - DNA, 140 bp, Artificial Sequence
  Synthetic
atggccgactcccaagtacggtacggtgctcattacccagtcagacacggccgcaaagtttccagttgtggatggcaacgtgtgtgtcgccccgtcgtctagggctggttctagggctggggagacccagcatggcgtat

SEQ ID NO: 5705 - DNA, 140 bp, Artificial Sequence
  Synthetic
aggccctggctgctgatatgagcgtccgattctttagggcagagctgtgtccggtcgtacaagaaacagcggagacgcgtgacacagcaatgtctcttcaggcaccaccgagtaccgccagaccttttgggacagcggtg

SEQ ID NO: 5706 - DNA, 140 bp, Artificial Sequence
  Synthetic
caccgctgtcccaaaaggtctggcggtactcggtggtgcctgaagagacattgctgtgtcacgcgtctccgctgtttcttgtacgaccggacacagctctgccctaaagaatcggacgctcatatcagcagccagggcct

SEQ ID NO: 5707 - DNA, 140 bp, Artificial Sequence
  Synthetic
atacgccatgctgggtctccggcagagctgtgtccggtcgtacaagaaacagcggagacgcgtgacacagcaatgtcttttcaggcaccgccgagtaccgccacggaactgaatcatccgcgtacttgggagtcggccat

SEQ ID NO: 5708 - DNA, 140 bp, Artificial Sequence
  Synthetic
atggccgactcccaagtacgcggatgattcagttccgtggcggtactcggcggtgcctgaaaagacattgctgtgtcacgcgtctccgctgtttcttgtacgaccggacacagctctgccggagacccagcatggcgtat

SEQ ID NO: 5709 - DNA, 140 bp, Artificial Sequence
  Synthetic
atacgccatgctgggtctccccgatctccttcggagcaccaagcgagacgttccccattacatttggggacttcaacgaaggagaaatcgaaagcttgtcttctgagttactaactttcgcgtacttgggagtcggccat

SEQ ID NO: 5710 - DNA, 140 bp, Artificial Sequence
  Synthetic
atggccgactcccaagtacgcgaaagttagtaactcagaagacaagctttcgatttctccttcgttgaagtccccaaatgtaatggggaacgtctcgcttggtgctccgaaggagatcggggagacccagcatggcgtat

SEQ ID NO: 5711 - DNA, 140 bp, Artificial Sequence
  Synthetic
atacgccatgctgggtctccgagacttcctacccggagaagtggatgacttgacagatagcgactggtccacgtgctcagacacggacgacgagttatgactagacagggcaggtgggtacgtacttgggagtcggccat

SEQ ID NO: 5712 - DNA, 140 bp, Artificial Sequence
  Synthetic
atggccgactcccaagtacgtacccacctgccctgtctagtcataactcgtcgtccgtgtctgagcacgtggaccagtcgctatctgtcaagtcatccacttctccgggtaggaagtctcggagacccagcatggcgtat

SEQ ID NO: 5713 - DNA, 140 bp, Artificial Sequence
  Synthetic
aggccctggctgctgatatgccgaacaccgcccagtaaaaggggaaagaatggaatggctggttaacaagataaacggccaccatgtgctcctggtcagtggctataaccttgcactgccgaccttttgggacagcggtg

SEQ ID NO: 5714 - DNA, 140 bp, Artificial Sequence
  Synthetic
caccgctgtcccaaaaggtcggcagtgcaaggttatagccactgaccaggagcacatggtggccgtttatcttgttaaccagccattccattctttccccttttactgggcggtgttcggcatatcagcagccagggcct

SEQ ID NO: 5715 - DNA, 140 bp, Artificial Sequence
  Synthetic
aggccctggctgctgatatgaagtccacgaggagaagtgttacccacctaagctggatgaagcaaaggagcaactattacttaagaaactccaggagagtgcatccatggccaacagaaggaccttttgggacagcggtg

SEQ ID NO: 5716 - DNA, 140 bp, Artificial Sequence
  Synthetic
caccgctgtcccaaaaggtccttctgttggccatggatgcactctcctggagtttcttaagtaatagttgctcctttgcttcatccagcttaggtgggtaacacttctcctcgtggacttcatatcagcagccagggcct

SEQ ID NO: 5717 - DNA, 140 bp, Artificial Sequence
  Synthetic
atacgccatgctgggtctcctactaagagagtcacttgggtagcgccgttaggtgtccgcggagcggactacacatactacctagagttgggtctgccagcaacgcttggtaggtatgaccgtacttgggagtcggccat

SEQ ID NO: 5718 - DNA, 140 bp, Artificial Sequence
  Synthetic
atggccgactcccaagtacggtcatacctaccaagcgttgctggcagacccaactctaggtagtatgtgtagtccgctccgcggacacctaacggcgctacccaagtgactctcttagtaggagacccagcatggcgtat

SEQ ID NO: 5719 - DNA, 140 bp, Artificial Sequence
  Synthetic
atacgccatgctgggtctccatatccggcgcctgtgtattcgcctccgatcaacgtccgattgtccaaccccgagtccgcagtggcagcatgcaatgagttcttagctagaaactatccgcgtacttgggagtcggccat

SEQ ID NO: 5720 - DNA, 140 bp, Artificial Sequence
  Synthetic
atggccgactcccaagtacgcggatagtttctagctaagaactcattgcatgctgccactgcggactcggggttggacaatcggacgttgatcggaggcgaatacacaggcgccggatatggagacccagcatggcgtat

SEQ ID NO: 5721 - DNA, 140 bp, Artificial Sequence
  Synthetic
atacgccatgctgggtctccattaggataacaactgagaatttagcaacctatgttactaaactaaaagggccaaaagcagcagcgctattcgcaaaaacccataatctactgccactaccgtacttgggagtcggccat

SEQ ID NO: 5722 - DNA, 140 bp, Artificial Sequence
  Synthetic
atggccgactcccaagtacggtagtggcagtagattatgggtttttgcgaatagcgctgctgcttttggcccttttagtttagtaacataggttgctaaattctcagttgttatcctaatggagacccagcatggcgtat

SEQ ID NO: 5723 - DNA, 140 bp, Artificial Sequence
  Synthetic
aggccctggctgctgatatgtattcgcaaaaacccataatctgctgccactgcaggaagtaccaatggataggttcacagtagacatgaaaagggacgtgaaggtgactcctggtacaaagaccttttgggacagcggtg

SEQ ID NO: 5724 - DNA, 140 bp, Artificial Sequence
  Synthetic
caccgctgtcccaaaaggtctttgtaccaggagtcaccttcacgtcccttttcatgtctactgtgaacctatccattggtacttcctgcagtggcagcagattatgggtttttgcgaatacatatcagcagccagggcct

SEQ ID NO: 5725 - DNA, 140 bp, Artificial Sequence
  Synthetic
aggccctggctgctgatatggcacacagaggaaagacctaaggtgcaggttatacaggcggctgaacccttggcgacagcatacctatgtgggattcacagagagctggttaggaggctggaccttttgggacagcggtg

SEQ ID NO: 5726 - DNA, 140 bp, Artificial Sequence
  Synthetic
caccgctgtcccaaaaggtccagcctcctaaccagctctctgtgaatcccacataggtatgctgtcgccaagggttcagccgcctgtataacctgcaccttaggtctttcctctgtgtgccatatcagcagccagggcct

SEQ ID NO: 5727 - DNA, 140 bp, Artificial Sequence
  Synthetic
aggccctggctgctgatatgtggcgacagcatacctatgtgggattcacagagagctggttaggaggctgaacgctgtcctcctacccaatgtacatacactatttgacatgtctgccgagaccttttgggacagcggtg

SEQ ID NO: 5728 - DNA, 140 bp, Artificial Sequence
  Synthetic
caccgctgtcccaaaaggtctcggcagacatgtcaaatagtgtatgtacattgggtaggaggacagcgttcagcctcctaaccagctctctgtgaatcccacataggtatgctgtcgccacatatcagcagccagggcct

SEQ ID NO: 5729 - DNA, 140 bp, Artificial Sequence
  Synthetic
aggccctggctgctgatatgcttactgctttgatgctgttagaagatttaggggtggatcactccctgctggacttgatagaggctgctttcggagagatttccagctgtcatctaccgagaccttttgggacagcggtg

SEQ ID NO: 5730 - DNA, 140 bp, Artificial Sequence
  Synthetic
caccgctgtcccaaaaggtctcggtagatgacagctggaaatctctccgaaagcagcctctatcaagtccagcagggagtgatccacccctaaatcttctaacagcatcaaagcagtaagcatatcagcagccagggcct

SEQ ID NO: 5731 - DNA, 140 bp, Artificial Sequence
  Synthetic
aggccctggctgctgatatgagccccttacttttgtggagggtttatactgcacgatactgtgacgggaacagcttgcagagtggcagacccgctaaaaaggctatttaaactgggcaaagaccttttgggacagcggtg

SEQ ID NO: 5732 - DNA, 140 bp, Artificial Sequence
  Synthetic
caccgctgtcccaaaaggtctttgcccagtttaaatagcctttttagcgggtctgccactctgcaagctgttcccgtcacagtatcgtgcagtataaaccctccacaaaagtaaggggctcatatcagcagccagggcct

SEQ ID NO: 5733 - DNA, 140 bp, Artificial Sequence
  Synthetic
aggccctggctgctgatatgtggcagccagatgtgccacttggatgaacatggaagtgaagatcatagatgcagttgtatccttgaaagccccttacttttgtggagggtttatactgcagaccttttgggacagcggtg

SEQ ID NO: 5734 - DNA, 140 bp, Artificial Sequence
  Synthetic
caccgctgtcccaaaaggtctgcagtataaaccctccacaaaagtaaggggctttcaaggatacaactgcatctatgatcttcacttccatgttcatccaagtggcacatctggctgccacatatcagcagccagggcct

SEQ ID NO: 5735 - DNA, 140 bp, Artificial Sequence
  Synthetic
aggccctggctgctgatatgtgacgaagtgatcagatggcaacgaacagggctaattgatgagttggagaaagcggtatactctaggtatgaagtgcagggtatatccgttgtggtaatggaccttttgggacagcggtg

SEQ ID NO: 5736 - DNA, 140 bp, Artificial Sequence
  Synthetic
caccgctgtcccaaaaggtccattaccacaacggatataccctgcacttcatacctagagtataccgctttctccaactcatcaattagccctgttcgttgccatctgatcacttcgtcacatatcagcagccagggcct

SEQ ID NO: 5737 - DNA, 140 bp, Artificial Sequence
  Synthetic
aggccctggctgctgatatgagaagacgagcgctggctgacgaagtgatcagatggcaacgaacagggctaattgatgagctggagaaagcggtatactctaggtacgaagtgcagggtagaccttttgggacagcggtg

SEQ ID NO: 5738 - DNA, 140 bp, Artificial Sequence
  Synthetic
caccgctgtcccaaaaggtctaccctgcacttcgtacctagagtataccgctttctccagctcatcaattagccctgttcgttgccatctgatcacttcgtcagccagcgctcgtcttctcatatcagcagccagggcct

SEQ ID NO: 5739 - DNA, 140 bp, Artificial Sequence
  Synthetic
aggccctggctgctgatatgcctattttgcagaagccgacagcaagtacctaaacactaatcagctacaatggatttcatcccaacccaaactttttacaacaggaggtaccagcctcgagaccttttgggacagcggtg

SEQ ID NO: 5740 - DNA, 140 bp, Artificial Sequence
  Synthetic
caccgctgtcccaaaaggtctcgaggctggtacctcctgttgtaaaaagtttgggttgggatgaaatccattgtagctgattagtgtttaggtacttgctgtcggcttctgcaaaataggcatatcagcagccagggcct

SEQ ID NO: 5741 - DNA, 140 bp, Artificial Sequence
  Synthetic
aggccctggctgctgatatgttcgagaagctcagaggacccgtcataactttgtacggcggtcctaaataggtacgcactacagctacctattttgcagaagccgacagcaagtatctaagaccttttgggacagcggtg

SEQ ID NO: 5742 - DNA, 140 bp, Artificial Sequence
  Synthetic
caccgctgtcccaaaaggtcttagatacttgctgtcggcttctgcaaaataggtagctgtagtgcgtacctatttaggaccgccgtacaaagttatgacgggtcctctgagcttctcgaacatatcagcagccagggcct

SEQ ID NO: 5743 - DNA, 140 bp, Artificial Sequence
  Synthetic
aggccctggctgctgatatgggggtactacaactggcaccacggagcagtacagtactcaggaggccggttcactatccccacaggtgctggcaaaccaggggacagcggtagaccgatcgaccttttgggacagcggtg

SEQ ID NO: 5744 - DNA, 140 bp, Artificial Sequence
  Synthetic
caccgctgtcccaaaaggtcgatcggtctaccgctgtcccctggtttgccagcacctgtggggatagtgaaccggcctcctgagtactgtactgctccgtggtgccagttgtagtacccccatatcagcagccagggcct

SEQ ID NO: 5745 - DNA, 140 bp, Artificial Sequence
  Synthetic
aggccctggctgctgatatgatcgaaagcttgtcttctgagctactaactttcggagacttcttaccaggagaagtggatgacttgacagacagcgactggtccacgtgctcagacacgggaccttttgggacagcggtg

SEQ ID NO: 5746 - DNA, 140 bp, Artificial Sequence
  Synthetic
caccgctgtcccaaaaggtcccgtgtctgagcacgtggaccagtcgctgtctgtcaagtcatccacttctcctggtaagaagtctccgaaagttagtagctcagaagacaagctttcgatcatatcagcagccagggcct

SEQ ID NO: 5747 - DNA, 140 bp, Artificial Sequence
  Synthetic
atacgccatgctgggtctccttcgacaacaagggacgcgtggtggccatagtcttaggaggagctaatgaaggagcccgtacagccctctcagtggtaacctggaataaagacattgtcacgtacttgggagtcggccat

SEQ ID NO: 5748 - DNA, 140 bp, Artificial Sequence
  Synthetic
atggccgactcccaagtacgtgacaatgtctttattccaggttaccactgagagggctgtacgggctccttcattagctcctcctaagactatggccaccacgcgtcccttgttgtcgaaggagacccagcatggcgtat

SEQ ID NO: 5749 - DNA, 140 bp, Artificial Sequence
  Synthetic
atacgccatgctgggtctccctaaaatcacccccgagggggccgaagagtggagtcttgctatcccagttatgtgcctgttggcaaacaccacgttcccctgctcccagcccccttgcaccgtacttgggagtcggccat

SEQ ID NO: 5750 - DNA, 140 bp, Artificial Sequence
  Synthetic
atggccgactcccaagtacggtgcaagggggctgggagcaggggaacgtggtgtttgccaacaggcacataactgggatagcaagactccactcttcggccccctcgggggtgattttagggagacccagcatggcgtat

SEQ ID NO: 5751 - DNA, 140 bp, Artificial Sequence
  Synthetic
aggccctggctgctgatatgactcgtgccatagtcccgtagcactagaacgcatcagaaatgaagcgacagacgggacgctgaaaatccaggtctccttgcaaatcggaataaagacggagaccttttgggacagcggtg

SEQ ID NO: 5752 - DNA, 140 bp, Artificial Sequence
  Synthetic
caccgctgtcccaaaaggtctccgtctttattccgatttgcaaggagacctggattttcagcgtcccgtctgtcgcttcatttctgatgcgttctagtgctacgggactatggcacgagtcatatcagcagccagggcct

SEQ ID NO: 5753 - DNA, 140 bp, Artificial Sequence
  Synthetic
atacgccatgctgggtctcctggatgaagcaaaggagcaactattacttaagaaactccaggagagtgcatctatggccaacagaagcaggtatcagtcgcgcaaagtagaaaacatgaacgtacttgggagtcggccat

SEQ ID NO: 5754 - DNA, 140 bp, Artificial Sequence
  Synthetic
atggccgactcccaagtacgttcatgttttctactttgcgcgactgatacctgcttctgttggccatagatgcactctcctggagtttcttaagtaatagttgctcctttgcttcatccaggagacccagcatggcgtat

SEQ ID NO: 5755 - DNA, 140 bp, Artificial Sequence
  Synthetic
aggccctggctgctgatatgtactcgcctccgatcaacgtccgattgtccaatcccgagtccgcagtggcagcatgcaatgagttcttagctagaaactatccaactgtctcatcataccgaccttttgggacagcggtg

SEQ ID NO: 5756 - DNA, 140 bp, Artificial Sequence
  Synthetic
caccgctgtcccaaaaggtcggtatgatgagacagttggatagtttctagctaagaactcattgcatgctgccactgcggactcgggattggacaatcggacgttgatcggaggcgagtacatatcagcagccagggcct

SEQ ID NO: 5757 - DNA, 140 bp, Artificial Sequence
  Synthetic
aggccctggctgctgatatgattactggaacaatgggacacttcatcctggcccgatgtccgaaaggggaaactctgacggtgggattcactgacggtaggaagattagtcactcatgtagaccttttgggacagcggtg

SEQ ID NO: 5758 - DNA, 140 bp, Artificial Sequence
  Synthetic
caccgctgtcccaaaaggtctacatgagtgactaatcttcctaccgtcagtgaatcccaccgtcagagtttcccctttcggacatcgggccaggatgaagtgtcccattgttccagtaatcatatcagcagccagggcct

SEQ ID NO: 5759 - DNA, 140 bp, Artificial Sequence
  Synthetic
atacgccatgctgggtctccaaattaccgacgagtatgatgcatatctagacatggtggacgggtcggagagttgcctggaccgagcgacattcaatccgtcaaaactcaggagctaccccgtacttgggagtcggccat

SEQ ID NO: 5760 - DNA, 140 bp, Artificial Sequence
  Synthetic
atggccgactcccaagtacggggtagctcctgagttttgacggattgaatgtcgctcggtccaggcaactctccgacccgtccaccatgtctagatatgcatcatactcgtcggtaatttggagacccagcatggcgtat

SEQ ID NO: 5761 - DNA, 140 bp, Artificial Sequence
  Synthetic
aggccctggctgctgatatgctgatcgcacattgatgtcacaacagtccggcaacgtaaagatcacagtcaatggccagacggtgcggtacaagtgtaattgcggtggctcaaacgaagggaccttttgggacagcggtg

SEQ ID NO: 5762 - DNA, 140 bp, Artificial Sequence
  Synthetic
caccgctgtcccaaaaggtcccttcgtttgagccaccgcaattacacttgtaccgcaccgtctggccattgactgtgatctttacgttgccggactgttgtgacatcaatgtgcgatcagcatatcagcagccagggcct

SEQ ID NO: 5763 - DNA, 140 bp, Artificial Sequence
  Synthetic
atacgccatgctgggtctccactaataactacagacaaagtgattaataattgcaaggttgatcaatgtcatgctgcggtcaccaatcacaaaaagtggcagtataactcccctctggtccgtacttgggagtcggccat

SEQ ID NO: 5764 - DNA, 140 bp, Artificial Sequence
  Synthetic
atggccgactcccaagtacggaccagaggggagttatactgccactttttgtgattggtgaccgcagcatgacattgatcaaccttgcaattattaatcactttgtctgtagttattagtggagacccagcatggcgtat

SEQ ID NO: 5765 - DNA, 140 bp, Artificial Sequence
  Synthetic
aggccctggctgctgatatgttatgagctgtaccctactatgactgtagtagttgtgtcagtggcctcgttcgtactcctgtcgatggtgggtatggcagtggggatgtgcatgtgtgcagaccttttgggacagcggtg

SEQ ID NO: 5766 - DNA, 140 bp, Artificial Sequence
  Synthetic
caccgctgtcccaaaaggtctgcacacatgcacatccccactgccatacccaccatcgacaggagtacgaacgaggccactgacacaactactacagtcatagtagggtacagctcataacatatcagcagccagggcct

SEQ ID NO: 5767 - DNA, 140 bp, Artificial Sequence
  Synthetic
aggccctggctgctgatatgtttcctgcttagcctaatatgctgcatcagaacaactaaagcggccacataccaagaggctgcggtatatctgtggaacgagcagcaacctttgttttgggaccttttgggacagcggtg

SEQ ID NO: 5768 - DNA, 140 bp, Artificial Sequence
  Synthetic
caccgctgtcccaaaaggtcccaaaacaaaggttgctgctcgttccacagatataccgcagcctcttggtatgtggccgctttagttgttctgatgcagcatattaggctaagcaggaaacatatcagcagccagggcct

SEQ ID NO: 5769 - DNA, 140 bp, Artificial Sequence
  Synthetic
aggccctggctgctgatatgccaaactatcaagaagagtgggtgatgcataagaaggaagtcgtgctaatcgtgccgactgaagggctcgaggtcacgtggggcaacaacgagccgtatagaccttttgggacagcggtg

SEQ ID NO: 5770 - DNA, 140 bp, Artificial Sequence
  Synthetic
caccgctgtcccaaaaggtctatacggctcgttgttgccccacgtgacctcgagcccttcagtcggcacgattagcacgacttccttcttatgcatcacccactcttcttgatagtttggcatatcagcagccagggcct

SEQ ID NO: 5771 - DNA, 140 bp, Artificial Sequence
  Synthetic
aggccctggctgctgatatgtcactgtaactgcctatgcaaacggcgaccatgccgtcacagttaaggacgccaaattcattgtggggccaatgtcttcagcctggacgcctttcgacaagaccttttgggacagcggtg

SEQ ID NO: 5772 - DNA, 140 bp, Artificial Sequence
  Synthetic
caccgctgtcccaaaaggtcttgtcgaaaggcgtccaggctgaagacattggccccacaatgaatttggcgtccttaactgtgacggcatggtcgccgtttgcataggcagttacagtgacatatcagcagccagggcct

SEQ ID NO: 5773 - DNA, 140 bp, Artificial Sequence
  Synthetic
aggccctggctgctgatatgttggcgcaggaagaccaggacaatttggcgatatccaaagtcgcacacctgagagtaaagacgtctatgctaatacacaactagtactgcagagaccggcgaccttttgggacagcggtg

SEQ ID NO: 5774 - DNA, 140 bp, Artificial Sequence
  Synthetic
caccgctgtcccaaaaggtcgccggtctctgcagtactagttgtgtattagcatagacgtctttactctcaggtgtgcgactttggatatcgccaaattgtcctggtcttcctgcgccaacatatcagcagccagggcct

SEQ ID NO: 5775 - DNA, 140 bp, Artificial Sequence
  Synthetic
atacgccatgctgggtctccgagagtaaagacgtctatgctaatacacaactagtactgcagagaccggctgcgggtacggtacatgtgccatactctcaggcaccatctggctttaagtcgtacttgggagtcggccat

SEQ ID NO: 5776 - DNA, 140 bp, Artificial Sequence
  Synthetic
atggccgactcccaagtacgacttaaagccagatggtgcctgagagtatggcacatgtaccgtacccgcagccggtctctgcagtactagttgtgtattagcatagacgtctttactctcggagacccagcatggcgtat

SEQ ID NO: 5777 - DNA, 140 bp, Artificial Sequence
  Synthetic
atacgccatgctgggtctcccatgcccatctccatcgacataccggatgcggccttcactagggtcgtcgacgcgccctctttaacggacatgtcgtgcgaggtaccagcctgcacccatcgtacttgggagtcggccat

SEQ ID NO: 5778 - DNA, 140 bp, Artificial Sequence
  Synthetic
atggccgactcccaagtacgatgggtgcaggctggtacctcgcacgacatgtccgttaaagagggcgcgtcgacgaccctagtgaaggccgcatccggtatgtcgatggagatgggcatgggagacccagcatggcgtat

SEQ ID NO: 5779 - DNA, 140 bp, Artificial Sequence
  Synthetic
atacgccatgctgggtctccttttttagccgtaatgagcgtcggtgcccacactgtgagcgcgtacgaacacgtaacagtgatcccgaacacggtgggagtaccgtataagactctagtccgtacttgggagtcggccat

SEQ ID NO: 5780 - DNA, 140 bp, Artificial Sequence
  Synthetic
atggccgactcccaagtacggactagagtcttatacggtactcccaccgtgttcgggatcactgttacgtgttcgtacgcgctcacagtgtgggcaccgacgctcattacggctaaaaaaggagacccagcatggcgtat

SEQ ID NO: 5781 - DNA, 140 bp, Artificial Sequence
  Synthetic
aggccctggctgctgatatgaggcaagtgtgcggtgcattcgatgaccaacgccgtcactattcgggaagctgagatagaagttgaagggaattctcagctgcaaatctctttctcgactgaccttttgggacagcggtg

SEQ ID NO: 5782 - DNA, 140 bp, Artificial Sequence
  Synthetic
caccgctgtcccaaaaggtcagtcgagaaagagatttgcagctgagaattcccttcaacttctatctcagcttcccgaatagtgacggcgttggtcatcgaatgcaccgcacacttgcctcatatcagcagccagggcct

SEQ ID NO: 5783 - DNA, 140 bp, Artificial Sequence
  Synthetic
atacgccatgctgggtctccctgagatagaagttgaagggaattctcagctgcaaatctctttctcgactgccttagccagcgccgaattccgcgtacaagtctgttctacacaagtacacgtacttgggagtcggccat

SEQ ID NO: 5784 - DNA, 140 bp, Artificial Sequence
  Synthetic
atggccgactcccaagtacgtgtacttgtgtagaacagacttgtacgcggaattcggcgctggctaaggcagtcgagaaagagatttgcagctgagaattcccttcaacttctatctcagggagacccagcatggcgtat

SEQ ID NO: 5785 - DNA, 140 bp, Artificial Sequence
  Synthetic
aggccctggctgctgatatgtgggtgcagaagatcacgggaggtgtgggactggttgtcgctgttgcagcactgattctaatcgtggtgctatgcgtgtcgttcagcaggcactaactcggaccttttgggacagcggtg

SEQ ID NO: 5786 - DNA, 140 bp, Artificial Sequence
  Synthetic
caccgctgtcccaaaaggtccgagttagtgcctgctgaacgacacgcatagcaccacgattagaatcagtgctgcaacagcgacaaccagtcccacacctcccgtgatcttctgcacccacatatcagcagccagggcct

SEQ ID NO: 5787 - DNA, 140 bp, Artificial Sequence
  Synthetic
aggccctggctgctgatatggtaaaggggaccatcgataacgcggacctggccaaactggcctttaagcggtcatctaagtatgaccttgaatgcgcgcagatacccgtgcacatgaagtgaccttttgggacagcggtg

SEQ ID NO: 5788 - DNA, 140 bp, Artificial Sequence
  Synthetic
caccgctgtcccaaaaggtcacttcatgtgcacgggtatctgcgcgcattcaaggtcatacttagatgaccgcttaaaggccagtttggccaggtccgcgttatcgatggtcccctttaccatatcagcagccagggcct

SEQ ID NO: 5789 - DNA, 140 bp, Artificial Sequence
  Synthetic
aggccctggctgctgatatgacaactaagtatgaaggtatatgtgtcccctaagagacacactgtacatagctaataatctatagatcaaagggctacacaacccctgaatagtaacaaagaccttttgggacagcggtg

SEQ ID NO: 5790 - DNA, 140 bp, Artificial Sequence
  Synthetic
caccgctgtcccaaaaggtctttgttactattcaggggttgtgtagccctttgatctatagattattagctatgtacagtgtgtctcttaggggacacatataccttcatacttagttgtcatatcagcagccagggcct

SEQ ID NO: 5791 - DNA, 140 bp, Artificial Sequence
  Synthetic
aggccctggctgctgatatgctctcggtggtgacctggaataaagacattgtcactaaaatcacccccgagggggccgaagagtggagtcttgccatcccagttatgtgcctgttggcaagaccttttgggacagcggtg

SEQ ID NO: 5792 - DNA, 140 bp, Artificial Sequence
  Synthetic
caccgctgtcccaaaaggtcttgccaacaggcacataactgggatggcaagactccactcttcggccccctcgggggtgattttagtgacaatgtctttattccaggtcaccaccgagagcatatcagcagccagggcct

SEQ ID NO: 5793 - DNA, 140 bp, Artificial Sequence
  Synthetic
atacgccatgctgggtctccacgtagcttaccagtttcttactgctctactctgcaaagcaagagattaagaacccatcatggatcctgtgtacgtggacatagacgctgacagcgccttcgtacttgggagtcggccat

SEQ ID NO: 5794 - DNA, 140 bp, Artificial Sequence
  Synthetic
atggccgactcccaagtacgaaggcgctgtcagcgtctatgtccacgtacacaggatccatgatgggttcttaatctcttgctttgcagagtagagcagtaagaaactggtaagctacgtggagacccagcatggcgtat

SEQ ID NO: 5795 - DNA, 140 bp, Artificial Sequence
  Synthetic
atacgccatgctgggtctcctttgaaggccctgcaacgtgcgtaccccatgtttgaggtggaacctaggcaggtcacactgaatgaccatgctaatgctagagcgttctcgcatctagctcgtacttgggagtcggccat

SEQ ID NO: 5796 - DNA, 140 bp, Artificial Sequence
  Synthetic
atggccgactcccaagtacgagctagatgcgagaacgctctagcattagcatggtcattcagtgtgacctgcctaggttccacctcaaacatggggtacgcacgttgcagggccttcaaaggagacccagcatggcgtat

SEQ ID NO: 5797 - DNA, 140 bp, Artificial Sequence
  Synthetic
aggccctggctgctgatatgagaaagctagcatctgccgcaggaaaagtcctggacagaaacatctctggaaagatcggggacttacaagcagcaatggccgtgccagacacggagacgcgaccttttgggacagcggtg

SEQ ID NO: 5798 - DNA, 140 bp, Artificial Sequence
  Synthetic
caccgctgtcccaaaaggtcgcgtctccgtgtctggcacggccattgctgcttgtaagtccccgatctttccagagatgtttctgtccaggacttttcctgcggcagatgctagctttctcatatcagcagccagggcct

SEQ ID NO: 5799 - DNA, 140 bp, Artificial Sequence
  Synthetic
aggccctggctgctgatatggacacttcatcctggcccgatgtccaaaaggggaaactctgacggtgggattcactgacagtaggaagattagtcattcatgtacgcacccatttcaccagaccttttgggacagcggtg

SEQ ID NO: 5800 - DNA, 140 bp, Artificial Sequence
  Synthetic
caccgctgtcccaaaaggtctggtgaaatgggtgcgtacatgaatgactaatcttcctactgtcagtgaatcccaccgtcagagtttccccttttggacatcgggccaggatgaagtgtccatatcagcagccagggcct

SEQ ID NO: 5801 - DNA, 140 bp, Artificial Sequence
  Synthetic
aggccctggctgctgatatgaattgggcagatgagcaggtactgaaggctaagaacttaggattatgttcaacagacctgacggaaggtagacgaggcaaattgtctattatgagaaaaagaccttttgggacagcggtg

SEQ ID NO: 5802 - DNA, 140 bp, Artificial Sequence
  Synthetic
caccgctgtcccaaaaggtctttttctcataatagacaatttgcctcgtctaccttccgtcaggtctgttgaacataatcctaagttcttagccttcagtacctgctcatctgcccaattcatatcagcagccagggcct

SEQ ID NO: 5803 - DNA, 140 bp, Artificial Sequence
  Synthetic
aggccctggctgctgatatgtttcgtgcgaaggctacgtcgttaagagaataacgatgagcccaggcctttacggaaaaaccgcagggtatgcggtaacccaccacgcagacggattcctgaccttttgggacagcggtg

SEQ ID NO: 5804 - DNA, 140 bp, Artificial Sequence
  Synthetic
caccgctgtcccaaaaggtcaggaatccgtctgcgtggtgggttaccgcataccctgcggtttttccgtaaaggcctgggctcatcgttattctcttaacgacgtagccttcgcacgaaacatatcagcagccagggcct

SEQ ID NO: 5805 - DNA, 140 bp, Artificial Sequence
  Synthetic
aggccctggctgctgatatgacatgcagggtgcctaaagcaaggaaccccaccgtgacgtacgggaaaaaccaagtcatcatgctactgtatcctgaccacccaacactcctgtcctaccgaccttttgggacagcggtg

SEQ ID NO: 5806 - DNA, 140 bp, Artificial Sequence
  Synthetic
caccgctgtcccaaaaggtcggtaggacaggagtgttgggtggtcaggatacagtagcatgatgacttggtttttcccgtacgtcacggtggggttccttgctttaggcaccctgcatgtcatatcagcagccagggcct

SEQ ID NO: 5807 - DNA, 140 bp, Artificial Sequence
  Synthetic
aggccctggctgctgatatggaaaatcaataaaaatcataaaatagaaaaaccataaacagaagtagtttaaagggctataaaacccctgaatagtaacaaaacataaagttaataaaaagaccttttgggacagcggtg

SEQ ID NO: 5808 - DNA, 140 bp, Artificial Sequence
  Synthetic
caccgctgtcccaaaaggtctttttattaactttatgttttgttactattcaggggttttatagccctttaaactacttctgtttatggtttttctattttatgatttttattgattttccatatcagcagccagggcct

SEQ ID NO: 5809 - DNA, 140 bp, Artificial Sequence
  Synthetic
aggccctggctgctgatatgaaagggctataaaacccctgaatagtaacaaaacataaagttaataaaaatcaaatgaataccataattggcaaacggaagagatgtaggtacttaagctgaccttttgggacagcggtg

SEQ ID NO: 5810 - DNA, 140 bp, Artificial Sequence
  Synthetic
caccgctgtcccaaaaggtcagcttaagtacctacatctcttccgtttgccaattatggtattcatttgatttttattaactttatgttttgttactattcaggggttttatagccctttcatatcagcagccagggcct

SEQ ID NO: 5811 - DNA, 140 bp, Artificial Sequence
  Synthetic
aggccctggctgctgatatgtcctaaaagcagccgaactcactttgagaagtaggcatagcataccgaactcttccacgattctccgaacccacagggacgtaggagatgttattttgttgaccttttgggacagcggtg

SEQ ID NO: 5812 - DNA, 140 bp, Artificial Sequence
  Synthetic
caccgctgtcccaaaaggtcaacaaaataacatctcctacgtccctgtgggttcggagaatcgtggaagagttcggtatgctatgcctacttctcaaagtgagttcggctgcttttaggacatatcagcagccagggcct

SEQ ID NO: 5813 - DNA, 140 bp, Artificial Sequence
  Synthetic
aggccctggctgctgatatggccgaactcactttgagaagtaggcatagcataccgaactcttccacgattctccgaacccacagggacgtaggagatgttattttgtttttaatatttcgaccttttgggacagcggtg

SEQ ID NO: 5814 - DNA, 140 bp, Artificial Sequence
  Synthetic
caccgctgtcccaaaaggtcgaaatattaaaaacaaaataacatctcctacgtccctgtgggttcggagaatcgtggaagagttcggtatgctatgcctacttctcaaagtgagttcggccatatcagcagccagggcct

SEQ ID NO: 5815 - DNA, 140 bp, Artificial Sequence
  Synthetic
atacgccatgctgggtctccccagagaatagtggttaacggcagaacgcaacggaatacgaacaccatgaaaaactatatgattcccgcggtcgcccaagccttcagtaagtgggcaaagcgtacttgggagtcggccat

SEQ ID NO: 5816 - DNA, 140 bp, Artificial Sequence
  Synthetic
atggccgactcccaagtacgctttgcccacttactgaaggcttgggcgaccgcgggaatcatatagtttttcatggtgttcgtattccgttgcgttctgccgttaaccactattctctggggagacccagcatggcgtat

SEQ ID NO: 5817 - DNA, 140 bp, Artificial Sequence
  Synthetic
atacgccatgctgggtctccactatgactgtagtagttgtgtcagtggccacgttcatactcctgtcgatggtgggtatggcagcggggatgtgcatgtgtgcacgacgcagatgcatcacgtacttgggagtcggccat

SEQ ID NO: 5818 - DNA, 140 bp, Artificial Sequence
  Synthetic
atggccgactcccaagtacgtgatgcatctgcgtcgtgcacacatgcacatccccgctgccatacccaccatcgacaggagtatgaacgtggccactgacacaactactacagtcatagtggagacccagcatggcgtat

SEQ ID NO: 5819 - DNA, 140 bp, Artificial Sequence
  Synthetic
atacgccatgctgggtctccgttgaggactagaatcaaatggttgttaagcaaggtgccaaaaaccgacctgaccccatacagcggggacgcccaagaagcccgcgacgcagaaaaagaacgtacttgggagtcggccat

SEQ ID NO: 5820 - DNA, 140 bp, Artificial Sequence
  Synthetic
atggccgactcccaagtacgttctttttctgcgtcgcgggcttcttgggcgtccccgctgtatggggtcaggtcggtttttggcaccttgcttaacaaccatttgattctagtcctcaacggagacccagcatggcgtat

SEQ ID NO: 5821 - DNA, 140 bp, Artificial Sequence
  Synthetic
aggccctggctgctgatatggtcgaagcgtacgacggcagagtcctagtgccctcaggctacgcaatctcgcctgaagacttccagagcctaagcgaaagcgcaacgatgatgtacaacggaccttttgggacagcggtg

SEQ ID NO: 5822 - DNA, 140 bp, Artificial Sequence
  Synthetic
caccgctgtcccaaaaggtccgttgtacatcatcgttgcgctttcgcttaggctctggaagtcttcaggcgagattgcgtagcctgagggcactaggactctgccgtcgtacgcttcgaccatatcagcagccagggcct

SEQ ID NO: 5823 - DNA, 140 bp, Artificial Sequence
  Synthetic
aggccctggctgctgatatgcgctgaaaacacgcagttgagcgaagcacatgtggagaagtccgaatcgtgcaaaacagaatttgcatcagcatacagggctcataccgcatctgcatcagaccttttgggacagcggtg

SEQ ID NO: 5824 - DNA, 140 bp, Artificial Sequence
  Synthetic
caccgctgtcccaaaaggtctgatgcagatgcggtatgagccctgtatgctgatgcaaattctgttttgcacgattcggacttctccacatgtgcttcgctcaactgcgtgttttcagcgcatatcagcagccagggcct

SEQ ID NO: 5825 - DNA, 140 bp, Artificial Sequence
  Synthetic
aggccctggctgctgatatggccctgaacaccgacgaagagtcgtatgagctggtgagggcagagaggacagaatacgagtacgtctacgacgtggaccagagaagatgctgtaagaagggaccttttgggacagcggtg

SEQ ID NO: 5826 - DNA, 140 bp, Artificial Sequence
  Synthetic
caccgctgtcccaaaaggtcccttcttacagcatcttctctggtccacgtcgtagacgtactcgtattctgtcctctctgccctcaccagctcatacgactcttcgtcggtgttcagggccatatcagcagccagggcct

SEQ ID NO: 5827 - DNA, 140 bp, Artificial Sequence
  Synthetic
atacgccatgctgggtctccaagaagctgcaggactggtactggtgggcgacttgactaatccgccctaccacgaattcgcatatgaagggctaaaaacccgccctgcctgcccatacaacgtacttgggagtcggccat

SEQ ID NO: 5828 - DNA, 140 bp, Artificial Sequence
  Synthetic
atggccgactcccaagtacgttgtatgggcaggcagggcgggtttttagcccttcatatgcgaattcgtggtagggcggattagtcaagtcgcccaccagtaccagtcctgcagcttcttggagacccagcatggcgtat

SEQ ID NO: 5829 - DNA, 140 bp, Artificial Sequence
  Synthetic
aggccctggctgctgatatggaaaactgccaagaaatcaccaccgacgtgatgagacagagaggtctagagatatctgcacgtacggttgactcgctgctcttgaatggatgtaacagacgaccttttgggacagcggtg

SEQ ID NO: 5830 - DNA, 140 bp, Artificial Sequence
  Synthetic
caccgctgtcccaaaaggtcgtctgttacatccattcaagagcagcgagtcaaccgtacgtgcagatatctctagacctctctgtctcatcacgtcggtggtgatttcttggcagttttccatatcagcagccagggcct

SEQ ID NO: 5831 - DNA, 140 bp, Artificial Sequence
  Synthetic
aggccctggctgctgatatgccaggtcatttacaacagaagtcagtacgccagtcagtgctgccggtgaacaccctggaggaagtccacgaggagaagtgttacccacctaagctggatggaccttttgggacagcggtg

SEQ ID NO: 5832 - DNA, 140 bp, Artificial Sequence
  Synthetic
caccgctgtcccaaaaggtccatccagcttaggtgggtaacacttctcctcgtggacttcctccagggtgttcaccggcagcactgactggcgtactgacttctgttgtaaatgacctggcatatcagcagccagggcct

SEQ ID NO: 5833 - DNA, 140 bp, Artificial Sequence
  Synthetic
aggccctggctgctgatatgaagcaaaggagcaactattacttaagaaactccaggagagtgcatccatggccaacagaagcaggtatcagtcgcgcaaagtagaaaacatgaaagcagcgaccttttgggacagcggtg

SEQ ID NO: 5834 - DNA, 140 bp, Artificial Sequence
  Synthetic
caccgctgtcccaaaaggtcgctgctttcatgttttctactttgcgcgactgatacctgcttctgttggccatggatgcactctcctggagtttcttaagtaatagttgctcctttgcttcatatcagcagccagggcct

SEQ ID NO: 5835 - DNA, 140 bp, Artificial Sequence
  Synthetic
aggccctggctgctgatatgcaatgagttcttagctagaaactatccaactgtctcatcataccaaattaccgacgagtatgatgcatatctagacatggtggacgggtcggagagttgcgaccttttgggacagcggtg

SEQ ID NO: 5836 - DNA, 140 bp, Artificial Sequence
  Synthetic
caccgctgtcccaaaaggtcgcaactctccgacccgtccaccatgtctagatatgcatcatactcgtcggtaatttggtatgatgagacagttggatagtttctagctaagaactcattgcatatcagcagccagggcct

SEQ ID NO: 5837 - DNA, 140 bp, Artificial Sequence
  Synthetic
aggccctggctgctgatatgtgcagtcaccaaatgacctttgatacattccaaaacaaagccaacgtttgttgggctaagagcttggtccctatcctcaaaacagcggggataaaactaagaccttttgggacagcggtg

SEQ ID NO: 5838 - DNA, 140 bp, Artificial Sequence
  Synthetic
caccgctgtcccaaaaggtcttagttttatccccgctgttttgaggatagggaccaagctcttagcccaacaaacgttggctttgttttggaatgtatcaaaggtcatttggtgactgcacatatcagcagccagggcct

SEQ ID NO: 5839 - DNA, 140 bp, Artificial Sequence
  Synthetic
aggccctggctgctgatatgccgacgagtatgatgcatatctagacatggtggacgggtcggagagttgcctggaccgagcgacattcaatccgtcaaaactcaggagctacccgaaacagaccttttgggacagcggtg

SEQ ID NO: 5840 - DNA, 140 bp, Artificial Sequence
  Synthetic
caccgctgtcccaaaaggtctgtttcgggtagctcctgagttttgacggattgaatgtcgctcggtccaggcaactctccgacccgtccaccatgtctagatatgcatcatactcgtcggcatatcagcagccagggcct

SEQ ID NO: 5841 - DNA, 140 bp, Artificial Sequence
  Synthetic
atacgccatgctgggtctcccgacattctgcttacacacagatgtctcatgtagacagagagcagacgtcgcgatatatcaagacgtctatgctgtacacgcacccacgtcgctataccacgtacttgggagtcggccat

SEQ ID NO: 5842 - DNA, 140 bp, Artificial Sequence
  Synthetic
atggccgactcccaagtacgtggtatagcgacgtgggtgcgtgtacagcatagacgtcttgatatatcgcgacgtctgctctctgtctacatgagacatctgtgtgtaagcagaatgtcgggagacccagcatggcgtat

SEQ ID NO: 5843 - DNA, 140 bp, Artificial Sequence
  Synthetic
atacgccatgctgggtctccggatctagacagcgggctattttctaaaccgttggtgtctgtgtattacgcggatagccactgggataataggcctggagggaagatgttcggattcaaccgtacttgggagtcggccat

SEQ ID NO: 5844 - DNA, 140 bp, Artificial Sequence
  Synthetic
atggccgactcccaagtacggttgaatccgaacatcttccctccaggcctattatcccagtggctatccgcgtaatacacagacaccaacggtttagaaaatagcccgctgtctagatccggagacccagcatggcgtat

SEQ ID NO: 5845 - DNA, 140 bp, Artificial Sequence
  Synthetic
atacgccatgctgggtctccaaaagctaaaaccgtgcgaccgtgtgctgttctcagtagggtcaacgctctacccggaaagtcgcaagctacttaagagctggcacctaccatcggtgttcgtacttgggagtcggccat

SEQ ID NO: 5846 - DNA, 140 bp, Artificial Sequence
  Synthetic
atggccgactcccaagtacgaacaccgatggtaggtgccagctcttaagtagcttgcgactttccgggtagagcgttgaccctactgagaacagcacacggtcgcacggttttagcttttggagacccagcatggcgtat

SEQ ID NO: 5847 - DNA, 140 bp, Artificial Sequence
  Synthetic
atacgccatgctgggtctccaaaagctataaccgtgcgaccgtgtgctgttctcagtagggtcaacgctctacccggaaagtcgcaagctacttaagagctggcacctaccatcggtgttcgtacttgggagtcggccat

SEQ ID NO: 5848 - DNA, 140 bp, Artificial Sequence
  Synthetic
atggccgactcccaagtacgaacaccgatggtaggtgccagctcttaagtagcttgcgactttccgggtagagcgttgaccctactgagaacagcacacggtcgcacggttatagcttttggagacccagcatggcgtat

SEQ ID NO: 5849 - DNA, 140 bp, Artificial Sequence
  Synthetic
atacgccatgctgggtctccaaaagctacaaccgtgcgaccgtgtgctgttctcagtagggtcaacgctctacccggaaagtcgcaagctacttaagagctggcacctaccatcggtgttcgtacttgggagtcggccat

SEQ ID NO: 5850 - DNA, 140 bp, Artificial Sequence
  Synthetic
atggccgactcccaagtacgaacaccgatggtaggtgccagctcttaagtagcttgcgactttccgggtagagcgttgaccctactgagaacagcacacggtcgcacggttgtagcttttggagacccagcatggcgtat

SEQ ID NO: 5851 - DNA, 140 bp, Artificial Sequence
  Synthetic
atacgccatgctgggtctccaaaagctagaaccgtgcgaccgtgtgctgttctcagtagggtcaacgctctacccggaaagtcgcaagctacttaagagctggcacctaccatcggtgttcgtacttgggagtcggccat

SEQ ID NO: 5852 - DNA, 140 bp, Artificial Sequence
  Synthetic
atggccgactcccaagtacgaacaccgatggtaggtgccagctcttaagtagcttgcgactttccgggtagagcgttgaccctactgagaacagcacacggtcgcacggttctagcttttggagacccagcatggcgtat

SEQ ID NO: 5853 - DNA, 140 bp, Artificial Sequence
  Synthetic
aggccctggctgctgatatgaaactaaaagggccaaaagcagcagcgctattcgcaaaaacccataatctactgccactacaggaagtaccaatggataggttcacagtagatatgaaaagaccttttgggacagcggtg

SEQ ID NO: 5854 - DNA, 140 bp, Artificial Sequence
  Synthetic
caccgctgtcccaaaaggtcttttcatatctactgtgaacctatccattggtacttcctgtagtggcagtagattatgggtttttgcgaatagcgctgctgcttttggcccttttagtttcatatcagcagccagggcct

SEQ ID NO: 5855 - DNA, 140 bp, Artificial Sequence
  Synthetic
atacgccatgctgggtctccgtggaacatcaacaagcagatctgcgtgactaccaggaggatagaagacttcaaccctaccaccaacattataccggccaacaggagactaccacactcacgtacttgggagtcggccat

SEQ ID NO: 5856 - DNA, 140 bp, Artificial Sequence
  Synthetic
atggccgactcccaagtacgtgagtgtggtagtctcctgttggccggtataatgttggtggtagggttgaagtcttctatcctcctggtagtcacgcagatctgcttgttgatgttccacggagacccagcatggcgtat

SEQ ID NO: 5857 - DNA, 140 bp, Artificial Sequence
  Synthetic
atacgccatgctgggtctcctaacaagataaacggccaccacgtgctcctggtcagtgactgtagcctagcactgcctactaagagagtcacttgggtagcgccactaggtgtccgcggacgtacttgggagtcggccat

SEQ ID NO: 5858 - DNA, 140 bp, Artificial Sequence
  Synthetic
atggccgactcccaagtacgtccgcggacacctagtggcgctacccaagtgactctcttagtaggcagtgctaggctacagtcactgaccaggagcacgtggtggccgtttatcttgttaggagacccagcatggcgtat

SEQ ID NO: 5859 - DNA, 140 bp, Artificial Sequence
  Synthetic
atacgccatgctgggtctccgattcacagagagctggttaggaggctgaacgccgtcctcctacccaatgtacatacactatttgacatgtctgccgaggatttcgatgccatcatagcccgtacttgggagtcggccat

SEQ ID NO: 5860 - DNA, 140 bp, Artificial Sequence
  Synthetic
atggccgactcccaagtacgggctatgatggcatcgaaatcctcggcagacatgtcaaatagtgtatgtacattgggtaggaggacggcgttcagcctcctaaccagctctctgtgaatcggagacccagcatggcgtat

SEQ ID NO: 5861 - DNA, 140 bp, Artificial Sequence
  Synthetic
atacgccatgctgggtctcctcccatacagcggggacgcccaagaagcccgggacgcagaaaaagaagcagaggaagaacgagaagcagaattgactcgtgaagccctaccacctctacacgtacttgggagtcggccat

SEQ ID NO: 5862 - DNA, 140 bp, Artificial Sequence
  Synthetic
atggccgactcccaagtacgtgtagaggtggtagggcttcacgagtcaattctgcttctcgttcttcctctgcttctttttctgcgtcccgggcttcttgggcgtccccgctgtatgggaggagacccagcatggcgtat

SEQ ID NO: 5863 - DNA, 140 bp, Artificial Sequence
  Synthetic
atacgccatgctgggtctccgacagctttgtggtaccgagtctgtggtcgtccgggttgtcaatccctttgaggactagaatcaagtggttgttaagcaaggtgccaaaaaccgacctgacgtacttgggagtcggccat

SEQ ID NO: 5864 - DNA, 140 bp, Artificial Sequence
  Synthetic
atggccgactcccaagtacgtcaggtcggtttttggcaccttgcttaacaaccacttgattctagtcctcaaagggattgacaacccggacgaccacagactcggtaccacaaagctgtcggagacccagcatggcgtat

SEQ ID NO: 5865 - DNA, 140 bp, Artificial Sequence
  Synthetic
atacgccatgctgggtctccactgcccaaccaacagaccacgtcgtgggagagtacctggtactttccccgcagaccgtactacgcagccagaagctcagcctaattcacgctttggcggcgtacttgggagtcggccat

SEQ ID NO: 5866 - DNA, 140 bp, Artificial Sequence
  Synthetic
atggccgactcccaagtacgccgccaaagcgtgaattaggctgagcttctggctgcgtagtacggtctgcggggaaagtaccaggtactctcccacgacgtggtctgttggttgggcagtggagacccagcatggcgtat

SEQ ID NO: 5867 - DNA, 140 bp, Artificial Sequence
  Synthetic
aggccctggctgctgatatgcgccatgatgaaatcaggtatgttcctaactctgttcgtcaacacattgttaaacatcaccatcgccagccgagtgctggaagatcgtctgacaaaatccgaccttttgggacagcggtg

SEQ ID NO: 5868 - DNA, 140 bp, Artificial Sequence
  Synthetic
caccgctgtcccaaaaggtcggattttgtcagacgatcttccagcactcggctggcgatggtgatgtttaacaatgtgttgacgaacagagttaggaacatacctgatttcatcatggcgcatatcagcagccagggcct

SEQ ID NO: 5869 - DNA, 140 bp, Artificial Sequence
  Synthetic
aggccctggctgctgatatgaagctgcaggactggtactggtgggcgacttgactaatccgccctaccacgaattcgcatacgaagggctaaaaatccgccctgcctgcccatacaaaatgaccttttgggacagcggtg

SEQ ID NO: 5870 - DNA, 140 bp, Artificial Sequence
  Synthetic
caccgctgtcccaaaaggtcattttgtatgggcaggcagggcggatttttagcccttcgtatgcgaattcgtggtagggcggattagtcaagtcgcccaccagtaccagtcctgcagcttcatatcagcagccagggcct

SEQ ID NO: 5871 - DNA, 140 bp, Artificial Sequence
  Synthetic
aggccctggctgctgatatgaactgccaagaaatcaccaccgacgtgatgagacagagaggtctagagatatctgcacgtacggttgactcgctgctcctgaatggatgcaacagaccaggaccttttgggacagcggtg

SEQ ID NO: 5872 - DNA, 140 bp, Artificial Sequence
  Synthetic
caccgctgtcccaaaaggtcctggtctgttgcatccattcaggagcagcgagtcaaccgtacgtgcagatatctctagacctctctgtctcatcacgtcggtggtgatttcttggcagttcatatcagcagccagggcct

SEQ ID NO: 5873 - DNA, 140 bp, Artificial Sequence
  Synthetic
atacgccatgctgggtctccaacgatgaagagtgcgtagtcaacgccgccaaccctcgcggtgacggtgtttgcaaggcagtatacaaaaaatggccggagtcctttaagaacagtgcaacgtacttgggagtcggccat

SEQ ID NO: 5874 - DNA, 140 bp, Artificial Sequence
  Synthetic
atggccgactcccaagtacgttgcactgttcttaaaggactccggccattttttgtatactgccttgcaaacaccgtcaccgcgagggttggcggcgttgactacgcactcttcatcgttggagacccagcatggcgtat

SEQ ID NO: 5875 - DNA, 140 bp, Artificial Sequence
  Synthetic
aggccctggctgctgatatgagatcatagatgcagttgtatccttgaaagccccttacttttgtggagggtttatactgcacgatactgtgacaggaacagcttgcagagtggcagacccgaccttttgggacagcggtg

SEQ ID NO: 5876 - DNA, 140 bp, Artificial Sequence
  Synthetic
caccgctgtcccaaaaggtcgggtctgccactctgcaagctgttcctgtcacagtatcgtgcagtataaaccctccacaaaagtaaggggctttcaaggatacaactgcatctatgatctcatatcagcagccagggcct

SEQ ID NO: 5877 - DNA, 140 bp, Artificial Sequence
  Synthetic
atacgccatgctgggtctcccaccagtgggaaccgcaaaaacagtcatgtgcggtacgtatccagtaatccacgccgttggaccaaacttctctaattatccggagtctgaaggggaccgcgtacttgggagtcggccat

SEQ ID NO: 5878 - DNA, 140 bp, Artificial Sequence
  Synthetic
atggccgactcccaagtacgcggtccccttcagactccggataattagagaagtttggtccaacggcgtggattactggatacgtaccgcacatgactgtttttgcggttcccactggtgggagacccagcatggcgtat

SEQ ID NO: 5879 - DNA, 140 bp, Artificial Sequence
  Synthetic
aggccctggctgctgatatgccagatccaacttcgagaagctcagaggacccgtcataactttgtacggcggtcctaaataggtacgcactacagctacctattttgcagaagccgacaggaccttttgggacagcggtg

SEQ ID NO: 5880 - DNA, 140 bp, Artificial Sequence
  Synthetic
caccgctgtcccaaaaggtcctgtcggcttctgcaaaataggtagctgtagtgcgtacctatttaggaccgccgtacaaagttatgacgggtcctctgagcttctcgaagttggatctggcatatcagcagccagggcct

SEQ ID NO: 5881 - DNA, 140 bp, Artificial Sequence
  Synthetic
atacgccatgctgggtctccaccctaccatcaacatcataccggccaacaggagactaccacactcattagtggccgaacaccgcccagtaaaaggggaaagaatggaatggctggtcaacgtacttgggagtcggccat

SEQ ID NO: 5882 - DNA, 140 bp, Artificial Sequence
  Synthetic
atggccgactcccaagtacgttgaccagccattccattctttccccttttactgggcggtgttcggccactaatgagtgtggtagtctcctgttggccggtatgatgttgatggtagggtggagacccagcatggcgtat

SEQ ID NO: 5883 - DNA, 140 bp, Artificial Sequence
  Synthetic
aggccctggctgctgatatggtggccgaacaccgcccagtaaaaggggaaagaatggaatggctggtcaacaagataaacggccgccacgtgctcctggtcagtggctataaccttgcacgaccttttgggacagcggtg

SEQ ID NO: 5884 - DNA, 140 bp, Artificial Sequence
  Synthetic
caccgctgtcccaaaaggtcgtgcaaggttatagccactgaccaggagcacgtggcggccgtttatcttgttgaccagccattccattctttccccttttactgggcggtgttcggccaccatatcagcagccagggcct

SEQ ID NO: 5885 - DNA, 140 bp, Artificial Sequence
  Synthetic
aggccctggctgctgatatggactacacatacaacctagagttgggtctgccagcaacgcttggtaggtatgacctagtggtcataaacatccacacaccttttcgtatacaccattaccgaccttttgggacagcggtg

SEQ ID NO: 5886 - DNA, 140 bp, Artificial Sequence
  Synthetic
caccgctgtcccaaaaggtcggtaatggtgtatacgaaaaggtgtgtggatgtttatgaccactaggtcatacctaccaagcgttgctggcagacccaactctaggttgtatgtgtagtccatatcagcagccagggcct

SEQ ID NO: 5887 - DNA, 140 bp, Artificial Sequence
  Synthetic
atacgccatgctgggtctccaacagtgcgtagaccacgcaatgaaactgcaaatgctcgggggtgactcattgagattgctcaaaccgggtggctctctattgatcagagcatatggttacgtacttgggagtcggccat

SEQ ID NO: 5888 - DNA, 140 bp, Artificial Sequence
  Synthetic
atggccgactcccaagtacgtaaccatatgctctgatcaatagagagccacccggtttgagcaatctcaatgagtcacccccgagcatttgcagtttcattgcgtggtctacgcactgttggagacccagcatggcgtat

SEQ ID NO: 5889 - DNA, 140 bp, Artificial Sequence
  Synthetic
aggccctggctgctgatatgttgagattgctcaaaccgggtggctctctattgatcagagcatatggttacgcagatagaaccagcgaacgagtcatctgcgtattgggacgcaagtttagaccttttgggacagcggtg

SEQ ID NO: 5890 - DNA, 140 bp, Artificial Sequence
  Synthetic
caccgctgtcccaaaaggtctaaacttgcgtcccaatacgcagatgactcgttcgctggttctatctgcgtaaccatatgctctgatcaatagagagccacccggtttgagcaatctcaacatatcagcagccagggcct

SEQ ID NO: 5891 - DNA, 140 bp, Artificial Sequence
  Synthetic
atacgccatgctgggtctccatgcagatgcatcatctcccccgaaaactgtcccgtgcctctgccgttatgccatgacaccagaacgcgttacccgacttcgcatgaaccatgtcacaagcgtacttgggagtcggccat

SEQ ID NO: 5892 - DNA, 140 bp, Artificial Sequence
  Synthetic
atggccgactcccaagtacgcttgtgacatggttcatgcgaagtcgggtaacgcgttctggtgtcatggcataacggcagaggcacgggacagttttcgggggagatgatgcatctgcatggagacccagcatggcgtat

SEQ ID NO: 5893 - DNA, 140 bp, Artificial Sequence
  Synthetic
atacgccatgctgggtctcctgtcatgaacaatcaactgaatgccgcctttgtaggacaggccacccgagcaggatgtgcaccgtcgtaccgggtaaaacgcatggacatcgcgaagaaccgtacttgggagtcggccat

SEQ ID NO: 5894 - DNA, 140 bp, Artificial Sequence
  Synthetic
atggccgactcccaagtacggttcttcgcgatgtccatgcgttttacccggtacgacggtgcacatcctgctcgggtggcctgtcctacaaaggcggcattcagttgattgttcatgacaggagacccagcatggcgtat

SEQ ID NO: 5895 - DNA, 140 bp, Artificial Sequence
  Synthetic
aggccctggctgctgatatgtcgcgcgtaagtccaagggaatacagaccttcccaggagtctgtacaggaagcgatactgcccgtcccgtcagacctggatgctgacgccccagccctaggaccttttgggacagcggtg

SEQ ID NO: 5896 - DNA, 140 bp, Artificial Sequence
  Synthetic
caccgctgtcccaaaaggtcctagggctggggcgtcagcatccaggtctgacgggacgggcagtatcgcttcctgtacagactcctgggaaggtctgtattcccttggacttacgcgcgacatatcagcagccagggcct

SEQ ID NO: 5897 - DNA, 140 bp, Artificial Sequence
  Synthetic
aggccctggctgctgatatggtgcaacaccagtgggaaccgcaaaaacagttatgtgcggtacgtatccagtaatccacgccgttggaccaaacttctctaactattcggagtccgaagggaccttttgggacagcggtg

SEQ ID NO: 5898 - DNA, 140 bp, Artificial Sequence
  Synthetic
caccgctgtcccaaaaggtcccttcggactccgaatagttagagaagtttggtccaacggcgtggattactggatacgtaccgcacataactgtttttgcggttcccactggtgttgcaccatatcagcagccagggcct

SEQ ID NO: 5899 - DNA, 140 bp, Artificial Sequence
  Synthetic
aggccctggctgctgatatggactgggagtaaatagtgtagctatacctctcctctccacaggtgtatactcaggagggaaagacaggttgacccagtcactgaaccacctttttacagcgaccttttgggacagcggtg

SEQ ID NO: 5900 - DNA, 140 bp, Artificial Sequence
  Synthetic
caccgctgtcccaaaaggtcgctgtaaaaaggtggttcagtgactgggtcaacctgtctttccctcctgagtatacacctgtggagaggagaggtatagctacactatttactcccagtccatatcagcagccagggcct

SEQ ID NO: 5901 - DNA, 140 bp, Artificial Sequence
  Synthetic
aggccctggctgctgatatgcagagctgtgtccagtcgtacaagaaacagcggagacgcgtgacacagctatgtctcttcaggcaccgccgagtaccgccacggaactgagtcacccgccgaccttttgggacagcggtg

SEQ ID NO: 5902 - DNA, 140 bp, Artificial Sequence
  Synthetic
caccgctgtcccaaaaggtcggcgggtgactcagttccgtggcggtactcggcggtgcctgaagagacatagctgtgtcacgcgtctccgctgtttcttgtacgactggacacagctctgcatatcagcagccagggcct

SEQ ID NO: 5903 - DNA, 140 bp, Artificial Sequence
  Synthetic
atacgccatgctgggtctccccgtacgtgaagtgctgcggtacagcagagtgcaaggacaaaaacctacctgactacagctgtaaggtcttcaccggcgtctacccatttatgtggggcgcgtacttgggagtcggccat

SEQ ID NO: 5904 - DNA, 140 bp, Artificial Sequence
  Synthetic
atggccgactcccaagtacgcgccccacataaatgggtagacgccggtgaagaccttacagctgtagtcaggtaggtttttgtccttgcactctgctgtaccgcagcacttcacgtacggggagacccagcatggcgtat

SEQ ID NO: 5905 - DNA, 140 bp, Artificial Sequence
  Synthetic
aggccctggctgctgatatgccggaggaaaccctacgcatgcttgaggacaacgtcatgagacctgggtactatcagctgctacaagcatccttaacatgttctccccaccgccagcgacgaccttttgggacagcggtg

SEQ ID NO: 5906 - DNA, 140 bp, Artificial Sequence
  Synthetic
caccgctgtcccaaaaggtcgtcgctggcggtggggagaacatgttaaggatgcttgtagcagctgatagtacccaggtctcatgacgttgtcctcaagcatgcgtagggtttcctccggcatatcagcagccagggcct

SEQ ID NO: 5907 - DNA, 140 bp, Artificial Sequence
  Synthetic
aggccctggctgctgatatgctatcagctgctacaagcatccttaacatgttctccccaccgccagcgacgcagcaccaaggacaacttcaatgtctataaagccacaagaccatacttagaccttttgggacagcggtg

SEQ ID NO: 5908 - DNA, 140 bp, Artificial Sequence
  Synthetic
caccgctgtcccaaaaggtctaagtatggtcttgtggctttatagacattgaagttgtccttggtgctgcgtcgctggcggtggggagaacatgttaaggatgcttgtagcagctgatagcatatcagcagccagggcct

SEQ ID NO: 5909 - DNA, 140 bp, Artificial Sequence
  Synthetic
atacgccatgctgggtctccacaggaagcgagtacaaccacgtcactgacgcatagccaattcgacctaagcgttgacggcgagatactgcccgtcccgtcagacctggatgttgacgcccgtacttgggagtcggccat

SEQ ID NO: 5910 - DNA, 140 bp, Artificial Sequence
  Synthetic
atggccgactcccaagtacgggcgtcaacatccaggtctgacgggacgggcagtatctcgccgtcaacgcttaggtcgaattggctatgcgtcagtgacgtggttgtactcgcttcctgtggagacccagcatggcgtat

SEQ ID NO: 5911 - DNA, 140 bp, Artificial Sequence
  Synthetic
atacgccatgctgggtctcctcagccctagaaccagccctagacgacggggcgacacacacgttgccatccataactggaaaccttgcggccgtgtctgactgggtaatgagcaccgtaccgtacttgggagtcggccat

SEQ ID NO: 5912 - DNA, 140 bp, Artificial Sequence
  Synthetic
atggccgactcccaagtacggtacggtgctcattacccagtcagacacggccgcaaggtttccagttatggatggcaacgtgtgtgtcgccccgtcgtctagggctggttctagggctgaggagacccagcatggcgtat

SEQ ID NO: 5913 - DNA, 140 bp, Artificial Sequence
  Synthetic
atacgccatgctgggtctccgtgctcagacacggacgacgagttatgactagacagggcaggagggtatatattctcgtcggacactggtccaggtcatttacaacagaagtcagtacgccgtacttgggagtcggccat

SEQ ID NO: 5914 - DNA, 140 bp, Artificial Sequence
  Synthetic
atggccgactcccaagtacggcgtactgacttctgttgtaaatgacctggaccagtgtccgacgagaatatataccctcctgccctgtctagtcataactcgtcgtccgtgtctgagcacggagacccagcatggcgtat

SEQ ID NO: 5915 - DNA, 140 bp, Artificial Sequence
  Synthetic
aggccctggctgctgatatggtagaaaacatgaaagcaacaatcatccagagactaaagagaggctgtagattatacttaatgtcagagaccccaaaagtccctacctaccggaccacatgaccttttgggacagcggtg

SEQ ID NO: 5916 - DNA, 140 bp, Artificial Sequence
  Synthetic
caccgctgtcccaaaaggtcatgtggtccggtaggtagggacttttggggtctctgacattaagtataatctacagcctctctttagtctctggatgattgttgctttcatgttttctaccatatcagcagccagggcct

SEQ ID NO: 5917 - DNA, 140 bp, Artificial Sequence
  Synthetic
atacgccatgctgggtctccattatacttaatgtcagagaccccaaaagtccctacctaccggaccacatatccggcgcctgtgcactcgcctccgattaacgtccgactgtccaacccccgtacttgggagtcggccat

SEQ ID NO: 5918 - DNA, 140 bp, Artificial Sequence
  Synthetic
atggccgactcccaagtacgggggttggacagtcggacgttaatcggaggcgagtgcacaggcgccggatatgtggtccggtaggtagggacttttggggtctctgacattaagtataatggagacccagcatggcgtat

SEQ ID NO: 5919 - DNA, 140 bp, Artificial Sequence
  Synthetic
aggccctggctgctgatatgtgttacccacctaagctggatgaagcaaaggagcaactattacttaagaaactccaggagagcgcatctatggccaacagaagcaggtatcagtcgcgcagaccttttgggacagcggtg

SEQ ID NO: 5920 - DNA, 140 bp, Artificial Sequence
  Synthetic
caccgctgtcccaaaaggtctgcgcgactgatacctgcttctgttggccatagatgcgctctcctggagtttcttaagtaatagttgctcctttgcttcatccagcttaggtgggtaacacatatcagcagccagggcct

SEQ ID NO: 5921 - DNA, 140 bp, Artificial Sequence
  Synthetic
aggccctggctgctgatatggagtccgcagtggcagcatgcaatgagttcttggctagaaactatccaactgtttcatcataccaaatcaccgacgagtatgatgcatatctagacatgggaccttttgggacagcggtg

SEQ ID NO: 5922 - DNA, 140 bp, Artificial Sequence
  Synthetic
caccgctgtcccaaaaggtcccatgtctagatatgcatcatactcgtcggtgatttggtatgatgaaacagttggatagtttctagccaagaactcattgcatgctgccactgcggactccatatcagcagccagggcct

SEQ ID NO: 5923 - DNA, 140 bp, Artificial Sequence
  Synthetic
aggccctggctgctgatatgtgtttcatcataccaaatcaccgacgagtatgatgcatatctagacatggtggacgggtcggagagttgtctggaccgagcgacattcaacccgtcaaaagaccttttgggacagcggtg

SEQ ID NO: 5924 - DNA, 140 bp, Artificial Sequence
  Synthetic
caccgctgtcccaaaaggtcttttgacgggttgaatgtcgctcggtccagacaactctccgacccgtccaccatgtctagatatgcatcatactcgtcggtgatttggtatgatgaaacacatatcagcagccagggcct

SEQ ID NO: 5925 - DNA, 140 bp, Artificial Sequence
  Synthetic
atacgccatgctgggtctccatacccggcgcctgtgtactcgccttcgatcaacgtccgattgtccaaccccgagtccgcagtggcagcatgcaatgagttcttagctagaaactatccacgtacttgggagtcggccat

SEQ ID NO: 5926 - DNA, 140 bp, Artificial Sequence
  Synthetic
atggccgactcccaagtacgtggatagtttctagctaagaactcattgcatgctgccactgcggactcggggttggacaatcggacgttgatcgaaggcgagtacacaggcgccgggtatggagacccagcatggcgtat

SEQ ID NO: 5927 - DNA, 140 bp, Artificial Sequence
  Synthetic
aggccctggctgctgatatgcaagaatactgggaagaatttgctgccagccctattaggataacaactgagaatttaacaacttatgttactaaactaaaagggccaaaagcagcagcgcgaccttttgggacagcggtg

SEQ ID NO: 5928 - DNA, 140 bp, Artificial Sequence
  Synthetic
caccgctgtcccaaaaggtcgcgctgctgcttttggcccttttagtttagtaacataagttgttaaattctcagttgttatcctaatagggctggcagcaaattcttcccagtattcttgcatatcagcagccagggcct

SEQ ID NO: 5929 - DNA, 140 bp, Artificial Sequence
  Synthetic
aggccctggctgctgatatgagtgtaattgcggtggctcaaatgaaggactaacaactacagacaaagtgattaataactgcaaggttgatcaatgtcatgccgcggtcaccaatcacaagaccttttgggacagcggtg

SEQ ID NO: 5930 - DNA, 140 bp, Artificial Sequence
  Synthetic
caccgctgtcccaaaaggtcttgtgattggtgaccgcggcatgacattgatcaaccttgcagttattaatcactttgtctgtagttgttagtccttcatttgagccaccgcaattacactcatatcagcagccagggcct

SEQ ID NO: 5931 - DNA, 140 bp, Artificial Sequence
  Synthetic
aggccctggctgctgatatgtggcgacagcatacctatgtgggattcacagagagctggttaggaggctgaacgccgtcctcctacccaacgtacatacactatttgacatgtctgccgagaccttttgggacagcggtg

SEQ ID NO: 5932 - DNA, 140 bp, Artificial Sequence
  Synthetic
caccgctgtcccaaaaggtctcggcagacatgtcaaatagtgtatgtacgttgggtaggaggacggcgttcagcctcctaaccagctctctgtgaatcccacataggtatgctgtcgccacatatcagcagccagggcct

SEQ ID NO: 5933 - DNA, 140 bp, Artificial Sequence
  Synthetic
aggccctggctgctgatatgtcctgtgataggtcgggaaaaattccattcccgaccgcagcacggtaaagagctaccttgcagcacgtacgtgcagagcaccgccgcaactaccgaggaggaccttttgggacagcggtg

SEQ ID NO: 5934 - DNA, 140 bp, Artificial Sequence
  Synthetic
caccgctgtcccaaaaggtcctcctcggtagttgcggcggtgctctgcacgtacgtgctgcaaggtagctctttaccgtgctgcggtcgggaatggaatttttcccgacctatcacaggacatatcagcagccagggcct

SEQ ID NO: 5935 - DNA, 140 bp, Artificial Sequence
  Synthetic
aggccctggctgctgatatgcagcttgcagagtggcagacccgctaaaaaggctatttaaactgggcaaaccgttagcggcaggtgacgaacaagatgaagatagaagacgagcgctggcgaccttttgggacagcggtg

SEQ ID NO: 5936 - DNA, 140 bp, Artificial Sequence
  Synthetic
caccgctgtcccaaaaggtcgccagcgctcgtcttctatcttcatcttgttcgtcacctgccgctaacggtttgcccagtttaaatagcctttttagcgggtctgccactctgcaagctgcatatcagcagccagggcct

SEQ ID NO: 5937 - DNA, 140 bp, Artificial Sequence
  Synthetic
atacgccatgctgggtctccaccgaaaaggaaaaattcacatcccgtttccgctggcaaatgtaacatgcagggtgcctaaagcaaggaaccccaccgtgacgtacgggaaaaaccaagtcgtacttgggagtcggccat

SEQ ID NO: 5938 - DNA, 140 bp, Artificial Sequence
  Synthetic
atggccgactcccaagtacgacttggtttttcccgtacgtcacggtggggttccttgctttaggcaccctgcatgttacatttgccagcggaaacgggatgtgaatttttccttttcggtggagacccagcatggcgtat

SEQ ID NO: 5939 - DNA, 140 bp, Artificial Sequence
  Synthetic
aggccctggctgctgatatgacccgtcataactttgtacggcggtcctaaataggtacgcactacagctacctattttgcagaagccgacagcaagtacctaaacactaacaatggagttgaccttttgggacagcggtg

SEQ ID NO: 5940 - DNA, 140 bp, Artificial Sequence
  Synthetic
caccgctgtcccaaaaggtcaactccattgttagtgtttaggtacttgctgtcggcttctgcaaaataggtagctgtagtgcgtacctatttaggaccgccgtacaaagttatgacgggtcatatcagcagccagggcct

SEQ ID NO: 5941 - DNA, 140 bp, Artificial Sequence
  Synthetic
aggccctggctgctgatatgtgggagaagaaccaaactatcaagaagagtgggtgatgcataagaaggaagtcgtgctaaccgtgccgactgaagggctcgaggtcacgtggggcaacaagaccttttgggacagcggtg

SEQ ID NO: 5942 - DNA, 140 bp, Artificial Sequence
  Synthetic
caccgctgtcccaaaaggtcttgttgccccacgtgacctcgagcccttcagtcggcacggttagcacgacttccttcttatgcatcacccactcttcttgatagtttggttcttctcccacatatcagcagccagggcct

SEQ ID NO: 5943 - DNA, 140 bp, Artificial Sequence
  Synthetic
aggccctggctgctgatatgacacagaggaaagacctaaggtacaggttatacaggcggctgaacccttggcaacagcatacctatgtgggattcacagagagctggttaggaggctgaagaccttttgggacagcggtg

SEQ ID NO: 5944 - DNA, 140 bp, Artificial Sequence
  Synthetic
caccgctgtcccaaaaggtcttcagcctcctaaccagctctctgtgaatcccacataggtatgctgttgccaagggttcagccgcctgtataacctgtaccttaggtctttcctctgtgtcatatcagcagccagggcct

SEQ ID NO: 5945 - DNA, 140 bp, Artificial Sequence
  Synthetic
aggccctggctgctgatatgactgtagtagttgtgtcagtggccacgttcatactcctgtcgatggtgggtatggcagcggggatgtgcatgtgtgcacgacgcagatgcatcacaccgtgaccttttgggacagcggtg

SEQ ID NO: 5946 - DNA, 140 bp, Artificial Sequence
  Synthetic
caccgctgtcccaaaaggtcacggtgtgatgcatctgcgtcgtgcacacatgcacatccccgctgccatacccaccatcgacaggagtatgaacgtggccactgacacaactactacagtcatatcagcagccagggcct

SEQ ID NO: 5947 - DNA, 140 bp, Artificial Sequence
  Synthetic
aggccctggctgctgatatgaaaagcaaaagcaacaggcgccacaaaacaacacaaaccaaaagaagcaaccacctaaaaagaaaccggctcaaaagaaaaagaagccgggccgcagagagaccttttgggacagcggtg

SEQ ID NO: 5948 - DNA, 140 bp, Artificial Sequence
  Synthetic
caccgctgtcccaaaaggtctctctgcggcccggcttctttttcttttgagccggtttctttttaggtggttgcttcttttggtttgtgttgttttgtggcgcctgttgcttttgcttttcatatcagcagccagggcct

SEQ ID NO: 5949 - DNA, 140 bp, Artificial Sequence
  Synthetic
atacgccatgctgggtctcctctgttcgtcaacacactgctaaatatcaccatcgccagccgagtgctggaagatcgtctgacaaaatccgcgtgcgcagccttcatcggcgacgacaaccgtacttgggagtcggccat

SEQ ID NO: 5950 - DNA, 140 bp, Artificial Sequence
  Synthetic
atggccgactcccaagtacggttgtcgtcgccgatgaaggctgcgcacgcggattttgtcagacgatcttccagcactcggctggcgatggtgatatttagcagtgtgttgacgaacagaggagacccagcatggcgtat

SEQ ID NO: 5951 - DNA, 140 bp, Artificial Sequence
  Synthetic
aggccctggctgctgatatgaagatcgtctgacaaaatccgcgtgcgcagccttcatcggcgacgacaacataattcatggagtcgtctccgatgaattgatggcagccagatgcgccacgaccttttgggacagcggtg

SEQ ID NO: 5952 - DNA, 140 bp, Artificial Sequence
  Synthetic
caccgctgtcccaaaaggtcgtggcgcatctggctgccatcaattcatcggagacgactccatgaattatgttgtcgtcgccgatgaaggctgcgcacgcggattttgtcagacgatcttcatatcagcagccagggcct

SEQ ID NO: 5953 - DNA, 140 bp, Artificial Sequence
  Synthetic
aggccctggctgctgatatgtgcatcagaacagctaaagcggccacataccaagaggctgcgatatacctgtggaacgagcagcaacctttgttttggctacaagcccttattccgctgggaccttttgggacagcggtg

SEQ ID NO: 5954 - DNA, 140 bp, Artificial Sequence
  Synthetic
caccgctgtcccaaaaggtcccagcggaataagggcttgtagccaaaacaaaggttgctgctcgttccacaggtatatcgcagcctcttggtatgtggccgctttagctgttctgatgcacatatcagcagccagggcct

SEQ ID NO: 5955 - DNA, 140 bp, Artificial Sequence
  Synthetic
aggccctggctgctgatatgaaaacgttggcttttttagccgtaatgagcgtcggtgcccacactgtgagcgcgtacgaacacgtaacagtgatcccgaacacggtgggagtaccgtatagaccttttgggacagcggtg

SEQ ID NO: 5956 - DNA, 140 bp, Artificial Sequence
  Synthetic
caccgctgtcccaaaaggtctatacggtactcccaccgtgttcgggatcactgttacgtgttcgtacgcgctcacagtgtgggcaccgacgctcattacggctaaaaaagccaacgttttcatatcagcagccagggcct

SEQ ID NO: 5957 - DNA, 140 bp, Artificial Sequence
  Synthetic
atacgccatgctgggtctcccgtacagccctctcggtggtgacctggaataaagacattgtcactaaaatcacccccgagggggccgaagagtggagtcttgctatcccagtcatgtgcccgtacttgggagtcggccat

SEQ ID NO: 5958 - DNA, 140 bp, Artificial Sequence
  Synthetic
atggccgactcccaagtacgggcacatgactgggatagcaagactccactcttcggccccctcgggggtgattttagtgacaatgtctttattccaggtcaccaccgagagggctgtacgggagacccagcatggcgtat

SEQ ID NO: 5959 - DNA, 140 bp, Artificial Sequence
  Synthetic
aggccctggctgctgatatgcgcgtacgaacacgtaacagtgatcccgaacacggtgggagtaccgtataagactctagtcaatagacctggctacagccccatggtattggagatggaagaccttttgggacagcggtg

SEQ ID NO: 5960 - DNA, 140 bp, Artificial Sequence
  Synthetic
caccgctgtcccaaaaggtcttccatctccaataccatggggctgtagccaggtctattgactagagtcttatacggtactcccaccgtgttcgggatcactgttacgtgttcgtacgcgcatatcagcagccagggcct

SEQ ID NO: 5961 - DNA, 140 bp, Artificial Sequence
  Synthetic
aggccctggctgctgatatgcagagtgcaaggacaaaaacctacctgactacagctgtaaggtcttcaccggcgtctacccatttatgtggggcggcgcctactgcttctgcgacgctgagaccttttgggacagcggtg

SEQ ID NO: 5962 - DNA, 140 bp, Artificial Sequence
  Synthetic
caccgctgtcccaaaaggtctcagcgtcgcagaagcagtaggcgccgccccacataaatgggtagacgccggtgaagaccttacagctgtagtcaggtaggtttttgtccttgcactctgcatatcagcagccagggcct

SEQ ID NO: 5963 - DNA, 140 bp, Artificial Sequence
  Synthetic
aggccctggctgctgatatgcatgagacctgggtactatcagctgctacaagcatccttaacatgttctccccaccgccagcgacgcagcaccaaggacaactttaatgtctataaagccgaccttttgggacagcggtg

SEQ ID NO: 5964 - DNA, 140 bp, Artificial Sequence
  Synthetic
caccgctgtcccaaaaggtcggctttatagacattaaagttgtccttggtgctgcgtcgctggcggtggggagaacatgttaaggatgcttgtagcagctgatagtacccaggtctcatgcatatcagcagccagggcct

SEQ ID NO: 5965 - DNA, 140 bp, Artificial Sequence
  Synthetic
atacgccatgctgggtctccacaagaccatatttagctcactgtcccgactgtggagaagggcactcgtgccatagtcccgtagcattagaacgcatcagaaatgaagcgacagacgggacgtacttgggagtcggccat

SEQ ID NO: 5966 - DNA, 140 bp, Artificial Sequence
  Synthetic
atggccgactcccaagtacgtcccgtctgtcgcttcatttctgatgcgttctaatgctacgggactatggcacgagtgcccttctccacagtcgggacagtgagctaaatatggtcttgtggagacccagcatggcgtat

SEQ ID NO: 5967 - DNA, 140 bp, Artificial Sequence
  Synthetic
aggccctggctgctgatatgccatagtcccgtagcattagaacgcatcagaaatgaagcgacagacgggacgcttaaaatccaggtctccttgcaaatcggaataaagacggatgatagcgaccttttgggacagcggtg

SEQ ID NO: 5968 - DNA, 140 bp, Artificial Sequence
  Synthetic
caccgctgtcccaaaaggtcgctatcatccgtctttattccgatttgcaaggagacctggattttaagcgtcccgtctgtcgcttcatttctgatgcgttctaatgctacgggactatggcatatcagcagccagggcct

SEQ ID NO: 5969 - DNA, 140 bp, Artificial Sequence
  Synthetic
aggccctggctgctgatatgcggcgaccatgccgtcacagttaaggacgccaaattcattgtggggccaatgtcttcagcctggacacctttcgacaacaaaattgtggtgtacaaaggtgaccttttgggacagcggtg

SEQ ID NO: 5970 - DNA, 140 bp, Artificial Sequence
  Synthetic
caccgctgtcccaaaaggtcacctttgtacaccacaattttgttgtcgaaaggtgtccaggctgaagacattggccccacaatgaatttggcgtccttaactgtgacggcatggtcgccgcatatcagcagccagggcct

SEQ ID NO: 5971 - DNA, 140 bp, Artificial Sequence
  Synthetic
aggccctggctgctgatatgtgtcttcagcctggacacctttcgacaacaaaattgtggtgtacaaaggtgacgtctataacatggactacccgccctttggcgcaggaagaccaggacagaccttttgggacagcggtg

SEQ ID NO: 5972 - DNA, 140 bp, Artificial Sequence
  Synthetic
caccgctgtcccaaaaggtctgtcctggtcttcctgcgccaaagggcgggtagtccatgttatagacgtcacctttgtacaccacaattttgttgtcgaaaggtgtccaggctgaagacacatatcagcagccagggcct

SEQ ID NO: 5973 - DNA, 140 bp, Artificial Sequence
  Synthetic
aggccctggctgctgatatggaacaatgggacacttcatcctggcccgatgcccgaaaggggaaactctgacggtgggattcactgacggtaggaagattagtcactcatgtacgcacccgaccttttgggacagcggtg

SEQ ID NO: 5974 - DNA, 140 bp, Artificial Sequence
  Synthetic
caccgctgtcccaaaaggtcgggtgcgtacatgagtgactaatcttcctaccgtcagtgaatcccaccgtcagagtttcccctttcgggcatcgggccaggatgaagtgtcccattgttccatatcagcagccagggcct

SEQ ID NO: 5975 - DNA, 140 bp, Artificial Sequence
  Synthetic
aggccctggctgctgatatgatttcaccacgaccctcctgtgataggccgggaaaaattccattcccgaccgcagcacggtaaagagctaccttgcagcacgtacgtgcagagcaccgccgaccttttgggacagcggtg

SEQ ID NO: 5976 - DNA, 140 bp, Artificial Sequence
  Synthetic
caccgctgtcccaaaaggtcggcggtgctctgcacgtacgtgctgcaaggtagctctttaccgtgctgcggtcgggaatggaatttttcccggcctatcacaggagggtcgtggtgaaatcatatcagcagccagggcct

SEQ ID NO: 5977 - DNA, 140 bp, Artificial Sequence
  Synthetic
aggccctggctgctgatatgcgcagcacggtaaagagctaccttgcagcacgtacgtgcagagcaccgccgcaactaccgaggagatagaggtacacatgcccccagatacccctgatcggaccttttgggacagcggtg

SEQ ID NO: 5978 - DNA, 140 bp, Artificial Sequence
  Synthetic
caccgctgtcccaaaaggtccgatcaggggtatctgggggcatgtgtacctctatctcctcggtagttgcggcggtgctctgcacgtacgtgctgcaaggtagctctttaccgtgctgcgcatatcagcagccagggcct

SEQ ID NO: 5979 - DNA, 140 bp, Artificial Sequence
  Synthetic
atacgccatgctgggtctcccacattgatgtcacaacagtccggcaacgtaaagatcacagtcaatggccagacggtgcggtacaagtgtaattgcggtggctcaaatgaaggactaatacgtacttgggagtcggccat

SEQ ID NO: 5980 - DNA, 140 bp, Artificial Sequence
  Synthetic
atggccgactcccaagtacgtattagtccttcatttgagccaccgcaattacacttgtaccgcaccgtctggccattgactgtgatctttacgttgccggactgttgtgacatcaatgtgggagacccagcatggcgtat

SEQ ID NO: 5981 - DNA, 140 bp, Artificial Sequence
  Synthetic
aggccctggctgctgatatgccggaagcggccttcactagggtcgtcgacgcgccctctttaacggacatgtcgtgcgaggtaccagcctgcacccattcctcagactttgggggcgtcggaccttttgggacagcggtg

SEQ ID NO: 5982 - DNA, 140 bp, Artificial Sequence
  Synthetic
caccgctgtcccaaaaggtccgacgcccccaaagtctgaggaatgggtgcaggctggtacctcgcacgacatgtccgttaaagagggcgcgtcgacgaccctagtgaaggccgcttccggcatatcagcagccagggcct

SEQ ID NO: 5983 - DNA, 140 bp, Artificial Sequence
  Synthetic
atacgccatgctgggtctcctgtcctaccggaatatgggagaagaaccaaactatcaagaagagtgggtgacgcataagaaggaagtcgtgctaaccgtgccgactgaagggctcgaggtcgtacttgggagtcggccat

SEQ ID NO: 5984 - DNA, 140 bp, Artificial Sequence
  Synthetic
atggccgactcccaagtacgacctcgagcccttcagtcggcacggttagcacgacttccttcttatgcgtcacccactcttcttgatagtttggttcttctcccatattccggtaggacaggagacccagcatggcgtat

SEQ ID NO: 5985 - DNA, 140 bp, Artificial Sequence
  Synthetic
aggccctggctgctgatatgacgcataagaaggaagtcgtgctaaccgtgccgactgaagggctcgaggtcacgtggggcaacaacgagccgtataagtactggccgcagttatctacaagaccttttgggacagcggtg

SEQ ID NO: 5986 - DNA, 140 bp, Artificial Sequence
  Synthetic
caccgctgtcccaaaaggtcttgtagataactgcggccagtacttatacggctcgttgttgccccacgtgacctcgagcccttcagtcggcacggttagcacgacttccttcttatgcgtcatatcagcagccagggcct

SEQ ID NO: 5987 - DNA, 140 bp, Artificial Sequence
  Synthetic
aggccctggctgctgatatgttctcagctgcaaatctctttctcgacggccttagccagcgccgaattccgcgtacaagtctgttctacacaagtacactgtgcagccgagtgccaccccgaccttttgggacagcggtg

SEQ ID NO: 5988 - DNA, 140 bp, Artificial Sequence
  Synthetic
caccgctgtcccaaaaggtcggggtggcactcggctgcacagtgtacttgtgtagaacagacttgtacgcggaattcggcgctggctaaggccgtcgagaaagagatttgcagctgagaacatatcagcagccagggcct

SEQ ID NO: 5989 - DNA, 140 bp, Artificial Sequence
  Synthetic
aggccctggctgctgatatgttctccccaccgccagcgacgcagcaccaaggacaacttcaatgtctataaagccacaagaccatacttagctcaatgtcccgactgtggagaagggcacgaccttttgggacagcggtg

SEQ ID NO: 5990 - DNA, 140 bp, Artificial Sequence
  Synthetic
caccgctgtcccaaaaggtcgtgcccttctccacagtcgggacattgagctaagtatggtcttgtggctttatagacattgaagttgtccttggtgctgcgtcgctggcggtggggagaacatatcagcagccagggcct

SEQ ID NO: 5991 - DNA, 140 bp, Artificial Sequence
  Synthetic
aggccctggctgctgatatgccaggacatctccgctacggcgatgtcatgggtgcagaagatcacgggaggtgtgggactggttgtcgctgttgccgcactgattctaatcgtggtgctagaccttttgggacagcggtg

SEQ ID NO: 5992 - DNA, 140 bp, Artificial Sequence
  Synthetic
caccgctgtcccaaaaggtctagcaccacgattagaatcagtgcggcaacagcgacaaccagtcccacacctcccgtgatcttctgcacccatgacatcgccgtagcggagatgtcctggcatatcagcagccagggcct

SEQ ID NO: 5993 - DNA, 140 bp, Artificial Sequence
  Synthetic
aggccctggctgctgatatgccgaaggaccacatagtcaactacccggcgtcacataccaccctcggggtccaggacatctccgctacggcgatgtcatgggtgcagaagatcacgggaggaccttttgggacagcggtg

SEQ ID NO: 5994 - DNA, 140 bp, Artificial Sequence
  Synthetic
caccgctgtcccaaaaggtcctcccgtgatcttctgcacccatgacatcgccgtagcggagatgtcctggaccccgagggtggtatgtgacgccgggtagttgactatgtggtccttcggcatatcagcagccagggcct

SEQ ID NO: 5995 - DNA, 140 bp, Artificial Sequence
  Synthetic
aggccctggctgctgatatgtcgtgccatagtcccgtagcactagaacgcatcagaaatgaagcgacagacgggacgctgaaaatccaggtctccttgcaacttggaatagggacggatggaccttttgggacagcggtg

SEQ ID NO: 5996 - DNA, 140 bp, Artificial Sequence
  Synthetic
caccgctgtcccaaaaggtccatccgtccctattccaagttgcaaggagacctggattttcagcgtcccgtctgtcgcttcatttctgatgcgttctagtgctacgggactatggcacgacatatcagcagccagggcct

SEQ ID NO: 5997 - DNA, 140 bp, Artificial Sequence
  Synthetic
atacgccatgctgggtctccggctgcggtatacctgtggaatgagcagcaacctttgttttggctacaagcccttattccgctggcagccctgattgtcctatgcaactgtctgagactccgtacttgggagtcggccat

SEQ ID NO: 5998 - DNA, 140 bp, Artificial Sequence
  Synthetic
atggccgactcccaagtacggagtctcagacagttgcataggacaatcagggctgccagcggaataagggcttgtagccaaaacaaaggttgctgctcattccacaggtataccgcagccggagacccagcatggcgtat

SEQ ID NO: 5999 - DNA, 140 bp, Artificial Sequence
  Synthetic
aggccctggctgctgatatggtgtcccctaagagacacactgtacatagcaaataatctatagatcaaagggctacgcaacccctgaatagtaacaaaatacaaaatcactaaaaattatgaccttttgggacagcggtg

SEQ ID NO: 6000 - DNA, 140 bp, Artificial Sequence
  Synthetic
caccgctgtcccaaaaggtcataatttttagtgattttgtattttgttactattcaggggttgcgtagccctttgatctatagattatttgctatgtacagtgtgtctcttaggggacaccatatcagcagccagggcct

SEQ ID NO: 6001 - DNA, 140 bp, Artificial Sequence
  Synthetic
atacgccatgctgggtctccatagccatgattggaccaagctgcgttacatggacaaccacataccagcagacgcagggagggccgggctatttgtaagaacatcagcaccatgcacgatcgtacttgggagtcggccat

SEQ ID NO: 6002 - DNA, 140 bp, Artificial Sequence
  Synthetic
atggccgactcccaagtacgatcgtgcatggtgctgatgttcttacaaatagcccggccctccctgcgtctgctggtatgtggttgtccatgtaacgcagcttggtccaatcatggctatggagacccagcatggcgtat

SEQ ID NO: 6003 - DNA, 140 bp, Artificial Sequence
  Synthetic
aggccctggctgctgatatgtaacaaaatatgaaaatcaataaaaatcataaaatagaaaaaccataaacagaagtagttcaaagggctataaaacccctgaatagtaacaaaacataaagaccttttgggacagcggtg

SEQ ID NO: 6004 - DNA, 140 bp, Artificial Sequence
  Synthetic
caccgctgtcccaaaaggtctttatgttttgttactattcaggggttttatagccctttgaactacttctgtttatggtttttctattttatgatttttattgattttcatattttgttacatatcagcagccagggcct

SEQ ID NO: 6005 - DNA, 140 bp, Artificial Sequence
  Synthetic
aggccctggctgctgatatgagaagtagttcaaagggctataaaacccctgaatagtaacaaaacataaaattaataaaaatcaaatgaataccataattggcaaacggaagagatgtaggaccttttgggacagcggtg

SEQ ID NO: 6006 - DNA, 140 bp, Artificial Sequence
  Synthetic
caccgctgtcccaaaaggtcctacatctcttccgtttgccaattatggtattcatttgatttttattaattttatgttttgttactattcaggggttttatagccctttgaactacttctcatatcagcagccagggcct

SEQ ID NO: 6007 - DNA, 140 bp, Artificial Sequence
  Synthetic
atacgccatgctgggtctccccgccgcaactgccgatgagatagaggtacacgtgcccccagacacccctgatcgcacattgctgtcacaacagtccagcaacgtaacgatcacagtcaacgtacttgggagtcggccat

SEQ ID NO: 6008 - DNA, 140 bp, Artificial Sequence
  Synthetic
atggccgactcccaagtacgttgactgtgatcgttacgttgctggactgttgtgacagcaatgtgcgatcaggggtgtctgggggcacgtgtacctctatctcatcggcagttgcggcggggagacccagcatggcgtat

SEQ ID NO: 6009 - DNA, 140 bp, Artificial Sequence
  Synthetic
atacgccatgctgggtctccaatgctgcggtacagcagagtgcaaggacaaaaacctacctgactacagctgcaaggtcttcaccggcgtctacccatttatgtggggcggcgcctactgcgtacttgggagtcggccat

SEQ ID NO: 6010 - DNA, 140 bp, Artificial Sequence
  Synthetic
atggccgactcccaagtacgcagtaggcgccgccccacataaatgggtagacgccggtgaagaccttgcagctgtagtcaggtaggtttttgtccttgcactctgctgtaccgcagcattggagacccagcatggcgtat

SEQ ID NO: 6011 - DNA, 140 bp, Artificial Sequence
  Synthetic
atacgccatgctgggtctcccggccggacggtgcggtataagtgtaattgcggtggctcaaatgaaggaacaataactacagataaagtgattaataactgcaagattgatcaatgtcatcgtacttgggagtcggccat

SEQ ID NO: 6012 - DNA, 140 bp, Artificial Sequence
  Synthetic
atggccgactcccaagtacgatgacattgatcaatcttgcagttattaatcactttatctgtagttattgttccttcatttgagccaccgcaattacacttataccgcaccgtccggccgggagacccagcatggcgtat

SEQ ID NO: 6013 - DNA, 140 bp, Artificial Sequence
  Synthetic
aggccctggctgctgatatgcacccatttcaccacgaccctcctgtgataggccgggaaaaattccattcccgaccgcagcacggtaaagagctaccttgcagcacatacgtgcagagcagaccttttgggacagcggtg

SEQ ID NO: 6014 - DNA, 140 bp, Artificial Sequence
  Synthetic
caccgctgtcccaaaaggtctgctctgcacgtatgtgctgcaaggtagctctttaccgtgctgcggtcgggaatggaatttttcccggcctatcacaggagggtcgtggtgaaatgggtgcatatcagcagccagggcct

SEQ ID NO: 6015 - DNA, 140 bp, Artificial Sequence
  Synthetic
aggccctggctgctgatatgttttgaaggccctgcagcgtgcgtaccccatgtttgaggtggaaccaaggcaggtcacaccgaatgaccatgccaatgctagagcattctcgcatctagcgaccttttgggacagcggtg

SEQ ID NO: 6016 - DNA, 140 bp, Artificial Sequence
  Synthetic
caccgctgtcccaaaaggtcgctagatgcgagaatgctctagcattggcatggtcattcggtgtgacctgccttggttccacctcaaacatggggtacgcacgctgcagggccttcaaaacatatcagcagccagggcct

SEQ ID NO: 6017 - DNA, 140 bp, Artificial Sequence
  Synthetic
atacgccatgctgggtctcccaggtcacaccgaatgaccatgccaatgctagagcattctcgcatctagctataagactaatagagcaggaaattgatcccgactcaaccatcctggacacgtacttgggagtcggccat

SEQ ID NO: 6018 - DNA, 140 bp, Artificial Sequence
  Synthetic
atggccgactcccaagtacgtgtccaggatggttgagtcgggatcaatttcctgctctattagtcttatagctagatgcgagaatgctctagcattggcatggtcattcggtgtgacctgggagacccagcatggcgtat

SEQ ID NO: 6019 - DNA, 140 bp, Artificial Sequence
  Synthetic
atacgccatgctgggtctcctgctggcaaatgtaacatgcatggtgcctaaagcaaggaaccccaccgtgacgtacgggaaaaaccaagtcatcatgctactgtatcctgaccacccaaccgtacttgggagtcggccat

SEQ ID NO: 6020 - DNA, 140 bp, Artificial Sequence
  Synthetic
atggccgactcccaagtacggttgggtggtcaggatacagtagcatgatgacttggtttttcccgtacgtcacggtggggttccttgctttaggcaccatgcatgttacatttgccagcaggagacccagcatggcgtat

SEQ ID NO: 6021 - DNA, 140 bp, Artificial Sequence
  Synthetic
aggccctggctgctgatatggtttgcccaatgcgcagcgcagaagaccctgagagactcgccaactacgcgagaaaactagcatctgccgcaggaaaagtcttggacagaaacatctccggaccttttgggacagcggtg

SEQ ID NO: 6022 - DNA, 140 bp, Artificial Sequence
  Synthetic
caccgctgtcccaaaaggtccggagatgtttctgtccaagacttttcctgcggcagatgctagttttctcgcgtagttggcgagtctctcagggtcttctgcgctgcgcattgggcaaaccatatcagcagccagggcct

SEQ ID NO: 6023 - DNA, 140 bp, Artificial Sequence
  Synthetic
aggccctggctgctgatatgaagacgtctatgctaatacacaactagtactgcagagaccggctgcaggtacggtacatgtgccatactctcaggcaccatctggctttaagtactggctgaccttttgggacagcggtg

SEQ ID NO: 6024 - DNA, 140 bp, Artificial Sequence
  Synthetic
caccgctgtcccaaaaggtcagccagtacttaaagccagatggtgcctgagagtatggcacatgtaccgtacctgcagccggtctctgcagtactagttgtgtattagcatagacgtcttcatatcagcagccagggcct

SEQ ID NO: 6025 - DNA, 140 bp, Artificial Sequence
  Synthetic
atacgccatgctgggtctccgaaagaacgaggggcgtcgctgcagcacacagcaccatttggctgccaaatagcaacaaatccggtaagagcggtgaactgcgccgtagggaacatgccccgtacttgggagtcggccat

SEQ ID NO: 6026 - DNA, 140 bp, Artificial Sequence
  Synthetic
atggccgactcccaagtacggggcatgttccctacggcgcagttcaccgctcttaccggatttgttgctatttggcagccaaatggtgctgtgtgctgcagcgacgcccctcgttctttcggagacccagcatggcgtat

SEQ ID NO: 6027 - DNA, 140 bp, Artificial Sequence
  Synthetic
aggccctggctgctgatatgtagcaacaaatccggtaagagcggtgaactgcgccgtagggaacatgcccatctccatcgacataccggatgcggccttcactagggtcgtcgacgcgccgaccttttgggacagcggtg

SEQ ID NO: 6028 - DNA, 140 bp, Artificial Sequence
  Synthetic
caccgctgtcccaaaaggtcggcgcgtcgacgaccctagtgaaggccgcatccggtatgtcgatggagatgggcatgttccctacggcgcagttcaccgctcttaccggatttgttgctacatatcagcagccagggcct

SEQ ID NO: 6029 - DNA, 140 bp, Artificial Sequence
  Synthetic
atacgccatgctgggtctccaccaggcgattaaaggagtccgtgtagcatactggatagggtttgatacaaccccgttcatgtataatgccatggcaggtgcatacccctcgtactcgaccgtacttgggagtcggccat

SEQ ID NO: 6030 - DNA, 140 bp, Artificial Sequence
  Synthetic
atggccgactcccaagtacggtcgagtacgaggggtatgcacctgccatggcattatacatgaacggggttgtatcaaaccctatccagtatgctacacggactcctttaatcgcctggtggagacccagcatggcgtat

SEQ ID NO: 6031 - DNA, 140 bp, Artificial Sequence
  Synthetic
aggccctggctgctgatatgaccccgttcatgtataatgccatggcaggtgcatacccctcgtactcgacaaactgggcagatgagcaggtgctgaaggcaaagaacataggattatgttgaccttttgggacagcggtg

SEQ ID NO: 6032 - DNA, 140 bp, Artificial Sequence
  Synthetic
caccgctgtcccaaaaggtcaacataatcctatgttctttgccttcagcacctgctcatctgcccagtttgtcgagtacgaggggtatgcacctgccatggcattatacatgaacggggtcatatcagcagccagggcct

SEQ ID NO: 6033 - DNA, 140 bp, Artificial Sequence
  Synthetic
aggccctggctgctgatatgacttcgggggcgtcgccattattaaatatgcagccagcaagaaaggcaagtgtgcggtgcattcgatgaccaacgccgttactattcgggaagctgagatgaccttttgggacagcggtg

SEQ ID NO: 6034 - DNA, 140 bp, Artificial Sequence
  Synthetic
caccgctgtcccaaaaggtcatctcagcttcccgaatagtaacggcgttggtcatcgaatgcaccgcacacttgcctttcttgctggctgcatatttaataatggcgacgcccccgaagtcatatcagcagccagggcct

SEQ ID NO: 6035 - DNA, 140 bp, Artificial Sequence
  Synthetic
atacgccatgctgggtctcccaacagacctgacggaaggtagacgaggtaaattgtctatcatgagaggaaaaaagatgaagccatgtgaccgcgtactgttctcagtcgggtcaacgctcgtacttgggagtcggccat

SEQ ID NO: 6036 - DNA, 140 bp, Artificial Sequence
  Synthetic
atggccgactcccaagtacgagcgttgacccgactgagaacagtacgcggtcacatggcttcatcttttttcctctcatgatagacaatttacctcgtctaccttccgtcaggtctgttgggagacccagcatggcgtat

SEQ ID NO: 6037 - DNA, 140 bp, Artificial Sequence
  Synthetic
aggccctggctgctgatatgacgcagatgcatcacaccatacgaactgacaccaggagctaccgtccctttcctgcttagcctaacatgctgcatcagaacagctaaagcggccacatacgaccttttgggacagcggtg

SEQ ID NO: 6038 - DNA, 140 bp, Artificial Sequence
  Synthetic
caccgctgtcccaaaaggtcgtatgtggccgctttagctgttctgatgcagcatgttaggctaagcaggaaagggacggtagctcctggtgtcagttcgtatggtgtgatgcatctgcgtcatatcagcagccagggcct

SEQ ID NO: 6039 - DNA, 140 bp, Artificial Sequence
  Synthetic
aggccctggctgctgatatgaaaaagatgaagccatgtgaccgcgtactgttctcagtcgggtcaacgctttacccggagagccgtaagcttcttaagagttggcacttaccttcagtgtgaccttttgggacagcggtg

SEQ ID NO: 6040 - DNA, 140 bp, Artificial Sequence
  Synthetic
caccgctgtcccaaaaggtcacactgaaggtaagtgccaactcttaagaagcttacggctctccgggtaaagcgttgacccgactgagaacagtacgcggtcacatggcttcatctttttcatatcagcagccagggcct

SEQ ID NO: 6041 - DNA, 140 bp, Artificial Sequence
  Synthetic
atacgccatgctgggtctcctccatctaaaagggaagctcagcttcacgtgccgctgtgatacagtggtttcgtgtgaaggctatgtcgttaagagaataacgattagcccgggcctctacgtacttgggagtcggccat

SEQ ID NO: 6042 - DNA, 140 bp, Artificial Sequence
  Synthetic
atggccgactcccaagtacgtagaggcccgggctaatcgttattctcttaacgacatagccttcacacgaaaccactgtatcacagcggcacgtgaagctgagcttcccttttagatggaggagacccagcatggcgtat

SEQ ID NO: 6043 - DNA, 140 bp, Artificial Sequence
  Synthetic
atacgccatgctgggtctccccatggtactggagatggagctactgtcagtcactttggagccaatgctatcgcttgattacatcacgtgcgaatacaaaaccgtcatcccgtctccgtacgtacttgggagtcggccat

SEQ ID NO: 6044 - DNA, 140 bp, Artificial Sequence
  Synthetic
atggccgactcccaagtacgtacggagacgggatgacggttttgtattcgcacgtgatgtaatcaagcgatagcattggctccaaagtgactgacagtagctccatctccagtaccatggggagacccagcatggcgtat

SEQ ID NO: 6045 - DNA, 140 bp, Artificial Sequence
  Synthetic
aggccctggctgctgatatgtcgtgtgaaggctatgtcgttaagagaataacgattagcccgggcctctacggtaaaaccacagggtacgcagtaacccaccatgcagacggattcctaagaccttttgggacagcggtg

SEQ ID NO: 6046 - DNA, 140 bp, Artificial Sequence
  Synthetic
caccgctgtcccaaaaggtcttaggaatccgtctgcatggtgggttactgcgtaccctgtggttttaccgtagaggcccgggctaatcgttattctcttaacgacatagccttcacacgacatatcagcagccagggcct

SEQ ID NO: 6047 - DNA, 140 bp, Artificial Sequence
  Synthetic
aggccctggctgctgatatgtcgtgtgaaggctatgtcgttaagagaataacgattagcccgggcctctacggttaaaccacagggtacgcagtaacccaccatgcagacggattcctaagaccttttgggacagcggtg

SEQ ID NO: 6048 - DNA, 140 bp, Artificial Sequence
  Synthetic
caccgctgtcccaaaaggtcttaggaatccgtctgcatggtgggttactgcgtaccctgtggtttaaccgtagaggcccgggctaatcgttattctcttaacgacatagccttcacacgacatatcagcagccagggcct

SEQ ID NO: 6049 - DNA, 140 bp, Artificial Sequence
  Synthetic
aggccctggctgctgatatgtcgtgtgaaggctatgtcgttaagagaataacgattagcccgggcctctacggtcaaaccacagggtacgcagtaacccaccatgcagacggattcctaagaccttttgggacagcggtg

SEQ ID NO: 6050 - DNA, 140 bp, Artificial Sequence
  Synthetic
caccgctgtcccaaaaggtcttaggaatccgtctgcatggtgggttactgcgtaccctgtggtttgaccgtagaggcccgggctaatcgttattctcttaacgacatagccttcacacgacatatcagcagccagggcct

SEQ ID NO: 6051 - DNA, 140 bp, Artificial Sequence
  Synthetic
aggccctggctgctgatatgtcgtgtgaaggctatgtcgttaagagaataacgattagcccgggcctctacggtgaaaccacagggtacgcagtaacccaccatgcagacggattcctaagaccttttgggacagcggtg

SEQ ID NO: 6052 - DNA, 140 bp, Artificial Sequence
  Synthetic
caccgctgtcccaaaaggtcttaggaatccgtctgcatggtgggttactgcgtaccctgtggtttcaccgtagaggcccgggctaatcgttattctcttaacgacatagccttcacacgacatatcagcagccagggcct

SEQ ID NO: 6053 - DNA, 140 bp, Artificial Sequence
  Synthetic
atacgccatgctgggtctccgaagtccgaatcatgcaaaacagaatttgcattagcatacagggctcataccgcatccgcatcagctaagctccgcgtcctttaccaaggaaataacatccgtacttgggagtcggccat

SEQ ID NO: 6054 - DNA, 140 bp, Artificial Sequence
  Synthetic
atggccgactcccaagtacggatgttatttccttggtaaaggacgcggagcttagctgatgcggatgcggtatgagccctgtatgctaatgcaaattctgttttgcatgattcggacttcggagacccagcatggcgtat

SEQ ID NO: 6055 - DNA, 140 bp, Artificial Sequence
  Synthetic
atacgccatgctgggtctcctgtgcaaaacaaccgatacggtagacggcgagagagtgtcattttcggtatgcacgtacgtacccgcaaccatttgtgatcaaatgacaggtattcttgccgtacttgggagtcggccat

SEQ ID NO: 6056 - DNA, 140 bp, Artificial Sequence
  Synthetic
atggccgactcccaagtacggcaagaatacctgtcatttgatcacaaatggttgcgggtacgtacgtgcataccgaaaatgacactctctcgccgtctaccgtatcggttgttttgcacaggagacccagcatggcgtat

SEQ ID NO: 6057 - DNA, 140 bp, Artificial Sequence
  Synthetic
atacgccatgctgggtctcccacggaggttacaccggaggatgcacagaagctgctggtgggactgaaccagaggatagtggtcaatggcagaacgcagaggaacacgaacacaatgaagcgtacttgggagtcggccat

SEQ ID NO: 6058 - DNA, 140 bp, Artificial Sequence
  Synthetic
atggccgactcccaagtacgcttcattgtgttcgtgttcctctgcgttctgccattgaccactatcctctggttcagtcccaccagcagcttctgtgcatcctccggtgtaacctccgtgggagacccagcatggcgtat

SEQ ID NO: 6059 - DNA, 140 bp, Artificial Sequence
  Synthetic
aggccctggctgctgatatgccgcatccgcatcagctaagctccgcgtcctttaccaaggaaataacatcactgtaactgcctatgcaaacggcgatcatgccgtcacagttaaggacgcgaccttttgggacagcggtg

SEQ ID NO: 6060 - DNA, 140 bp, Artificial Sequence
  Synthetic
caccgctgtcccaaaaggtcgcgtccttaactgtgacggcatgatcgccgtttgcataggcagttacagtgatgttatttccttggtaaaggacgcggagcttagctgatgcggatgcggcatatcagcagccagggcct

SEQ ID NO: 6061 - DNA, 140 bp, Artificial Sequence
  Synthetic
atacgccatgctgggtctccaattacttgcttcctgtggttgcccaagccttcagtaagtgggcaaaggaatgccggaaagatatggaagatgaaaaacttttgggcatcagagaaaggacgtacttgggagtcggccat

SEQ ID NO: 6062 - DNA, 140 bp, Artificial Sequence
  Synthetic
atggccgactcccaagtacgtcctttctctgatgcccaaaagtttttcatcttccatatctttccggcattcctttgcccacttactgaaggcttgggcaaccacaggaagcaagtaattggagacccagcatggcgtat

SEQ ID NO: 6063 - DNA, 140 bp, Artificial Sequence
  Synthetic
aggccctggctgctgatatgatgccggaaagatatggaagatgaaaaacttttgggcatcagagaaaggacactgacatgctgctgcctttgggcgttcaagaagcagaagacacacacggaccttttgggacagcggtg

SEQ ID NO: 6064 - DNA, 140 bp, Artificial Sequence
  Synthetic
caccgctgtcccaaaaggtccgtgtgtgtcttctgcttcttgaacgcccaaaggcagcagcatgtcagtgtcctttctctgatgcccaaaagtttttcatcttccatatctttccggcatcatatcagcagccagggcct

SEQ ID NO: 6065 - DNA, 140 bp, Artificial Sequence
  Synthetic
aggccctggctgctgatatgacttaagcttcctaaaagcagccgaactcactttgagacgtaggcatagcataccgaactcttccacgattctccgaacccacagggacgtaggagatgtgaccttttgggacagcggtg

SEQ ID NO: 6066 - DNA, 140 bp, Artificial Sequence
  Synthetic
caccgctgtcccaaaaggtcacatctcctacgtccctgtgggttcggagaatcgtggaagagttcggtatgctatgcctacgtctcaaagtgagttcggctgcttttaggaagcttaagtcatatcagcagccagggcct

SEQ ID NO: 6067 - DNA, 140 bp, Artificial Sequence
  Synthetic
atacgccatgctgggtctcccgggtacggtacacgtgccatactctcaggcaccatctggctttaagtattggtttaaagaacgaggggcgtcgctacagcacacagcaccatttggctgcgtacttgggagtcggccat

SEQ ID NO: 6068 - DNA, 140 bp, Artificial Sequence
  Synthetic
atggccgactcccaagtacgcagccaaatggtgctgtgtgctgtagcgacgcccctcgttctttaaaccaatacttaaagccagatggtgcctgagagtatggcacgtgtaccgtacccgggagacccagcatggcgtat

SEQ ID NO: 6069 - DNA, 140 bp, Artificial Sequence
  Synthetic
atacgccatgctgggtctccgcaacacttggtaggtatgacctagtggtcataaacatccacacaccttttcgcatacaccattaccaacagtgcgtagatcacgcaatgaaactgcaaacgtacttgggagtcggccat

SEQ ID NO: 6070 - DNA, 140 bp, Artificial Sequence
  Synthetic
atggccgactcccaagtacgtttgcagtttcattgcgtgatctacgcactgttggtaatggtgtatgcgaaaaggtgtgtggatgtttatgaccactaggtcatacctaccaagtgttgcggagacccagcatggcgtat

SEQ ID NO: 6071 - DNA, 140 bp, Artificial Sequence
  Synthetic
atacgccatgctgggtctccgcaactcttggtaggtatgacctagtggtcataaacatccacacaccttttcgcatacaccattaccaacagtgcgtagatcacgcaatgaaactgcaaacgtacttgggagtcggccat

SEQ ID NO: 6072 - DNA, 140 bp, Artificial Sequence
  Synthetic
atggccgactcccaagtacgtttgcagtttcattgcgtgatctacgcactgttggtaatggtgtatgcgaaaaggtgtgtggatgtttatgaccactaggtcatacctaccaagagttgcggagacccagcatggcgtat

SEQ ID NO: 6073 - DNA, 140 bp, Artificial Sequence
  Synthetic
atacgccatgctgggtctccgcaacccttggtaggtatgacctagtggtcataaacatccacacaccttttcgcatacaccattaccaacagtgcgtagatcacgcaatgaaactgcaaacgtacttgggagtcggccat

SEQ ID NO: 6074 - DNA, 140 bp, Artificial Sequence
  Synthetic
atggccgactcccaagtacgtttgcagtttcattgcgtgatctacgcactgttggtaatggtgtatgcgaaaaggtgtgtggatgtttatgaccactaggtcatacctaccaagggttgcggagacccagcatggcgtat

SEQ ID NO: 6075 - DNA, 140 bp, Artificial Sequence
  Synthetic
atacgccatgctgggtctccgcaacgcttggtaggtatgacctagtggtcataaacatccacacaccttttcgcatacaccattaccaacagtgcgtagatcacgcaatgaaactgcaaacgtacttgggagtcggccat

SEQ ID NO: 6076 - DNA, 140 bp, Artificial Sequence
  Synthetic
atggccgactcccaagtacgtttgcagtttcattgcgtgatctacgcactgttggtaatggtgtatgcgaaaaggtgtgtggatgtttatgaccactaggtcatacctaccaagcgttgcggagacccagcatggcgtat

SEQ ID NO: 6077 - DNA, 140 bp, Artificial Sequence
  Synthetic
atacgccatgctgggtctccgtctacaagaggcctgacactcagtcaattcggaaagtcccagccgaatttgacagctttgtggtaccaagtctgtggtcatctggactgtcgatcccgccgtacttgggagtcggccat

SEQ ID NO: 6078 - DNA, 140 bp, Artificial Sequence
  Synthetic
atggccgactcccaagtacggcgggatcgacagtccagatgaccacagacttggtaccacaaagctgtcaaattcggctgggactttccgaattgactgagtgtcaggcctcttgtagacggagacccagcatggcgtat

SEQ ID NO: 6079 - DNA, 140 bp, Artificial Sequence
  Synthetic
aggccctggctgctgatatgatcccttacagcggtgacgccaaagaagcccgcgatgctgaaaaagaagcagaagaagaacgagaagcggagctgactcgcgaggcactaccaccactacgaccttttgggacagcggtg

SEQ ID NO: 6080 - DNA, 140 bp, Artificial Sequence
  Synthetic
caccgctgtcccaaaaggtcgtagtggtggtagtgcctcgcgagtcagctccgcttctcgttcttcttctgcttctttttcagcatcgcgggcttctttggcgtcaccgctgtaagggatcatatcagcagccagggcct

SEQ ID NO: 6081 - DNA, 140 bp, Artificial Sequence
  Synthetic
aggccctggctgctgatatgctgtgacacagtggtttcgtgtgagggctacgtcgttaagagaataacgatgagcccaggcctttatggaaaaaccatagggtatgcggtaacccaccacgaccttttgggacagcggtg

SEQ ID NO: 6082 - DNA, 140 bp, Artificial Sequence
  Synthetic
caccgctgtcccaaaaggtcgtggtgggttaccgcataccctatggtttttccataaaggcctgggctcatcgttattctcttaacgacgtagccctcacacgaaaccactgtgtcacagcatatcagcagccagggcct

SEQ ID NO: 6083 - DNA, 140 bp, Artificial Sequence
  Synthetic
atacgccatgctgggtctccaggcggcacaggatgacgtccaggtcgaaattgacgtggaacagctcgaagacagagctggggcaggaataattgaaactccaagaggagctatcaaagtcgtacttgggagtcggccat

SEQ ID NO: 6084 - DNA, 140 bp, Artificial Sequence
  Synthetic
atggccgactcccaagtacgactttgatagctcctcttggagtttcaattattcctgccccagctctgtcttcgagctgttccacgtcaatttcgacctggacgtcatcctgtgccgcctggagacccagcatggcgtat

SEQ ID NO: 6085 - DNA, 140 bp, Artificial Sequence
  Synthetic
atacgccatgctgggtctccggacaatcatatgccagcagacgcagagagggccaggctatttgtaagaacgtcagcaccgtgcacgattactggaacaatgggacacttcatcctggcccgtacttgggagtcggccat

SEQ ID NO: 6086 - DNA, 140 bp, Artificial Sequence
  Synthetic
atggccgactcccaagtacgggccaggatgaagtgtcccattgttccagtaatcgtgcacggtgctgacgttcttacaaatagcctggccctctctgcgtctgctggcatatgattgtccggagacccagcatggcgtat

SEQ ID NO: 6087 - DNA, 140 bp, Artificial Sequence
  Synthetic
aggccctggctgctgatatggagatagaagttgaagggaattctcagctgcaaatctctttctcgacggccttggccagcgccgaattccgcgtacaagtctgttctacacaagtacactgaccttttgggacagcggtg

SEQ ID NO: 6088 - DNA, 140 bp, Artificial Sequence
  Synthetic
caccgctgtcccaaaaggtcagtgtacttgtgtagaacagacttgtacgcggaattcggcgctggccaaggccgtcgagaaagagatttgcagctgagaattcccttcaacttctatctccatatcagcagccagggcct

SEQ ID NO: 6089 - DNA, 140 bp, Artificial Sequence
  Synthetic
atacgccatgctgggtctcccactgcccaaccaacagaccacgtcgtgggagagtacttggtactttccccgcagaccgtgttacgaagccagaagctcagcctgatccacgcattggcgcgtacttgggagtcggccat

SEQ ID NO: 6090 - DNA, 140 bp, Artificial Sequence
  Synthetic
atggccgactcccaagtacgcgccaatgcgtggatcaggctgagcttctggcttcgtaacacggtctgcggggaaagtaccaagtactctcccacgacgtggtctgttggttgggcagtgggagacccagcatggcgtat

SEQ ID NO: 6091 - DNA, 140 bp, Artificial Sequence
  Synthetic
atacgccatgctgggtctcctgcccatctccatcgacataccggatgcggccttcactagggtcgtcgaagcgccctctttaacggacatgtcatgcgaggtaccagcctgcacccattccgtacttgggagtcggccat

SEQ ID NO: 6092 - DNA, 140 bp, Artificial Sequence
  Synthetic
atggccgactcccaagtacggaatgggtgcaggctggtacctcgcatgacatgtccgttaaagagggcgcttcgacgaccctagtgaaggccgcatccggtatgtcgatggagatgggcaggagacccagcatggcgtat

SEQ ID NO: 6093 - DNA, 140 bp, Artificial Sequence
  Synthetic
atacgccatgctgggtctccgaacaagtgaagacatgcacacacagcggacgagcaggaaggtacgcggtcgaagcatatgatggcagaatccttgtgccctcaggctatgcaatatcaccgtacttgggagtcggccat

SEQ ID NO: 6094 - DNA, 140 bp, Artificial Sequence
  Synthetic
atggccgactcccaagtacggtgatattgcatagcctgagggcacaaggattctgccatcatatgcttcgaccgcgtaccttcctgctcgtccgctgtgtgtgcatgtcttcacttgttcggagacccagcatggcgtat

SEQ ID NO: 6095 - DNA, 140 bp, Artificial Sequence
  Synthetic
aggccctggctgctgatatgtacggaccagaatcaagtggctgctaagcaaagtgccaaagactgatttgatcccttacagcggtgacgccaaagaagcccgcgatgctgaaaaagaagcgaccttttgggacagcggtg

SEQ ID NO: 6096 - DNA, 140 bp, Artificial Sequence
  Synthetic
caccgctgtcccaaaaggtcgcttctttttcagcatcgcgggcttctttggcgtcaccgctgtaagggatcaaatcagtctttggcactttgcttagcagccacttgattctggtccgtacatatcagcagccagggcct

SEQ ID NO: 6097 - DNA, 140 bp, Artificial Sequence
  Synthetic
aggccctggctgctgatatgagggagttcgtaaataggaaattacaccatatcgcgttgcacggaccagccctgaacactgacgaggagtcgtacgagctggtaagggcagaaaggacaggaccttttgggacagcggtg

SEQ ID NO: 6098 - DNA, 140 bp, Artificial Sequence
  Synthetic
caccgctgtcccaaaaggtcctgtcctttctgcccttaccagctcgtacgactcctcgtcagtgttcagggctggtccgtgcaacgcgatatggtgtaatttcctatttacgaactccctcatatcagcagccagggcct

SEQ ID NO: 6099 - DNA, 140 bp, Artificial Sequence
  Synthetic
atacgccatgctgggtctccgactaagcatgaaggtatatgtgtcccctaagagacacaccgtatatagctaataatctgtagatcaaagggctatataacccctgaatagtaacaaaatcgtacttgggagtcggccat

SEQ ID NO: 6100 - DNA, 140 bp, Artificial Sequence
  Synthetic
atggccgactcccaagtacgattttgttactattcaggggttatatagccctttgatctacagattattagctatatacggtgtgtctcttaggggacacatataccttcatgcttagtcggagacccagcatggcgtat

SEQ ID NO: 6101 - DNA, 140 bp, Artificial Sequence
  Synthetic
aggccctggctgctgatatgtgcccgatgcgcagtgcggaagatcccgagagactcgctaattatgcgagaaagctagcatctgccgcaagaaaagtcctggacagaaacatctctggaagaccttttgggacagcggtg

SEQ ID NO: 6102 - DNA, 140 bp, Artificial Sequence
  Synthetic
caccgctgtcccaaaaggtcttccagagatgtttctgtccaggacttttcttgcggcagatgctagctttctcgcataattagcgagtctctcgggatcttccgcactgcgcatcgggcacatatcagcagccagggcct

SEQ ID NO: 6103 - DNA, 140 bp, Artificial Sequence
  Synthetic
atacgccatgctgggtctccctgggcagatgagcaggtactgaaggctaagaacataggattatgttcaacagacttgacggaaggtagacgaggcaagttgtctattatgagagggaaacgtacttgggagtcggccat

SEQ ID NO: 6104 - DNA, 140 bp, Artificial Sequence
  Synthetic
atggccgactcccaagtacgtttccctctcataatagacaacttgcctcgtctaccttccgtcaagtctgttgaacataatcctatgttcttagccttcagtacctgctcatctgcccagggagacccagcatggcgtat

SEQ ID NO: 6105 - DNA, 140 bp, Artificial Sequence
  Synthetic
atacgccatgctgggtctcctgagttcgcatatgaagggctgagaatccgccccgcctgcccatacaagaccgcagtaataggggtctttggagtgccaggatccggcaaatcagcaatccgtacttgggagtcggccat

SEQ ID NO: 6106 - DNA, 140 bp, Artificial Sequence
  Synthetic
atggccgactcccaagtacggattgctgatttgccggatcctggcactccaaagacccctattactgcggtcttgtatgggcaggcggggcggattctcagcccttcatatgcgaactcaggagacccagcatggcgtat

SEQ ID NO: 6107 - DNA, 140 bp, Artificial Sequence
  Synthetic
aggccctggctgctgatatgctgaagacttccagagcctgagcgaaagtgcgacgatggtgtacaacgaaagggagttcgtaaataggaaattacaccatatcgcgttgcacggaccagcgaccttttgggacagcggtg

SEQ ID NO: 6108 - DNA, 140 bp, Artificial Sequence
  Synthetic
caccgctgtcccaaaaggtcgctggtccgtgcaacgcgatatggtgtaatttcctatttacgaactccctttcgttgtacaccatcgtcgcactttcgctcaggctctggaagtcttcagcatatcagcagccagggcct

SEQ ID NO: 6109 - DNA, 140 bp, Artificial Sequence
  Synthetic
atacgccatgctgggtctccattaagaacctagttaccaggcaagacctagtgaccagtggaaagaaagaaaactgccaagaaatctccaccgacgtgatgcgacagaggaatctggagacgtacttgggagtcggccat

SEQ ID NO: 6110 - DNA, 140 bp, Artificial Sequence
  Synthetic
atggccgactcccaagtacgtctccagattcctctgtcgcatcacgtcggtggagatttcttggcagttttctttctttccactggtcactaggtcttgcctggtaactaggttcttaatggagacccagcatggcgtat

SEQ ID NO: 6111 - DNA, 140 bp, Artificial Sequence
  Synthetic
atacgccatgctgggtctccaaatgaataccataattggcaaacggaagagatgtaggtacttaagcttcctaaaagcagccgaactcactttgagatgtaggcatagcataccgaactccgtacttgggagtcggccat

SEQ ID NO: 6112 - DNA, 140 bp, Artificial Sequence
  Synthetic
atggccgactcccaagtacggagttcggtatgctatgcctacatctcaaagtgagttcggctgcttttaggaagcttaagtacctacatctcttccgtttgccaattatggtattcatttggagacccagcatggcgtat

SEQ ID NO: 6113 - DNA, 140 bp, Artificial Sequence
  Synthetic
atacgccatgctgggtctcctatctgcacgcacggtcgactcactgctcttgaacggatgcaccagaccagtcgacgtgttgtacgtcgacgaagcgtttgcgtgccattctggcacgctcgtacttgggagtcggccat

SEQ ID NO: 6114 - DNA, 140 bp, Artificial Sequence
  Synthetic
atggccgactcccaagtacgagcgtgccagaatggcacgcaaacgcttcgtcgacgtacaacacgtcgactggtctggtgcatccgttcaagagcagtgagtcgaccgtgcgtgcagataggagacccagcatggcgtat

SEQ ID NO: 6115 - DNA, 140 bp, Artificial Sequence
  Synthetic
atacgccatgctgggtctccttccacgattctccgaacccacacggacgtaggagatgttattttgatacttgataccataattggcaaacggaagagatgtaggtacttaagcttcctacgtacttgggagtcggccat

SEQ ID NO: 6116 - DNA, 140 bp, Artificial Sequence
  Synthetic
atggccgactcccaagtacgtaggaagcttaagtacctacatctcttccgtttgccaattatggtatcaagtatcaaaataacatctcctacgtccgtgtgggttcggagaatcgtggaaggagacccagcatggcgtat

SEQ ID NO: 6117 - DNA, 140 bp, Artificial Sequence
  Synthetic
aggccctggctgctgatatggtcgacgtgttgtacgtcgacgaagcgtttgcgtgccattctggcacgctacttgctctgatagccttggtgagaccgagacagaaagtcgtgctatgcggaccttttgggacagcggtg

SEQ ID NO: 6118 - DNA, 140 bp, Artificial Sequence
  Synthetic
caccgctgtcccaaaaggtccgcatagcacgactttctgtctcggtctcaccaaggctatcagagcaagtagcgtgccagaatggcacgcaaacgcttcgtcgacgtacaacacgtcgaccatatcagcagccagggcct

SEQ ID NO: 6119 - DNA, 140 bp, Artificial Sequence
  Synthetic
aggccctggctgctgatatgaacggaagagatgtaggtacttaagcttcctaaaagcagccgaactcactttgagatgtaggcatagcataccgaactcttccacgattctccgaacccagaccttttgggacagcggtg

SEQ ID NO: 6120 - DNA, 140 bp, Artificial Sequence
  Synthetic
caccgctgtcccaaaaggtctgggttcggagaatcgtggaagagttcggtatgctatgcctacatctcaaagtgagttcggctgcttttaggaagcttaagtacctacatctcttccgttcatatcagcagccagggcct

SEQ ID NO: 6121 - DNA, 140 bp, Artificial Sequence
  Synthetic
aggccctggctgctgatatgacctgaagtagccctgaatgaaatatgtacgcgcatgtatggggtggatctagacagcgggctgttttctaaaccgttggtgtctgtgtattacgcggatgaccttttgggacagcggtg

SEQ ID NO: 6122 - DNA, 140 bp, Artificial Sequence
  Synthetic
caccgctgtcccaaaaggtcatccgcgtaatacacagacaccaacggtttagaaaacagcccgctgtctagatccaccccatacatgcgcgtacatatttcattcagggctacttcaggtcatatcagcagccagggcct

SEQ ID NO: 6123 - DNA, 140 bp, Artificial Sequence
  Synthetic
aggccctggctgctgatatggcttgcagagtggcagacccgctaaaaaggctttttaaactgggcaaaccgctggcggcaggtgacgaacaagatgaagatagaagacgagcgctggctggaccttttgggacagcggtg

SEQ ID NO: 6124 - DNA, 140 bp, Artificial Sequence
  Synthetic
caccgctgtcccaaaaggtccagccagcgctcgtcttctatcttcatcttgttcgtcacctgccgccagcggtttgcccagtttaaaaagcctttttagcgggtctgccactctgcaagccatatcagcagccagggcct

SEQ ID NO: 6125 - DNA, 140 bp, Artificial Sequence
  Synthetic
aggccctggctgctgatatgaaatgcgcacaacaaatgagtacaacaagccaattgtagtggatactacaggctcgacaaaacccgaccccggagaccttgtgctaacatgtttcagagggaccttttgggacagcggtg

SEQ ID NO: 6126 - DNA, 140 bp, Artificial Sequence
  Synthetic
caccgctgtcccaaaaggtccctctgaaacatgttagcacaaggtctccggggtcgggttttgtcgagcctgtagtatccactacaattggcttgttgtactcatttgttgtgcgcatttcatatcagcagccagggcct

SEQ ID NO: 6127 - DNA, 140 bp, Artificial Sequence
  Synthetic
atacgccatgctgggtctccgtgggttaagcaactgcaaattgactaccgtggacacgaggtcatgacagcagctgcatctcaggggctaaccagaaaaggggtctatgccgtcaggcaacgtacttgggagtcggccat

SEQ ID NO: 6128 - DNA, 140 bp, Artificial Sequence
  Synthetic
atggccgactcccaagtacgttgcctgacggcatagaccccttttctggttagcccctgagatgcagctgctgtcatgacctcgtgtccacggtagtcaatttgcagttgcttaacccacggagacccagcatggcgtat

SEQ ID NO: 6129 - DNA, 140 bp, Artificial Sequence
  Synthetic
aggccctggctgctgatatgcagctgcatctcaggggctaaccagaaaaggggtctatgccgtcaggcaaaaagtcaatgaaaaccccctttacgcatcaacatcagagcacgtgaacgtgaccttttgggacagcggtg

SEQ ID NO: 6130 - DNA, 140 bp, Artificial Sequence
  Synthetic
caccgctgtcccaaaaggtcacgttcacgtgctctgatgttgatgcgtaaagggggttttcattgactttttgcctgacggcatagaccccttttctggttagcccctgagatgcagctgcatatcagcagccagggcct

SEQ ID NO: 6131 - DNA, 140 bp, Artificial Sequence
  Synthetic
aggccctggctgctgatatgacccatggataaagacactgcagaacccgccgaaaggaaattttaaagcaacaattaaggaatgggaagtggaacatgcttcaataatggcgggtatctggaccttttgggacagcggtg

SEQ ID NO: 6132 - DNA, 140 bp, Artificial Sequence
  Synthetic
caccgctgtcccaaaaggtccagatacccgccattattgaagcatgttccacttcccattccttaattgttgctttaaaatttcctttcggcgggttctgcagtgtctttatccatgggtcatatcagcagccagggcct

SEQ ID NO: 6133 - DNA, 140 bp, Artificial Sequence
  Synthetic
atacgccatgctgggtctccacaattaaggaatgggaagtggaacatgcttcaataatggcgggtatctgtaaccaccaagtgaccttcgacacgttccagaataaagccaatgtctgctcgtacttgggagtcggccat

SEQ ID NO: 6134 - DNA, 140 bp, Artificial Sequence
  Synthetic
atggccgactcccaagtacgagcagacattggctttattctggaacgtgtcgaaggtcacttggtggttacagatacccgccattattgaagcatgttccacttcccattccttaattgtggagacccagcatggcgtat

SEQ ID NO: 6135 - DNA, 140 bp, Artificial Sequence
  Synthetic
atacgccatgctgggtctcctacaaacggtacagcccatagccacccgcatgagataattctgtattattatgagctgtaccctactatgactgtagtagttgtgtcagtggccacgttccgtacttgggagtcggccat

SEQ ID NO: 6136 - DNA, 140 bp, Artificial Sequence
  Synthetic
atggccgactcccaagtacggaacgtggccactgacacaactactacagtcatagtagggtacagctcataataatacagaattatctcatgcgggtggctatgggctgtaccgtttgtaggagacccagcatggcgtat

SEQ ID NO: 6137 - DNA, 140 bp, Artificial Sequence
  Synthetic
aggccctggctgctgatatggacaggcagtggtcccagataatccaggcttttaaagaagacagagcatactcacccgaggtagccctgaatgagatatgcacgcgcatgtacggggtaggaccttttgggacagcggtg

SEQ ID NO: 6138 - DNA, 140 bp, Artificial Sequence
  Synthetic
caccgctgtcccaaaaggtcctaccccgtacatgcgcgtgcatatctcattcagggctacctcgggtgagtatgctctgtcttctttaaaagcctggattatctgggaccactgcctgtccatatcagcagccagggcct

SEQ ID NO: 6139 - DNA, 140 bp, Artificial Sequence
  Synthetic
aggccctggctgctgatatgtgattctaatcgtggtgctatgcgtgtcgttcagcaggcactaacttgacaattaagtatgaaggtatatgtgtcccctaagaggcacaccgtacatagcgaccttttgggacagcggtg

SEQ ID NO: 6140 - DNA, 140 bp, Artificial Sequence
  Synthetic
caccgctgtcccaaaaggtcgctatgtacggtgtgcctcttaggggacacatataccttcatacttaattgtcaagttagtgcctgctgaacgacacgcatagcaccacgattagaatcacatatcagcagccagggcct

SEQ ID NO: 6141 - DNA, 140 bp, Artificial Sequence
  Synthetic
atacgccatgctgggtctccacctggacagcgggctgttctctaaaccactggtgtccgtgcattatgcggataatcactgggacaacaggccgggagggaagatgttcggattcaaccccgtacttgggagtcggccat

SEQ ID NO: 6142 - DNA, 140 bp, Artificial Sequence
  Synthetic
atggccgactcccaagtacggggttgaatccgaacatcttccctcccggcctgttgtcccagtgattatccgcataatgcacggacaccagtggtttagagaacagcccgctgtccaggtggagacccagcatggcgtat

SEQ ID NO: 6143 - DNA, 140 bp, Artificial Sequence
  Synthetic
aggccctggctgctgatatggataatcactgggacaacaggccgggagggaagatgttcggattcaaccccgaagcggcgtccatactggagaggaaatacccgtttacaaaagggaagtgaccttttgggacagcggtg

SEQ ID NO: 6144 - DNA, 140 bp, Artificial Sequence
  Synthetic
caccgctgtcccaaaaggtcacttcccttttgtaaacgggtatttcctctccagtatggacgccgcttcggggttgaatccgaacatcttccctcccggcctgttgtcccagtgattatccatatcagcagccagggcct

SEQ ID NO: 6145 - DNA, 140 bp, Artificial Sequence
  Synthetic
aggccctggctgctgatatgagactaaagagaggctgtagactatacttaatgtcagagacctcaaaagtccctacttaccggaccacatatccggcgcctgtgtactcgcctccgatcagaccttttgggacagcggtg

SEQ ID NO: 6146 - DNA, 140 bp, Artificial Sequence
  Synthetic
caccgctgtcccaaaaggtctgatcggaggcgagtacacaggcgccggatatgtggtccggtaagtagggacttttgaggtctctgacattaagtatagtctacagcctctctttagtctcatatcagcagccagggcct

SEQ ID NO: 6147 - DNA, 140 bp, Artificial Sequence
  Synthetic
atacgccatgctgggtctccggtggccgaacatcgcccggtaaaaggggagaggatggaatggttggtcaacaaaataaatggccaccatgtgctcctggtcagcggctacaacctcgttcgtacttgggagtcggccat

SEQ ID NO: 6148 - DNA, 140 bp, Artificial Sequence
  Synthetic
atggccgactcccaagtacgaacgaggttgtagccgctgaccaggagcacatggtggccatttattttgttgaccaaccattccatcctctccccttttaccgggcgatgttcggccaccggagacccagcatggcgtat

SEQ ID NO: 6149 - DNA, 140 bp, Artificial Sequence
  Synthetic
atacgccatgctgggtctccacggatgcagacgtggtcatctactgccgcgacaaagaatgggagaggaaaatatctgaggccatacagatgcggacccaagtagagctgctggatgagccgtacttgggagtcggccat

SEQ ID NO: 6150 - DNA, 140 bp, Artificial Sequence
  Synthetic
atggccgactcccaagtacggctcatccagcagctctacttgggtccgcatctgtatggcctcagatattttcctctcccattctttgtcgcggcagtagatgaccacgtctgcatccgtggagacccagcatggcgtat

SEQ ID NO: 6151 - DNA, 140 bp, Artificial Sequence
  Synthetic
aggccctggctgctgatatgacaaaataaatggccaccatgtgctcctggtcagcggctacaacctcgttctgcccactaagagagtcacctgggtggcgccgctgggcatccggggagcgaccttttgggacagcggtg

SEQ ID NO: 6152 - DNA, 140 bp, Artificial Sequence
  Synthetic
caccgctgtcccaaaaggtcgctccccggatgcccagcggcgccacccaggtgactctcttagtgggcagaacgaggttgtagccgctgaccaggagcacatggtggccatttattttgtcatatcagcagccagggcct

SEQ ID NO: 6153 - DNA, 140 bp, Artificial Sequence
  Synthetic
atacgccatgctgggtctcctgactacacatacaacctagagttaggcctaccagcaacgctcggtagatatgacctagtgattataaacatccacacaccctttcgcatacatcattaccgtacttgggagtcggccat

SEQ ID NO: 6154 - DNA, 140 bp, Artificial Sequence
  Synthetic
atggccgactcccaagtacggtaatgatgtatgcgaaagggtgtgtggatgtttataatcactaggtcatatctaccgagcgttgctggtaggcctaactctaggttgtatgtgtagtcaggagacccagcatggcgtat

SEQ ID NO: 6155 - DNA, 140 bp, Artificial Sequence
  Synthetic
aggccctggctgctgatatgatgacctagtgattataaacatccacacaccctttcgcatacatcattaccaacagtgcgtggatcacgcaatgaagctgcagatgctcggaggagactcgaccttttgggacagcggtg

SEQ ID NO: 6156 - DNA, 140 bp, Artificial Sequence
  Synthetic
caccgctgtcccaaaaggtcgagtctcctccgagcatctgcagcttcattgcgtgatccacgcactgttggtaatgatgtatgcgaaagggtgtgtggatgtttataatcactaggtcatcatatcagcagccagggcct

SEQ ID NO: 6157 - DNA, 140 bp, Artificial Sequence
  Synthetic
aggccctggctgctgatatgaaccagcactagacgacggggcgacacacacgctgccatccacaaccggaaaccttgcggccgtgtctgactgggtaataagcaccgtacctgtcgcgccgaccttttgggacagcggtg

SEQ ID NO: 6158 - DNA, 140 bp, Artificial Sequence
  Synthetic
caccgctgtcccaaaaggtcggcgcgacaggtacggtgcttattacccagtcagacacggccgcaaggtttccggttgtggatggcagcgtgtgtgtcgccccgtcgtctagtgctggttcatatcagcagccagggcct

SEQ ID NO: 6159 - DNA, 140 bp, Artificial Sequence
  Synthetic
aggccctggctgctgatatggaattgcgccgtagggaacatgcccatctccatcgacataccggatgcggccttcattagggtcgtcgacgcgccctctttaacggacatgtcgtgcgaggaccttttgggacagcggtg

SEQ ID NO: 6160 - DNA, 140 bp, Artificial Sequence
  Synthetic
caccgctgtcccaaaaggtcctcgcacgacatgtccgttaaagagggcgcgtcgacgaccctaatgaaggccgcatccggtatgtcgatggagatgggcatgttccctacggcgcaattccatatcagcagccagggcct

SEQ ID NO: 6161 - DNA, 140 bp, Artificial Sequence
  Synthetic
aggccctggctgctgatatgacgcagacagaacaagcgaacgagtagtctgcgtactgggacgcaagtttcgatcatccagagcgttgaaaccgccgtgcgttactagcaacaccgagatgaccttttgggacagcggtg

SEQ ID NO: 6162 - DNA, 140 bp, Artificial Sequence
  Synthetic
caccgctgtcccaaaaggtcatctcggtgttgctagtaacgcacggcggtttcaacgctctggatgatcgaaacttgcgtcccagtacgcagactactcgttcgcttgttctgtctgcgtcatatcagcagccagggcct

SEQ ID NO: 6163 - DNA, 140 bp, Artificial Sequence
  Synthetic
aggccctggctgctgatatgtgtccggtcgtacaagaaacagcggagacgcgtgacacagcaatgtctcttcaggcaccaccgagtaccgccacggaaccgaatcatccgccgatctcctgaccttttgggacagcggtg

SEQ ID NO: 6164 - DNA, 140 bp, Artificial Sequence
  Synthetic
caccgctgtcccaaaaggtcaggagatcggcggatgattcggttccgtggcggtactcggtggtgcctgaagagacattgctgtgtcacgcgtctccgctgtttcttgtacgaccggacacatatcagcagccagggcct

SEQ ID NO: 6165 - DNA, 140 bp, Artificial Sequence
  Synthetic
aggccctggctgctgatatggtttttcttgttcagcaactttgataacggcagaaggaactttacaacgcacgtaatgaacaaccagctgaatgctgcttttgttggtcaggccacccgagaccttttgggacagcggtg

SEQ ID NO: 6166 - DNA, 140 bp, Artificial Sequence
  Synthetic
caccgctgtcccaaaaggtctcgggtggcctgaccaacaaaagcagcattcagctggttgttcattacgtgcgttgtaaagttccttctgccgttatcaaagttgctgaacaagaaaaaccatatcagcagccagggcct

SEQ ID NO: 6167 - DNA, 140 bp, Artificial Sequence
  Synthetic
aggccctggctgctgatatgacgtaatgaacaaccagctgaatgctgcttttgttggtcaggccacccgagcagggtgtgcaccgtcgtaccgggttaaacgcatggacatcgcaaagaagaccttttgggacagcggtg

SEQ ID NO: 6168 - DNA, 140 bp, Artificial Sequence
  Synthetic
caccgctgtcccaaaaggtcttctttgcgatgtccatgcgtttaacccggtacgacggtgcacaccctgctcgggtggcctgaccaacaaaagcagcattcagctggttgttcattacgtcatatcagcagccagggcct

SEQ ID NO: 6169 - DNA, 140 bp, Artificial Sequence
  Synthetic
atacgccatgctgggtctcccgtacccgtcgcgccgcctagaagaaggagagggagaaacctgaccgtgatatgtgacgagagagaagggaatataacacccatggctagcgtccgattccgtacttgggagtcggccat

SEQ ID NO: 6170 - DNA, 140 bp, Artificial Sequence
  Synthetic
atggccgactcccaagtacggaatcggacgctagccatgggtgttatattcccttctctctcgtcacatatcacggtcaggtttctccctctccttcttctaggcggcgcgacgggtacgggagacccagcatggcgtat

SEQ ID NO: 6171 - DNA, 140 bp, Artificial Sequence
  Synthetic
atacgccatgctgggtctcccgtacccgtcgcgccgcctagaagaaggagagggagaaacctgaccgtgatttgtgacgagagagaagggaatataacacccatggctagcgtccgattccgtacttgggagtcggccat

SEQ ID NO: 6172 - DNA, 140 bp, Artificial Sequence
  Synthetic
atggccgactcccaagtacggaatcggacgctagccatgggtgttatattcccttctctctcgtcacaaatcacggtcaggtttctccctctccttcttctaggcggcgcgacgggtacgggagacccagcatggcgtat

SEQ ID NO: 6173 - DNA, 140 bp, Artificial Sequence
  Synthetic
atacgccatgctgggtctcccgtacccgtcgcgccgcctagaagaaggagagggagaaacctgaccgtgatctgtgacgagagagaagggaatataacacccatggctagcgtccgattccgtacttgggagtcggccat

SEQ ID NO: 6174 - DNA, 140 bp, Artificial Sequence
  Synthetic
atggccgactcccaagtacggaatcggacgctagccatgggtgttatattcccttctctctcgtcacagatcacggtcaggtttctccctctccttcttctaggcggcgcgacgggtacgggagacccagcatggcgtat

SEQ ID NO: 6175 - DNA, 140 bp, Artificial Sequence
  Synthetic
atacgccatgctgggtctcccgtacccgtcgcgccgcctagaagaaggagagggagaaacctgaccgtgatgtgtgacgagagagaagggaatataacacccatggctagcgtccgattccgtacttgggagtcggccat

SEQ ID NO: 6176 - DNA, 140 bp, Artificial Sequence
  Synthetic
atggccgactcccaagtacggaatcggacgctagccatgggtgttatattcccttctctctcgtcacacatcacggtcaggtttctccctctccttcttctaggcggcgcgacgggtacgggagacccagcatggcgtat

SEQ ID NO: 6177 - DNA, 140 bp, Artificial Sequence
  Synthetic
atacgccatgctgggtctcccgatgaagagtgcgtagtcaacgccgccaaccctcgtgggctaccaggcgatggcgtctgtaaagcagtatacaaaaaatggccggagtccttcaagaaccgtacttgggagtcggccat

SEQ ID NO: 6178 - DNA, 140 bp, Artificial Sequence
  Synthetic
atggccgactcccaagtacggttcttgaaggactccggccattttttgtatactgctttacagacgccatcgcctggtagcccacgagggttggcggcgttgactacgcactcttcatcgggagacccagcatggcgtat

SEQ ID NO: 6179 - DNA, 140 bp, Artificial Sequence
  Synthetic
atacgccatgctgggtctcctagcataccgaactcttccacaattctccgtacccatagggacgtaggagatgttattttgtttttaatatttcaaaaaaaaaaaaaaaaaaaaaaaaaacgtacttgggagtcggccat

SEQ ID NO: 6180 - DNA, 140 bp, Artificial Sequence
  Synthetic
atggccgactcccaagtacgttttttttttttttttttttttttttgaaatattaaaaacaaaataacatctcctacgtccctatgggtacggagaattgtggaagagttcggtatgctaggagacccagcatggcgtat

SEQ ID NO: 6181 - DNA, 140 bp, Artificial Sequence
  Synthetic
aggccctggctgctgatatgatggcgtctgtaaagcagtatacaaaaaatggccggagtccttcaagaacagtgcaacaccagtgggaaccgcaaagacagtcatgtgcggtacatacccgaccttttgggacagcggtg

SEQ ID NO: 6182 - DNA, 140 bp, Artificial Sequence
  Synthetic
caccgctgtcccaaaaggtcgggtatgtaccgcacatgactgtctttgcggttcccactggtgttgcactgttcttgaaggactccggccattttttgtatactgctttacagacgccatcatatcagcagccagggcct

SEQ ID NO: 6183 - DNA, 140 bp, Artificial Sequence
  Synthetic
aggccctggctgctgatatgtcactttgagaagtaggcatagcataccgaactcttccacgattctccgaacccacagggacgtaggagatgttattttgtttttaatatttcaaaaaaagaccttttgggacagcggtg

SEQ ID NO: 6184 - DNA, 140 bp, Artificial Sequence
  Synthetic
caccgctgtcccaaaaggtctttttttgaaatattaaaaacaaaataacatctcctacgtccctgtgggttcggagaatcgtggaagagttcggtatgctatgcctacttctcaaagtgacatatcagcagccagggcct

SEQ ID NO: 6185 - DNA, 140 bp, Artificial Sequence
  Synthetic
atacgccatgctgggtctccgatgtgcatgaaaatcgaaaatgattgtattttcgaagtcaagcacgaaggtaaggtaacaggttacgcgtgcctggtgggagacaaagtaatgaaaccacgtacttgggagtcggccat

SEQ ID NO: 6186 - DNA, 140 bp, Artificial Sequence
  Synthetic
atggccgactcccaagtacgtggtttcattactttgtctcccaccaggcacgcgtaacctgttaccttaccttcgtgcttgacttcgaaaatacaatcattttcgattttcatgcacatcggagacccagcatggcgtat

SEQ ID NO: 6187 - DNA, 140 bp, Artificial Sequence
  Synthetic
atacgccatgctgggtctccagactaggagtaaacagcgtagctataccgctcctttccaccggcgtgtactctggagggaaagacaggctgactcagtcattaaaccacctttttacagcgtacttgggagtcggccat

SEQ ID NO: 6188 - DNA, 140 bp, Artificial Sequence
  Synthetic
atggccgactcccaagtacgctgtaaaaaggtggtttaatgactgagtcagcctgtctttccctccagagtacacgccggtggaaaggagcggtatagctacgctgtttactcctagtctggagacccagcatggcgtat

SEQ ID NO: 6189 - DNA, 140 bp, Artificial Sequence
  Synthetic
aggccctggctgctgatatgtgggagaagaaaatagccgaggccatacaaatgaggacccaagtggaactactagacgaacacatctctgtagactgcgatatcatccgagtgcaccctggaccttttgggacagcggtg

SEQ ID NO: 6190 - DNA, 140 bp, Artificial Sequence
  Synthetic
caccgctgtcccaaaaggtccagggtgcactcggatgatatcgcagtctacagagatgtgttcgtctagtagttccacttgggtcctcatttgtatggcctcggctattttcttctcccacatatcagcagccagggcct

SEQ ID NO: 6191 - DNA, 140 bp, Artificial Sequence
  Synthetic
aggccctggctgctgatatgagaccatacttagctcactgtcccgactgtggagaagggcactcgtgccatagtcccgtagcactagaacgcatcagaaatgaagcgacagacgggacgcgaccttttgggacagcggtg

SEQ ID NO: 6192 - DNA, 140 bp, Artificial Sequence
  Synthetic
caccgctgtcccaaaaggtcgcgtcccgtctgtcgcttcatttctgatgcgttctagtgctacgggactatggcacgagtgcccttctccacagtcgggacagtgagctaagtatggtctcatatcagcagccagggcct

SEQ ID NO: 6193 - DNA, 140 bp, Artificial Sequence
  Synthetic
aggccctggctgctgatatgtactcctacttggaagggacacggttccatcagacggcagtggacatggcagaagtatataccatgtggccaaagcagacggaggccaatgaacaagtttgaccttttgggacagcggtg

SEQ ID NO: 6194 - DNA, 140 bp, Artificial Sequence
  Synthetic
caccgctgtcccaaaaggtcaaacttgttcattggcctccgtctgctttggccacatggtatatacttctgccatgtccactgccgtctgatggaaccgtgtcccttccaagtaggagtacatatcagcagccagggcct

SEQ ID NO: 6195 - DNA, 140 bp, Artificial Sequence
  Synthetic
atacgccatgctgggtctccgcttgtacgcgttgggggaaagtatagaatcaatcaggcaaaagtgcccagtggatgatgcagatgcatcgtcgcccccaaaaaccgtcccgtgcctctgcgtacttgggagtcggccat

SEQ ID NO: 6196 - DNA, 140 bp, Artificial Sequence
  Synthetic
atggccgactcccaagtacgcagaggcacgggacggtttttgggggcgacgatgcatctgcatcatccactgggcacttttgcctgattgattctatactttcccccaacgcgtacaagcggagacccagcatggcgtat

SEQ ID NO: 6197 - DNA, 140 bp, Artificial Sequence
  Synthetic
aggccctggctgctgatatgcaccaatcacaaaaagtggcagtataactcccctctggtcccgcgtaatgctgaacttggggaccgaaaaggaaaaattcacatcccgtttccgctggcagaccttttgggacagcggtg

SEQ ID NO: 6198 - DNA, 140 bp, Artificial Sequence
  Synthetic
caccgctgtcccaaaaggtctgccagcggaaacgggatgtgaatttttccttttcggtccccaagttcagcattacgcgggaccagaggggagttatactgccactttttgtgattggtgcatatcagcagccagggcct

SEQ ID NO: 6199 - DNA, 140 bp, Artificial Sequence
  Synthetic
aggccctggctgctgatatgccgttatgccatgacacccgaacgagtcaccaggcttcgtatgaaccatgtcacaagcataatagtatgctcatcattcccccttccaaagtataaaatagaccttttgggacagcggtg

SEQ ID NO: 6200 - DNA, 140 bp, Artificial Sequence
  Synthetic
caccgctgtcccaaaaggtctattttatactttggaagggggaatgatgagcatactattatgcttgtgacatggttcatacgaagcctggtgactcgttcgggtgtcatggcataacggcatatcagcagccagggcct

SEQ ID NO: 6201 - DNA, 140 bp, Artificial Sequence
  Synthetic
atacgccatgctgggtctccgaaggagtgcagaaagtcaagtgttctaaagtgatgctgttcgaccataacgtgccatcacgcgttagtccaagggaatataaatcgcctcaggagaccgcgtacttgggagtcggccat

SEQ ID NO: 6202 - DNA, 140 bp, Artificial Sequence
  Synthetic
atggccgactcccaagtacgcggtctcctgaggcgatttatattcccttggactaacgcgtgatggcacgttatggtcgaacagcatcactttagaacacttgactttctgcactccttcggagacccagcatggcgtat

SEQ ID NO: 6203 - DNA, 140 bp, Artificial Sequence
  Synthetic
atacgccatgctgggtctccagcgttgacggtgaggtgctgcccgccccgtctgacctggaagctgatgctccgattccggagccaacaccagacgacagagcggtacttactttgcctccgtacttgggagtcggccat

SEQ ID NO: 6204 - DNA, 140 bp, Artificial Sequence
  Synthetic
atggccgactcccaagtacggaggcaaagtaagtaccgctctgtcgtctggtgttggctccggaatcggagcatcagcttccaggtcagacggggcgggcagcacctcaccgtcaacgctggagacccagcatggcgtat

SEQ ID NO: 6205 - DNA, 140 bp, Artificial Sequence
  Synthetic
aggccctggctgctgatatgaatcatgcaaaacagaatttgcatcagcatacagggctcataccgcatctgcatcagctaagctccgcgtcctttaccaaggaaataacatcactgtaacgaccttttgggacagcggtg

SEQ ID NO: 6206 - DNA, 140 bp, Artificial Sequence
  Synthetic
caccgctgtcccaaaaggtcgttacagtgatgttatttccttggtaaaggacgcggagcttagctgatgcagatgcggtatgagccctgtatgctgatgcaaattctgttttgcatgattcatatcagcagccagggcct

SEQ ID NO: 6207 - DNA, 140 bp, Artificial Sequence
  Synthetic
aggccctggctgctgatatgacgtctatgctaatacacaactggtactgcagagaccggctgtgggtacggtacacgtgccatactctcaggcaccatctggctttaagtattggctaaagaccttttgggacagcggtg

SEQ ID NO: 6208 - DNA, 140 bp, Artificial Sequence
  Synthetic
caccgctgtcccaaaaggtctttagccaatacttaaagccagatggtgcctgagagtatggcacgtgtaccgtacccacagccggtctctgcagtaccagttgtgtattagcatagacgtcatatcagcagccagggcct

SEQ ID NO: 6209 - DNA, 140 bp, Artificial Sequence
  Synthetic
aggccctggctgctgatatgtccgattccggagccaacaccagacgacagagcggtacttactttgcctcccacgatcgaaaatttttcggctgtgtcggactgggtaatgaataccgcggaccttttgggacagcggtg

SEQ ID NO: 6210 - DNA, 140 bp, Artificial Sequence
  Synthetic
caccgctgtcccaaaaggtccgcggtattcattacccagtccgacacagccgaaaaattttcgatcgtgggaggcaaagtaagtaccgctctgtcgtctggtgttggctccggaatcggacatatcagcagccagggcct

SEQ ID NO: 6211 - DNA, 140 bp, Artificial Sequence
  Synthetic
aggccctggctgctgatatgccagtcgcaccacccagaagaagacgtgggaaaaacttgaatgtcacctgcgacgagagagaagggaacgtacttcccatggctagcgttcggtttttcagaccttttgggacagcggtg

SEQ ID NO: 6212 - DNA, 140 bp, Artificial Sequence
  Synthetic
caccgctgtcccaaaaggtctgaaaaaccgaacgctagccatgggaagtacgttcccttctctctcgtcgcaggtgacattcaagtttttcccacgtcttcttctgggtggtgcgactggcatatcagcagccagggcct

SEQ ID NO: 6213 - DNA, 140 bp, Artificial Sequence
  Synthetic
aggccctggctgctgatatggagcggatctgcactccatcgtacaggaaacggcagagatacgcgatacggccgcgtccctccaggcgcccctgagtgtcgctacagaaccaaatcaactgaccttttgggacagcggtg

SEQ ID NO: 6214 - DNA, 140 bp, Artificial Sequence
  Synthetic
caccgctgtcccaaaaggtcagttgatttggttctgtagcgacactcaggggcgcctggagggacgcggccgtatcgcgtatctctgccgtttcctgtacgatggagtgcagatccgctccatatcagcagccagggcct

SEQ ID NO: 6215 - DNA, 140 bp, Artificial Sequence
  Synthetic
aggccctggctgctgatatggccgcgtccctccaggcgcccctgagtgtcgctacagaaccaaatcaactgccgatctcatttggagcaccaaacgagactttccccataacgttcgggggaccttttgggacagcggtg

SEQ ID NO: 6216 - DNA, 140 bp, Artificial Sequence
  Synthetic
caccgctgtcccaaaaggtcccccgaacgttatggggaaagtctcgtttggtgctccaaatgagatcggcagttgatttggttctgtagcgacactcaggggcgcctggagggacgcggccatatcagcagccagggcct

SEQ ID NO: 6217 - DNA, 140 bp, Artificial Sequence
  Synthetic
atacgccatgctgggtctccgccgatctcatttggagcaccaaacgagactttccccataacgttcggggattttgatgaaggggagattgaaagcttgtcctctgagttactgacctttcgtacttgggagtcggccat

SEQ ID NO: 6218 - DNA, 140 bp, Artificial Sequence
  Synthetic
atggccgactcccaagtacgaaaggtcagtaactcagaggacaagctttcaatctccccttcatcaaaatccccgaacgttatggggaaagtctcgtttggtgctccaaatgagatcggcggagacccagcatggcgtat

SEQ ID NO: 6219 - DNA, 140 bp, Artificial Sequence
  Synthetic
aggccctggctgctgatatgaagaagcaaaagcaaaagcagcaggcgccacgaaacaacatgaatcaaaagaagcagccccctacaaagaaaccggctcaaaagaaaaagaagccgggccgaccttttgggacagcggtg

SEQ ID NO: 6220 - DNA, 140 bp, Artificial Sequence
  Synthetic
caccgctgtcccaaaaggtcggcccggcttctttttcttttgagccggtttctttgtagggggctgcttcttttgattcatgttgtttcgtggcgcctgctgcttttgcttttgcttcttcatatcagcagccagggcct

SEQ ID NO: 6221 - DNA, 140 bp, Artificial Sequence
  Synthetic
atacgccatgctgggtctccggagacttctcgccaggcgaagtggatgacctgacagacagcgattggtccacgtgttcagatacggacgacgaattatgactagatagggcaggtgggtcgtacttgggagtcggccat

SEQ ID NO: 6222 - DNA, 140 bp, Artificial Sequence
  Synthetic
atggccgactcccaagtacgacccacctgccctatctagtcataattcgtcgtccgtatctgaacacgtggaccaatcgctgtctgtcaggtcatccacttcgcctggcgagaagtctccggagacccagcatggcgtat

SEQ ID NO: 6223 - DNA, 140 bp, Artificial Sequence
  Synthetic
aggccctggctgctgatatgcacgtgttcagatacggacgacgaattatgactagatagggcaggtgggtacatattctcatctgacaccggccccggccacctgcaacagaggtctgtcgaccttttgggacagcggtg

SEQ ID NO: 6224 - DNA, 140 bp, Artificial Sequence
  Synthetic
caccgctgtcccaaaaggtcgacagacctctgttgcaggtggccggggccggtgtcagatgagaatatgtacccacctgccctatctagtcataattcgtcgtccgtatctgaacacgtgcatatcagcagccagggcct

SEQ ID NO: 6225 - DNA, 140 bp, Artificial Sequence
  Synthetic
aggccctggctgctgatatgatgttacccacctaagttggatgaagtgaaagagcagttgttacttaagaaactccaggaaagtgcgtctatggctaacagaagcaggtaccaatcccgcgaccttttgggacagcggtg

SEQ ID NO: 6226 - DNA, 140 bp, Artificial Sequence
  Synthetic
caccgctgtcccaaaaggtcgcgggattggtacctgcttctgttagccatagacgcactttcctggagtttcttaagtaacaactgctctttcacttcatccaacttaggtgggtaacatcatatcagcagccagggcct

SEQ ID NO: 6227 - DNA, 140 bp, Artificial Sequence
  Synthetic
aggccctggctgctgatatgaaagtagagaacatgaaagcaacaatagtccaaaggctgaagggtggttgcaaactctatttaatgtcggagaccccgaaagttcctacctaccgaactagaccttttgggacagcggtg

SEQ ID NO: 6228 - DNA, 140 bp, Artificial Sequence
  Synthetic
caccgctgtcccaaaaggtctagttcggtaggtaggaactttcggggtctccgacattaaatagagtttgcaaccacccttcagcctttggactattgttgctttcatgttctctactttcatatcagcagccagggcct

SEQ ID NO: 6229 - DNA, 140 bp, Artificial Sequence
  Synthetic
atacgccatgctgggtctccaaaagctagaaccgtgcgaccgtgtgctgttctcagtagggtcaacgctctacccggaaagccgtaagctacttaagagctggcacctaccatcggtgttcgtacttgggagtcggccat

SEQ ID NO: 6230 - DNA, 140 bp, Artificial Sequence
  Synthetic
atggccgactcccaagtacgaacaccgatggtaggtgccagctcttaagtagcttacggctttccgggtagagcgttgaccctactgagaacagcacacggtcgcacggttctagcttttggagacccagcatggcgtat

SEQ ID NO: 6231 - DNA, 140 bp, Artificial Sequence
  Synthetic
atacgccatgctgggtctcccatatccggcaccagtgtactcacccccaatcaatatccgactgtccaaccccgagtctgctgtggcagcgtgcaatgagttcctagcaaggaactatcccgtacttgggagtcggccat

SEQ ID NO: 6232 - DNA, 140 bp, Artificial Sequence
  Synthetic
atggccgactcccaagtacgggatagttccttgctaggaactcattgcacgctgccacagcagactcggggttggacagtcggatattgattgggggtgagtacactggtgccggatatgggagacccagcatggcgtat

SEQ ID NO: 6233 - DNA, 140 bp, Artificial Sequence
  Synthetic
aggccctggctgctgatatgtaggagatgttcaaagtggctataaaaccctgaatagtaataaaacataaaattaataaggatcaaatgagtaccataattggcaaacggaagagacgtagaccttttgggacagcggtg

SEQ ID NO: 6234 - DNA, 140 bp, Artificial Sequence
  Synthetic
caccgctgtcccaaaaggtctacgtctcttccgtttgccaattatggtactcatttgatccttattaattttatgttttattactattcagggttttatagccactttgaacatctcctacatatcagcagccagggcct

SEQ ID NO: 6235 - DNA, 140 bp, Artificial Sequence
  Synthetic
atacgccatgctgggtctcctggtggacgggtcggaaagctgccttgaccgggcgacgttcaatccatcaaagcttagaagttatccaaaacagcactcctaccatgcacccacaatcagcgtacttgggagtcggccat

SEQ ID NO: 6236 - DNA, 140 bp, Artificial Sequence
  Synthetic
atggccgactcccaagtacgctgattgtgggtgcatggtaggagtgctgttttggataacttctaagctttgatggattgaacgtcgcccggtcaaggcagctttccgacccgtccaccaggagacccagcatggcgtat

SEQ ID NO: 6237 - DNA, 140 bp, Artificial Sequence
  Synthetic
aggccctggctgctgatatgaagcttagaagttatccaaaacagcactcctaccatgcacccacaatcagaagtgccgtaccttccccgttccagaacacgttgcagaacgtactggctggaccttttgggacagcggtg

SEQ ID NO: 6238 - DNA, 140 bp, Artificial Sequence
  Synthetic
caccgctgtcccaaaaggtccagccagtacgttctgcaacgtgttctggaacggggaaggtacggcacttctgattgtgggtgcatggtaggagtgctgttttggataacttctaagcttcatatcagcagccagggcct

SEQ ID NO: 6239 - DNA, 140 bp, Artificial Sequence
  Synthetic
atacgccatgctgggtctccctgccacgaaaagaaattgcaacgtcacacagatgagagaactgcctactttggattcagcggtatttaatgttgagtgctttaaaaaatttgcgtgcaacgtacttgggagtcggccat

SEQ ID NO: 6240 - DNA, 140 bp, Artificial Sequence
  Synthetic
atggccgactcccaagtacgttgcacgcaaattttttaaagcactcaacattaaataccgctgaatccaaagtaggcagttctctcatctgtgtgacgttgcaatttcttttcgtggcagggagacccagcatggcgtat

SEQ ID NO: 6241 - DNA, 140 bp, Artificial Sequence
  Synthetic
atacgccatgctgggtctccagaacttgacaacctatgtcacaaaactaaaaggaccaaaagcagcagcattgtttgccaagacacataacctgctaccattgcaggaggtaccaatggacgtacttgggagtcggccat

SEQ ID NO: 6242 - DNA, 140 bp, Artificial Sequence
  Synthetic
atggccgactcccaagtacgtccattggtacctcctgcaatggtagcaggttatgtgtcttggcaaacaatgctgctgcttttggtccttttagttttgtgacataggttgtcaagttctggagacccagcatggcgtat

SEQ ID NO: 6243 - DNA, 140 bp, Artificial Sequence
  Synthetic
atacgccatgctgggtctcccaggtttactgtagacatgaaaagggacgtgaaggtgactccggggacgaagcacactgaggaaagacctaaagtgcaggtcatacaggcagccgaacctcgtacttgggagtcggccat

SEQ ID NO: 6244 - DNA, 140 bp, Artificial Sequence
  Synthetic
atggccgactcccaagtacgaggttcggctgcctgtatgacctgcactttaggtctttcctcagtgtgcttcgtccccggagtcaccttcacgtcccttttcatgtctacagtaaacctgggagacccagcatggcgtat

SEQ ID NO: 6245 - DNA, 140 bp, Artificial Sequence
  Synthetic
atacgccatgctgggtctccgtgcaacaccagtgggaaccgcaaaaacagtcatgtgcggtacgtatccagtaatccacgccgttggaccaaacttctctaattattcggagtctgaaggcgtacttgggagtcggccat

SEQ ID NO: 6246 - DNA, 140 bp, Artificial Sequence
  Synthetic
atggccgactcccaagtacgccttcagactccgaataattagagaagtttggtccaacggcgtggattactggatacgtaccgcacatgactgtttttgcggttcccactggtgttgcacggagacccagcatggcgtat

SEQ ID NO: 6247 - DNA, 140 bp, Artificial Sequence
  Synthetic
atacgccatgctgggtctccgtgcaacacctgtgggaaccgcaaaaacagtcatgtgcggtacgtatccagtaatccacgccgttggaccaaacttctctaattattcggagtctgaaggcgtacttgggagtcggccat

SEQ ID NO: 6248 - DNA, 140 bp, Artificial Sequence
  Synthetic
atggccgactcccaagtacgccttcagactccgaataattagagaagtttggtccaacggcgtggattactggatacgtaccgcacatgactgtttttgcggttcccacaggtgttgcacggagacccagcatggcgtat

SEQ ID NO: 6249 - DNA, 140 bp, Artificial Sequence
  Synthetic
atacgccatgctgggtctccgtgcaacacccgtgggaaccgcaaaaacagtcatgtgcggtacgtatccagtaatccacgccgttggaccaaacttctctaattattcggagtctgaaggcgtacttgggagtcggccat

SEQ ID NO: 6250 - DNA, 140 bp, Artificial Sequence
  Synthetic
atggccgactcccaagtacgccttcagactccgaataattagagaagtttggtccaacggcgtggattactggatacgtaccgcacatgactgtttttgcggttcccacgggtgttgcacggagacccagcatggcgtat

SEQ ID NO: 6251 - DNA, 140 bp, Artificial Sequence
  Synthetic
atacgccatgctgggtctccgtgcaacaccggtgggaaccgcaaaaacagtcatgtgcggtacgtatccagtaatccacgccgttggaccaaacttctctaattattcggagtctgaaggcgtacttgggagtcggccat

SEQ ID NO: 6252 - DNA, 140 bp, Artificial Sequence
  Synthetic
atggccgactcccaagtacgccttcagactccgaataattagagaagtttggtccaacggcgtggattactggatacgtaccgcacatgactgtttttgcggttcccaccggtgttgcacggagacccagcatggcgtat

SEQ ID NO: 6253 - DNA, 140 bp, Artificial Sequence
  Synthetic
aggccctggctgctgatatggaatgcagtccttctacctaatgtacacacgctgtttgacatgtctgccgaggactttgacgccattattgccgcgcacttcaagccaggggacgccgtagaccttttgggacagcggtg

SEQ ID NO: 6254 - DNA, 140 bp, Artificial Sequence
  Synthetic
caccgctgtcccaaaaggtctacggcgtcccctggcttgaagtgcgcggcaataatggcgtcaaagtcctcggcagacatgtcaaacagcgtgtgtacattaggtagaaggactgcattccatatcagcagccagggcct

SEQ ID NO: 6255 - DNA, 140 bp, Artificial Sequence
  Synthetic
atacgccatgctgggtctccttggaaaccgatatagcctcctttgacaagagccaagacgactcattggcgctcactgctctaatgttgctagaggatttgggggtggatcatcccctgtcgtacttgggagtcggccat

SEQ ID NO: 6256 - DNA, 140 bp, Artificial Sequence
  Synthetic
atggccgactcccaagtacgacaggggatgatccacccccaaatcctctagcaacattagagcagtgagcgccaatgagtcgtcttggctcttgtcaaaggaggctatatcggtttccaaggagacccagcatggcgtat

SEQ ID NO: 6257 - DNA, 140 bp, Artificial Sequence
  Synthetic
aggccctggctgctgatatggctcactgctctaatgttgctagaggatttgggggtggatcatcccctgttggacttgatagaggctgccttcggggagatctccagctgccacctaccggaccttttgggacagcggtg

SEQ ID NO: 6258 - DNA, 140 bp, Artificial Sequence
  Synthetic
caccgctgtcccaaaaggtccggtaggtggcagctggagatctccccgaaggcagcctctatcaagtccaacaggggatgatccacccccaaatcctctagcaacattagagcagtgagccatatcagcagccagggcct

SEQ ID NO: 6259 - DNA, 140 bp, Artificial Sequence
  Synthetic
atacgccatgctgggtctcctggacttgatagaggctgccttcggggagatctccagctgccacctaccgacgggcacccgttttaagttcggcgccatgatgaagtctggtatgtttctcgtacttgggagtcggccat

SEQ ID NO: 6260 - DNA, 140 bp, Artificial Sequence
  Synthetic
atggccgactcccaagtacgagaaacataccagacttcatcatggcgccgaacttaaaacgggtgcccgtcggtaggtggcagctggagatctccccgaaggcagcctctatcaagtccaggagacccagcatggcgtat

SEQ ID NO: 6261 - DNA, 140 bp, Artificial Sequence
  Synthetic
atacgccatgctgggtctccaaccctgttcgtcaatacactgctaaacatcaccatagccagccgagtgctggaggaccgcttgacaaagtctgcgtgcgcggccttcatcggcgacgaccgtacttgggagtcggccat

SEQ ID NO: 6262 - DNA, 140 bp, Artificial Sequence
  Synthetic
atggccgactcccaagtacggtcgtcgccgatgaaggccgcgcacgcagactttgtcaagcggtcctccagcactcggctggctatggtgatgtttagcagtgtattgacgaacagggttggagacccagcatggcgtat

SEQ ID NO: 6263 - DNA, 140 bp, Artificial Sequence
  Synthetic
aggccctggctgctgatatgtggaggaccgcttgacaaagtctgcgtgcgcggccttcatcggcgacgacaatataatacatggggttgtctctgacgaactgatggcagcaagatgcgcgaccttttgggacagcggtg

SEQ ID NO: 6264 - DNA, 140 bp, Artificial Sequence
  Synthetic
caccgctgtcccaaaaggtcgcgcatcttgctgccatcagttcgtcagagacaaccccatgtattatattgtcgtcgccgatgaaggccgcgcacgcagactttgtcaagcggtcctccacatatcagcagccagggcct

SEQ ID NO: 6265 - DNA, 140 bp, Artificial Sequence
  Synthetic
aggccctggctgctgatatgaagtagaaaacatgaaagcaacaatcatccagagacttgatagaggctgcagattatacttaatgtcagagaccccaaaagtccctacctaccggaccacgaccttttgggacagcggtg

SEQ ID NO: 6266 - DNA, 140 bp, Artificial Sequence
  Synthetic
caccgctgtcccaaaaggtcgtggtccggtaggtagggacttttggggtctctgacattaagtataatctgcagcctctatcaagtctctggatgattgttgctttcatgttttctacttcatatcagcagccagggcct

SEQ ID NO: 6267 - DNA, 140 bp, Artificial Sequence
  Synthetic
aggccctggctgctgatatgaagtagaaaacatgaaagcaacaatcatccagtgacttgatagaggctgcagattatacttaatgtcagagaccccaaaagtccctacctaccggaccacgaccttttgggacagcggtg

SEQ ID NO: 6268 - DNA, 140 bp, Artificial Sequence
  Synthetic
caccgctgtcccaaaaggtcgtggtccggtaggtagggacttttggggtctctgacattaagtataatctgcagcctctatcaagtcactggatgattgttgctttcatgttttctacttcatatcagcagccagggcct

SEQ ID NO: 6269 - DNA, 140 bp, Artificial Sequence
  Synthetic
aggccctggctgctgatatgaagtagaaaacatgaaagcaacaatcatccagcgacttgatagaggctgcagattatacttaatgtcagagaccccaaaagtccctacctaccggaccacgaccttttgggacagcggtg

SEQ ID NO: 6270 - DNA, 140 bp, Artificial Sequence
  Synthetic
caccgctgtcccaaaaggtcgtggtccggtaggtagggacttttggggtctctgacattaagtataatctgcagcctctatcaagtcgctggatgattgttgctttcatgttttctacttcatatcagcagccagggcct

SEQ ID NO: 6271 - DNA, 140 bp, Artificial Sequence
  Synthetic
aggccctggctgctgatatgaagtagaaaacatgaaagcaacaatcatccagggacttgatagaggctgcagattatacttaatgtcagagaccccaaaagtccctacctaccggaccacgaccttttgggacagcggtg

SEQ ID NO: 6272 - DNA, 140 bp, Artificial Sequence
  Synthetic
caccgctgtcccaaaaggtcgtggtccggtaggtagggacttttggggtctctgacattaagtataatctgcagcctctatcaagtccctggatgattgttgctttcatgttttctacttcatatcagcagccagggcct

SEQ ID NO: 6273 - DNA, 140 bp, Artificial Sequence
  Synthetic
atacgccatgctgggtctcctacatggatgaacatggaagtgaagatcatagatgcggtcgtgtctcagaaagccccgtacttctgcggagggtttatactgtatgacacagtagcaggccgtacttgggagtcggccat

SEQ ID NO: 6274 - DNA, 140 bp, Artificial Sequence
  Synthetic
atggccgactcccaagtacggcctgctactgtgtcatacagtataaaccctccgcagaagtacggggctttctgagacacgaccgcatctatgatcttcacttccatgttcatccatgtaggagacccagcatggcgtat

SEQ ID NO: 6275 - DNA, 140 bp, Artificial Sequence
  Synthetic
aggccctggctgctgatatgaagccccgtacttctgcggagggtttatactgtatgacacagtagcaggcacggcctgcagagtggcagacccgctaaagcggctgttcaagctgggcaagaccttttgggacagcggtg

SEQ ID NO: 6276 - DNA, 140 bp, Artificial Sequence
  Synthetic
caccgctgtcccaaaaggtcttgcccagcttgaacagccgctttagcgggtctgccactctgcaggccgtgcctgctactgtgtcatacagtataaaccctccgcagaagtacggggcttcatatcagcagccagggcct

SEQ ID NO: 6277 - DNA, 140 bp, Artificial Sequence
  Synthetic
aggccctggctgctgatatgaccgctggcggcgggagatgaacaagacgacgacagaagacgtgcactggctgacgaagtggttagatggcaacgaacagggctaattgatgagctagaagaccttttgggacagcggtg

SEQ ID NO: 6278 - DNA, 140 bp, Artificial Sequence
  Synthetic
caccgctgtcccaaaaggtcttctagctcatcaattagccctgttcgttgccatctaaccacttcgtcagccagtgcacgtcttctgtcgtcgtcttgttcatctcccgccgccagcggtcatatcagcagccagggcct

SEQ ID NO: 6279 - DNA, 140 bp, Artificial Sequence
  Synthetic
atacgccatgctgggtctccaaagcggtacactccaggtatgaagtgcagggcatatctgtcgtggtaatgtctatggccacctttgcaagctctagatctaactttgagaagctcagagcgtacttgggagtcggccat

SEQ ID NO: 6280 - DNA, 140 bp, Artificial Sequence
  Synthetic
atggccgactcccaagtacgctctgagcttctcaaagttagatctagagcttgcaaaggtggccatagacattaccacgacagatatgccctgcacttcatacctggagtgtaccgctttggagacccagcatggcgtat

SEQ ID NO: 6281 - DNA, 140 bp, Artificial Sequence
  Synthetic
aggccctggctgctgatatgtgacaatgcgcgcggtaccccaacagaagccacgcaggaaccggaagaataagaagcaaaagcaaaagcaacaggcgccacaaaacaacacaaaccaaaagaccttttgggacagcggtg

SEQ ID NO: 6282 - DNA, 140 bp, Artificial Sequence
  Synthetic
caccgctgtcccaaaaggtcttttggtttgtgttgttttgtggcgcctgttgcttttgcttttgcttcttattcttccggttcctgcgtggcttctgttggggtaccgcgcgcattgtcacatatcagcagccagggcct

SEQ ID NO: 6283 - DNA, 140 bp, Artificial Sequence
  Synthetic
atacgccatgctgggtctccacctatttcgtcagaaaccaatcgcagctacttgcatacctactagctacaatggagttcatcccaacgcaaactttctacaacagaaggtaccaacccccgtacttgggagtcggccat

SEQ ID NO: 6284 - DNA, 140 bp, Artificial Sequence
  Synthetic
atggccgactcccaagtacgggggttggtaccttctgttgtagaaagtttgcgttgggatgaactccattgtagctagtaggtatgcaagtagctgcgattggtttctgacgaaataggtggagacccagcatggcgtat

SEQ ID NO: 6285 - DNA, 140 bp, Artificial Sequence
  Synthetic
aggccctggctgctgatatgaagaagcaaccaccacaaaagaagccggctcaaaagaagaagaaaccaggccgtagagagagaatgtgcatgaaaattgaaaatgattgcatcttcgaaggaccttttgggacagcggtg

SEQ ID NO: 6286 - DNA, 140 bp, Artificial Sequence
  Synthetic
caccgctgtcccaaaaggtccttcgaagatgcaatcattttcaattttcatgcacattctctctctacggcctggtttcttcttcttttgagccggcttcttttgtggtggttgcttcttcatatcagcagccagggcct

SEQ ID NO: 6287 - DNA, 140 bp, Artificial Sequence
  Synthetic
aggccctggctgctgatatgccgtagagagagaatgtgcatgaaaattgaaaatgattgcatcttcgaagtcaagcatgaaggcaaagtgatgggctacgcatgtctggtgggggataaagaccttttgggacagcggtg

SEQ ID NO: 6288 - DNA, 140 bp, Artificial Sequence
  Synthetic
caccgctgtcccaaaaggtctttatcccccaccagacatgcgtagcccatcactttgccttcatgcttgacttcgaagatgcaatcattttcaattttcatgcacattctctctctacggcatatcagcagccagggcct

SEQ ID NO: 6289 - DNA, 140 bp, Artificial Sequence
  Synthetic
aggccctggctgctgatatggtaatgaaaccagcacatgtgaagggaactatcgacaatgccgatctggctaaactggccttcaagcggtcgtctaaatacgatcttgaatgtgcacagagaccttttgggacagcggtg

SEQ ID NO: 6290 - DNA, 140 bp, Artificial Sequence
  Synthetic
caccgctgtcccaaaaggtctctgtgcacattcaagatcgtatttagacgaccgcttgaaggccagtttagccagatcggcattgtcgatagttcccttcacatgtgctggtttcattaccatatcagcagccagggcct

SEQ ID NO: 6291 - DNA, 140 bp, Artificial Sequence
  Synthetic
atacgccatgctgggtctcccaacgccgcaactgccgaggagatagaggtacacatgcccccagacacccctgatcgcacattgctgtcacaacagtccggcaacgtaaagatcacagtccgtacttgggagtcggccat

SEQ ID NO: 6292 - DNA, 140 bp, Artificial Sequence
  Synthetic
atggccgactcccaagtacggactgtgatctttacgttgccggactgttgtgacagcaatgtgcgatcaggggtgtctgggggcatgtgtacctctatctcctcggcagttgcggcgttgggagacccagcatggcgtat

SEQ ID NO: 6293 - DNA, 140 bp, Artificial Sequence
  Synthetic
atacgccatgctgggtctccaatgcggcttcttcaatatgatgcagatgaaagtcaactataatcacaacatctgcacccaagtgtaccacaaaagtatctccaggcggtgtacactgcccgtacttgggagtcggccat

SEQ ID NO: 6294 - DNA, 140 bp, Artificial Sequence
  Synthetic
atggccgactcccaagtacgggcagtgtacaccgcctggagatacttttgtggtacacttgggtgcagatgttgtgattatagttgactttcatctgcatcatattgaagaagccgcattggagacccagcatggcgtat

SEQ ID NO: 6295 - DNA, 140 bp, Artificial Sequence
  Synthetic
atacgccatgctgggtctccgaggggtactataactggcatcacggagcagtgcagtattcaggaggccggttcactatcccgacgggtgcaggcaagccgggagacagcggcagaccgacgtacttgggagtcggccat

SEQ ID NO: 6296 - DNA, 140 bp, Artificial Sequence
  Synthetic
atggccgactcccaagtacgtcggtctgccgctgtctcccggcttgcctgcacccgtcgggatagtgaaccggcctcctgaatactgcactgctccgtgatgccagttatagtacccctcggagacccagcatggcgtat

SEQ ID NO: 6297 - DNA, 140 bp, Artificial Sequence
  Synthetic
aggccctggctgctgatatgatgccgcggtcaccaatcacaaaaagtggcagtataactcccctttggtcccgcgtaacgctgaactcggggaccgaaaaggaaaaattcacatcccgttgaccttttgggacagcggtg

SEQ ID NO: 6298 - DNA, 140 bp, Artificial Sequence
  Synthetic
caccgctgtcccaaaaggtcaacgggatgtgaatttttccttttcggtccccgagttcagcgttacgcgggaccaaaggggagttatactgccactttttgtgattggtgaccgcggcatcatatcagcagccagggcct

SEQ ID NO: 6299 - DNA, 140 bp, Artificial Sequence
  Synthetic
atacgccatgctgggtctccgaaggtgcccgcacggccctctccgtggtgacgtggaacaaagacatcgtcacaaaaattacccctgagggagccgaagagtggagcctcgccctcccggcgtacttgggagtcggccat

SEQ ID NO: 6300 - DNA, 140 bp, Artificial Sequence
  Synthetic
atggccgactcccaagtacgccgggagggcgaggctccactcttcggctccctcaggggtaatttttgtgacgatgtctttgttccacgtcaccacggagagggccgtgcgggcaccttcggagacccagcatggcgtat

SEQ ID NO: 6301 - DNA, 140 bp, Artificial Sequence
  Synthetic
atacgccatgctgggtctcccacaaaaattacccctgagggagccgaagagtggagcctcgccctcccggtcttgtgcctgttggcaaacaccacattcccctgctctcagccgccttgccgtacttgggagtcggccat

SEQ ID NO: 6302 - DNA, 140 bp, Artificial Sequence
  Synthetic
atggccgactcccaagtacggcaaggcggctgagagcaggggaatgtggtgtttgccaacaggcacaagaccgggagggcgaggctccactcttcggctccctcaggggtaatttttgtgggagacccagcatggcgtat

SEQ ID NO: 6303 - DNA, 140 bp, Artificial Sequence
  Synthetic
aggccctggctgctgatatgccccatggtactggagatggagctactgtcagtcactttggagccaacgctatcgcttgattacatcacgtgcgaatacaaaaccgtcatcccgtctccggaccttttgggacagcggtg

SEQ ID NO: 6304 - DNA, 140 bp, Artificial Sequence
  Synthetic
caccgctgtcccaaaaggtccggagacgggatgacggttttgtattcgcacgtgatgtaatcaagcgatagcgttggctccaaagtgactgacagtagctccatctccagtaccatggggcatatcagcagccagggcct

SEQ ID NO: 6305 - DNA, 140 bp, Artificial Sequence
  Synthetic
atacgccatgctgggtctccgcattcgtgccacagccctatcgcattggagcgcatcagaaatgaagcaacggacggaacgctgaaaatccaggtctctttgcagatcgggataaagacacgtacttgggagtcggccat

SEQ ID NO: 6306 - DNA, 140 bp, Artificial Sequence
  Synthetic
atggccgactcccaagtacgtgtctttatcccgatctgcaaagagacctggattttcagcgttccgtccgttgcttcatttctgatgcgctccaatgcgatagggctgtggcacgaatgcggagacccagcatggcgtat

SEQ ID NO: 6307 - DNA, 140 bp, Artificial Sequence
  Synthetic
aggccctggctgctgatatgatacaaaatcactaaaaattataaaaaaaaaaaaaaaaaaaaaaaaaaaaaaaaaaaaaaaaaaaaaaaaaaaaacagaaaaatatataaataggtatacgaccttttgggacagcggtg

SEQ ID NO: 6308 - DNA, 140 bp, Artificial Sequence
  Synthetic
caccgctgtcccaaaaggtcgtatacctatttatatatttttctgtttttttttttttttttttttttttttttttttttttttttttttttttttttataatttttagtgattttgtatcatatcagcagccagggcct

SEQ ID NO: 6309 - DNA, 140 bp, Artificial Sequence
  Synthetic
aggccctggctgctgatatgatacaaaatcactaaaaattattaaaaaaaaaaaaaaaaaaaaaaaaaaaaaaaaaaaaaaaaaaaaaaaaaaaacagaaaaatatataaataggtatacgaccttttgggacagcggtg

SEQ ID NO: 6310 - DNA, 140 bp, Artificial Sequence
  Synthetic
caccgctgtcccaaaaggtcgtatacctatttatatatttttctgttttttttttttttttttttttttttttttttttttttttttttttttttttaataatttttagtgattttgtatcatatcagcagccagggcct

SEQ ID NO: 6311 - DNA, 140 bp, Artificial Sequence
  Synthetic
aggccctggctgctgatatgatacaaaatcactaaaaattatcaaaaaaaaaaaaaaaaaaaaaaaaaaaaaaaaaaaaaaaaaaaaaaaaaaaacagaaaaatatataaataggtatacgaccttttgggacagcggtg

SEQ ID NO: 6312 - DNA, 140 bp, Artificial Sequence
  Synthetic
caccgctgtcccaaaaggtcgtatacctatttatatatttttctgttttttttttttttttttttttttttttttttttttttttttttttttttttgataatttttagtgattttgtatcatatcagcagccagggcct

SEQ ID NO: 6313 - DNA, 140 bp, Artificial Sequence
  Synthetic
aggccctggctgctgatatgatacaaaatcactaaaaattatgaaaaaaaaaaaaaaaaaaaaaaaaaaaaaaaaaaaaaaaaaaaaaaaaaaaacagaaaaatatataaataggtatacgaccttttgggacagcggtg

SEQ ID NO: 6314 - DNA, 140 bp, Artificial Sequence
  Synthetic
caccgctgtcccaaaaggtcgtatacctatttatatatttttctgttttttttttttttttttttttttttttttttttttttttttttttttttttcataatttttagtgattttgtatcatatcagcagccagggcct

SEQ ID NO: 6315 - DNA, 140 bp, Artificial Sequence
  Synthetic
atacgccatgctgggtctccagcaccgctgccactgccgaggagatagaggtgcatatgcccccagacactcctgaccgcacgctgatgacgcagcagtctggcaacgtgaagatcacagcgtacttgggagtcggccat

SEQ ID NO: 6316 - DNA, 140 bp, Artificial Sequence
  Synthetic
atggccgactcccaagtacgctgtgatcttcacgttgccagactgctgcgtcatcagcgtgcggtcaggagtgtctgggggcatatgcacctctatctcctcggcagtggcagcggtgctggagacccagcatggcgtat

SEQ ID NO: 6317 - DNA, 140 bp, Artificial Sequence
  Synthetic
aggccctggctgctgatatgtctacaagaggcctgatacccagtcaatccagaaggttcaggccgaatttgacagctttgtagtaccgggcctgtgttcgtccgggttgtcaatcccgttgaccttttgggacagcggtg

SEQ ID NO: 6318 - DNA, 140 bp, Artificial Sequence
  Synthetic
caccgctgtcccaaaaggtcaacgggattgacaacccggacgaacacaggcccggtactacaaagctgtcaaattcggcctgaaccttctggattgactgggtatcaggcctcttgtagacatatcagcagccagggcct

SEQ ID NO: 6319 - DNA, 140 bp, Artificial Sequence
  Synthetic
aggccctggctgctgatatgggactgacaaccacagacaaagtgatcaataactgcaaaattgatcagtgccatgctgcagtcactaatcacaagaagtggcaatacaactcccctttaggaccttttgggacagcggtg

SEQ ID NO: 6320 - DNA, 140 bp, Artificial Sequence
  Synthetic
caccgctgtcccaaaaggtcctaaaggggagttgtattgccacttcttgtgattagtgactgcagcatggcactgatcaattttgcagttattgatcactttgtctgtggttgtcagtcccatatcagcagccagggcct

SEQ ID NO: 6321 - DNA, 140 bp, Artificial Sequence
  Synthetic
aggccctggctgctgatatgccatgctgcagtcactaatcacaagaagtggcaatacaactcccctttagtcccgcgcaacgctgaactcggggaccgtaaaggaaagattcacatcccagaccttttgggacagcggtg

SEQ ID NO: 6322 - DNA, 140 bp, Artificial Sequence
  Synthetic
caccgctgtcccaaaaggtctgggatgtgaatctttcctttacggtccccgagttcagcgttgcgcgggactaaaggggagttgtattgccacttcttgtgattagtgactgcagcatggcatatcagcagccagggcct

SEQ ID NO: 6323 - DNA, 140 bp, Artificial Sequence
  Synthetic
aggccctggctgctgatatgatctgcacgtacggttgattcgctgctcttgaatggatgcaatagaccagtcgacgtgttgtacgtagacgaggcgtttgcatgccactctggaacgttagaccttttgggacagcggtg

SEQ ID NO: 6324 - DNA, 140 bp, Artificial Sequence
  Synthetic
caccgctgtcccaaaaggtctaacgttccagagtggcatgcaaacgcctcgtctacgtacaacacgtcgactggtctattgcatccattcaagagcagcgaatcaaccgtacgtgcagatcatatcagcagccagggcct

SEQ ID NO: 6325 - DNA, 140 bp, Artificial Sequence
  Synthetic
aggccctggctgctgatatgttcccattggcaaacgtgacttgcagagtaccaaaagcaagaaaccccacagtaacgtacggaaaaaaccaagtcaccatgctgctgtatcctgaccatcgaccttttgggacagcggtg

SEQ ID NO: 6326 - DNA, 140 bp, Artificial Sequence
  Synthetic
caccgctgtcccaaaaggtcgatggtcaggatacagcagcatggtgacttggttttttccgtacgttactgtggggtttcttgcttttggtactctgcaagtcacgtttgccaatgggaacatatcagcagccagggcct

SEQ ID NO: 6327 - DNA, 140 bp, Artificial Sequence
  Synthetic
aggccctggctgctgatatgtgacccgaagcagtgcggcttcttcaatatgatgcagatgaaagtcaactacaaccataacatctgcacccaagtgtaccacaaaagtatctccaggcgggaccttttgggacagcggtg

SEQ ID NO: 6328 - DNA, 140 bp, Artificial Sequence
  Synthetic
caccgctgtcccaaaaggtcccgcctggagatacttttgtggtacacttgggtgcagatgttatggttgtagttgactttcatctgcatcatattgaagaagccgcactgcttcgggtcacatatcagcagccagggcct

SEQ ID NO: 6329 - DNA, 140 bp, Artificial Sequence
  Synthetic
atacgccatgctgggtctcccgacactcttgtcttaccgtaacatgggacaggaaccaaattaccacgaggagtgggtgacatacaagaaggaggttaccttgaccgtgcctactgagggcgtacttgggagtcggccat

SEQ ID NO: 6330 - DNA, 140 bp, Artificial Sequence
  Synthetic
atggccgactcccaagtacgccctcagtaggcacggtcaaggtaacctccttcttgtatgtcacccactcctcgtggtaatttggttcctgtcccatgttacggtaagacaagagtgtcgggagacccagcatggcgtat

SEQ ID NO: 6331 - DNA, 140 bp, Artificial Sequence
  Synthetic
aggccctggctgctgatatgctattaaggagtgggaggtggagcacgcatcgataatggcgggcatctgcagtcaccaagtgacttttgacacgttccaaaacaaagccaacgtttgctggaccttttgggacagcggtg

SEQ ID NO: 6332 - DNA, 140 bp, Artificial Sequence
  Synthetic
caccgctgtcccaaaaggtccagcaaacgttggctttgttttggaacgtgtcaaaagtcacttggtgactgcagatgcccgccattatcgatgcgtgctccacctcccactccttaatagcatatcagcagccagggcct

SEQ ID NO: 6333 - DNA, 140 bp, Artificial Sequence
  Synthetic
atacgccatgctgggtctcctctggaggtcacttggggcaacaacgaaccatacaagtactggccgcagatgtctacgaacggtactgctcatggtcacccacatgagataatcttgtaccgtacttgggagtcggccat

SEQ ID NO: 6334 - DNA, 140 bp, Artificial Sequence
  Synthetic
atggccgactcccaagtacggtacaagattatctcatgtgggtgaccatgagcagtaccgttcgtagacatctgcggccagtacttgtatggttcgttgttgccccaagtgacctccagaggagacccagcatggcgtat

SEQ ID NO: 6335 - DNA, 140 bp, Artificial Sequence
  Synthetic
atacgccatgctgggtctcctattatgagctgtaccccactatgactgtaatcattgtgtcggtggcctcgttcgtgcttctgtcaatggtgggcacagcagtgggaatgtgtgtgtgcgcgtacttgggagtcggccat

SEQ ID NO: 6336 - DNA, 140 bp, Artificial Sequence
  Synthetic
atggccgactcccaagtacgcgcacacacacattcccactgctgtgcccaccattgacagaagcacgaacgaggccaccgacacaatgattacagtcatagtggggtacagctcataataggagacccagcatggcgtat

SEQ ID NO: 6337 - DNA, 140 bp, Artificial Sequence
  Synthetic
aggccctggctgctgatatgtggatgatgcagacgcatcatctcccccgaaaaccgtcccgtgcctttgccgttatgccatgactcctgaacgcgtcacccgtcttcgcatgaaccatgtgaccttttgggacagcggtg

SEQ ID NO: 6338 - DNA, 140 bp, Artificial Sequence
  Synthetic
caccgctgtcccaaaaggtcacatggttcatgcgaagacgggtgacgcgttcaggagtcatggcataacggcaaaggcacgggacggttttcgggggagatgatgcgtctgcatcatccacatatcagcagccagggcct

SEQ ID NO: 6339 - DNA, 140 bp, Artificial Sequence
  Synthetic
aggccctggctgctgatatgcacggcgcagatgcattacaccatatgaattaacaccaggagccactgttccctttctgctcagcctgctatgttgcgtcagaacgaccaaggcggccacgaccttttgggacagcggtg

SEQ ID NO: 6340 - DNA, 140 bp, Artificial Sequence
  Synthetic
caccgctgtcccaaaaggtcgtggccgccttggtcgttctgacgcaacatagcaggctgagcagaaagggaacagtggctcctggtgttaattcatatggtgtaatgcatctgcgccgtgcatatcagcagccagggcct

SEQ ID NO: 6341 - DNA, 140 bp, Artificial Sequence
  Synthetic
atacgccatgctgggtctccccctttctgctcagcctgctatgttgcgtcagaacgaccaaggcggccacatattacgaggctgcggcgtatctatggaacgaacaacagcccctgttctcgtacttgggagtcggccat

SEQ ID NO: 6342 - DNA, 140 bp, Artificial Sequence
  Synthetic
atggccgactcccaagtacgagaacaggggctgttgttcgttccatagatacgccgcagcctcgtaatatgtggccgccttggtcgttctgacgcaacatagcaggctgagcagaaagggggagacccagcatggcgtat

SEQ ID NO: 6343 - DNA, 140 bp, Artificial Sequence
  Synthetic
aggccctggctgctgatatgctgtcgcgccgcctagaagaaggagagggagaaacctgactgtgatatgtgacgagagagaagggaatgtaacacccatggctagcgtccgattctttaggaccttttgggacagcggtg

SEQ ID NO: 6344 - DNA, 140 bp, Artificial Sequence
  Synthetic
caccgctgtcccaaaaggtcctaaagaatcggacgctagccatgggtgttacattcccttctctctcgtcacatatcacagtcaggtttctccctctccttcttctaggcggcgcgacagcatatcagcagccagggcct

SEQ ID NO: 6345 - DNA, 140 bp, Artificial Sequence
  Synthetic
atacgccatgctgggtctccggttgcaggctcttatcccgctggccgccttgatcgtcctgtgcaactgtctgaaactcttgccatgctgctgtaagaccctggcttttttagccgtaatcgtacttgggagtcggccat

SEQ ID NO: 6346 - DNA, 140 bp, Artificial Sequence
  Synthetic
atggccgactcccaagtacgattacggctaaaaaagccagggtcttacagcagcatggcaagagtttcagacagttgcacaggacgatcaaggcggccagcgggataagagcctgcaaccggagacccagcatggcgtat

SEQ ID NO: 6347 - DNA, 140 bp, Artificial Sequence
  Synthetic
atacgccatgctgggtctcccgccctctctaacggacatgtcgtgcgaagtaccagcctgcacacattcctcagacttcgggggcgtcgccattattaaatatgcagccagcaggaaaggcgtacttgggagtcggccat

SEQ ID NO: 6348 - DNA, 140 bp, Artificial Sequence
  Synthetic
atggccgactcccaagtacgcctttcctgctggctgcatatttaataatggcgacgcccccgaagtctgaggaatgtgtgcaggctggtacttcgcacgacatgtccgttagagagggcgggagacccagcatggcgtat

SEQ ID NO: 6349 - DNA, 140 bp, Artificial Sequence
  Synthetic
atacgccatgctgggtctccgagcatcggtgcccacactgtgagcgcgtacgaacacgtaacagtgatcccgaacacggtgggagtaccgtataagactcttgtcaacagaccgggttaccgtacttgggagtcggccat

SEQ ID NO: 6350 - DNA, 140 bp, Artificial Sequence
  Synthetic
atggccgactcccaagtacggtaacccggtctgttgacaagagtcttatacggtactcccaccgtgttcgggatcactgttacgtgttcgtacgcgctcacagtgtgggcaccgatgctcggagacccagcatggcgtat

SEQ ID NO: 6351 - DNA, 140 bp, Artificial Sequence
  Synthetic
aggccctggctgctgatatgcgaacacggtgggagtaccgtataagactcttgtcaacagaccgggttacagccccatggtattggagatggagctacaatcagtcaccttggaaccaacgaccttttgggacagcggtg

SEQ ID NO: 6352 - DNA, 140 bp, Artificial Sequence
  Synthetic
caccgctgtcccaaaaggtcgttggttccaaggtgactgattgtagctccatctccaataccatggggctgtaacccggtctgttgacaagagtcttatacggtactcccaccgtgttcgcatatcagcagccagggcct

SEQ ID NO: 6353 - DNA, 140 bp, Artificial Sequence
  Synthetic
atacgccatgctgggtctccggacttgatagaggctgcttttggagagatttctagctgtcacctgccgacaggtacgcgcttcaagttcggcgctatgatgaaatccggtatgttcctacgtacttgggagtcggccat

SEQ ID NO: 6354 - DNA, 140 bp, Artificial Sequence
  Synthetic
atggccgactcccaagtacgtaggaacataccggatttcatcatagcgccgaacttgaagcgcgtacctgtcggcaggtgacagctagaaatctctccaaaagcagcctctatcaagtccggagacccagcatggcgtat

SEQ ID NO: 6355 - DNA, 140 bp, Artificial Sequence
  Synthetic
atacgccatgctgggtctccagccccatggtattggagatggagctacaatcagtcaccttggaaccaacactgtcacttgactacatcacgtgcgagtacaaaactgtcattccctccccgtacttgggagtcggccat

SEQ ID NO: 6356 - DNA, 140 bp, Artificial Sequence
  Synthetic
atggccgactcccaagtacggggagggaatgacagttttgtactcgcacgtgatgtagtcaagtgacagtgttggttccaaggtgactgattgtagctccatctccaataccatggggctggagacccagcatggcgtat

SEQ ID NO: 6357 - DNA, 140 bp, Artificial Sequence
  Synthetic
aggccctggctgctgatatgcgtacgtgaagtgctgtggtacagcagagtgcaaggacaagagcctaccagactacagctgcaaggtctttactggagtctacccatttatgtggggcgggaccttttgggacagcggtg

SEQ ID NO: 6358 - DNA, 140 bp, Artificial Sequence
  Synthetic
caccgctgtcccaaaaggtcccgccccacataaatgggtagactccagtaaagaccttgcagctgtagtctggtaggctcttgtccttgcactctgctgtaccacagcacttcacgtacgcatatcagcagccagggcct

SEQ ID NO: 6359 - DNA, 140 bp, Artificial Sequence
  Synthetic
atacgccatgctgggtctccgactacagctgcaaggtctttactggagtctacccatttatgtggggcggcgcctactgcttttgcgacgccgaaaatacgcaattgagcgaggcacatgcgtacttgggagtcggccat

SEQ ID NO: 6360 - DNA, 140 bp, Artificial Sequence
  Synthetic
atggccgactcccaagtacgcatgtgcctcgctcaattgcgtattttcggcgtcgcaaaagcagtaggcgccgccccacataaatgggtagactccagtaaagaccttgcagctgtagtcggagacccagcatggcgtat

SEQ ID NO: 6361 - DNA, 140 bp, Artificial Sequence
  Synthetic
atacgccatgctgggtctccgtgggtgacgcacaagaaggagatcaggttaaccgtgccgactgaagggctcgaggtcacgtggggtaacaatgagccgtacaagtattggccgcagttacgtacttgggagtcggccat

SEQ ID NO: 6362 - DNA, 140 bp, Artificial Sequence
  Synthetic
atggccgactcccaagtacgtaactgcggccaatacttgtacggctcattgttaccccacgtgacctcgagcccttcagtcggcacggttaacctgatctccttcttgtgcgtcacccacggagacccagcatggcgtat

SEQ ID NO: 6363 - DNA, 140 bp, Artificial Sequence
  Synthetic
aggccctggctgctgatatgtcgaggtcacgtggggtaacaatgagccgtacaagtattggccgcagttatccacaaacggtacggcccacggccacccgcatgagataattctgtattagaccttttgggacagcggtg

SEQ ID NO: 6364 - DNA, 140 bp, Artificial Sequence
  Synthetic
caccgctgtcccaaaaggtctaatacagaattatctcatgcgggtggccgtgggccgtaccgtttgtggataactgcggccaatacttgtacggctcattgttaccccacgtgacctcgacatatcagcagccagggcct

SEQ ID NO: 6365 - DNA, 140 bp, Artificial Sequence
  Synthetic
aggccctggctgctgatatgcaggtacgcgcttcaagttcggcgctatgatgaaatccggtatgttcctaactctgtttgtcaacacattgttaaatatcaccatcgctagccgggtgttgaccttttgggacagcggtg

SEQ ID NO: 6366 - DNA, 140 bp, Artificial Sequence
  Synthetic
caccgctgtcccaaaaggtcaacacccggctagcgatggtgatatttaacaatgtgttgacaaacagagttaggaacataccggatttcatcatagcgccgaacttgaagcgcgtacctgcatatcagcagccagggcct

SEQ ID NO: 6367 - DNA, 140 bp, Artificial Sequence
  Synthetic
aggccctggctgctgatatgcattaccgtagctgcctacgctaacggcgatcatgccgtcacagtaaaggacgctaagtttgtcgtgggaccaatgtcctccgcctggacaccttttgacgaccttttgggacagcggtg

SEQ ID NO: 6368 - DNA, 140 bp, Artificial Sequence
  Synthetic
caccgctgtcccaaaaggtcgtcaaaaggtgtccaggcggaggacattggtcccacgacaaacttagcgtcctttactgtgacggcatgatcgccgttagcgtaggcagctacggtaatgcatatcagcagccagggcct

SEQ ID NO: 6369 - DNA, 140 bp, Artificial Sequence
  Synthetic
atacgccatgctgggtctcccgacgcagatgtattacaccgtacgaactgacaccaggagctaccgtccctttcctgcttagcctaatatgctgcattagaacagctaaagcagccacatcgtacttgggagtcggccat

SEQ ID NO: 6370 - DNA, 140 bp, Artificial Sequence
  Synthetic
atggccgactcccaagtacgatgtggctgctttagctgttctaatgcagcatattaggctaagcaggaaagggacggtagctcctggtgtcagttcgtacggtgtaatacatctgcgtcgggagacccagcatggcgtat

SEQ ID NO: 6371 - DNA, 140 bp, Artificial Sequence
  Synthetic
atacgccatgctgggtctccttttggcgcaggaagaccaggacaatttggtgacattcaaagtcgtacaccggaaagtaaagacgtttatgccaacactcagttggtactacagaggccacgtacttgggagtcggccat

SEQ ID NO: 6372 - DNA, 140 bp, Artificial Sequence
  Synthetic
atggccgactcccaagtacgtggcctctgtagtaccaactgagtgttggcataaacgtctttactttccggtgtacgactttgaatgtcaccaaattgtcctggtcttcctgcgccaaaaggagacccagcatggcgtat

SEQ ID NO: 6373 - DNA, 140 bp, Artificial Sequence
  Synthetic
atacgccatgctgggtctcctaccgcatccgcatcagccaagctccgcgtcctttaccaaggaaataatgtcactgtatctgcttatgcaaacggcgaccatgccgtcacagttaaggaccgtacttgggagtcggccat

SEQ ID NO: 6374 - DNA, 140 bp, Artificial Sequence
  Synthetic
atggccgactcccaagtacggtccttaactgtgacggcatggtcgccgtttgcataagcagatacagtgacattatttccttggtaaaggacgcggagcttggctgatgcggatgcggtaggagacccagcatggcgtat

SEQ ID NO: 6375 - DNA, 140 bp, Artificial Sequence
  Synthetic
atacgccatgctgggtctccgtattggctgaaggaacgaggagcatcgctacagcacacggcaccgttcggttgccagattgcgacaaacccggtaagagctgtaaattgcgctgtggggcgtacttgggagtcggccat

SEQ ID NO: 6376 - DNA, 140 bp, Artificial Sequence
  Synthetic
atggccgactcccaagtacgccccacagcgcaatttacagctcttaccgggtttgtcgcaatctggcaaccgaacggtgccgtgtgctgtagcgatgctcctcgttccttcagccaatacggagacccagcatggcgtat

SEQ ID NO: 6377 - DNA, 140 bp, Artificial Sequence
  Synthetic
aggccctggctgctgatatgtcggcgcaggaagaccaggacaatttggcgacatccaaagtcgcacgcctgagagcgaagacatctatgctaacacacaactggtactgcagagaccgtcgaccttttgggacagcggtg

SEQ ID NO: 6378 - DNA, 140 bp, Artificial Sequence
  Synthetic
caccgctgtcccaaaaggtcgacggtctctgcagtaccagttgtgtgttagcatagatgtcttcgctctcaggcgtgcgactttggatgtcgccaaattgtcctggtcttcctgcgccgacatatcagcagccagggcct

SEQ ID NO: 6379 - DNA, 140 bp, Artificial Sequence
  Synthetic
aggccctggctgctgatatgcgtcacacaccacccccggggtccaagacatttccgctacggcgatgtcatgggtgcagaagatcacgggaggtgtgggactggttgttgctgttgcagcgaccttttgggacagcggtg

SEQ ID NO: 6380 - DNA, 140 bp, Artificial Sequence
  Synthetic
caccgctgtcccaaaaggtcgctgcaacagcaacaaccagtcccacacctcccgtgatcttctgcacccatgacatcgccgtagcggaaatgtcttggaccccgggggtggtgtgtgacgcatatcagcagccagggcct

SEQ ID NO: 6381 - DNA, 140 bp, Artificial Sequence
  Synthetic
aggccctggctgctgatatgcgatgcaccctctgtaacggacatgtcatgcgaagtaccagcctgcactcactcctccgactttgggggcgtcgccatcatcaaatatacagctagcaaggaccttttgggacagcggtg

SEQ ID NO: 6382 - DNA, 140 bp, Artificial Sequence
  Synthetic
caccgctgtcccaaaaggtccttgctagctgtatatttgatgatggcgacgcccccaaagtcggaggagtgagtgcaggctggtacttcgcatgacatgtccgttacagagggtgcatcgcatatcagcagccagggcct

SEQ ID NO: 6383 - DNA, 140 bp, Artificial Sequence
  Synthetic
aggccctggctgctgatatgtagctaagaatcaatagataagcatagatcaaagggctgaataacccctgaataataacaaaatataaaatcaataaaaatcataaaatagaaaaccatagaccttttgggacagcggtg

SEQ ID NO: 6384 - DNA, 140 bp, Artificial Sequence
  Synthetic
caccgctgtcccaaaaggtctatggttttctattttatgatttttattgattttatattttgttattattcaggggttattcagccctttgatctatgcttatctattgattcttagctacatatcagcagccagggcct

SEQ ID NO: 6385 - DNA, 140 bp, Artificial Sequence
  Synthetic
aggccctggctgctgatatgaaaggtaaatgtgcagtacattcgatgaccaacgccgttaccattcgagaagccgacgtagaagtagaggggaactcccagctgcaaatatccttctcaagaccttttgggacagcggtg

SEQ ID NO: 6386 - DNA, 140 bp, Artificial Sequence
  Synthetic
caccgctgtcccaaaaggtcttgagaaggatatttgcagctgggagttcccctctacttctacgtcggcttctcgaatggtaacggcgttggtcatcgaatgtactgcacatttacctttcatatcagcagccagggcct

SEQ ID NO: 6387 - DNA, 140 bp, Artificial Sequence
  Synthetic
atacgccatgctgggtctccaacagaagtagttcaaagggctataaaacccctgaatagtaacaaaacataaaactaatagaaatcaaatgaataccataattggcaatcggaagagatgcgtacttgggagtcggccat

SEQ ID NO: 6388 - DNA, 140 bp, Artificial Sequence
  Synthetic
atggccgactcccaagtacgcatctcttccgattgccaattatggtattcatttgatttctattagttttatgttttgttactattcaggggttttatagccctttgaactacttctgttggagacccagcatggcgtat

SEQ ID NO: 6389 - DNA, 140 bp, Artificial Sequence
  Synthetic
atacgccatgctgggtctcccagccttggcaagcgccgagtttcgcgtgcaagtgtgctccacacaagtacactgcgcagccgcatgccaccctccaaaggaccacatagtcaattaccccgtacttgggagtcggccat

SEQ ID NO: 6390 - DNA, 140 bp, Artificial Sequence
  Synthetic
atggccgactcccaagtacggggtaattgactatgtggtcctttggagggtggcatgcggctgcgcagtgtacttgtgtggagcacacttgcacgcgaaactcggcgcttgccaaggctgggagacccagcatggcgtat

SEQ ID NO: 6391 - DNA, 140 bp, Artificial Sequence
  Synthetic
atacgccatgctgggtctccagcatcacacaccacccttggggtccaggatatatccacaacggcaatgtcttgggtgcagaagatcacgggaggagtaggattaattgttgctgttgctcgtacttgggagtcggccat

SEQ ID NO: 6392 - DNA, 140 bp, Artificial Sequence
  Synthetic
atggccgactcccaagtacgagcaacagcaacaattaatcctactcctcccgtgatcttctgcacccaagacattgccgttgtggatatatcctggaccccaagggtggtgtgtgatgctggagacccagcatggcgtat

SEQ ID NO: 6393 - DNA, 140 bp, Artificial Sequence
  Synthetic
aggccctggctgctgatatggtagcacaccgaactcttccataattctccgaacccacagggacgtaggagatgttcaaagtgactataaaaaaccctgaacagtaataaaacataaaatgaccttttgggacagcggtg

SEQ ID NO: 6394 - DNA, 140 bp, Artificial Sequence
  Synthetic
caccgctgtcccaaaaggtcattttatgttttattactgttcagggttttttatagtcactttgaacatctcctacgtccctgtgggttcggagaattatggaagagttcggtgtgctaccatatcagcagccagggcct

SEQ ID NO: 6395 - DNA, 140 bp, Artificial Sequence
  Synthetic
atacgccatgctgggtctccgccttaattttaattgtggtgctatgcgtgtcgtttagcaggcactaaaccgatgataaggcacgaaataactaaatagtaaaagtagaaagtacataaccgtacttgggagtcggccat

SEQ ID NO: 6396 - DNA, 140 bp, Artificial Sequence
  Synthetic
atggccgactcccaagtacggttatgtactttctacttttactatttagttatttcgtgccttatcatcggtttagtgcctgctaaacgacacgcatagcaccacaattaaaattaaggcggagacccagcatggcgtat

SEQ ID NO: 6397 - DNA, 140 bp, Artificial Sequence
  Synthetic
aggccctggctgctgatatgcgatgataaggcacgaaataactaaatagtaaaagtagaaagtacataactaggtatatgtgccccctaagaggcacaatatatatagctaagcaccattgaccttttgggacagcggtg

SEQ ID NO: 6398 - DNA, 140 bp, Artificial Sequence
  Synthetic
caccgctgtcccaaaaggtcaatggtgcttagctatatatattgtgcctcttagggggcacatatacctagttatgtactttctacttttactatttagttatttcgtgccttatcatcgcatatcagcagccagggcct

SEQ ID NO: 6399 - DNA, 140 bp, Artificial Sequence
  Synthetic
aggccctggctgctgatatgaagagacgtaggtacttaagcttcctaaaagcagccgaactcactttgagatgtaggcatagcataccgaactcttccacaattctccgtacccataggggaccttttgggacagcggtg

SEQ ID NO: 6400 - DNA, 140 bp, Artificial Sequence
  Synthetic
caccgctgtcccaaaaggtcccctatgggtacggagaattgtggaagagttcggtatgctatgcctacatctcaaagtgagttcggctgcttttaggaagcttaagtacctacgtctcttcatatcagcagccagggcct

SEQ ID NO: 6401 - DNA, 140 bp, Artificial Sequence
  Synthetic
aggccctggctgctgatatgtaaaaatcataaaaagaaaaatctcataaacaggtatacgtgtcccctaagagacacattgtatgtaggtagtagagacacattgtatgtaggtagtaaggaccttttgggacagcggtg

SEQ ID NO: 6402 - DNA, 140 bp, Artificial Sequence
  Synthetic
caccgctgtcccaaaaggtccttactacctacatacaatgtgtctctactacctacatacaatgtgtctcttaggggacacgtatacctgtttatgagatttttctttttatgatttttacatatcagcagccagggcct

SEQ ID NO: 6403 - DNA, 140 bp, Artificial Sequence
  Synthetic
aggccctggctgctgatatgtatagatcaaagggctatattaacccctgaatagtaacaaaacacaaaaacaataaaaactacaaaatagaaaatctataaacaaaagtagttcaaaggggaccttttgggacagcggtg

SEQ ID NO: 6404 - DNA, 140 bp, Artificial Sequence
  Synthetic
caccgctgtcccaaaaggtcccctttgaactacttttgtttatagattttctattttgtagtttttattgtttttgtgttttgttactattcaggggttaatatagccctttgatctatacatatcagcagccagggcct

SEQ ID NO: 6405 - DNA, 140 bp, Artificial Sequence
  Synthetic
aggccctggctgctgatatggcaacgagaagagacgtaggtatttaagcttcctaaaagcagccgaactcactttgagacgtaggcatagcataccgaactcttccactattctccgaacgaccttttgggacagcggtg

SEQ ID NO: 6406 - DNA, 140 bp, Artificial Sequence
  Synthetic
caccgctgtcccaaaaggtcgttcggagaatagtggaagagttcggtatgctatgcctacgtctcaaagtgagttcggctgcttttaggaagcttaaatacctacgtctcttctcgttgccatatcagcagccagggcct

SEQ ID NO: 6407 - DNA, 140 bp, Artificial Sequence
  Synthetic
aggccctggctgctgatatgcaaagcaagagatcaataacccatcatggattctgtgtacgtggatatagacgctgacagcgcctttttgaaggccctgcaacgtgcgtaccccatgtttgaccttttgggacagcggtg

SEQ ID NO: 6408 - DNA, 140 bp, Artificial Sequence
  Synthetic
caccgctgtcccaaaaggtcaaacatggggtacgcacgttgcagggccttcaaaaaggcgctgtcagcgtctatatccacgtacacagaatccatgatgggttattgatctcttgctttgcatatcagcagccagggcct

SEQ ID NO: 6409 - DNA, 140 bp, Artificial Sequence
  Synthetic
atacgccatgctgggtctcctgacaaaatccgcgtgcgcggccttcatcggcgacgacaacataatacatggagtcgtctccgatgaattgatggcagccagatgtgccacttggatgaacgtacttgggagtcggccat

SEQ ID NO: 6410 - DNA, 140 bp, Artificial Sequence
  Synthetic
atggccgactcccaagtacgttcatccaagtggcacatctggctgccatcaattcatcggagacgactccatgtattatgttgtcgtcgccgatgaaggccgcgcacgcggattttgtcaggagacccagcatggcgtat

SEQ ID NO: 6411 - DNA, 140 bp, Artificial Sequence
  Synthetic
aggccctggctgctgatatgacgtgttgtacgtagacgaggcgtttgcgtgccactctggaacgctacttgctttgatcgccttggtgagaccaaggcagaaagttgtactgtgtggtgagaccttttgggacagcggtg

SEQ ID NO: 6412 - DNA, 140 bp, Artificial Sequence
  Synthetic
caccgctgtcccaaaaggtctcaccacacagtacaactttctgccttggtctcaccaaggcgatcaaagcaagtagcgttccagagtggcacgcaaacgcctcgtctacgtacaacacgtcatatcagcagccagggcct

SEQ ID NO: 6413 - DNA, 140 bp, Artificial Sequence
  Synthetic
aggccctggctgctgatatgcccctcatactcgacaaattgggcggatgagcaggtactgaaggctaagaacataggattatgttcaacagacctgacggaaggtagacgaggcaaattggaccttttgggacagcggtg

SEQ ID NO: 6414 - DNA, 140 bp, Artificial Sequence
  Synthetic
caccgctgtcccaaaaggtccaatttgcctcgtctaccttccgtcaggtctgttgaacataatcctatgttcttagccttcagtacctgctcatccgcccaatttgtcgagtatgaggggcatatcagcagccagggcct

SEQ ID NO: 6415 - DNA, 140 bp, Artificial Sequence
  Synthetic
aggccctggctgctgatatgttcacagtagatatgaaaagggacgtaaaggtgactcctggtacaaagcatacagaggaaagacctaaggtgcaggttatacaggcagctgaccccttgggaccttttgggacagcggtg

SEQ ID NO: 6416 - DNA, 140 bp, Artificial Sequence
  Synthetic
caccgctgtcccaaaaggtcccaaggggtcagctgcctgtataacctgcaccttaggtctttcctctgtatgctttgtaccaggagtcacctttacgtcccttttcatatctactgtgaacatatcagcagccagggcct

SEQ ID NO: 6417 - DNA, 140 bp, Artificial Sequence
  Synthetic
aggccctggctgctgatatgacgaacaccatgaagaactatctacttcccgtggtcgcccaggccttcagtaagtgggcgaaggagtgccggaaggacatggaagatgagaagcttctgggaccttttgggacagcggtg

SEQ ID NO: 6418 - DNA, 140 bp, Artificial Sequence
  Synthetic
caccgctgtcccaaaaggtcccagaagcttctcatcttccatgtccttccggcactccttcgcccacttactgaaggcctgggcgaccacgggaagtagatagttcttcatggtgttcgtcatatcagcagccagggcct

SEQ ID NO: 6419 - DNA, 140 bp, Artificial Sequence
  Synthetic
aggccctggctgctgatatgatggccacctttgcaagctccagatccaacttcgagaagctcagaggacccgtcataactttgtacggcggtcctaaataggtacgcactacagctacctgaccttttgggacagcggtg

SEQ ID NO: 6420 - DNA, 140 bp, Artificial Sequence
  Synthetic
caccgctgtcccaaaaggtcaggtagctgtagtgcgtacctatttaggaccgccgtacaaagttatgacgggtcctctgagcttctcgaagttggatctggagcttgcaaaggtggccatcatatcagcagccagggcct

SEQ ID NO: 6421 - DNA, 140 bp, Artificial Sequence
  Synthetic
aggccctggctgctgatatggggtcagagaaagaacactaacctgctgctgtctgtgggcatttaagaagcagaaaacacacacggtctacaagaggcctgatacccagtcaatccagaagaccttttgggacagcggtg

SEQ ID NO: 6422 - DNA, 140 bp, Artificial Sequence
  Synthetic
caccgctgtcccaaaaggtcttctggattgactgggtatcaggcctcttgtagaccgtgtgtgttttctgcttcttaaatgcccacagacagcagcaggttagtgttctttctctgaccccatatcagcagccagggcct

SEQ ID NO: 6423 - DNA, 140 bp, Artificial Sequence
  Synthetic
aggccctggctgctgatatgggttgtcaatcccgttgaggactagaatcaagtggctgttacgcaaggtgccgaaagcagacctgatcccatacagcggaaatgcccaagaagcccaggagaccttttgggacagcggtg

SEQ ID NO: 6424 - DNA, 140 bp, Artificial Sequence
  Synthetic
caccgctgtcccaaaaggtctcctgggcttcttgggcatttccgctgtatgggatcaggtctgctttcggcaccttgcgtaacagccacttgattctagtcctcaacgggattgacaacccatatcagcagccagggcct

SEQ ID NO: 6425 - DNA, 140 bp, Artificial Sequence
  Synthetic
aggccctggctgctgatatgctctaccacccctacaggcagcacaggaagatgtccaggtcgaaatcgacgtggaacaacttgaggatagagctggtgctggaataatagagactccgaggaccttttgggacagcggtg

SEQ ID NO: 6426 - DNA, 140 bp, Artificial Sequence
  Synthetic
caccgctgtcccaaaaggtcctcggagtctctattattccagcaccagctctatcctcaagttgttccacgtcgatttcgacctggacatcttcctgtgctgcctgtaggggtggtagagcatatcagcagccagggcct

SEQ ID NO: 6427 - DNA, 140 bp, Artificial Sequence
  Synthetic
aggccctggctgctgatatgtctgacggtgggattcactgacagtaggaagattagtcactcatgtacgcacccatttcaccacgaccctcctgtgataggtcgggaaaaattccattccgaccttttgggacagcggtg

SEQ ID NO: 6428 - DNA, 140 bp, Artificial Sequence
  Synthetic
caccgctgtcccaaaaggtcggaatggaatttttcccgacctatcacaggagggtcgtggtgaaatgggtgcgtacatgagtgactaatcttcctactgtcagtgaatcccaccgtcagacatatcagcagccagggcct

SEQ ID NO: 6429 - DNA, 140 bp, Artificial Sequence
  Synthetic
atacgccatgctgggtctccgtggaacaacttgaggatagagctggtgctggaataatagagactccgagaggcgctattaaagttactgcccaactaaccgaccacgtcgtgggggagtcgtacttgggagtcggccat

SEQ ID NO: 6430 - DNA, 140 bp, Artificial Sequence
  Synthetic
atggccgactcccaagtacgactcccccacgacgtggtcggttagttgggcagtaactttaatagcgcctctcggagtctctattattccagcaccagctctatcctcaagttgttccacggagacccagcatggcgtat

SEQ ID NO: 6431 - DNA, 140 bp, Artificial Sequence
  Synthetic
atacgccatgctgggtctccacctggtactttccccgcagaccgtattacgcagccagaagctcagcctgatccacgctttagcggagcaagtgaagacgtgtacgcatagcggacgagccgtacttgggagtcggccat

SEQ ID NO: 6432 - DNA, 140 bp, Artificial Sequence
  Synthetic
atggccgactcccaagtacggctcgtccgctatgcgtacacgtcttcacttgctccgctaaagcgtggatcaggctgagcttctggctgcgtaatacggtctgcggggaaagtaccaggtggagacccagcatggcgtat

SEQ ID NO: 6433 - DNA, 140 bp, Artificial Sequence
  Synthetic
atacgccatgctgggtctccagggaggtatgcggtcgaagcgtacgatggccgagttctagtgccctcaggctatgcaatttcgcctgaagacttccagagtctaagcgaaagcgcaacgcgtacttgggagtcggccat

SEQ ID NO: 6434 - DNA, 140 bp, Artificial Sequence
  Synthetic
atggccgactcccaagtacgcgttgcgctttcgcttagactctggaagtcttcaggcgaaattgcatagcctgagggcactagaactcggccatcgtacgcttcgaccgcatacctccctggagacccagcatggcgtat

SEQ ID NO: 6435 - DNA, 140 bp, Artificial Sequence
  Synthetic
aggccctggctgctgatatggatgcacggaccagccctgaacactgacgaagagtcgtatgagcttgtgagggcagagagaacagaacacgagtacgtctacgacgtggaccagagaagagaccttttgggacagcggtg

SEQ ID NO: 6436 - DNA, 140 bp, Artificial Sequence
  Synthetic
caccgctgtcccaaaaggtctcttctctggtccacgtcgtagacgtactcgtgttctgttctctctgccctcacaagctcatacgactcttcgtcagtgttcagggctggtccgtgcatccatatcagcagccagggcct

SEQ ID NO: 6437 - DNA, 140 bp, Artificial Sequence
  Synthetic
aggccctggctgctgatatggggtacggtacacgtgccatactctcaggcaccatctggctttaagtattggctaaaagaacgcggggcgtcgctgcagcacacagcaccatttggctgcgaccttttgggacagcggtg

SEQ ID NO: 6438 - DNA, 140 bp, Artificial Sequence
  Synthetic
caccgctgtcccaaaaggtcgcagccaaatggtgctgtgtgctgcagcgacgccccgcgttcttttagccaatacttaaagccagatggtgcctgagagtatggcacgtgtaccgtaccccatatcagcagccagggcct

SEQ ID NO: 6439 - DNA, 140 bp, Artificial Sequence
  Synthetic
atacgccatgctgggtctccgacagaaacatttctggaaagatcggggacttacaagaggtgatggccgtgccagacacggagacgccaacattttgcctacacacagatgtctcatgtacgtacttgggagtcggccat

SEQ ID NO: 6440 - DNA, 140 bp, Artificial Sequence
  Synthetic
atggccgactcccaagtacgtacatgagacatctgtgtgtaggcaaaatgttggcgtctccgtgtctggcacggccatcacctcttgtaagtccccgatctttccagaaatgtttctgtcggagacccagcatggcgtat

SEQ ID NO: 6441 - DNA, 140 bp, Artificial Sequence
  Synthetic
atacgccatgctgggtctccccactctggaacgttacttgccttgatcgccttggtgagaccaagactgaaagttgtactttgtggtgacccgaagcagtgcggcttcttcaatatgatgcgtacttgggagtcggccat

SEQ ID NO: 6442 - DNA, 140 bp, Artificial Sequence
  Synthetic
atggccgactcccaagtacgcatcatattgaagaagccgcactgcttcgggtcaccacaaagtacaactttcagtcttggtctcaccaaggcgatcaaggcaagtaacgttccagagtggggagacccagcatggcgtat

SEQ ID NO: 6443 - DNA, 140 bp, Artificial Sequence
  Synthetic
aggccctggctgctgatatggggttgtcaatcccgttgaggactagaatcaagtggctgttacgcaaggtgccgaaagcagacctgatcccatatagcggaaatgcccaagaagcccagggaccttttgggacagcggtg

SEQ ID NO: 6444 - DNA, 140 bp, Artificial Sequence
  Synthetic
caccgctgtcccaaaaggtccctgggcttcttgggcatttccgctatatgggatcaggtctgctttcggcaccttgcgtaacagccacttgattctagtcctcaacgggattgacaaccccatatcagcagccagggcct

SEQ ID NO: 6445 - DNA, 140 bp, Artificial Sequence
  Synthetic
aggccctggctgctgatatgtgcattacgaaggcaaaatgcgcactacgaatgagtacaacatgccgattgtagtggacactacgggctcaacgaaacctgaccctggagacctcgtgttgaccttttgggacagcggtg

SEQ ID NO: 6446 - DNA, 140 bp, Artificial Sequence
  Synthetic
caccgctgtcccaaaaggtcaacacgaggtctccagggtcaggtttcgttgagcccgtagtgtccactacaatcggcatgttgtactcattcgtagtgcgcattttgccttcgtaatgcacatatcagcagccagggcct

SEQ ID NO: 6447 - DNA, 140 bp, Artificial Sequence
  Synthetic
atacgccatgctgggtctccaaagccaacgtttgctgggctaagagcttggtccctatccttgaaacagcggggataaaactaaatgataggcagtggtcccagataattcaagctttcacgtacttgggagtcggccat

SEQ ID NO: 6448 - DNA, 140 bp, Artificial Sequence
  Synthetic
atggccgactcccaagtacgtgaaagcttgaattatctgggaccactgcctatcatttagttttatccccgctgtttcaaggatagggaccaagctcttagcccagcaaacgttggctttggagacccagcatggcgtat

SEQ ID NO: 6449 - DNA, 140 bp, Artificial Sequence
  Synthetic
aggccctggctgctgatatgtttagagcagagcagtgtccgaccgtacaagaaacagcggagacgcgtgacacagctatttcctttcgggcaccgccaagtatcaccgtggaattgagccgaccttttgggacagcggtg

SEQ ID NO: 6450 - DNA, 140 bp, Artificial Sequence
  Synthetic
caccgctgtcccaaaaggtcggctcaattccacggtgatacttggcggtgcccgaaaggaaatagctgtgtcacgcgtctccgctgtttcttgtacggtcggacactgctctgctctaaacatatcagcagccagggcct

SEQ ID NO: 6451 - DNA, 140 bp, Artificial Sequence
  Synthetic
aggccctggctgctgatatgagagcacgtcaacgtactcctaacgcgtacggaaggtaaactggtatggaagacactctctggtgacccgtggataaagacgctgcagaacccaccgaaagaccttttgggacagcggtg

SEQ ID NO: 6452 - DNA, 140 bp, Artificial Sequence
  Synthetic
caccgctgtcccaaaaggtctttcggtgggttctgcagcgtctttatccacgggtcaccagagagtgtcttccataccagtttaccttccgtacgcgttaggagtacgttgacgtgctctcatatcagcagccagggcct

SEQ ID NO: 6453 - DNA, 140 bp, Artificial Sequence
  Synthetic
atacgccatgctgggtctcctttcggagacttcctacccggtgaagtggatgatttgacagatagcgactggtccacgtgctcagacacggacgatgagttatgactagacagggcaggtcgtacttgggagtcggccat

SEQ ID NO: 6454 - DNA, 140 bp, Artificial Sequence
  Synthetic
atggccgactcccaagtacgacctgccctgtctagtcataactcatcgtccgtgtctgagcacgtggaccagtcgctatctgtcaaatcatccacttcaccgggtaggaagtctccgaaaggagacccagcatggcgtat

SEQ ID NO: 6455 - DNA, 140 bp, Artificial Sequence
  Synthetic
atacgccatgctgggtctccaagccaacgtttgctgggctaagagcttggtccctgtcctcgaaacagcggggataaaactaaatgataggcagtggtcccagataattcaagccttcaacgtacttgggagtcggccat

SEQ ID NO: 6456 - DNA, 140 bp, Artificial Sequence
  Synthetic
atggccgactcccaagtacgttgaaggcttgaattatctgggaccactgcctatcatttagttttatccccgctgtttcgaggacagggaccaagctcttagcccagcaaacgttggcttggagacccagcatggcgtat

SEQ ID NO: 6457 - DNA, 140 bp, Artificial Sequence
  Synthetic
aggccctggctgctgatatggggataaaactaaatgataggcagtggtcccagataattcaagccttcaaagaagacaaagcatactcacccgaagtagccctgaatgaaatatgcacgcgaccttttgggacagcggtg

SEQ ID NO: 6458 - DNA, 140 bp, Artificial Sequence
  Synthetic
caccgctgtcccaaaaggtcgcgtgcatatttcattcagggctacttcgggtgagtatgctttgtcttctttgaaggcttgaattatctgggaccactgcctatcatttagttttatccccatatcagcagccagggcct

SEQ ID NO: 6459 - DNA, 140 bp, Artificial Sequence
  Synthetic
atacgccatgctgggtctccttgcgcttaccgccttaatgctgttagaagatttgggagtggatcactgcttgttggacctgatagaggctgcttttggagagatttccagctgtcacctcgtacttgggagtcggccat

SEQ ID NO: 6460 - DNA, 140 bp, Artificial Sequence
  Synthetic
atggccgactcccaagtacgaggtgacagctggaaatctctccaaaagcagcctctatcaggtccaacaagcagtgatccactcccaaatcttctaacagcattaaggcggtaagcgcaaggagacccagcatggcgtat

SEQ ID NO: 6461 - DNA, 140 bp, Artificial Sequence
  Synthetic
atacgccatgctgggtctcctctgtgtattacgcggataaccactgggataataggccgggaggaaagatgttcggattcaaccctgaggcagcgtccattctagaaagaaagtacccgtcgtacttgggagtcggccat

SEQ ID NO: 6462 - DNA, 140 bp, Artificial Sequence
  Synthetic
atggccgactcccaagtacgacgggtactttctttctagaatggacgctgcctcagggttgaatccgaacatctttcctcccggcctattatcccagtggttatccgcgtaatacacagaggagacccagcatggcgtat

SEQ ID NO: 6463 - DNA, 140 bp, Artificial Sequence
  Synthetic
aggccctggctgctgatatggttcggattcaaccctgaggcagcgtccattctagaaagaaagtacccgtttacaaaaggaaagtggaacatcaacaagcagatctgcgtgactaccagggaccttttgggacagcggtg

SEQ ID NO: 6464 - DNA, 140 bp, Artificial Sequence
  Synthetic
caccgctgtcccaaaaggtccctggtagtcacgcagatctgcttgttgatgttccactttccttttgtaaacgggtactttctttctagaatggacgctgcctcagggttgaatccgaaccatatcagcagccagggcct

SEQ ID NO: 6465 - DNA, 140 bp, Artificial Sequence
  Synthetic
aggccctggctgctgatatgcgacagacgggacgttgaaaatccaggtttccttgcaaatcggaataaagacggatgatagccacgattggaccaagctgcgttatatggacaatcacatgaccttttgggacagcggtg

SEQ ID NO: 6466 - DNA, 140 bp, Artificial Sequence
  Synthetic
caccgctgtcccaaaaggtcatgtgattgtccatataacgcagcttggtccaatcgtggctatcatccgtctttattccgatttgcaaggaaacctggattttcaacgtcccgtctgtcgcatatcagcagccagggcct

SEQ ID NO: 6467 - DNA, 140 bp, Artificial Sequence
  Synthetic
aggccctggctgctgatatgcggcgcctactgcttctgcgacaccgaaaatacgcaattgagcgaagcacatgtggagaagtccgaatcatgcaaaacagaatttgcatcagcatacagggaccttttgggacagcggtg

SEQ ID NO: 6468 - DNA, 140 bp, Artificial Sequence
  Synthetic
caccgctgtcccaaaaggtccctgtatgctgatgcaaattctgttttgcatgattcggacttctccacatgtgcttcgctcaattgcgtattttcggtgtcgcagaagcagtaggcgccgcatatcagcagccagggcct

SEQ ID NO: 6469 - DNA, 140 bp, Artificial Sequence
  Synthetic
aggccctggctgctgatatgcggcgcctactgcttctgcgacaccgaaaatacgcaattgagcgaagcacatgtggagaagtccgaatcatgcaaaactgaatttgcatcagcatacagggaccttttgggacagcggtg

SEQ ID NO: 6470 - DNA, 140 bp, Artificial Sequence
  Synthetic
caccgctgtcccaaaaggtccctgtatgctgatgcaaattcagttttgcatgattcggacttctccacatgtgcttcgctcaattgcgtattttcggtgtcgcagaagcagtaggcgccgcatatcagcagccagggcct

SEQ ID NO: 6471 - DNA, 140 bp, Artificial Sequence
  Synthetic
aggccctggctgctgatatgcggcgcctactgcttctgcgacaccgaaaatacgcaattgagcgaagcacatgtggagaagtccgaatcatgcaaaaccgaatttgcatcagcatacagggaccttttgggacagcggtg

SEQ ID NO: 6472 - DNA, 140 bp, Artificial Sequence
  Synthetic
caccgctgtcccaaaaggtccctgtatgctgatgcaaattcggttttgcatgattcggacttctccacatgtgcttcgctcaattgcgtattttcggtgtcgcagaagcagtaggcgccgcatatcagcagccagggcct

SEQ ID NO: 6473 - DNA, 140 bp, Artificial Sequence
  Synthetic
aggccctggctgctgatatgcggcgcctactgcttctgcgacaccgaaaatacgcaattgagcgaagcacatgtggagaagtccgaatcatgcaaaacggaatttgcatcagcatacagggaccttttgggacagcggtg

SEQ ID NO: 6474 - DNA, 140 bp, Artificial Sequence
  Synthetic
caccgctgtcccaaaaggtccctgtatgctgatgcaaattccgttttgcatgattcggacttctccacatgtgcttcgctcaattgcgtattttcggtgtcgcagaagcagtaggcgccgcatatcagcagccagggcct

SEQ ID NO: 6475 - DNA, 140 bp, Artificial Sequence
  Synthetic
aggccctggctgctgatatgaggtactaagcttcttaaaagcagccgaactcactttgagatgtaggcatagcataccgaactcttccacaattctccgaacccacagggacgtaggagagaccttttgggacagcggtg

SEQ ID NO: 6476 - DNA, 140 bp, Artificial Sequence
  Synthetic
caccgctgtcccaaaaggtctctcctacgtccctgtgggttcggagaattgtggaagagttcggtatgctatgcctacatctcaaagtgagttcggctgcttttaagaagcttagtacctcatatcagcagccagggcct

SEQ ID NO: 6477 - DNA, 140 bp, Artificial Sequence
  Synthetic
aggccctggctgctgatatgcacgtagcctaccagtttcttactgctctactctgcaaagcaagagattaataacccatcatggatcctgtgtacgtggacatagacgctgacagcgcctgaccttttgggacagcggtg

SEQ ID NO: 6478 - DNA, 140 bp, Artificial Sequence
  Synthetic
caccgctgtcccaaaaggtcaggcgctgtcagcgtctatgtccacgtacacaggatccatgatgggttattaatctcttgctttgcagagtagagcagtaagaaactggtaggctacgtgcatatcagcagccagggcct

SEQ ID NO: 6479 - DNA, 140 bp, Artificial Sequence
  Synthetic
aggccctggctgctgatatgttaacggacatgtcgtgcgaggtaccagcctgcacccattcctcagactttgggggcgtcgccattattaaatatgcagccagcaagaaaggcaagtgtggaccttttgggacagcggtg

SEQ ID NO: 6480 - DNA, 140 bp, Artificial Sequence
  Synthetic
caccgctgtcccaaaaggtccacacttgcctttcttgctggctgcatatttaataatggcgacgcccccaaagtctgaggaatgggtgcaggctggtacctcgcacgacatgtccgttaacatatcagcagccagggcct

SEQ ID NO: 6481 - DNA, 140 bp, Artificial Sequence
  Synthetic
aggccctggctgctgatatggagaaagctagcatctgccgcaggaaaagtcctggacagaaacatctctggaaagatcggggacttacaagcagtaatggccgtgccagacaaggaaacggaccttttgggacagcggtg

SEQ ID NO: 6482 - DNA, 140 bp, Artificial Sequence
  Synthetic
caccgctgtcccaaaaggtccgtttccttgtctggcacggccattactgcttgtaagtccccgatctttccagagatgtttctgtccaggacttttcctgcggcagatgctagctttctccatatcagcagccagggcct

SEQ ID NO: 6483 - DNA, 140 bp, Artificial Sequence
  Synthetic
atacgccatgctgggtctccggacatcgcgaagaacgatgaagagtgcgtggtcaacgccgccaaccctcgcgggttaccgggtgacggtgtttgcaaggcagtatataaaaaatggccgcgtacttgggagtcggccat

SEQ ID NO: 6484 - DNA, 140 bp, Artificial Sequence
  Synthetic
atggccgactcccaagtacgcggccattttttatatactgccttgcaaacaccgtcacccggtaacccgcgagggttggcggcgttgaccacgcactcttcatcgttcttcgcgatgtccggagacccagcatggcgtat

SEQ ID NO: 6485 - DNA, 140 bp, Artificial Sequence
  Synthetic
aggccctggctgctgatatgagagacacattgtatgtaggtgataagtatagatcaaagggccgaataacccctgaatagtaacaaaatatgaaaatcaatagaaatcataaaatagaaagaccttttgggacagcggtg

SEQ ID NO: 6486 - DNA, 140 bp, Artificial Sequence
  Synthetic
caccgctgtcccaaaaggtctttctattttatgatttctattgattttcatattttgttactattcaggggttattcggccctttgatctatacttatcacctacatacaatgtgtctctcatatcagcagccagggcct

SEQ ID NO: 6487 - DNA, 140 bp, Artificial Sequence
  Synthetic
atacgccatgctgggtctccgagtcctttaaaaatagtgcaacaccagtaggaactgcaaaaacagttatgtgcggtacatatccagtaatccacgccgtaggaccaaacttctcaaattcgtacttgggagtcggccat

SEQ ID NO: 6488 - DNA, 140 bp, Artificial Sequence
  Synthetic
atggccgactcccaagtacgaatttgagaagtttggtcctacggcgtggattactggatatgtaccgcacataactgtttttgcagttcctactggtgttgcactatttttaaaggactcggagacccagcatggcgtat

SEQ ID NO: 6489 - DNA, 140 bp, Artificial Sequence
  Synthetic
atacgccatgctgggtctccacacggagtccgaaggggaccgggaattggcggctgcctatcgagaagtcgcaaaggaagtaactagactgggagtaaatagcgtagctatacctctcctcgtacttgggagtcggccat

SEQ ID NO: 6490 - DNA, 140 bp, Artificial Sequence
  Synthetic
atggccgactcccaagtacgaggagaggtatagctacgctatttactcccagtctagttacttcctttgcgacttctcgataggcagccgccaattcccggtccccttcggactccgtgtggagacccagcatggcgtat

SEQ ID NO: 6491 - DNA, 140 bp, Artificial Sequence
  Synthetic
aggccctggctgctgatatgtataaaactaatagagcaggaaattgatcccgactcaaccatcctggacataggcagcgcgccagcaaggaggatgatgtcggataggaagtatcactgcgaccttttgggacagcggtg

SEQ ID NO: 6492 - DNA, 140 bp, Artificial Sequence
  Synthetic
caccgctgtcccaaaaggtcgcagtgatacttcctatccgacatcatcctccttgctggcgcgctgcctatgtccaggatggttgagtcgggatcaatttcctgctctattagttttatacatatcagcagccagggcct

SEQ ID NO: 6493 - DNA, 140 bp, Artificial Sequence
  Synthetic
aggccctggctgctgatatgtgccgagacaaggaatgggagaagaaaatatctgaggccatacagatgcggacccaagtggagctgctggatgagcacatctccatagactgcgatgtcagaccttttgggacagcggtg

SEQ ID NO: 6494 - DNA, 140 bp, Artificial Sequence
  Synthetic
caccgctgtcccaaaaggtctgacatcgcagtctatggagatgtgctcatccagcagctccacttgggtccgcatctgtatggcctcagatattttcttctcccattccttgtctcggcacatatcagcagccagggcct

SEQ ID NO: 6495 - DNA, 140 bp, Artificial Sequence
  Synthetic
aggccctggctgctgatatgttcgcgtgcaccctgacagtagtttggcaggtagaaaaggatacagcaccacggaaggcgcactgtattcatatctagaagggacacgttttcaccagacgaccttttgggacagcggtg

SEQ ID NO: 6496 - DNA, 140 bp, Artificial Sequence
  Synthetic
caccgctgtcccaaaaggtcgtctggtgaaaacgtgtcccttctagatatgaatacagtgcgccttccgtggtgctgtatccttttctacctgccaaactactgtcagggtgcacgcgaacatatcagcagccagggcct

SEQ ID NO: 6497 - DNA, 140 bp, Artificial Sequence
  Synthetic
atacgccatgctgggtctccacggaaggcgcactgtattcatatctagaagggacacgttttcaccagacggcagtggatgtggcagagatacatactatgtggccaaagcaaacagaggcgtacttgggagtcggccat

SEQ ID NO: 6498 - DNA, 140 bp, Artificial Sequence
  Synthetic
atggccgactcccaagtacgcctctgtttgctttggccacatagtatgtatctctgccacatccactgccgtctggtgaaaacgtgtcccttctagatatgaatacagtgcgccttccgtggagacccagcatggcgtat

SEQ ID NO: 6499 - DNA, 140 bp, Artificial Sequence
  Synthetic
aggccctggctgctgatatgtgtgcaagactaccgacacggttgacggcgaaagagtgtcattctcggtgtgcacatacgtgccggcgaccatttgtgatcaaatgaccggcatccttgcgaccttttgggacagcggtg

SEQ ID NO: 6500 - DNA, 140 bp, Artificial Sequence
  Synthetic
caccgctgtcccaaaaggtcgcaaggatgccggtcatttgatcacaaatggtcgccggcacgtatgtgcacaccgagaatgacactctttcgccgtcaaccgtgtcggtagtcttgcacacatatcagcagccagggcct

SEQ ID NO: 6501 - DNA, 140 bp, Artificial Sequence
  Synthetic
aggccctggctgctgatatgatgacctagtgattataaacatccacacaccctttcgcatacatcattaccaacagtgcgtggatcatgcaatgaagctgcagatgctcggaggagactcgaccttttgggacagcggtg

SEQ ID NO: 6502 - DNA, 140 bp, Artificial Sequence
  Synthetic
caccgctgtcccaaaaggtcgagtctcctccgagcatctgcagcttcattgcatgatccacgcactgttggtaatgatgtatgcgaaagggtgtgtggatgtttataatcactaggtcatcatatcagcagccagggcct

SEQ ID NO: 6503 - DNA, 140 bp, Artificial Sequence
  Synthetic
atacgccatgctgggtctccaggcagaaatgcccggtggatgatgcagatgcatcatctcccccgaaaactgtcccgtgcctttgccgttatgccatgactcctgaacgcgtcacccgaccgtacttgggagtcggccat

SEQ ID NO: 6504 - DNA, 140 bp, Artificial Sequence
  Synthetic
atggccgactcccaagtacggtcgggtgacgcgttcaggagtcatggcataacggcaaaggcacgggacagttttcgggggagatgatgcatctgcatcatccaccgggcatttctgcctggagacccagcatggcgtat

SEQ ID NO: 6505 - DNA, 140 bp, Artificial Sequence
  Synthetic
aggccctggctgctgatatgggtaatccatgcagtaggacctaatttctcaaattactctgagtccgaaggagaccgggaattggcagctgcttaccgagaagtcgctaaagaggtgactgaccttttgggacagcggtg

SEQ ID NO: 6506 - DNA, 140 bp, Artificial Sequence
  Synthetic
caccgctgtcccaaaaggtcagtcacctctttagcgacttctcggtaagcagctgccaattcccggtctccttcggactcagagtaatttgagaaattaggtcctactgcatggattacccatatcagcagccagggcct

SEQ ID NO: 6507 - DNA, 140 bp, Artificial Sequence
  Synthetic
aggccctggctgctgatatgttcgcatgaaccatgtcacaaatataattgtgtgttcttcatttccccttccaaagtacaagatagaaggagtgcaaaaagtcaaatgctccaaggtaatgaccttttgggacagcggtg

SEQ ID NO: 6508 - DNA, 140 bp, Artificial Sequence
  Synthetic
caccgctgtcccaaaaggtcattaccttggagcatttgactttttgcactccttctatcttgtactttggaaggggaaatgaagaacacacaattatatttgtgacatggttcatgcgaacatatcagcagccagggcct

SEQ ID NO: 6509 - DNA, 140 bp, Artificial Sequence
  Synthetic
aggccctggctgctgatatgtaaccaccaagtgacctttgacacgttccagaataaagccaatgtctgctgggcgaagagcttagtccccatcctagaaacagcaggaataaaattaaacgaccttttgggacagcggtg

SEQ ID NO: 6510 - DNA, 140 bp, Artificial Sequence
  Synthetic
caccgctgtcccaaaaggtcgtttaattttattcctgctgtttctaggatggggactaagctcttcgcccagcagacattggctttattctggaacgtgtcaaaggtcacttggtggttacatatcagcagccagggcct

SEQ ID NO: 6511 - DNA, 140 bp, Artificial Sequence
  Synthetic
atacgccatgctgggtctccccgttatgccatgacacccgaacgagtcaccaggcttcgtatgaaccatgtcacaaacataatagtatgctcatcattcccccttccaaagtataaaatacgtacttgggagtcggccat

SEQ ID NO: 6512 - DNA, 140 bp, Artificial Sequence
  Synthetic
atggccgactcccaagtacgtattttatactttggaagggggaatgatgagcatactattatgtttgtgacatggttcatacgaagcctggtgactcgttcgggtgtcatggcataacggggagacccagcatggcgtat

SEQ ID NO: 6513 - DNA, 140 bp, Artificial Sequence
  Synthetic
atacgccatgctgggtctccagcgttgacggtgaggtactgcccgctccgtctgacctggaagctgatgctccgatttcggagccaacaccagacgacagagcggtacttactttgcctccgtacttgggagtcggccat

SEQ ID NO: 6514 - DNA, 140 bp, Artificial Sequence
  Synthetic
atggccgactcccaagtacggaggcaaagtaagtaccgctctgtcgtctggtgttggctccgaaatcggagcatcagcttccaggtcagacggagcgggcagtacctcaccgtcaacgctggagacccagcatggcgtat

SEQ ID NO: 6515 - DNA, 140 bp, Artificial Sequence
  Synthetic
atacgccatgctgggtctcccctggatgctgacgccccagccctagaaccggccctagacgacggggcgatcggaaaccttgcggccgtgtctgactgggtaatgagcaccgtacctgtccgtacttgggagtcggccat

SEQ ID NO: 6516 - DNA, 140 bp, Artificial Sequence
  Synthetic
atggccgactcccaagtacggacaggtacggtgctcattacccagtcagacacggccgcaaggtttccgatcgccccgtcgtctagggccggttctagggctggggcgtcagcatccaggggagacccagcatggcgtat

SEQ ID NO: 6517 - DNA, 140 bp, Artificial Sequence
  Synthetic
atacgccatgctgggtctccgcgccgcctagaagaaggagagggagaaacctgaccgtgatatgtgacgagagagaagggaatataacacccatggctagcgtccgattctttagagcagcgtacttgggagtcggccat

SEQ ID NO: 6518 - DNA, 140 bp, Artificial Sequence
  Synthetic
atggccgactcccaagtacgctgctctaaagaatcggacgctagccatgggtgttatattcccttctctctcgtcacatatcacggtcaggtttctccctctccttcttctaggcggcgcggagacccagcatggcgtat

SEQ ID NO: 6519 - DNA, 140 bp, Artificial Sequence
  Synthetic
aggccctggctgctgatatgacatattctcatccgacaccggccccggccacctgcaacagaggtctgtccgtcagacagtactgccggtaaataccttggaggaagttcaggaggagaagaccttttgggacagcggtg

SEQ ID NO: 6520 - DNA, 140 bp, Artificial Sequence
  Synthetic
caccgctgtcccaaaaggtcttctcctcctgaacttcctccaaggtatttaccggcagtactgtctgacggacagacctctgttgcaggtggccggggccggtgtcggatgagaatatgtcatatcagcagccagggcct

SEQ ID NO: 6521 - DNA, 140 bp, Artificial Sequence
  Synthetic
aggccctggctgctgatatgaaagtagagaacatgaaagcaacaatagtccaaaggctgaagggtggttgcaaactttatttaatgtcggagactccgaaagttcctacctaccgaactagaccttttgggacagcggtg

SEQ ID NO: 6522 - DNA, 140 bp, Artificial Sequence
  Synthetic
caccgctgtcccaaaaggtctagttcggtaggtaggaactttcggagtctccgacattaaataaagtttgcaaccacccttcagcctttggactattgttgctttcatgttctctactttcatatcagcagccagggcct

SEQ ID NO: 6523 - DNA, 140 bp, Artificial Sequence
  Synthetic
atacgccatgctgggtctcctcccttcgggcaccgccaagtatcaccgtggaactgagccatccaccgatctccttcggagcaccaagcgagacgttccccatcacatttggggacttcgcgtacttgggagtcggccat

SEQ ID NO: 6524 - DNA, 140 bp, Artificial Sequence
  Synthetic
atggccgactcccaagtacgcgaagtccccaaatgtgatggggaacgtctcgcttggtgctccgaaggagatcggtggatggctcagttccacggtgatacttggcggtgcccgaagggaggagacccagcatggcgtat

SEQ ID NO: 6525 - DNA, 140 bp, Artificial Sequence
  Synthetic
aggccctggctgctgatatgctccttcggagcaccaagcgagacgttccccatcacatttggggacttcgacgatggagaaatcgaaagcttgtcttctgagctactaactttcggagacgaccttttgggacagcggtg

SEQ ID NO: 6526 - DNA, 140 bp, Artificial Sequence
  Synthetic
caccgctgtcccaaaaggtcgtctccgaaagttagtagctcagaagacaagctttcgatttctccatcgtcgaagtccccaaatgtgatggggaacgtctcgcttggtgctccgaaggagcatatcagcagccagggcct

SEQ ID NO: 6527 - DNA, 140 bp, Artificial Sequence
  Synthetic
atacgccatgctgggtctccacgatggagaaatcgaaagcttgtcttctgagctactaactttcggagacttcctacccggtgaagtggatgatttgacagatagcgactggtccacgtgcgtacttgggagtcggccat

SEQ ID NO: 6528 - DNA, 140 bp, Artificial Sequence
  Synthetic
atggccgactcccaagtacgcacgtggaccagtcgctatctgtcaaatcatccacttcaccgggtaggaagtctccgaaagttagtagctcagaagacaagctttcgatttctccatcgtggagacccagcatggcgtat

SEQ ID NO: 6529 - DNA, 140 bp, Artificial Sequence
  Synthetic
atacgccatgctgggtctccgacagttgcgtcgtaccaaatcactgatgagtacgatgcatacctggacatggtggacgggtcggaaagttgccttgaccgggcgacgttcaatccatcacgtacttgggagtcggccat

SEQ ID NO: 6530 - DNA, 140 bp, Artificial Sequence
  Synthetic
atggccgactcccaagtacgtgatggattgaacgtcgcccggtcaaggcaactttccgacccgtccaccatgtccaggtatgcatcgtactcatcagtgatttggtacgacgcaactgtcggagacccagcatggcgtat

SEQ ID NO: 6531 - DNA, 140 bp, Artificial Sequence
  Synthetic
aggccctggctgctgatatgagaacttgacaacttatgtcacaaaactaaaaggaccaaaagcagcagcattgtttgccaagacacataacctgctaccactgcaggaggtaccgatggagaccttttgggacagcggtg

SEQ ID NO: 6532 - DNA, 140 bp, Artificial Sequence
  Synthetic
caccgctgtcccaaaaggtctccatcggtacctcctgcagtggtagcaggttatgtgtcttggcaaacaatgctgctgcttttggtccttttagttttgtgacataagttgtcaagttctcatatcagcagccagggcct

SEQ ID NO: 6533 - DNA, 140 bp, Artificial Sequence
  Synthetic
aggccctggctgctgatatgtcagtgctgccggtaaacaccctggaggaagttcacgaggagaagtgttacccacctaagctggatgaattaaaggagcaactactacttaagaaactccgaccttttgggacagcggtg

SEQ ID NO: 6534 - DNA, 140 bp, Artificial Sequence
  Synthetic
caccgctgtcccaaaaggtcggagtttcttaagtagtagttgctcctttaattcatccagcttaggtgggtaacacttctcctcgtgaacttcctccagggtgtttaccggcagcactgacatatcagcagccagggcct

SEQ ID NO: 6535 - DNA, 140 bp, Artificial Sequence
  Synthetic
aggccctggctgctgatatgagcacactgaggaaagacctaaagtgcaggtcatacaggcagccgaacctttggcaacagcgtatctgtgtgggatccacagagagttggtcagaaggctgaccttttgggacagcggtg

SEQ ID NO: 6536 - DNA, 140 bp, Artificial Sequence
  Synthetic
caccgctgtcccaaaaggtcagccttctgaccaactctctgtggatcccacacagatacgctgttgccaaaggttcggctgcctgtatgacctgcactttaggtctttcctcagtgtgctcatatcagcagccagggcct

SEQ ID NO: 6537 - DNA, 140 bp, Artificial Sequence
  Synthetic
aggccctggctgctgatatggaagccgcaggactggtactggtgggcgacttgactaatccgccctaccacgaattcgcatatgaagggctaaaaatccgccctgcctgcccatacaaaagaccttttgggacagcggtg

SEQ ID NO: 6538 - DNA, 140 bp, Artificial Sequence
  Synthetic
caccgctgtcccaaaaggtcttttgtatgggcaggcagggcggatttttagcccttcatatgcgaattcgtggtagggcggattagtcaagtcgcccaccagtaccagtcctgcggcttccatatcagcagccagggcct

SEQ ID NO: 6539 - DNA, 140 bp, Artificial Sequence
  Synthetic
aggccctggctgctgatatgaggactttgacgccattattgccgcgcacttcaagccaggggacgccgtattggaaaccgatatagcctcctttgacaagagccaagacgactcgttggcgaccttttgggacagcggtg

SEQ ID NO: 6540 - DNA, 140 bp, Artificial Sequence
  Synthetic
caccgctgtcccaaaaggtcgccaacgagtcgtcttggctcttgtcaaaggaggctatatcggtttccaatacggcgtcccctggcttgaagtgcgcggcaataatggcgtcaaagtcctcatatcagcagccagggcct

SEQ ID NO: 6541 - DNA, 140 bp, Artificial Sequence
  Synthetic
atacgccatgctgggtctcctacatggatgaacatggaagtgaagatcatagatgcggtcgtgtctcagaaagccccgtacttctgcggagggtttatactgtatgatacagtagcaggccgtacttgggagtcggccat

SEQ ID NO: 6542 - DNA, 140 bp, Artificial Sequence
  Synthetic
atggccgactcccaagtacggcctgctactgtatcatacagtataaaccctccgcagaagtacggggctttctgagacacgaccgcatctatgatcttcacttccatgttcatccatgtaggagacccagcatggcgtat

SEQ ID NO: 6543 - DNA, 140 bp, Artificial Sequence
  Synthetic
atacgccatgctgggtctccaggagctacccgaaacaacatgcttatcacgcgccttctatcagaagcgctgtaccttccccattccagaacacactacagaatgtactggcagcagccacgtacttgggagtcggccat

SEQ ID NO: 6544 - DNA, 140 bp, Artificial Sequence
  Synthetic
atggccgactcccaagtacgtggctgctgccagtacattctgtagtgtgttctggaatggggaaggtacagcgcttctgatagaaggcgcgtgataagcatgttgtttcgggtagctcctggagacccagcatggcgtat

SEQ ID NO: 6545 - DNA, 140 bp, Artificial Sequence
  Synthetic
atacgccatgctgggtctcctcaagcatgaaggcaaagtgatgggctacgcatgcctggtgggggataaagtaatgaaaccagcacatgtgaagggaactatcgacaatgccgatttggccgtacttgggagtcggccat

SEQ ID NO: 6546 - DNA, 140 bp, Artificial Sequence
  Synthetic
atggccgactcccaagtacggccaaatcggcattgtcgatagttcccttcacatgtgctggtttcattactttatcccccaccaggcatgcgtagcccatcactttgccttcatgcttgaggagacccagcatggcgtat

SEQ ID NO: 6547 - DNA, 140 bp, Artificial Sequence
  Synthetic
atacgccatgctgggtctcctaaactggccttcaagcggtcgtctaaatacgatcttgaatgtgcacagataccagtgcacatgaagtctgatgcctcgaagtttacccacgagaaaccccgtacttgggagtcggccat

SEQ ID NO: 6548 - DNA, 140 bp, Artificial Sequence
  Synthetic
atggccgactcccaagtacggggtttctcgtgggtaaacttcgaggcatcagacttcatgtgcactggtatctgtgcacattcaagatcgtatttagacgaccgcttgaaggccagtttaggagacccagcatggcgtat

SEQ ID NO: 6549 - DNA, 140 bp, Artificial Sequence
  Synthetic
atacgccatgctgggtctcccttgttctccccaccgccaaagacgcagtactaaggacaattttaatgtctataaagctacaagaccatatctagctcattgtcctgactgcggagaaggcgtacttgggagtcggccat

SEQ ID NO: 6550 - DNA, 140 bp, Artificial Sequence
  Synthetic
atggccgactcccaagtacgccttctccgcagtcaggacaatgagctagatatggtcttgtagctttatagacattaaaattgtccttagtactgcgtctttggcggtggggagaacaagggagacccagcatggcgtat

SEQ ID NO: 6551 - DNA, 140 bp, Artificial Sequence
  Synthetic
aggccctggctgctgatatgcacagtagatatgaaaagggacgtgaaggtaactcctggtacaaagcatacagaggaaaggcctaaggtgcaggttatacaggcggctgaacccttggcagaccttttgggacagcggtg

SEQ ID NO: 6552 - DNA, 140 bp, Artificial Sequence
  Synthetic
caccgctgtcccaaaaggtctgccaagggttcagccgcctgtataacctgcaccttaggcctttcctctgtatgctttgtaccaggagttaccttcacgtcccttttcatatctactgtgcatatcagcagccagggcct

SEQ ID NO: 6553 - DNA, 140 bp, Artificial Sequence
  Synthetic
atacgccatgctgggtctcccagaggaaaggcctaaggtgcaggttatacaggcggctgaacccttggcaacagcgtacctatgtggaattcacagagaattggttaggagattgaacgccgtacttgggagtcggccat

SEQ ID NO: 6554 - DNA, 140 bp, Artificial Sequence
  Synthetic
atggccgactcccaagtacggcgttcaatctcctaaccaattctctgtgaattccacataggtacgctgttgccaagggttcagccgcctgtataacctgcaccttaggcctttcctctgggagacccagcatggcgtat

SEQ ID NO: 6555 - DNA, 140 bp, Artificial Sequence
  Synthetic
aggccctggctgctgatatgtattatgagctgtaccccactatgactgtaatcattgtgtcggtggcctcgttcgtgcttctgtcgatggtgggcacagcagtggggatgtgtgtgtgcggaccttttgggacagcggtg

SEQ ID NO: 6556 - DNA, 140 bp, Artificial Sequence
  Synthetic
caccgctgtcccaaaaggtccgcacacacacatccccactgctgtgcccaccatcgacagaagcacgaacgaggccaccgacacaatgattacagtcatagtggggtacagctcataatacatatcagcagccagggcct

SEQ ID NO: 6557 - DNA, 140 bp, Artificial Sequence
  Synthetic
atacgccatgctgggtctcccacggcgcagatgcattacaccatatgaattaacaccaggagccaccgttccctttctgctcagcctgctatgttgcgtcagaacgaccaaggcggccaccgtacttgggagtcggccat

SEQ ID NO: 6558 - DNA, 140 bp, Artificial Sequence
  Synthetic
atggccgactcccaagtacggtggccgccttggtcgttctgacgcaacatagcaggctgagcagaaagggaacggtggctcctggtgttaattcatatggtgtaatgcatctgcgccgtgggagacccagcatggcgtat

SEQ ID NO: 6559 - DNA, 140 bp, Artificial Sequence
  Synthetic
aggccctggctgctgatatgccctttctgctcagcctgctatgttgcgtcagaacgaccaaggcggccacatattacgaggctgtggcatatctatggaacgaacagcagcccctgttctgaccttttgggacagcggtg

SEQ ID NO: 6560 - DNA, 140 bp, Artificial Sequence
  Synthetic
caccgctgtcccaaaaggtcagaacaggggctgctgttcgttccatagatatgccacagcctcgtaatatgtggccgccttggtcgttctgacgcaacatagcaggctgagcagaaagggcatatcagcagccagggcct

SEQ ID NO: 6561 - DNA, 140 bp, Artificial Sequence
  Synthetic
aggccctggctgctgatatgctcacctgaagtagccctgaatgaaatatgtacgcgcatgtatggggtggatctagacagcgggctattttctaaaccgtcggtgtctgtgtattacgcggaccttttgggacagcggtg

SEQ ID NO: 6562 - DNA, 140 bp, Artificial Sequence
  Synthetic
caccgctgtcccaaaaggtccgcgtaatacacagacaccgacggtttagaaaatagcccgctgtctagatccaccccatacatgcgcgtacatatttcattcagggctacttcaggtgagcatatcagcagccagggcct

SEQ ID NO: 6563 - DNA, 140 bp, Artificial Sequence
  Synthetic
aggccctggctgctgatatgcgaacacggtgggagtaccgtataagactcttgtcaacagaccgggttacagccccatggtattggagatggagctacaatcggtcaccttggaaccaacgaccttttgggacagcggtg

SEQ ID NO: 6564 - DNA, 140 bp, Artificial Sequence
  Synthetic
caccgctgtcccaaaaggtcgttggttccaaggtgaccgattgtagctccatctccaataccatggggctgtaacccggtctgttgacaagagtcttatacggtactcccaccgtgttcgcatatcagcagccagggcct

SEQ ID NO: 6565 - DNA, 140 bp, Artificial Sequence
  Synthetic
aggccctggctgctgatatgatcgtctgacaaaatctgcatgcgcggccttcatcggcgacgacaacataatacatggtgtcgtctccgatgaattgatggcagccagatgcgctacttggaccttttgggacagcggtg

SEQ ID NO: 6566 - DNA, 140 bp, Artificial Sequence
  Synthetic
caccgctgtcccaaaaggtccaagtagcgcatctggctgccatcaattcatcggagacgacaccatgtattatgttgtcgtcgccgatgaaggccgcgcatgcagattttgtcagacgatcatatcagcagccagggcct

SEQ ID NO: 6567 - DNA, 140 bp, Artificial Sequence
  Synthetic
aggccctggctgctgatatgcattactgtagctgcctacgctaacggcgaccatgccgtcacagtaaaggacgccaagtttgtcgtgggaccaatgtcctccgcctggacaccttttgacgaccttttgggacagcggtg

SEQ ID NO: 6568 - DNA, 140 bp, Artificial Sequence
  Synthetic
caccgctgtcccaaaaggtcgtcaaaaggtgtccaggcggaggacattggtcccacgacaaacttggcgtcctttactgtgacggcatggtcgccgttagcgtaggcagctacagtaatgcatatcagcagccagggcct

SEQ ID NO: 6569 - DNA, 140 bp, Artificial Sequence
  Synthetic
aggccctggctgctgatatgaaaggtaaatgtgcagtacattcgatgaccaacgccgttaccattcgagaagccgacgtagaagtagaggggaattcccagctgcaaatatccttctcaagaccttttgggacagcggtg

SEQ ID NO: 6570 - DNA, 140 bp, Artificial Sequence
  Synthetic
caccgctgtcccaaaaggtcttgagaaggatatttgcagctgggaattcccctctacttctacgtcggcttctcgaatggtaacggcgttggtcatcgaatgtactgcacatttacctttcatatcagcagccagggcct

SEQ ID NO: 6571 - DNA, 140 bp, Artificial Sequence
  Synthetic
aggccctggctgctgatatgcttacttttgtggagggtttatactgcatgatactgtgacaggaacagcttgcagggtggcggacccgctaaaaaggttatttaaactgggcaaaccgttgaccttttgggacagcggtg

SEQ ID NO: 6572 - DNA, 140 bp, Artificial Sequence
  Synthetic
caccgctgtcccaaaaggtcaacggtttgcccagtttaaataacctttttagcgggtccgccaccctgcaagctgttcctgtcacagtatcatgcagtataaaccctccacaaaagtaagcatatcagcagccagggcct

SEQ ID NO: 6573 - DNA, 140 bp, Artificial Sequence
  Synthetic
atacgccatgctgggtctccgccttaattttaattgtggtgctatgcgtgtcgtttagcaggcactaaactgatgataaggcacgaaataactaaacagcaaaagtagaaagtacataaccgtacttgggagtcggccat

SEQ ID NO: 6574 - DNA, 140 bp, Artificial Sequence
  Synthetic
atggccgactcccaagtacggttatgtactttctacttttgctgtttagttatttcgtgccttatcatcagtttagtgcctgctaaacgacacgcatagcaccacaattaaaattaaggcggagacccagcatggcgtat

SEQ ID NO: 6575 - DNA, 140 bp, Artificial Sequence
  Synthetic
aggccctggctgctgatatgaagtaatcagatggcaacgaacagggctaatagatgagctggagaaagcggtgtactctaggtacgaagtgcagggtatatcagttgctgtaatgtctatgaccttttgggacagcggtg

SEQ ID NO: 6576 - DNA, 140 bp, Artificial Sequence
  Synthetic
caccgctgtcccaaaaggtcatagacattacagcaactgatataccctgcacttcgtacctagagtacaccgctttctccagctcatctattagccctgttcgttgccatctgattacttcatatcagcagccagggcct

SEQ ID NO: 6577 - DNA, 140 bp, Artificial Sequence
  Synthetic
aggccctggctgctgatatggactccgcgccctactatccaagttatcagacccagaccgcgtccgcaaaggaaggccgggcaacttgcccagctgatctcagcagttaataaactgacagaccttttgggacagcggtg

SEQ ID NO: 6578 - DNA, 140 bp, Artificial Sequence
  Synthetic
caccgctgtcccaaaaggtctgtcagtttattaactgctgagatcagctgggcaagttgcccggccttcctttgcggacgcggtctgggtctgataacttggatagtagggcgcggagtccatatcagcagccagggcct

SEQ ID NO: 6579 - DNA, 140 bp, Artificial Sequence
  Synthetic
aggccctggctgctgatatgtacacggagtccgaaggggaccgggaattggcggctgcctatcgagaagtcgcaaaggaagtaattagactgggagtaaatagcgtagctatacctctccgaccttttgggacagcggtg

SEQ ID NO: 6580 - DNA, 140 bp, Artificial Sequence
  Synthetic
caccgctgtcccaaaaggtcggagaggtatagctacgctatttactcccagtctaattacttcctttgcgacttctcgataggcagccgccaattcccggtccccttcggactccgtgtacatatcagcagccagggcct

SEQ ID NO: 6581 - DNA, 140 bp, Artificial Sequence
  Synthetic
atacgccatgctgggtctccgagagaatgtgcatgaaaatcgaaaatgattgcatcttcgaagtcaagcatgaaggtaaggtaacaggttacgcgtgcttggtaggggacaaagtaatgacgtacttgggagtcggccat

SEQ ID NO: 6582 - DNA, 140 bp, Artificial Sequence
  Synthetic
atggccgactcccaagtacgtcattactttgtcccctaccaagcacgcgtaacctgttaccttaccttcatgcttgacttcgaagatgcaatcattttcgattttcatgcacattctctcggagacccagcatggcgtat

SEQ ID NO: 6583 - DNA, 140 bp, Artificial Sequence
  Synthetic
aggccctggctgctgatatgcgttctcgcatctagctataaaactaatagagcaggaaattgatcccgactcaaccatcctggatatcggcagtgcgccagcaaggaggatgatgtcggagaccttttgggacagcggtg

SEQ ID NO: 6584 - DNA, 140 bp, Artificial Sequence
  Synthetic
caccgctgtcccaaaaggtctccgacatcatcctccttgctggcgcactgccgatatccaggatggttgagtcgggatcaatttcctgctctattagttttatagctagatgcgagaacgcatatcagcagccagggcct

SEQ ID NO: 6585 - DNA, 140 bp, Artificial Sequence
  Synthetic
aggccctggctgctgatatgctgtgatacagtggtttcgtgtgagggctacgtcgttaagagaataacgatgagcccgggcctttatggagaaaccacagggtatgcggtaacccaccacgaccttttgggacagcggtg

SEQ ID NO: 6586 - DNA, 140 bp, Artificial Sequence
  Synthetic
caccgctgtcccaaaaggtcgtggtgggttaccgcataccctgtggtttctccataaaggcccgggctcatcgttattctcttaacgacgtagccctcacacgaaaccactgtatcacagcatatcagcagccagggcct

SEQ ID NO: 6587 - DNA, 140 bp, Artificial Sequence
  Synthetic
atacgccatgctgggtctccatcacccctgagggggccgaagagtggagtctggccattccagttatgtgcctgctggcaaataccacgttcccctgctcccagcccccttgcacaccctcgtacttgggagtcggccat

SEQ ID NO: 6588 - DNA, 140 bp, Artificial Sequence
  Synthetic
atggccgactcccaagtacgagggtgtgcaagggggctgggagcaggggaacgtggtatttgccagcaggcacataactggaatggccagactccactcttcggccccctcaggggtgatggagacccagcatggcgtat

SEQ ID NO: 6589 - DNA, 140 bp, Artificial Sequence
  Synthetic
aggccctggctgctgatatgtactcatatctagaagggacccgttttcatcagacggctgtggatatggcggagatacatactatgtggccaaagcaaacagaggccaatgagcaagtctgaccttttgggacagcggtg

SEQ ID NO: 6590 - DNA, 140 bp, Artificial Sequence
  Synthetic
caccgctgtcccaaaaggtcagacttgctcattggcctctgtttgctttggccacatagtatgtatctccgccatatccacagccgtctgatgaaaacgggtcccttctagatatgagtacatatcagcagccagggcct

SEQ ID NO: 6591 - DNA, 140 bp, Artificial Sequence
  Synthetic
aggccctggctgctgatatggctgctacgaaaaagagccggagaaaaccttgcgcatgcttgaagacaatgtcatgagccccgggtactatcagctgctacaagcatccttaacatgttcgaccttttgggacagcggtg

SEQ ID NO: 6592 - DNA, 140 bp, Artificial Sequence
  Synthetic
caccgctgtcccaaaaggtcgaacatgttaaggatgcttgtagcagctgatagtacccggggctcatgacattgtcttcaagcatgcgcaaggttttctccggctctttttcgtagcagccatatcagcagccagggcct

SEQ ID NO: 6593 - DNA, 140 bp, Artificial Sequence
  Synthetic
aggccctggctgctgatatggtcatgagccccgggtactatcagctgctacaagcatccttaacatgttctccccgacgccggcggcgcagtattaaggaccacttcaatgtctataaaggaccttttgggacagcggtg

SEQ ID NO: 6594 - DNA, 140 bp, Artificial Sequence
  Synthetic
caccgctgtcccaaaaggtcctttatagacattgaagtggtccttaatactgcgccgccggcgtcggggagaacatgttaaggatgcttgtagcagctgatagtacccggggctcatgaccatatcagcagccagggcct

SEQ ID NO: 6595 - DNA, 140 bp, Artificial Sequence
  Synthetic
aggccctggctgctgatatggccatgattggaccaagctgcgttatatggacaatcacatgccagcagacgcagagcgggccgggctatttgtaagaacgtcagcaccgtgcacgattacgaccttttgggacagcggtg

SEQ ID NO: 6596 - DNA, 140 bp, Artificial Sequence
  Synthetic
caccgctgtcccaaaaggtcgtaatcgtgcacggtgctgacgttcttacaaatagcccggcccgctctgcgtctgctggcatgtgattgtccatataacgcagcttggtccaatcatggccatatcagcagccagggcct

SEQ ID NO: 6597 - DNA, 140 bp, Artificial Sequence
  Synthetic
atacgccatgctgggtctccaagatgattcgcttgcgcttactgctttgatgctgttagaggatttaggggtagatcactccctgctggacttgatagaggctgctttcggagagatttccgtacttgggagtcggccat

SEQ ID NO: 6598 - DNA, 140 bp, Artificial Sequence
  Synthetic
atggccgactcccaagtacggaaatctctccgaaagcagcctctatcaagtccagcagggagtgatctacccctaaatcctctaacagcatcaaagcagtaagcgcaagcgaatcatcttggagacccagcatggcgtat

SEQ ID NO: 6599 - DNA, 140 bp, Artificial Sequence
  Synthetic
aggccctggctgctgatatgtggaacaatgggacacttcattctggcccgatgtccgaaaggagaaactctgacggtggggttcactgatggtagaaagatcagtcactcatgtacgcacgaccttttgggacagcggtg

SEQ ID NO: 6600 - DNA, 140 bp, Artificial Sequence
  Synthetic
caccgctgtcccaaaaggtcgtgcgtacatgagtgactgatctttctaccatcagtgaaccccaccgtcagagtttctcctttcggacatcgggccagaatgaagtgtcccattgttccacatatcagcagccagggcct

SEQ ID NO: 6601 - DNA, 140 bp, Artificial Sequence
  Synthetic
aggccctggctgctgatatggtagatcactccctgctggacttgatagaggctgctttcggagagatttccagctgccacctaccgacaggtacgcgcttcaagttcggcgccatgatgagaccttttgggacagcggtg

SEQ ID NO: 6602 - DNA, 140 bp, Artificial Sequence
  Synthetic
caccgctgtcccaaaaggtctcatcatggcgccgaacttgaagcgcgtacctgtcggtaggtggcagctggaaatctctccgaaagcagcctctatcaagtccagcagggagtgatctaccatatcagcagccagggcct

SEQ ID NO: 6603 - DNA, 140 bp, Artificial Sequence
  Synthetic
aggccctggctgctgatatgagcgttgatggcgagatactgcccgtcccgtcagacctggatgctgacgccccagccctagaaccagcactagacgacggggcgacacacacgctgccatgaccttttgggacagcggtg

SEQ ID NO: 6604 - DNA, 140 bp, Artificial Sequence
  Synthetic
caccgctgtcccaaaaggtcatggcagcgtgtgtgtcgccccgtcgtctagtgctggttctagggctggggcgtcagcatccaggtctgacgggacgggcagtatctcgccatcaacgctcatatcagcagccagggcct

SEQ ID NO: 6605 - DNA, 140 bp, Artificial Sequence
  Synthetic
aggccctggctgctgatatgaccgcagcacggtagggaactaccttgcagcacgtacgcgcagagcaccgctgcaactgccgaggagatagaggtacatatgcccccagacaccccagatgaccttttgggacagcggtg

SEQ ID NO: 6606 - DNA, 140 bp, Artificial Sequence
  Synthetic
caccgctgtcccaaaaggtcatctggggtgtctgggggcatatgtacctctatctcctcggcagttgcagcggtgctctgcgcgtacgtgctgcaaggtagttccctaccgtgctgcggtcatatcagcagccagggcct

SEQ ID NO: 6607 - DNA, 140 bp, Artificial Sequence
  Synthetic
atacgccatgctgggtctccctgcaactgccgaggagatagaggtacatatgcccccagacaccccagatcgcacattaatgtcacaacagtccggcaatgtaaagatcacagtcaatagcgtacttgggagtcggccat

SEQ ID NO: 6608 - DNA, 140 bp, Artificial Sequence
  Synthetic
atggccgactcccaagtacgctattgactgtgatctttacattgccggactgttgtgacattaatgtgcgatctggggtgtctgggggcatatgtacctctatctcctcggcagttgcagggagacccagcatggcgtat

SEQ ID NO: 6609 - DNA, 140 bp, Artificial Sequence
  Synthetic
aggccctggctgctgatatgcgcacattaatgtcacaacagtccggcaatgtaaagatcacagtcaatagtcagacggtgcggtacaagtgcaattgtggtgactcaagtgaaggattaagaccttttgggacagcggtg

SEQ ID NO: 6610 - DNA, 140 bp, Artificial Sequence
  Synthetic
caccgctgtcccaaaaggtcttaatccttcacttgagtcaccacaattgcacttgtaccgcaccgtctgactattgactgtgatctttacattgccggactgttgtgacattaatgtgcgcatatcagcagccagggcct

SEQ ID NO: 6611 - DNA, 140 bp, Artificial Sequence
  Synthetic
atacgccatgctgggtctccccactacagataaagtgattaataactgcaaggttgatcaatgccatgccgcggtcaccaatcacaaaaaatggcagtataattcccctctggtcccgcgcgtacttgggagtcggccat

SEQ ID NO: 6612 - DNA, 140 bp, Artificial Sequence
  Synthetic
atggccgactcccaagtacgcgcgggaccagaggggaattatactgccattttttgtgattggtgaccgcggcatggcattgatcaaccttgcagttattaatcactttatctgtagtggggagacccagcatggcgtat

SEQ ID NO: 6613 - DNA, 140 bp, Artificial Sequence
  Synthetic
aggccctggctgctgatatgacttcaacgaaggagaaatcgaaagcttgtcttctgagctactaactttcggagacttcttaccaggagaagtggatgacttgacagacagcgactggtcgaccttttgggacagcggtg

SEQ ID NO: 6614 - DNA, 140 bp, Artificial Sequence
  Synthetic
caccgctgtcccaaaaggtcgaccagtcgctgtctgtcaagtcatccacttctcctggtaagaagtctccgaaagttagtagctcagaagacaagctttcgatttctccttcgttgaagtcatatcagcagccagggcct

SEQ ID NO: 6615 - DNA, 140 bp, Artificial Sequence
  Synthetic
aggccctggctgctgatatggcggtcaccaatcacaaaaaatggcagtataattcccctctggtcccgcgcaatgctgaatccggggaccggaaaggaaaacttcacattccatttcctcgaccttttgggacagcggtg

SEQ ID NO: 6616 - DNA, 140 bp, Artificial Sequence
  Synthetic
caccgctgtcccaaaaggtcgaggaaatggaatgtgaagttttcctttccggtccccggattcagcattgcgcgggaccagaggggaattatactgccattttttgtgattggtgaccgccatatcagcagccagggcct

SEQ ID NO: 6617 - DNA, 140 bp, Artificial Sequence
  Synthetic
aggccctggctgctgatatgtggcaaatgtgacatgcagggtgcctaaagcaagaaaccccaccgtgacgtacggaaaaaaccaagtcatcatgttgctgtatcctgaccacccaacgctgaccttttgggacagcggtg

SEQ ID NO: 6618 - DNA, 140 bp, Artificial Sequence
  Synthetic
caccgctgtcccaaaaggtcagcgttgggtggtcaggatacagcaacatgatgacttggttttttccgtacgtcacggtggggtttcttgctttaggcaccctgcatgtcacatttgccacatatcagcagccagggcct

SEQ ID NO: 6619 - DNA, 140 bp, Artificial Sequence
  Synthetic
aggccctggctgctgatatggtcacgtggggtaacaatgagccgtacaagtattggccgcagttatccacaaacggtacagcccacggccacccgcatgagataattctgtattattatggaccttttgggacagcggtg

SEQ ID NO: 6620 - DNA, 140 bp, Artificial Sequence
  Synthetic
caccgctgtcccaaaaggtccataataatacagaattatctcatgcgggtggccgtgggctgtaccgtttgtggataactgcggccaatacttgtacggctcattgttaccccacgtgaccatatcagcagccagggcct

SEQ ID NO: 6621 - DNA, 140 bp, Artificial Sequence
  Synthetic
aggccctggctgctgatatgaaagtagaaaacatgaaagcagcaatcatccagagactaaagagtggctgtagactatacttaatgtcagagaccccaaaagtccctacttaccggactagaccttttgggacagcggtg

SEQ ID NO: 6622 - DNA, 140 bp, Artificial Sequence
  Synthetic
caccgctgtcccaaaaggtctagtccggtaagtagggacttttggggtctctgacattaagtatagtctacagccactctttagtctctggatgattgctgctttcatgttttctactttcatatcagcagccagggcct

SEQ ID NO: 6623 - DNA, 140 bp, Artificial Sequence
  Synthetic
atacgccatgctgggtctccagctgtacccaactatgactgtggtagttgtgtcagtggcctcgttcatactcctgtcgatggtgggtgtggcagtggggatgtgcatgtgtgcacgacgcgtacttgggagtcggccat

SEQ ID NO: 6624 - DNA, 140 bp, Artificial Sequence
  Synthetic
atggccgactcccaagtacgcgtcgtgcacacatgcacatccccactgccacacccaccatcgacaggagtatgaacgaggccactgacacaactaccacagtcatagttgggtacagctggagacccagcatggcgtat

SEQ ID NO: 6625 - DNA, 140 bp, Artificial Sequence
  Synthetic
atacgccatgctgggtctcccagatgcattacaccgtacgaactgacaccaggagctaccgtccctttcctgcttagcctaatatgctgcattaggacagctaaagcggccacataccagcgtacttgggagtcggccat

SEQ ID NO: 6626 - DNA, 140 bp, Artificial Sequence
  Synthetic
atggccgactcccaagtacgctggtatgtggccgctttagctgtcctaatgcagcatattaggctaagcaggaaagggacggtagctcctggtgtcagttcgtacggtgtaatgcatctgggagacccagcatggcgtat

SEQ ID NO: 6627 - DNA, 140 bp, Artificial Sequence
  Synthetic
aggccctggctgctgatatgaactgtctcgtcataccaaattaccgacgagtatgatgcatatctagacatggtggacgggtcggagagttgcctggaccgagcgacatttaatccgtcagaccttttgggacagcggtg

SEQ ID NO: 6628 - DNA, 140 bp, Artificial Sequence
  Synthetic
caccgctgtcccaaaaggtctgacggattaaatgtcgctcggtccaggcaactctccgacccgtccaccatgtctagatatgcatcatactcgtcggtaatttggtatgacgagacagttcatatcagcagccagggcct

SEQ ID NO: 6629 - DNA, 140 bp, Artificial Sequence
  Synthetic
aggccctggctgctgatatggaggccgcggtatacctgtggaacgagcagcagcctttattttggctgcaagcccttattccgctggcagccctgattgtcctatgtaactgtctgagacgaccttttgggacagcggtg

SEQ ID NO: 6630 - DNA, 140 bp, Artificial Sequence
  Synthetic
caccgctgtcccaaaaggtcgtctcagacagttacataggacaatcagggctgccagcggaataagggcttgcagccaaaataaaggctgctgctcgttccacaggtataccgcggcctccatatcagcagccagggcct

SEQ ID NO: 6631 - DNA, 140 bp, Artificial Sequence
  Synthetic
atacgccatgctgggtctccagcccttattccgctggcagccctgattgtcctatgtaactgtctgagactcttaccatgctgttgtaaaatgttgacttttttagccgtactgagcgtccgtacttgggagtcggccat

SEQ ID NO: 6632 - DNA, 140 bp, Artificial Sequence
  Synthetic
atggccgactcccaagtacggacgctcagtacggctaaaaaagtcaacattttacaacagcatggtaagagtctcagacagttacataggacaatcagggctgccagcggaataagggctggagacccagcatggcgtat

SEQ ID NO: 6633 - DNA, 140 bp, Artificial Sequence
  Synthetic
aggccctggctgctgatatgcccgagtccgcagtggcagcatgcaatgagttcttagctagaaactatccaactgtctcgtcataccaaattaccgacgagtatgatgcatatctagacagaccttttgggacagcggtg

SEQ ID NO: 6634 - DNA, 140 bp, Artificial Sequence
  Synthetic
caccgctgtcccaaaaggtctgtctagatatgcatcatactcgtcggtaatttggtatgacgagacagttggatagtttctagctaagaactcattgcatgctgccactgcggactcgggcatatcagcagccagggcct

SEQ ID NO: 6635 - DNA, 140 bp, Artificial Sequence
  Synthetic
aggccctggctgctgatatgggtgcccacactgtgagcgcgtacgaacacgtaacagtgatcccgaacacggtgggagtaccgtataagactctagtcaacagaccgggctacagccccagaccttttgggacagcggtg

SEQ ID NO: 6636 - DNA, 140 bp, Artificial Sequence
  Synthetic
caccgctgtcccaaaaggtctggggctgtagcccggtctgttgactagagtcttatacggtactcccaccgtgttcgggatcactgttacgtgttcgtacgcgctcacagtgtgggcacccatatcagcagccagggcct

SEQ ID NO: 6637 - DNA, 140 bp, Artificial Sequence
  Synthetic
aggccctggctgctgatatgtgcttctgcgacaccgaaaatacgcaattgagcgaagcacatgtggagaagtccgaatcatgcaaaacagaatttgcatcagcatacagggctcataccggaccttttgggacagcggtg

SEQ ID NO: 6638 - DNA, 140 bp, Artificial Sequence
  Synthetic
caccgctgtcccaaaaggtccggtatgagccctgtatgctgatgcaaattctgttttgcatgattcggacttctccacatgtgcttcgctcaattgcgtattttcggtgtcgcagaagcacatatcagcagccagggcct

SEQ ID NO: 6639 - DNA, 140 bp, Artificial Sequence
  Synthetic
atacgccatgctgggtctcctgtatcctgaccacccaacactcctgtcctaccggaatatgggagaagaaccacactatcaagaagagtgggtgatgcataagaaggaagtcgtgctaaccgtacttgggagtcggccat

SEQ ID NO: 6640 - DNA, 140 bp, Artificial Sequence
  Synthetic
atggccgactcccaagtacggttagcacgacttccttcttatgcatcacccactcttcttgatagtgtggttcttctcccatattccggtaggacaggagtgttgggtggtcaggatacaggagacccagcatggcgtat

SEQ ID NO: 6641 - DNA, 140 bp, Artificial Sequence
  Synthetic
aggccctggctgctgatatgaaaaagatgaagccatgtgaccgcgtactgttctcagtcgggtcaacgctttacccggagagccgtaagcttcttgagagttggcacttaccttcagtgtgaccttttgggacagcggtg

SEQ ID NO: 6642 - DNA, 140 bp, Artificial Sequence
  Synthetic
caccgctgtcccaaaaggtcacactgaaggtaagtgccaactctcaagaagcttacggctctccgggtaaagcgttgacccgactgagaacagtacgcggtcacatggcttcatctttttcatatcagcagccagggcct

SEQ ID NO: 6643 - DNA, 140 bp, Artificial Sequence
  Synthetic
atacgccatgctgggtctcccggtaaaaccacagggtacgcagtaacccaccatgcagacggattcctagtgtgcaaaacaaccgatacggtagatggcgagagagtgtcattttcggtacgtacttgggagtcggccat

SEQ ID NO: 6644 - DNA, 140 bp, Artificial Sequence
  Synthetic
atggccgactcccaagtacgtaccgaaaatgacactctctcgccatctaccgtatcggttgttttgcacactaggaatccgtctgcatggtgggttactgcgtaccctgtggttttaccgggagacccagcatggcgtat

SEQ ID NO: 6645 - DNA, 140 bp, Artificial Sequence
  Synthetic
atacgccatgctgggtctccgcagggtgtgcaccgtcgtaccgggttaaacgcatggacatcgcaagaacgatgaagagtgcgtagtcaacgccgccaaccctcgtgggctaccaggcgacgtacttgggagtcggccat

SEQ ID NO: 6646 - DNA, 140 bp, Artificial Sequence
  Synthetic
atggccgactcccaagtacgtcgcctggtagcccacgagggttggcggcgttgactacgcactcttcatcgttcttgcgatgtccatgcgtttaacccggtacgacggtgcacaccctgcggagacccagcatggcgtat

SEQ ID NO: 6647 - DNA, 140 bp, Artificial Sequence
  Synthetic
aggccctggctgctgatatggtacggtgcacgtgccgtactctcaggcaccatctggcttcaagtattggctaaaagaacgaggggcgtcgctacagcacacagcaccatttggctgtcagaccttttgggacagcggtg

SEQ ID NO: 6648 - DNA, 140 bp, Artificial Sequence
  Synthetic
caccgctgtcccaaaaggtctgacagccaaatggtgctgtgtgctgtagcgacgcccctcgttcttttagccaatacttgaagccagatggtgcctgagagtacggcacgtgcaccgtaccatatcagcagccagggcct

SEQ ID NO: 6649 - DNA, 140 bp, Artificial Sequence
  Synthetic
aggccctggctgctgatatgaatagcaacaaacccggtaagagcgatgaactgcgccgtagggaacatgcctatctccatcgacataccggacgcggcctttaccagggtcgtcgacgcggaccttttgggacagcggtg

SEQ ID NO: 6650 - DNA, 140 bp, Artificial Sequence
  Synthetic
caccgctgtcccaaaaggtccgcgtcgacgaccctggtaaaggccgcgtccggtatgtcgatggagataggcatgttccctacggcgcagttcatcgctcttaccgggtttgttgctattcatatcagcagccagggcct

SEQ ID NO: 6651 - DNA, 140 bp, Artificial Sequence
  Synthetic
aggccctggctgctgatatgtaggtatgaaggcatacgcgtccctaaagagacacaccacatatagctaagaatcaatagataagtatagatcaaagggctgaacaatccctgaatagtagaccttttgggacagcggtg

SEQ ID NO: 6652 - DNA, 140 bp, Artificial Sequence
  Synthetic
caccgctgtcccaaaaggtctactattcagggattgttcagccctttgatctatacttatctattgattcttagctatatgtggtgtgtctctttagggacgcgtatgccttcatacctacatatcagcagccagggcct

SEQ ID NO: 6653 - DNA, 140 bp, Artificial Sequence
  Synthetic
aggccctggctgctgatatgacaaaatataaaaatcaacaaaaatcataaaatagaaaactagaaatagaagtaggtaagaaggtatatgtgtcccctaagagacacaccatatatagctgaccttttgggacagcggtg

SEQ ID NO: 6654 - DNA, 140 bp, Artificial Sequence
  Synthetic
caccgctgtcccaaaaggtcagctatatatggtgtgtctcttaggggacacatataccttcttacctacttctatttctagttttctattttatgatttttgttgatttttatattttgtcatatcagcagccagggcct

SEQ ID NO: 6655 - DNA, 140 bp, Artificial Sequence
  Synthetic
atacgccatgctgggtctcctaacaaaatataaaaaccaataaaaatcataaaatagaaaaccataaacagaagtagttcaaagggctatgaaacccctgaatagtaacaaaatataaaacgtacttgggagtcggccat

SEQ ID NO: 6656 - DNA, 140 bp, Artificial Sequence
  Synthetic
atggccgactcccaagtacgttttatattttgttactattcaggggtttcatagccctttgaactacttctgtttatggttttctattttatgatttttattggtttttatattttgttaggagacccagcatggcgtat

SEQ ID NO: 6657 - DNA, 140 bp, Artificial Sequence
  Synthetic
aggccctggctgctgatatggtgccatcacgcgttagtccaagggaatataaatcgcctcaggagaccgcacaagaagtaagttcgaccacgtcactgacgcacagccaattcgaccttagaccttttgggacagcggtg

SEQ ID NO: 6658 - DNA, 140 bp, Artificial Sequence
  Synthetic
caccgctgtcccaaaaggtctaaggtcgaattggctgtgcgtcagtgacgtggtcgaacttacttcttgtgcggtctcctgaggcgatttatattcccttggactaacgcgtgatggcaccatatcagcagccagggcct

SEQ ID NO: 6659 - DNA, 140 bp, Artificial Sequence
  Synthetic
aggccctggctgctgatatgaaaaccaataaaaatcataaaatagaaaaccataaacagaagtagttcaaagggctatgaaacccctgaatagtaacaaaatataaaactaataaaaatcgaccttttgggacagcggtg

SEQ ID NO: 6660 - DNA, 140 bp, Artificial Sequence
  Synthetic
caccgctgtcccaaaaggtcgatttttattagttttatattttgttactattcaggggtttcatagccctttgaactacttctgtttatggttttctattttatgatttttattggttttcatatcagcagccagggcct

SEQ ID NO: 6661 - DNA, 140 bp, Artificial Sequence
  Synthetic
aggccctggctgctgatatgttcaccatccctacaggtgctggcaaaccaggggacagcggcagaccgatcttcgacaacaagggacgcgtggtggccatagtcttaggaggagctaatggaccttttgggacagcggtg

SEQ ID NO: 6662 - DNA, 140 bp, Artificial Sequence
  Synthetic
caccgctgtcccaaaaggtccattagctcctcctaagactatggccaccacgcgtcccttgttgtcgaagatcggtctgccgctgtcccctggtttgccagcacctgtagggatggtgaacatatcagcagccagggcct

SEQ ID NO: 6663 - DNA, 140 bp, Artificial Sequence
  Synthetic
aggccctggctgctgatatgtagcatctgccgcaggaaaagtcctggacagaaacatctctggaaagatcggggacttacaagcagtaatggccgtgccagacaaggagacgccaacattgaccttttgggacagcggtg

SEQ ID NO: 6664 - DNA, 140 bp, Artificial Sequence
  Synthetic
caccgctgtcccaaaaggtcaatgttggcgtctccttgtctggcacggccattactgcttgtaagtccccgatctttccagagatgtttctgtccaggacttttcctgcggcagatgctacatatcagcagccagggcct

SEQ ID NO: 6665 - DNA, 140 bp, Artificial Sequence
  Synthetic
aggccctggctgctgatatgctgcttacacacagacgtctcatgtagacagagagcagacgtcgctatataccaagacgtctatgctgtacacgcacccacgtcgctataccaccaggcggaccttttgggacagcggtg

SEQ ID NO: 6666 - DNA, 140 bp, Artificial Sequence
  Synthetic
caccgctgtcccaaaaggtccgcctggtggtatagcgacgtgggtgcgtgtacagcatagacgtcttggtatatagcgacgtctgctctctgtctacatgagacgtctgtgtgtaagcagcatatcagcagccagggcct

SEQ ID NO: 6667 - DNA, 140 bp, Artificial Sequence
  Synthetic
atacgccatgctgggtctccgggacttctcgccgggcgaagtggatgacctgacagacagcgactggtccacgtgttcagacacggacgacgaattaagactagatagggcaggtgggtacgtacttgggagtcggccat

SEQ ID NO: 6668 - DNA, 140 bp, Artificial Sequence
  Synthetic
atggccgactcccaagtacgtacccacctgccctatctagtcttaattcgtcgtccgtgtctgaacacgtggaccagtcgctgtctgtcaggtcatccacttcgcccggcgagaagtcccggagacccagcatggcgtat

SEQ ID NO: 6669 - DNA, 140 bp, Artificial Sequence
  Synthetic
atacgccatgctgggtctccgggacttctcgccgggcgaagtggatgacctgacagacagcgactggtccacgtgttcagacacggacgacgaattatgactagatagggcaggtgggtacgtacttgggagtcggccat

SEQ ID NO: 6670 - DNA, 140 bp, Artificial Sequence
  Synthetic
atggccgactcccaagtacgtacccacctgccctatctagtcataattcgtcgtccgtgtctgaacacgtggaccagtcgctgtctgtcaggtcatccacttcgcccggcgagaagtcccggagacccagcatggcgtat

SEQ ID NO: 6671 - DNA, 140 bp, Artificial Sequence
  Synthetic
atacgccatgctgggtctccgggacttctcgccgggcgaagtggatgacctgacagacagcgactggtccacgtgttcagacacggacgacgaattacgactagatagggcaggtgggtacgtacttgggagtcggccat

SEQ ID NO: 6672 - DNA, 140 bp, Artificial Sequence
  Synthetic
atggccgactcccaagtacgtacccacctgccctatctagtcgtaattcgtcgtccgtgtctgaacacgtggaccagtcgctgtctgtcaggtcatccacttcgcccggcgagaagtcccggagacccagcatggcgtat

SEQ ID NO: 6673 - DNA, 140 bp, Artificial Sequence
  Synthetic
atacgccatgctgggtctccgggacttctcgccgggcgaagtggatgacctgacagacagcgactggtccacgtgttcagacacggacgacgaattaggactagatagggcaggtgggtacgtacttgggagtcggccat

SEQ ID NO: 6674 - DNA, 140 bp, Artificial Sequence
  Synthetic
atggccgactcccaagtacgtacccacctgccctatctagtcctaattcgtcgtccgtgtctgaacacgtggaccagtcgctgtctgtcaggtcatccacttcgcccggcgagaagtcccggagacccagcatggcgtat

SEQ ID NO: 6675 - DNA, 140 bp, Artificial Sequence
  Synthetic
aggccctggctgctgatatgaccaagacgtctatgctgtacacgcacccacgtcgctataccaccaggcgattaaaggggtccgagtggcgtactgggttgggttcgacacaaccccgttgaccttttgggacagcggtg

SEQ ID NO: 6676 - DNA, 140 bp, Artificial Sequence
  Synthetic
caccgctgtcccaaaaggtcaacggggttgtgtcgaacccaacccagtacgccactcggacccctttaatcgcctggtggtatagcgacgtgggtgcgtgtacagcatagacgtcttggtcatatcagcagccagggcct

SEQ ID NO: 6677 - DNA, 140 bp, Artificial Sequence
  Synthetic
aggccctggctgctgatatgaaaaccgtgcgaccgtgtgctgttctcagtagggtcaacgctctacccggaaagccgcaagctacttaagagctggcacctgccatcggtgttccatttagaccttttgggacagcggtg

SEQ ID NO: 6678 - DNA, 140 bp, Artificial Sequence
  Synthetic
caccgctgtcccaaaaggtctaaatggaacaccgatggcaggtgccagctcttaagtagcttgcggctttccgggtagagcgttgaccctactgagaacagcacacggtcgcacggttttcatatcagcagccagggcct

SEQ ID NO: 6679 - DNA, 140 bp, Artificial Sequence
  Synthetic
atacgccatgctgggtctccaagggcaaactcagcttcacatgccgctgtgatacagtggtttcgtgtgagggctacgtcgttaagagaataacgatgagcccaggcctttatggaaaaacgtacttgggagtcggccat

SEQ ID NO: 6680 - DNA, 140 bp, Artificial Sequence
  Synthetic
atggccgactcccaagtacgtttttccataaaggcctgggctcatcgttattctcttaacgacgtagccctcacacgaaaccactgtatcacagcggcatgtgaagctgagtttgcccttggagacccagcatggcgtat

SEQ ID NO: 6681 - DNA, 140 bp, Artificial Sequence
  Synthetic
aggccctggctgctgatatgtcacgccggaggatgcacagaagctgttggtggggctgaaccagagaatagtggttaacggcagaacgcaacggaatatgaacaccatgaaaaattatctgaccttttgggacagcggtg

SEQ ID NO: 6682 - DNA, 140 bp, Artificial Sequence
  Synthetic
caccgctgtcccaaaaggtcagataatttttcatggtgttcatattccgttgcgttctgccgttaaccactattctctggttcagccccaccaacagcttctgtgcatcctccggcgtgacatatcagcagccagggcct

SEQ ID NO: 6683 - DNA, 140 bp, Artificial Sequence
  Synthetic
atacgccatgctgggtctcccaatggccagacggtgcggtataagtgtaattgcggtggctcaaatgaaggactaacaactacagacaaagtgattaataactgcaaggttgatcaatgtcgtacttgggagtcggccat

SEQ ID NO: 6684 - DNA, 140 bp, Artificial Sequence
  Synthetic
atggccgactcccaagtacgacattgatcaaccttgcagttattaatcactttgtctgtagttgttagtccttcatttgagccaccgcaattacacttataccgcaccgtctggccattgggagacccagcatggcgtat

SEQ ID NO: 6685 - DNA, 140 bp, Artificial Sequence
  Synthetic
atacgccatgctgggtctcccaagaatactggaaggaatttgccgccagtcctattaggataacgactgagaacttgacaacttatgtcacaaaactaaaaggaccaaaagcagcagcatcgtacttgggagtcggccat

SEQ ID NO: 6686 - DNA, 140 bp, Artificial Sequence
  Synthetic
atggccgactcccaagtacgatgctgctgcttttggtccttttagttttgtgacataagttgtcaagttctcagtcgttatcctaataggactggcggcaaattccttccagtattcttgggagacccagcatggcgtat

SEQ ID NO: 6687 - DNA, 140 bp, Artificial Sequence
  Synthetic
atacgccatgctgggtctcctgctgctgtctatgggcattcaagaagcagaaaacacacacggtctacaagaggcctgatacccagtcaattcagaaggttcaggccgagtttgacagctcgtacttgggagtcggccat

SEQ ID NO: 6688 - DNA, 140 bp, Artificial Sequence
  Synthetic
atggccgactcccaagtacgagctgtcaaactcggcctgaaccttctgaattgactgggtatcaggcctcttgtagaccgtgtgtgttttctgcttcttgaatgcccatagacagcagcaggagacccagcatggcgtat

SEQ ID NO: 6689 - DNA, 140 bp, Artificial Sequence
  Synthetic
aggccctggctgctgatatgcaggaagatgttcaggtcgaaatcgacgtggaacagcttgaggacagagcgggcgcaggaataatagagactccgagaggagctatcaaagttactgcccgaccttttgggacagcggtg

SEQ ID NO: 6690 - DNA, 140 bp, Artificial Sequence
  Synthetic
caccgctgtcccaaaaggtcgggcagtaactttgatagctcctctcggagtctctattattcctgcgcccgctctgtcctcaagctgttccacgtcgatttcgacctgaacatcttcctgcatatcagcagccagggcct

SEQ ID NO: 6691 - DNA, 140 bp, Artificial Sequence
  Synthetic
aggccctggctgctgatatgaaccaacagaccacgtcgtgggagagtacctggtactctccccgcagaccgtactacgtagccagaagctcagtctgattcacgctttggcggagcaagtgaccttttgggacagcggtg

SEQ ID NO: 6692 - DNA, 140 bp, Artificial Sequence
  Synthetic
caccgctgtcccaaaaggtcacttgctccgccaaagcgtgaatcagactgagcttctggctacgtagtacggtctgcggggagagtaccaggtactctcccacgacgtggtctgttggttcatatcagcagccagggcct

SEQ ID NO: 6693 - DNA, 140 bp, Artificial Sequence
  Synthetic
aggccctggctgctgatatggtactacgtagccagaagctcagtctgattcacgctttggcggagcaagtgaagacgtgcacgcacaacggacgagcagggaggtatgcggtcgaagcgtgaccttttgggacagcggtg

SEQ ID NO: 6694 - DNA, 140 bp, Artificial Sequence
  Synthetic
caccgctgtcccaaaaggtcacgcttcgaccgcatacctccctgctcgtccgttgtgcgtgcacgtcttcacttgctccgccaaagcgtgaatcagactgagcttctggctacgtagtaccatatcagcagccagggcct

SEQ ID NO: 6695 - DNA, 140 bp, Artificial Sequence
  Synthetic
atacgccatgctgggtctccgaagacgtgcacgcacaacggacgagcagggaggtatgcggtcgaagcgtacgacggccgagtcctagtgccctcaggctatgcaatctcgcctgaagaccgtacttgggagtcggccat

SEQ ID NO: 6696 - DNA, 140 bp, Artificial Sequence
  Synthetic
atggccgactcccaagtacggtcttcaggcgagattgcatagcctgagggcactaggactcggccgtcgtacgcttcgaccgcatacctccctgctcgtccgttgtgcgtgcacgtcttcggagacccagcatggcgtat

SEQ ID NO: 6697 - DNA, 140 bp, Artificial Sequence
  Synthetic
aggccctggctgctgatatgtgagactcttaccatgctgctgtaaaacgttggcttttttagccgtaatgagcgtcggtgcccacactgtgagcgcgtacgaacacgtaacagtgatcccgaccttttgggacagcggtg

SEQ ID NO: 6698 - DNA, 140 bp, Artificial Sequence
  Synthetic
caccgctgtcccaaaaggtcgggatcactgttacgtgttcgtacgcgctcacagtgtgggcaccgacgctcattacggctaaaaaagccaacgttttacagcagcatggtaagagtctcacatatcagcagccagggcct

SEQ ID NO: 6699 - DNA, 140 bp, Artificial Sequence
  Synthetic
aggccctggctgctgatatgccgacgaagagtcgtatgagctggtgagggcagagaggacagaacacgagtacgtctacgacgtggatcagagaagatgctgtaagaaggaagaagccgcgaccttttgggacagcggtg

SEQ ID NO: 6700 - DNA, 140 bp, Artificial Sequence
  Synthetic
caccgctgtcccaaaaggtcgcggcttcttccttcttacagcatcttctctgatccacgtcgtagacgtactcgtgttctgtcctctctgccctcaccagctcatacgactcttcgtcggcatatcagcagccagggcct

SEQ ID NO: 6701 - DNA, 140 bp, Artificial Sequence
  Synthetic
aggccctggctgctgatatgataggagtcttcggagtaccgggatctggcaagtcagctattatcaagaacctagttaccaggcaggacctggtgactagcggaaagaaagaaaactgccgaccttttgggacagcggtg

SEQ ID NO: 6702 - DNA, 140 bp, Artificial Sequence
  Synthetic
caccgctgtcccaaaaggtcggcagttttctttctttccgctagtcaccaggtcctgcctggtaactaggttcttgataatagctgacttgccagatcccggtactccgaagactcctatcatatcagcagccagggcct

SEQ ID NO: 6703 - DNA, 140 bp, Artificial Sequence
  Synthetic
atacgccatgctgggtctccgttgtacgtagacgaggcgtttgcgtgccactctggaacgctacttgctttgattgccttggtgagaccaaggcagaaagttgtactttgtggtgacccgcgtacttgggagtcggccat

SEQ ID NO: 6704 - DNA, 140 bp, Artificial Sequence
  Synthetic
atggccgactcccaagtacgcgggtcaccacaaagtacaactttctgccttggtctcaccaaggcaatcaaagcaagtagcgttccagagtggcacgcaaacgcctcgtctacgtacaacggagacccagcatggcgtat

SEQ ID NO: 6705 - DNA, 140 bp, Artificial Sequence
  Synthetic
aggccctggctgctgatatgataaagacgctgcagaacccaccgaaaggaaacttcaaagcaactattaaggagtgggaggtggagcatgcatcaataatggcgggcatctgcagtcaccgaccttttgggacagcggtg

SEQ ID NO: 6706 - DNA, 140 bp, Artificial Sequence
  Synthetic
caccgctgtcccaaaaggtcggtgactgcagatgcccgccattattgatgcatgctccacctcccactccttaatagttgctttgaagtttcctttcggtgggttctgcagcgtctttatcatatcagcagccagggcct

SEQ ID NO: 6707 - DNA, 140 bp, Artificial Sequence
  Synthetic
aggccctggctgctgatatggcaaataatctatagatcaaagggctacgcaacccctgaatagtaacaaaatacaaaatcactaaaaattataaaaacagaaaaatacataaataggtatgaccttttgggacagcggtg

SEQ ID NO: 6708 - DNA, 140 bp, Artificial Sequence
  Synthetic
caccgctgtcccaaaaggtcatacctatttatgtatttttctgtttttataatttttagtgattttgtattttgttactattcaggggttgcgtagccctttgatctatagattatttgccatatcagcagccagggcct

SEQ ID NO: 6709 - DNA, 140 bp, Artificial Sequence
  Synthetic
aggccctggctgctgatatgaacaagcagatctgcgtgactaccaggaggatagaagactttaaccctaccaccaacatcataccggccaacaggagactaccacactcattagtggccggaccttttgggacagcggtg

SEQ ID NO: 6710 - DNA, 140 bp, Artificial Sequence
  Synthetic
caccgctgtcccaaaaggtccggccactaatgagtgtggtagtctcctgttggccggtatgatgttggtggtagggttaaagtcttctatcctcctggtagtcacgcagatctgcttgttcatatcagcagccagggcct

SEQ ID NO: 6711 - DNA, 140 bp, Artificial Sequence
  Synthetic
atacgccatgctgggtctcccaccaacatcataccggccaacaggagactaccacactcattagtggccgaacaccgcccagtaaaaggggaaagaatggaatggctggttaacaagatacgtacttgggagtcggccat

SEQ ID NO: 6712 - DNA, 140 bp, Artificial Sequence
  Synthetic
atggccgactcccaagtacgtatcttgttaaccagccattccattctttccccttttactgggcggtgttcggccactaatgagtgtggtagtctcctgttggccggtatgatgttggtgggagacccagcatggcgtat

SEQ ID NO: 6713 - DNA, 140 bp, Artificial Sequence
  Synthetic
atacgccatgctgggtctccatggcagccacgattggaccaagctgcgctatatggatagccatacgccagcggacgcggagcgagccggattgcttgtaaggacttcagcaccgtgcaccgtacttgggagtcggccat

SEQ ID NO: 6714 - DNA, 140 bp, Artificial Sequence
  Synthetic
atggccgactcccaagtacggtgcacggtgctgaagtccttacaagcaatccggctcgctccgcgtccgctggcgtatggctatccatatagcgcagcttggtccaatcgtggctgccatggagacccagcatggcgtat

SEQ ID NO: 6715 - DNA, 140 bp, Artificial Sequence
  Synthetic
aggccctggctgctgatatgcgcaagctacttaagagctggcacctgccatcggtgttccatttaaagggcaaactcagcttcacatgccgctgtgatacagtgttttcgtgtgagggctgaccttttgggacagcggtg

SEQ ID NO: 6716 - DNA, 140 bp, Artificial Sequence
  Synthetic
caccgctgtcccaaaaggtcagccctcacacgaaaacactgtatcacagcggcatgtgaagctgagtttgccctttaaatggaacaccgatggcaggtgccagctcttaagtagcttgcgcatatcagcagccagggcct

SEQ ID NO: 6717 - DNA, 140 bp, Artificial Sequence
  Synthetic
aggccctggctgctgatatggatcaccgggaccatgggacactttattctcgcccgatgcccgaaaggagagacgctgacagtgggatttacggacagcagaaagatcagccacacatgcgaccttttgggacagcggtg

SEQ ID NO: 6718 - DNA, 140 bp, Artificial Sequence
  Synthetic
caccgctgtcccaaaaggtcgcatgtgtggctgatctttctgctgtccgtaaatcccactgtcagcgtctctcctttcgggcatcgggcgagaataaagtgtcccatggtcccggtgatccatatcagcagccagggcct

SEQ ID NO: 6719 - DNA, 140 bp, Artificial Sequence
  Synthetic
aggccctggctgctgatatgacgtcgttaagagaataacgatgagcccaggcctttatggaaaaaccacagggtatgcggtaacccaccacgcagacggatttctgatgtgcaagactacgaccttttgggacagcggtg

SEQ ID NO: 6720 - DNA, 140 bp, Artificial Sequence
  Synthetic
caccgctgtcccaaaaggtcgtagtcttgcacatcagaaatccgtctgcgtggtgggttaccgcataccctgtggtttttccataaaggcctgggctcatcgttattctcttaacgacgtcatatcagcagccagggcct

SEQ ID NO: 6721 - DNA, 140 bp, Artificial Sequence
  Synthetic
aggccctggctgctgatatgttggcaaacggaagagatgtaggtacttaagcttcctaaaagcagccgaactcactttgagaagtaggcatagcataccgaactcttccacgattctcgagaccttttgggacagcggtg

SEQ ID NO: 6722 - DNA, 140 bp, Artificial Sequence
  Synthetic
caccgctgtcccaaaaggtctcgagaatcgtggaagagttcggtatgctatgcctacttctcaaagtgagttcggctgcttttaggaagcttaagtacctacatctcttccgtttgccaacatatcagcagccagggcct

SEQ ID NO: 6723 - DNA, 140 bp, Artificial Sequence
  Synthetic
aggccctggctgctgatatgctctcgaccacaacatggtaaagagttaccttgcagcacgtacgtgcagagcaccgctgccactgccgaggagatagaggtgcatatgcccccagatactgaccttttgggacagcggtg

SEQ ID NO: 6724 - DNA, 140 bp, Artificial Sequence
  Synthetic
caccgctgtcccaaaaggtcagtatctgggggcatatgcacctctatctcctcggcagtggcagcggtgctctgcacgtacgtgctgcaaggtaactctttaccatgttgtggtcgagagcatatcagcagccagggcct

SEQ ID NO: 6725 - DNA, 140 bp, Artificial Sequence
  Synthetic
aggccctggctgctgatatggtaccgagtctgtggtcgtccgggttgtcaatccctttgaggactagaatcaaatggttgttaagcaaggtgccaaaaaccgacctgatcccatacagcggaccttttgggacagcggtg

SEQ ID NO: 6726 - DNA, 140 bp, Artificial Sequence
  Synthetic
caccgctgtcccaaaaggtccgctgtatgggatcaggtcggtttttggcaccttgcttaacaaccatttgattctagtcctcaaagggattgacaacccggacgaccacagactcggtaccatatcagcagccagggcct

SEQ ID NO: 6727 - DNA, 140 bp, Artificial Sequence
  Synthetic
aggccctggctgctgatatgtgcaccgtcgtaccgggtaaaacgcatggacatcgcgaagaacgatgaagagtgcgtagtcaacgccgctaaccctcgcgggttaccgggtgacggtgttgaccttttgggacagcggtg

SEQ ID NO: 6728 - DNA, 140 bp, Artificial Sequence
  Synthetic
caccgctgtcccaaaaggtcaacaccgtcacccggtaacccgcgagggttagcggcgttgactacgcactcttcatcgttcttcgcgatgtccatgcgttttacccggtacgacggtgcacatatcagcagccagggcct

SEQ ID NO: 6729 - DNA, 140 bp, Artificial Sequence
  Synthetic
atacgccatgctgggtctcccccgcgtaacgctgaactcggggaccgtaaaggaaagattcacatcccattcccattggcaaacgtgacttgcagagtgccaaaagcaagaaaccccacacgtacttgggagtcggccat

SEQ ID NO: 6730 - DNA, 140 bp, Artificial Sequence
  Synthetic
atggccgactcccaagtacgtgtggggtttcttgcttttggcactctgcaagtcacgtttgccaatgggaatgggatgtgaatctttcctttacggtccccgagttcagcgttacgcgggggagacccagcatggcgtat

SEQ ID NO: 6731 - DNA, 140 bp, Artificial Sequence
  Synthetic
atacgccatgctgggtctccgagtttaagcgaaagcgcaacgatggtgtataacgaaagagagttcgtaaacagaaagttacaccatattgtgatgcacggaccagccctgaacaccgaccgtacttgggagtcggccat

SEQ ID NO: 6732 - DNA, 140 bp, Artificial Sequence
  Synthetic
atggccgactcccaagtacggtcggtgttcagggctggtccgtgcatcacaatatggtgtaactttctgtttacgaactctctttcgttatacaccatcgttgcgctttcgcttaaactcggagacccagcatggcgtat

SEQ ID NO: 6733 - DNA, 140 bp, Artificial Sequence
  Synthetic
atacgccatgctgggtctccgtaacgtacggaaaaaaccaagtcaccatgctgttgtatcctgaccatccgacactcttgtcttatcgtaacatgggacaggaaccaaattaccacgaggcgtacttgggagtcggccat

SEQ ID NO: 6734 - DNA, 140 bp, Artificial Sequence
  Synthetic
atggccgactcccaagtacgcctcgtggtaatttggttcctgtcccatgttacgataagacaagagtgtcggatggtcaggatacaacagcatggtgacttggttttttccgtacgttacggagacccagcatggcgtat

SEQ ID NO: 6735 - DNA, 140 bp, Artificial Sequence
  Synthetic
aggccctggctgctgatatggaattggcagctgcctatcgagaagtcgcaaaggaagtaactaggctgggagtaaatagtgtagctatacctctcctctctacaggtgtatactcaggaggaccttttgggacagcggtg

SEQ ID NO: 6736 - DNA, 140 bp, Artificial Sequence
  Synthetic
caccgctgtcccaaaaggtcctcctgagtatacacctgtagagaggagaggtatagctacactatttactcccagcctagttacttcctttgcgacttctcgataggcagctgccaattccatatcagcagccagggcct

SEQ ID NO: 6737 - DNA, 140 bp, Artificial Sequence
  Synthetic
atacgccatgctgggtctccgtgcggcttcttcaatatgatgcagatgaaagtcaactataatcataacatccgcacccaagtgtaccacaaaagtatctccaggcggtgtacactgcctcgtacttgggagtcggccat

SEQ ID NO: 6738 - DNA, 140 bp, Artificial Sequence
  Synthetic
atggccgactcccaagtacgaggcagtgtacaccgcctggagatacttttgtggtacacttgggtgcggatgttatgattatagttgactttcatctgcatcatattgaagaagccgcacggagacccagcatggcgtat

SEQ ID NO: 6739 - DNA, 140 bp, Artificial Sequence
  Synthetic
atacgccatgctgggtctccgtgaccgccgttgtgtcatcgttgcattacgaaggcaaaatgcgcactacgaatgagtacaacaagccgattgtagtggatactacaggctcaacaagaccgtacttgggagtcggccat

SEQ ID NO: 6740 - DNA, 140 bp, Artificial Sequence
  Synthetic
atggccgactcccaagtacggtcttgttgagcctgtagtatccactacaatcggcttgttgtactcattcgtagtgcgcattttgccttcgtaatgcaacgatgacacaacggcggtcacggagacccagcatggcgtat

SEQ ID NO: 6741 - DNA, 140 bp, Artificial Sequence
  Synthetic
aggccctggctgctgatatgggaaagacaggctgacccagtcactgaaccacctctttacagccatggactcgacggatgcagacgtggtcatctactgccgcgacaaagaatgggagaagaccttttgggacagcggtg

SEQ ID NO: 6742 - DNA, 140 bp, Artificial Sequence
  Synthetic
caccgctgtcccaaaaggtcttctcccattctttgtcgcggcagtagatgaccacgtctgcatccgtcgagtccatggctgtaaagaggtggttcagtgactgggtcagcctgtctttcccatatcagcagccagggcct

SEQ ID NO: 6743 - DNA, 140 bp, Artificial Sequence
  Synthetic
aggccctggctgctgatatgagcacatctccatagactgcgatattgttcgcgtgcaccctgacagcagcttggcaggcagaaaaggatacagcaccacggaaggcgcactgtactcatagaccttttgggacagcggtg

SEQ ID NO: 6744 - DNA, 140 bp, Artificial Sequence
  Synthetic
caccgctgtcccaaaaggtctatgagtacagtgcgccttccgtggtgctgtatccttttctgcctgccaagctgctgtcagggtgcacgcgaacaatatcgcagtctatggagatgtgctcatatcagcagccagggcct

SEQ ID NO: 6745 - DNA, 140 bp, Artificial Sequence
  Synthetic
atacgccatgctgggtctccaaactggatgaagcaaaggagcaactattacttaagaaactccaggagagtgcatccatggccaacagaagcaggtaccagtcgcgcaaagtagaaaacacgtacttgggagtcggccat

SEQ ID NO: 6746 - DNA, 140 bp, Artificial Sequence
  Synthetic
atggccgactcccaagtacgtgttttctactttgcgcgactggtacctgcttctgttggccatggatgcactctcctggagtttcttaagtaatagttgctcctttgcttcatccagtttggagacccagcatggcgtat

SEQ ID NO: 6747 - DNA, 140 bp, Artificial Sequence
  Synthetic
aggccctggctgctgatatgatactatgtggccaaagcaaacagaggccaatgagcaagtctgcctatatgccctgggggaaagtattgaatcgatcaggcagaaatgcccggtggatgagaccttttgggacagcggtg

SEQ ID NO: 6748 - DNA, 140 bp, Artificial Sequence
  Synthetic
caccgctgtcccaaaaggtctcatccaccgggcatttctgcctgatcgattcaatactttcccccagggcatataggcagacttgctcattggcctctgtttgctttggccacatagtatcatatcagcagccagggcct

SEQ ID NO: 6749 - DNA, 140 bp, Artificial Sequence
  Synthetic
aggccctggctgctgatatggccctgggggaaagtattgaatcgatcaggcagaaatgcccggtggatgatgcagacgcatcatctccccccaaaactgtcccgtgcctttgccgttacggaccttttgggacagcggtg

SEQ ID NO: 6750 - DNA, 140 bp, Artificial Sequence
  Synthetic
caccgctgtcccaaaaggtccgtaacggcaaaggcacgggacagttttggggggagatgatgcgtctgcatcatccaccgggcatttctgcctgatcgattcaatactttcccccagggccatatcagcagccagggcct

SEQ ID NO: 6751 - DNA, 140 bp, Artificial Sequence
  Synthetic
aggccctggctgctgatatgtattcaacgtggagtgtttcaaaaaattcgcatgcaaccaagaatactgggaagaatttgctgccagccctattaggataacaactgagaatttagcaacgaccttttgggacagcggtg

SEQ ID NO: 6752 - DNA, 140 bp, Artificial Sequence
  Synthetic
caccgctgtcccaaaaggtcgttgctaaattctcagttgttatcctaatagggctggcagcaaattcttcccagtattcttggttgcatgcgaattttttgaaacactccacgttgaatacatatcagcagccagggcct

SEQ ID NO: 6753 - DNA, 140 bp, Artificial Sequence
  Synthetic
atacgccatgctgggtctccagagaaatctgaatcttgcaaaacagagtttgcatcggcctacagagcccacaccgcatcggcgtcggcgaagctccgcgtcctttaccaaggaaacaaccgtacttgggagtcggccat

SEQ ID NO: 6754 - DNA, 140 bp, Artificial Sequence
  Synthetic
atggccgactcccaagtacggttgtttccttggtaaaggacgcggagcttcgccgacgccgatgcggtgtgggctctgtaggccgatgcaaactctgttttgcaagattcagatttctctggagacccagcatggcgtat

SEQ ID NO: 6755 - DNA, 140 bp, Artificial Sequence
  Synthetic
aggccctggctgctgatatggccgcccagaagaaggcgagggagaaacctgactgtgacatgtgacgagagagaagggaatataacacccatggctagcgtccgattctttagggcagaggaccttttgggacagcggtg

SEQ ID NO: 6756 - DNA, 140 bp, Artificial Sequence
  Synthetic
caccgctgtcccaaaaggtcctctgccctaaagaatcggacgctagccatgggtgttatattcccttctctctcgtcacatgtcacagtcaggtttctccctcgccttcttctgggcggccatatcagcagccagggcct

SEQ ID NO: 6757 - DNA, 140 bp, Artificial Sequence
  Synthetic
aggccctggctgctgatatgtcttcaggcaccaccgagtaccgccacggaaccgaatcatccgccgatctccttcggagcatcaagcgagacgttccccattacatttggggacttcaacgaccttttgggacagcggtg

SEQ ID NO: 6758 - DNA, 140 bp, Artificial Sequence
  Synthetic
caccgctgtcccaaaaggtcgttgaagtccccaaatgtaatggggaacgtctcgcttgatgctccgaaggagatcggcggatgattcggttccgtggcggtactcggtggtgcctgaagacatatcagcagccagggcct

SEQ ID NO: 6759 - DNA, 140 bp, Artificial Sequence
  Synthetic
aggccctggctgctgatatgcagacacggacgacgagttatgactagacagggcaggtgggtatatattctcgtcggacaccggtccaggtcatttacaacagaagtcagtacgccagtcgaccttttgggacagcggtg

SEQ ID NO: 6760 - DNA, 140 bp, Artificial Sequence
  Synthetic
caccgctgtcccaaaaggtcgactggcgtactgacttctgttgtaaatgacctggaccggtgtccgacgagaatatatacccacctgccctgtctagtcataactcgtcgtccgtgtctgcatatcagcagccagggcct

SEQ ID NO: 6761 - DNA, 140 bp, Artificial Sequence
  Synthetic
atacgccatgctgggtctccattccgctggcagccctgattgttctatgcaactgtctgagactcttaccatgctgctgtaatacgttggcttttttagccgtaatgagcgtcggtgcctcgtacttgggagtcggccat

SEQ ID NO: 6762 - DNA, 140 bp, Artificial Sequence
  Synthetic
atggccgactcccaagtacgaggcaccgacgctcattacggctaaaaaagccaacgtattacagcagcatggtaagagtctcagacagttgcatagaacaatcagggctgccagcggaatggagacccagcatggcgtat

SEQ ID NO: 6763 - DNA, 140 bp, Artificial Sequence
  Synthetic
atacgccatgctgggtctccgcgcctgtgtactcgcctccgatcaacgtccgattgtccaatcccgagtccgcagtggcagcatgcaatgagttcttagctagaaactatccaactgtctcgtacttgggagtcggccat

SEQ ID NO: 6764 - DNA, 140 bp, Artificial Sequence
  Synthetic
atggccgactcccaagtacgagacagttggatagtttctagctaagaactcattgcatgctgccactgcggactcgggattggacaatcggacgttgatcggaggcgagtacacaggcgcggagacccagcatggcgtat

SEQ ID NO: 6765 - DNA, 140 bp, Artificial Sequence
  Synthetic
atacgccatgctgggtctccgaccaggacaatttggcgatatccaaagtcgtacacctgagagtaaagacgtctatgctaatacacagctggtactgcagagaccggctgcgggtacggtcgtacttgggagtcggccat

SEQ ID NO: 6766 - DNA, 140 bp, Artificial Sequence
  Synthetic
atggccgactcccaagtacgaccgtacccgcagccggtctctgcagtaccagctgtgtattagcatagacgtctttactctcaggtgtacgactttggatatcgccaaattgtcctggtcggagacccagcatggcgtat

SEQ ID NO: 6767 - DNA, 140 bp, Artificial Sequence
  Synthetic
aggccctggctgctgatatggagctacccgaaacagcacgcttaccacgcgccctccatcagaagcgctgtaccgtccccattccagaacacactacagaatgtactggcagcagccacggaccttttgggacagcggtg

SEQ ID NO: 6768 - DNA, 140 bp, Artificial Sequence
  Synthetic
caccgctgtcccaaaaggtccgtggctgctgccagtacattctgtagtgtgttctggaatggggacggtacagcgcttctgatggagggcgcgtggtaagcgtgctgtttcgggtagctccatatcagcagccagggcct

SEQ ID NO: 6769 - DNA, 140 bp, Artificial Sequence
  Synthetic
aggccctggctgctgatatgtaccgtccccattccagaacacactacagaatgtactggcagcagccacgaaaagaaactgcaacgtcacacagatgagggaattacccactttggactcgaccttttgggacagcggtg

SEQ ID NO: 6770 - DNA, 140 bp, Artificial Sequence
  Synthetic
caccgctgtcccaaaaggtcgagtccaaagtgggtaattccctcatctgtgtgacgttgcagtttcttttcgtggctgctgccagtacattctgtagtgtgttctggaatggggacggtacatatcagcagccagggcct

SEQ ID NO: 6771 - DNA, 140 bp, Artificial Sequence
  Synthetic
aggccctggctgctgatatgcatcgacataccggaagcggccttcactagggtcgtcgacgcgccctctttaacggacatgtcgtgcgaggtaccagcctgcacccattcctcagactttgaccttttgggacagcggtg

SEQ ID NO: 6772 - DNA, 140 bp, Artificial Sequence
  Synthetic
caccgctgtcccaaaaggtcaaagtctgaggaatgggtgcaggctggtacctcgcacgacatgtccgttaaagagggcgcgtcgacgaccctagtgaaggccgcttccggtatgtcgatgcatatcagcagccagggcct

SEQ ID NO: 6773 - DNA, 140 bp, Artificial Sequence
  Synthetic
atacgccatgctgggtctccctataaataaaagtagttcaaagggctacaaaacccctgaatagtaacaaaacataaaatgtaataaaaattaagtgtgtacccaaaagaggtacagtaacgtacttgggagtcggccat

SEQ ID NO: 6774 - DNA, 140 bp, Artificial Sequence
  Synthetic
atggccgactcccaagtacgttactgtacctcttttgggtacacacttaatttttattacattttatgttttgttactattcaggggttttgtagccctttgaactacttttatttatagggagacccagcatggcgtat

SEQ ID NO: 6775 - DNA, 140 bp, Artificial Sequence
  Synthetic
aggccctggctgctgatatggcgcttcaagttcggcgccatgatgaaatcaggtatgttcctaactctgttcgtcaacacattgttaaacatcaccatcgccagccgagtgctggaagatgaccttttgggacagcggtg

SEQ ID NO: 6776 - DNA, 140 bp, Artificial Sequence
  Synthetic
caccgctgtcccaaaaggtcatcttccagcactcggctggcgatggtgatgtttaacaatgtgttgacgaacagagttaggaacatacctgatttcatcatggcgccgaacttgaagcgccatatcagcagccagggcct

SEQ ID NO: 6777 - DNA, 140 bp, Artificial Sequence
  Synthetic
atacgccatgctgggtctccacattaatgtcacaacagtccggcaacgtaaagatcacagtcaatggccagacggtgcagtacaagtgtgattgcggtggctcaaatgaaggactaacaacgtacttgggagtcggccat

SEQ ID NO: 6778 - DNA, 140 bp, Artificial Sequence
  Synthetic
atggccgactcccaagtacgttgttagtccttcatttgagccaccgcaatcacacttgtactgcaccgtctggccattgactgtgatctttacgttgccggactgttgtgacattaatgtggagacccagcatggcgtat

SEQ ID NO: 6779 - DNA, 140 bp, Artificial Sequence
  Synthetic
aggccctggctgctgatatgcggtggctcaaatgaaggactaacaactacagacaaagtgattaataactgcaaggtagatcaatgtcatgccgcggtcaccaatcacaaaaagtggcaggaccttttgggacagcggtg

SEQ ID NO: 6780 - DNA, 140 bp, Artificial Sequence
  Synthetic
caccgctgtcccaaaaggtcctgccactttttgtgattggtgaccgcggcatgacattgatctaccttgcagttattaatcactttgtctgtagttgttagtccttcatttgagccaccgcatatcagcagccagggcct

SEQ ID NO: 6781 - DNA, 140 bp, Artificial Sequence
  Synthetic
aggccctggctgctgatatggcgcgcggtaccccaacagaagccacgcaggaatcggaagaataagaagcaaaagcaaaaacaacaggcgccacaaaacaacacaaatcaaaagaagcaggaccttttgggacagcggtg

SEQ ID NO: 6782 - DNA, 140 bp, Artificial Sequence
  Synthetic
caccgctgtcccaaaaggtcctgcttcttttgatttgtgttgttttgtggcgcctgttgtttttgcttttgcttcttattcttccgattcctgcgtggcttctgttggggtaccgcgcgccatatcagcagccagggcct

SEQ ID NO: 6783 - DNA, 140 bp, Artificial Sequence
  Synthetic
aggccctggctgctgatatgctttaagcggtcatctaagtatgaccttgaatgcgcgcagatacccgtgcacatgaagtccgacgcttcgaagttcacccatgagaaaccggaggggtacgaccttttgggacagcggtg

SEQ ID NO: 6784 - DNA, 140 bp, Artificial Sequence
  Synthetic
caccgctgtcccaaaaggtcgtacccctccggtttctcatgggtgaacttcgaagcgtcggacttcatgtgcacgggtatctgcgcgcattcaaggtcatacttagatgaccgcttaaagcatatcagcagccagggcct

SEQ ID NO: 6785 - DNA, 140 bp, Artificial Sequence
  Synthetic
atacgccatgctgggtctccatggctgcgtgagactcacgtagcctaccagtttcttactgctctactctgcaaagcaagagatcaataacccatcatggattctgtgtacgtggatatacgtacttgggagtcggccat

SEQ ID NO: 6786 - DNA, 140 bp, Artificial Sequence
  Synthetic
atggccgactcccaagtacgtatatccacgtacacagaatccatgatgggttattgatctcttgctttgcagagtagagcagtaagaaactggtaggctacgtgagtctcacgcagccatggagacccagcatggcgtat

SEQ ID NO: 6787 - DNA, 140 bp, Artificial Sequence
  Synthetic
atacgccatgctgggtctccgtctatcatgagagggaaaaagctaaaaccgtgcgaccgtgtgctgttctcagtagggtcaaagctttacccggaaagccgcatgctacttaagagctggcgtacttgggagtcggccat

SEQ ID NO: 6788 - DNA, 140 bp, Artificial Sequence
  Synthetic
atggccgactcccaagtacgccagctcttaagtagcatgcggctttccgggtaaagctttgaccctactgagaacagcacacggtcgcacggttttagctttttccctctcatgatagacggagacccagcatggcgtat

SEQ ID NO: 6789 - DNA, 140 bp, Artificial Sequence
  Synthetic
aggccctggctgctgatatgtgctacgaaaaggaaccggaggaaaccctacgcatgcttgaggacaacgtcatgagacctgggtactatcagctgctacaagcatccttaacatgttctcgaccttttgggacagcggtg

SEQ ID NO: 6790 - DNA, 140 bp, Artificial Sequence
  Synthetic
caccgctgtcccaaaaggtcgagaacatgttaaggatgcttgtagcagctgatagtacccaggtctcatgacgttgtcctcaagcatgcgtagggtttcctccggttccttttcgtagcacatatcagcagccagggcct

SEQ ID NO: 6791 - DNA, 140 bp, Artificial Sequence
  Synthetic
atacgccatgctgggtctcccagagaggtctagaaatatctgcacgtacggtagattcgctgctcttgaatggatgcaatagaccagtcgacgtgttgtacgtagacgaggcgtttgcgtcgtacttgggagtcggccat

SEQ ID NO: 6792 - DNA, 140 bp, Artificial Sequence
  Synthetic
atggccgactcccaagtacgacgcaaacgcctcgtctacgtacaacacgtcgactggtctattgcatccattcaagagcagcgaatctaccgtacgtgcagatatttctagacctctctgggagacccagcatggcgtat

SEQ ID NO: 6793 - DNA, 140 bp, Artificial Sequence
  Synthetic
aggccctggctgctgatatgctgtcccgtgcctttgccgttatgccatgactcctgaacgcgtcacccgacttcacatgaaccgtgtcacaaatataattgtgtgttcttcatttcccctgaccttttgggacagcggtg

SEQ ID NO: 6794 - DNA, 140 bp, Artificial Sequence
  Synthetic
caccgctgtcccaaaaggtcaggggaaatgaagaacacacaattatatttgtgacacggttcatgtgaagtcgggtgacgcgttcaggagtcatggcataacggcaaaggcacgggacagcatatcagcagccagggcct

SEQ ID NO: 6795 - DNA, 140 bp, Artificial Sequence
  Synthetic
aggccctggctgctgatatgccatagtcccgtagcactagaacgcatcagaaatgaagcgacagacgggacgctgaaaatccaggtctccttgcaaatcggaataaagacggatgacagcgaccttttgggacagcggtg

SEQ ID NO: 6796 - DNA, 140 bp, Artificial Sequence
  Synthetic
caccgctgtcccaaaaggtcgctgtcatccgtctttattccgatttgcaaggagacctggattttcagcgtcccgtctgtcgcttcatttctgatgcgttctagtgctacgggactatggcatatcagcagccagggcct

SEQ ID NO: 6797 - DNA, 140 bp, Artificial Sequence
  Synthetic
atacgccatgctgggtctccgtacatacattaccaaccataattggaaaccttgcggccgtgtctgactgggtaatgagcaccgtacctgtcgcgccgcctagaagaaggagagggagaacgtacttgggagtcggccat

SEQ ID NO: 6798 - DNA, 140 bp, Artificial Sequence
  Synthetic
atggccgactcccaagtacgttctccctctccttcttctaggcggcgcgacaggtacggtgctcattacccagtcagacacggccgcaaggtttccaattatggttggtaatgtatgtacggagacccagcatggcgtat

SEQ ID NO: 6799 - DNA, 140 bp, Artificial Sequence
  Synthetic
atacgccatgctgggtctccatagtggtagaccgatctttgacaacaaggggcgcgtggtggccatagttttaggaggagctaatgaaggagcccgtacagccctctcggtggtgacctgcgtacttgggagtcggccat

SEQ ID NO: 6800 - DNA, 140 bp, Artificial Sequence
  Synthetic
atggccgactcccaagtacgcaggtcaccaccgagagggctgtacgggctccttcattagctcctcctaaaactatggccaccacgcgccccttgttgtcaaagatcggtctaccactatggagacccagcatggcgtat

SEQ ID NO: 6801 - DNA, 140 bp, Artificial Sequence
  Synthetic
aggccctggctgctgatatgcatggactacccgcccttcggcgcaggaagaccaggacaatttggcgacatccaaagtcgcacgcctgaaagcgaagacttctatgctaatacacaactggaccttttgggacagcggtg

SEQ ID NO: 6802 - DNA, 140 bp, Artificial Sequence
  Synthetic
caccgctgtcccaaaaggtccagttgtgtattagcatagaagtcttcgctttcaggcgtgcgactttggatgtcgccaaattgtcctggtcttcctgcgccgaagggcgggtagtccatgcatatcagcagccagggcct

SEQ ID NO: 6803 - DNA, 140 bp, Artificial Sequence
  Synthetic
aggccctggctgctgatatgcacattaatgtcacaacagtccggcaacgtaaagatcacagtcaatggccagacggtgcggtacaagtgtaattgcggtggctcaaatgaaggactaacagaccttttgggacagcggtg

SEQ ID NO: 6804 - DNA, 140 bp, Artificial Sequence
  Synthetic
caccgctgtcccaaaaggtctgttagtccttcatttgagccaccgcaattacacttgtaccgcaccgtctggccattgactgtgatctttacgttgccggactgttgtgacattaatgtgcatatcagcagccagggcct

SEQ ID NO: 6805 - DNA, 140 bp, Artificial Sequence
  Synthetic
aggccctggctgctgatatgaataaaacataaaattaataaggagtaccataattggcaaacggaagagacgtaggtacttaagcttcctaaaagcagccgaactcactttgagatgtaggaccttttgggacagcggtg

SEQ ID NO: 6806 - DNA, 140 bp, Artificial Sequence
  Synthetic
caccgctgtcccaaaaggtcctacatctcaaagtgagttcggctgcttttaggaagcttaagtacctacgtctcttccgtttgccaattatggtactccttattaattttatgttttattcatatcagcagccagggcct

SEQ ID NO: 6807 - DNA, 140 bp, Artificial Sequence
  Synthetic
aggccctggctgctgatatgactacagacaaagtgattaataactgcaaggttgatcaatgtcatgccgcggtcaccaatcacaaaaagtggcagtataactcccctctggtcccgcgtagaccttttgggacagcggtg

SEQ ID NO: 6808 - DNA, 140 bp, Artificial Sequence
  Synthetic
caccgctgtcccaaaaggtctacgcgggaccagaggggagttatactgccactttttgtgattggtgaccgcggcatgacattgatcaaccttgcagttattaatcactttgtctgtagtcatatcagcagccagggcct

SEQ ID NO: 6809 - DNA, 140 bp, Artificial Sequence
  Synthetic
atacgccatgctgggtctcccgtcactatttgggaagctgaaatagaagtggaagggaactctcagttgcaaatctcttttttgacggccctagccagcgccgaattccgcgtacaagtccgtacttgggagtcggccat

SEQ ID NO: 6810 - DNA, 140 bp, Artificial Sequence
  Synthetic
atggccgactcccaagtacggacttgtacgcggaattcggcgctggctagggccgtcaaaaaagagatttgcaactgagagttcccttccacttctatttcagcttcccaaatagtgacgggagacccagcatggcgtat

SEQ ID NO: 6811 - DNA, 140 bp, Artificial Sequence
  Synthetic
atacgccatgctgggtctccatggctgcatgagacacacgtagcctaccagtttcttactgctctactctgcaaagcaagagattaataacccatcatggattctgtgtacgtggacatacgtacttgggagtcggccat

SEQ ID NO: 6812 - DNA, 140 bp, Artificial Sequence
  Synthetic
atggccgactcccaagtacgtatgtccacgtacacagaatccatgatgggttattaatctcttgctttgcagagtagagcagtaagaaactggtaggctacgtgtgtctcatgcagccatggagacccagcatggcgtat

SEQ ID NO: 6813 - DNA, 140 bp, Artificial Sequence
  Synthetic
atacgccatgctgggtctccatggctgcttgagacacacgtagcctaccagtttcttactgctctactctgcaaagcaagagattaataacccatcatggattctgtgtacgtggacatacgtacttgggagtcggccat

SEQ ID NO: 6814 - DNA, 140 bp, Artificial Sequence
  Synthetic
atggccgactcccaagtacgtatgtccacgtacacagaatccatgatgggttattaatctcttgctttgcagagtagagcagtaagaaactggtaggctacgtgtgtctcaagcagccatggagacccagcatggcgtat

SEQ ID NO: 6815 - DNA, 140 bp, Artificial Sequence
  Synthetic
atacgccatgctgggtctccatggctgcctgagacacacgtagcctaccagtttcttactgctctactctgcaaagcaagagattaataacccatcatggattctgtgtacgtggacatacgtacttgggagtcggccat

SEQ ID NO: 6816 - DNA, 140 bp, Artificial Sequence
  Synthetic
atggccgactcccaagtacgtatgtccacgtacacagaatccatgatgggttattaatctcttgctttgcagagtagagcagtaagaaactggtaggctacgtgtgtctcaggcagccatggagacccagcatggcgtat

SEQ ID NO: 6817 - DNA, 140 bp, Artificial Sequence
  Synthetic
atacgccatgctgggtctccatggctgcgtgagacacacgtagcctaccagtttcttactgctctactctgcaaagcaagagattaataacccatcatggattctgtgtacgtggacatacgtacttgggagtcggccat

SEQ ID NO: 6818 - DNA, 140 bp, Artificial Sequence
  Synthetic
atggccgactcccaagtacgtatgtccacgtacacagaatccatgatgggttattaatctcttgctttgcagagtagagcagtaagaaactggtaggctacgtgtgtctcacgcagccatggagacccagcatggcgtat

SEQ ID NO: 6819 - DNA, 140 bp, Artificial Sequence
  Synthetic
aggccctggctgctgatatgagacggtgcggtacaagtgtaattgcggtggctcaaatgaaggactaacaactacagacaaagtgattaataactgcaaggttgatcaatgtcatgccgcgaccttttgggacagcggtg

SEQ ID NO: 6820 - DNA, 140 bp, Artificial Sequence
  Synthetic
caccgctgtcccaaaaggtcgcggcatgacattgatcaaccttgcagttattaatcactttgtctgtagttgttagtccttcatttgagccaccgcaattacacttgtaccgcaccgtctcatatcagcagccagggcct

SEQ ID NO: 6821 - DNA, 140 bp, Artificial Sequence
  Synthetic
atacgccatgctgggtctccgctctaccaccactacaggcagcacaggaagatgtccaggtcgaaatcgacgtggaacagcttgaggatagagctggtgctggaataatagagactccgacgtacttgggagtcggccat

SEQ ID NO: 6822 - DNA, 140 bp, Artificial Sequence
  Synthetic
atggccgactcccaagtacgtcggagtctctattattccagcaccagctctatcctcaagctgttccacgtcgatttcgacctggacatcttcctgtgctgcctgtagtggtggtagagcggagacccagcatggcgtat

SEQ ID NO: 6823 - DNA, 140 bp, Artificial Sequence
  Synthetic
atacgccatgctgggtctccgctctaccacctctacaggcagcacaggaagatgtccaggtcgaaatcgacgtggaacagcttgaggatagagctggtgctggaataatagagactccgacgtacttgggagtcggccat

SEQ ID NO: 6824 - DNA, 140 bp, Artificial Sequence
  Synthetic
atggccgactcccaagtacgtcggagtctctattattccagcaccagctctatcctcaagctgttccacgtcgatttcgacctggacatcttcctgtgctgcctgtagaggtggtagagcggagacccagcatggcgtat

SEQ ID NO: 6825 - DNA, 140 bp, Artificial Sequence
  Synthetic
atacgccatgctgggtctccgctctaccacccctacaggcagcacaggaagatgtccaggtcgaaatcgacgtggaacagcttgaggatagagctggtgctggaataatagagactccgacgtacttgggagtcggccat

SEQ ID NO: 6826 - DNA, 140 bp, Artificial Sequence
  Synthetic
atggccgactcccaagtacgtcggagtctctattattccagcaccagctctatcctcaagctgttccacgtcgatttcgacctggacatcttcctgtgctgcctgtaggggtggtagagcggagacccagcatggcgtat

SEQ ID NO: 6827 - DNA, 140 bp, Artificial Sequence
  Synthetic
atacgccatgctgggtctccgctctaccaccgctacaggcagcacaggaagatgtccaggtcgaaatcgacgtggaacagcttgaggatagagctggtgctggaataatagagactccgacgtacttgggagtcggccat

SEQ ID NO: 6828 - DNA, 140 bp, Artificial Sequence
  Synthetic
atggccgactcccaagtacgtcggagtctctattattccagcaccagctctatcctcaagctgttccacgtcgatttcgacctggacatcttcctgtgctgcctgtagcggtggtagagcggagacccagcatggcgtat

SEQ ID NO: 6829 - DNA, 140 bp, Artificial Sequence
  Synthetic
aggccctggctgctgatatgcagctgtcatctgccgacaggtacgcgcttcaagttcggcgctatgatgaaatccggtatgttcctaactctgttcgtcaacacgttgttaaaaatcaccgaccttttgggacagcggtg

SEQ ID NO: 6830 - DNA, 140 bp, Artificial Sequence
  Synthetic
caccgctgtcccaaaaggtcggtgatttttaacaacgtgttgacgaacagagttaggaacataccggatttcatcatagcgccgaacttgaagcgcgtacctgtcggcagatgacagctgcatatcagcagccagggcct

SEQ ID NO: 6831 - DNA, 140 bp, Artificial Sequence
  Synthetic
aggccctggctgctgatatgcagctgtcatctgccgacaggtacgcgcttcaagttcggcgctatgatgaaatccggtatgttcctaactctgttcgtcaacacgttgttaaatatcaccgaccttttgggacagcggtg

SEQ ID NO: 6832 - DNA, 140 bp, Artificial Sequence
  Synthetic
caccgctgtcccaaaaggtcggtgatatttaacaacgtgttgacgaacagagttaggaacataccggatttcatcatagcgccgaacttgaagcgcgtacctgtcggcagatgacagctgcatatcagcagccagggcct

SEQ ID NO: 6833 - DNA, 140 bp, Artificial Sequence
  Synthetic
aggccctggctgctgatatgcagctgtcatctgccgacaggtacgcgcttcaagttcggcgctatgatgaaatccggtatgttcctaactctgttcgtcaacacgttgttaaacatcaccgaccttttgggacagcggtg

SEQ ID NO: 6834 - DNA, 140 bp, Artificial Sequence
  Synthetic
caccgctgtcccaaaaggtcggtgatgtttaacaacgtgttgacgaacagagttaggaacataccggatttcatcatagcgccgaacttgaagcgcgtacctgtcggcagatgacagctgcatatcagcagccagggcct

SEQ ID NO: 6835 - DNA, 140 bp, Artificial Sequence
  Synthetic
aggccctggctgctgatatgcagctgtcatctgccgacaggtacgcgcttcaagttcggcgctatgatgaaatccggtatgttcctaactctgttcgtcaacacgttgttaaagatcaccgaccttttgggacagcggtg

SEQ ID NO: 6836 - DNA, 140 bp, Artificial Sequence
  Synthetic
caccgctgtcccaaaaggtcggtgatctttaacaacgtgttgacgaacagagttaggaacataccggatttcatcatagcgccgaacttgaagcgcgtacctgtcggcagatgacagctgcatatcagcagccagggcct

SEQ ID NO: 6837 - DNA, 140 bp, Artificial Sequence
  Synthetic
aggccctggctgctgatatgacgtgccggcgaccatttgtgatcaaatgaccggcatccttgctacagaagtcacgccggaggatgcacagaagctgttggtggggctgaaccagagaatgaccttttgggacagcggtg

SEQ ID NO: 6838 - DNA, 140 bp, Artificial Sequence
  Synthetic
caccgctgtcccaaaaggtcattctctggttcagccccaccaacagcttctgtgcatcctccggcgtgacttctgtagcaaggatgccggtcatttgatcacaaatggtcgccggcacgtcatatcagcagccagggcct

SEQ ID NO: 6839 - DNA, 140 bp, Artificial Sequence
  Synthetic
aggccctggctgctgatatgggctgcgatatacctgtggaacgagcagcaacctttgttttggctacaagcccttattccgctggcagccctgattgttctatgcaactgtctgagactcgaccttttgggacagcggtg

SEQ ID NO: 6840 - DNA, 140 bp, Artificial Sequence
  Synthetic
caccgctgtcccaaaaggtcgagtctcagacagttgcatagaacaatcagggctgccagcggaataagggcttgtagccaaaacaaaggttgctgctcgttccacaggtatatcgcagcccatatcagcagccagggcct

SEQ ID NO: 6841 - DNA, 140 bp, Artificial Sequence
  Synthetic
atacgccatgctgggtctccatcggaataaagacggatgatagccatgattggaccaagctgcgttacatggacaatcacatgccagcagacgcagagagggccgggctatttgtaagaacgtacttgggagtcggccat

SEQ ID NO: 6842 - DNA, 140 bp, Artificial Sequence
  Synthetic
atggccgactcccaagtacgttcttacaaatagcccggccctctctgcgtctgctggcatgtgattgtccatgtaacgcagcttggtccaatcatggctatcatccgtctttattccgatggagacccagcatggcgtat

SEQ ID NO: 6843 - DNA, 140 bp, Artificial Sequence
  Synthetic
aggccctggctgctgatatgagcagcctttgttttggctgcaagcccttattccgctggcagccctgattgtcctatgcaactgtctgagactcttaccatgctgttgtaaaacgttgacgaccttttgggacagcggtg

SEQ ID NO: 6844 - DNA, 140 bp, Artificial Sequence
  Synthetic
caccgctgtcccaaaaggtcgtcaacgttttacaacagcatggtaagagtctcagacagttgcataggacaatcagggctgccagcggaataagggcttgcagccaaaacaaaggctgctcatatcagcagccagggcct

SEQ ID NO: 6845 - DNA, 140 bp, Artificial Sequence
  Synthetic
aggccctggctgctgatatgctgcctgtgaccgccattgtgtcatcgttgcattacgaaggcaaaatgcgcactacgaatgagtacaacaagccgattgtagtggacactacaggctcaagaccttttgggacagcggtg

SEQ ID NO: 6846 - DNA, 140 bp, Artificial Sequence
  Synthetic
caccgctgtcccaaaaggtcttgagcctgtagtgtccactacaatcggcttgttgtactcattcgtagtgcgcattttgccttcgtaatgcaacgatgacacaatggcggtcacaggcagcatatcagcagccagggcct

SEQ ID NO: 6847 - DNA, 140 bp, Artificial Sequence
  Synthetic
atacgccatgctgggtctcctagcctaccagtttcttactgctctactctgcaaagcaagagattaataacccatcatggattctgtgtacgtggatatagacgctgacagcgcctttttcgtacttgggagtcggccat

SEQ ID NO: 6848 - DNA, 140 bp, Artificial Sequence
  Synthetic
atggccgactcccaagtacgaaaaaggcgctgtcagcgtctatatccacgtacacagaatccatgatgggttattaatctcttgctttgcagagtagagcagtaagaaactggtaggctaggagacccagcatggcgtat

SEQ ID NO: 6849 - DNA, 140 bp, Artificial Sequence
  Synthetic
atacgccatgctgggtctccgtggtgtacaaaggtgacgtctataacatggactacccgccctttggcgcaggaagaccaggacaatttggcgatatccaaagtcgcacacctgagagtacgtacttgggagtcggccat

SEQ ID NO: 6850 - DNA, 140 bp, Artificial Sequence
  Synthetic
atggccgactcccaagtacgtactctcaggtgtgcgactttggatatcgccaaattgtcctggtcttcctgcgccaaagggcgggtagtccatgttatagacgtcacctttgtacaccacggagacccagcatggcgtat

SEQ ID NO: 6851 - DNA, 140 bp, Artificial Sequence
  Synthetic
aggccctggctgctgatatgaaactaatagagcaggaaattgatcccgactcaaccatcctggatataggtagtgcgccagcaaggaggatgatgtcggacaggaagtaccactgcgtttgaccttttgggacagcggtg

SEQ ID NO: 6852 - DNA, 140 bp, Artificial Sequence
  Synthetic
caccgctgtcccaaaaggtcaaacgcagtggtacttcctgtccgacatcatcctccttgctggcgcactacctatatccaggatggttgagtcgggatcaatttcctgctctattagtttcatatcagcagccagggcct

SEQ ID NO: 6853 - DNA, 140 bp, Artificial Sequence
  Synthetic
aggccctggctgctgatatggatcggggacttacaagcggtgatggccgtgccagacacggagacgccaacattttgcttacacacagatgtctcatgtagacagagagcagacgtcgcggaccttttgggacagcggtg

SEQ ID NO: 6854 - DNA, 140 bp, Artificial Sequence
  Synthetic
caccgctgtcccaaaaggtccgcgacgtctgctctctgtctacatgagacatctgtgtgtaagcaaaatgttggcgtctccgtgtctggcacggccatcaccgcttgtaagtccccgatccatatcagcagccagggcct

SEQ ID NO: 6855 - DNA, 140 bp, Artificial Sequence
  Synthetic
atacgccatgctgggtctcccattttgcttacacacagatgtctcatgtagacagagagcagacgtcgcgatataccaagacgtctatgctgtacacgcacccacgtcgctatatcaccacgtacttgggagtcggccat

SEQ ID NO: 6856 - DNA, 140 bp, Artificial Sequence
  Synthetic
atggccgactcccaagtacgtggtgatatagcgacgtgggtgcgtgtacagcatagacgtcttggtatatcgcgacgtctgctctctgtctacatgagacatctgtgtgtaagcaaaatgggagacccagcatggcgtat

SEQ ID NO: 6857 - DNA, 140 bp, Artificial Sequence
  Synthetic
aggccctggctgctgatatgatggcgagatactgcccgtcccgtcagacctggatgctgacgccccagccctagaaccagcactagacgacggggcgacacacacgctgccatccacaacgaccttttgggacagcggtg

SEQ ID NO: 6858 - DNA, 140 bp, Artificial Sequence
  Synthetic
caccgctgtcccaaaaggtcgttgtggatggcagcgtgtgtgtcgccccgtcgtctagtgctggttctagggctggggcgtcagcatccaggtctgacgggacgggcagtatctcgccatcatatcagcagccagggcct

SEQ ID NO: 6859 - DNA, 140 bp, Artificial Sequence
  Synthetic
atacgccatgctgggtctcctgtgcggtgcattcgatgactaacgccgtcactattcgggaagctgagatagaagttgaagggaattctcagctgcaaatctctttctcgacggccttagcgtacttgggagtcggccat

SEQ ID NO: 6860 - DNA, 140 bp, Artificial Sequence
  Synthetic
atggccgactcccaagtacgctaaggccgtcgagaaagagatttgcagctgagaattcccttcaacttctatctcagcttcccgaatagtgacggcgttagtcatcgaatgcaccgcacaggagacccagcatggcgtat

SEQ ID NO: 6861 - DNA, 140 bp, Artificial Sequence
  Synthetic
atacgccatgctgggtctccagacctgacggaaggtagacgaggcaaattgtctatcatgagagggaaaaagctaaaaccgtgcgaccgtgtgctgttctcagtagggtcaacgctttaccgtacttgggagtcggccat

SEQ ID NO: 6862 - DNA, 140 bp, Artificial Sequence
  Synthetic
atggccgactcccaagtacggtaaagcgttgaccctactgagaacagcacacggtcgcacggttttagctttttccctctcatgatagacaatttgcctcgtctaccttccgtcaggtctggagacccagcatggcgtat

SEQ ID NO: 6863 - DNA, 140 bp, Artificial Sequence
  Synthetic
aggccctggctgctgatatgagaagatcacgggaggtgtgggactggttgttgctgttgccgcactgattctaatcgtggtgctatgcgtgtcgttcagcaggcactaacttgacaattagaccttttgggacagcggtg

SEQ ID NO: 6864 - DNA, 140 bp, Artificial Sequence
  Synthetic
caccgctgtcccaaaaggtctaattgtcaagttagtgcctgctgaacgacacgcatagcaccacgattagaatcagtgcggcaacagcaacaaccagtcccacacctcccgtgatcttctcatatcagcagccagggcct

SEQ ID NO: 6865 - DNA, 140 bp, Artificial Sequence
  Synthetic
aggccctggctgctgatatgctaatcgtggtgctatgcgtgtcgttcagcaggcactaacttgacaattaagtatgaaggtatatgtgtcccctaagagacacactatacatagcaaatagaccttttgggacagcggtg

SEQ ID NO: 6866 - DNA, 140 bp, Artificial Sequence
  Synthetic
caccgctgtcccaaaaggtctatttgctatgtatagtgtgtctcttaggggacacatataccttcatacttaattgtcaagttagtgcctgctgaacgacacgcatagcaccacgattagcatatcagcagccagggcct

SEQ ID NO: 6867 - DNA, 140 bp, Artificial Sequence
  Synthetic
aggccctggctgctgatatggtgagggctacgtcgttaagagaataacgatgagcccaggcctttatggaaaaaccaaagggtatgcggtaacccaccacgcagacggattcttgatgtggaccttttgggacagcggtg

SEQ ID NO: 6868 - DNA, 140 bp, Artificial Sequence
  Synthetic
caccgctgtcccaaaaggtccacatcaagaatccgtctgcgtggtgggttaccgcataccctttggtttttccataaaggcctgggctcatcgttattctcttaacgacgtagccctcaccatatcagcagccagggcct

SEQ ID NO: 6869 - DNA, 140 bp, Artificial Sequence
  Synthetic
aggccctggctgctgatatggtgagggctacgtcgttaagagaataacgatgagcccaggcctttatggaaaaaccatagggtatgcggtaacccaccacgcagacggattcttgatgtggaccttttgggacagcggtg

SEQ ID NO: 6870 - DNA, 140 bp, Artificial Sequence
  Synthetic
caccgctgtcccaaaaggtccacatcaagaatccgtctgcgtggtgggttaccgcataccctatggtttttccataaaggcctgggctcatcgttattctcttaacgacgtagccctcaccatatcagcagccagggcct

SEQ ID NO: 6871 - DNA, 140 bp, Artificial Sequence
  Synthetic
aggccctggctgctgatatggtgagggctacgtcgttaagagaataacgatgagcccaggcctttatggaaaaaccacagggtatgcggtaacccaccacgcagacggattcttgatgtggaccttttgggacagcggtg

SEQ ID NO: 6872 - DNA, 140 bp, Artificial Sequence
  Synthetic
caccgctgtcccaaaaggtccacatcaagaatccgtctgcgtggtgggttaccgcataccctgtggtttttccataaaggcctgggctcatcgttattctcttaacgacgtagccctcaccatatcagcagccagggcct

SEQ ID NO: 6873 - DNA, 140 bp, Artificial Sequence
  Synthetic
aggccctggctgctgatatggtgagggctacgtcgttaagagaataacgatgagcccaggcctttatggaaaaaccagagggtatgcggtaacccaccacgcagacggattcttgatgtggaccttttgggacagcggtg

SEQ ID NO: 6874 - DNA, 140 bp, Artificial Sequence
  Synthetic
caccgctgtcccaaaaggtccacatcaagaatccgtctgcgtggtgggttaccgcataccctctggtttttccataaaggcctgggctcatcgttattctcttaacgacgtagccctcaccatatcagcagccagggcct

SEQ ID NO: 6875 - DNA, 140 bp, Artificial Sequence
  Synthetic
aggccctggctgctgatatgcaagactaccgacacggttgacggcgaaagagtgtcattctcggtgtgcacgtacgtgccggcgaccatttgtgatcaaatgaccggcatccttgctacagaccttttgggacagcggtg

SEQ ID NO: 6876 - DNA, 140 bp, Artificial Sequence
  Synthetic
caccgctgtcccaaaaggtctgtagcaaggatgccggtcatttgatcacaaatggtcgccggcacgtacgtgcacaccgagaatgacactctttcgccgtcaaccgtgtcggtagtcttgcatatcagcagccagggcct

SEQ ID NO: 6877 - DNA, 140 bp, Artificial Sequence
  Synthetic
aggccctggctgctgatatgataacccctgaatagtaacaaaatatgaaaatcaataaaaatcataaaatagaaaaaccataaacagaagtagttcaaagggctataaaacccctgaatagaccttttgggacagcggtg

SEQ ID NO: 6878 - DNA, 140 bp, Artificial Sequence
  Synthetic
caccgctgtcccaaaaggtctattcaggggttttatagccctttgaactacttctgtttatggtttttctattttatgatttttattgattttcatattttgttactattcaggggttatcatatcagcagccagggcct

SEQ ID NO: 6879 - DNA, 140 bp, Artificial Sequence
  Synthetic
aggccctggctgctgatatggaagtcacgccggaggatgcacagaagctgttggtggggctgaaccagagaatagtggttaacggcagaacgcaacggaacacgaacaccatgaagaactgaccttttgggacagcggtg

SEQ ID NO: 6880 - DNA, 140 bp, Artificial Sequence
  Synthetic
caccgctgtcccaaaaggtcagttcttcatggtgttcgtgttccgttgcgttctgccgttaaccactattctctggttcagccccaccaacagcttctgtgcatcctccggcgtgacttccatatcagcagccagggcct

SEQ ID NO: 6881 - DNA, 140 bp, Artificial Sequence
  Synthetic
aggccctggctgctgatatgccctaagagacacattgtatgtaggtgataagtatagatcaaagggccgaataacccctgaatagtaacaaaatatgaaaatcaataaaaatcataaaatgaccttttgggacagcggtg

SEQ ID NO: 6882 - DNA, 140 bp, Artificial Sequence
  Synthetic
caccgctgtcccaaaaggtcattttatgatttttattgattttcatattttgttactattcaggggttattcggccctttgatctatacttatcacctacatacaatgtgtctcttagggcatatcagcagccagggcct

SEQ ID NO: 6883 - DNA, 140 bp, Artificial Sequence
  Synthetic
aggccctggctgctgatatgtttcttactgctctactctgcaaagcaagagattaataacccatcatggatcctgtgtacgtggacatagacgctgacagcgcctttttgaaggccctgcgaccttttgggacagcggtg

SEQ ID NO: 6884 - DNA, 140 bp, Artificial Sequence
  Synthetic
caccgctgtcccaaaaggtcgcagggccttcaaaaaggcgctgtcagcgtctatgtccacgtacacaggatccatgatgggttattaatctcttgctttgcagagtagagcagtaagaaacatatcagcagccagggcct

SEQ ID NO: 6885 - DNA, 140 bp, Artificial Sequence
  Synthetic
aggccctggctgctgatatgaacctgctgctgtctgtgggcatttaagaagcagaaaacacacacggtctacaagaggcctgatacccagtcaatccagaaggttcaggccgaatttgacgaccttttgggacagcggtg

SEQ ID NO: 6886 - DNA, 140 bp, Artificial Sequence
  Synthetic
caccgctgtcccaaaaggtcgtcaaattcggcctgaaccttctggattgactgggtatcaggcctcttgtagaccgtgtgtgttttctgcttcttaaatgcccacagacagcagcaggttcatatcagcagccagggcct

SEQ ID NO: 6887 - DNA, 140 bp, Artificial Sequence
  Synthetic
aggccctggctgctgatatgacaagaggcctgatacccagtcaatccagaaggttcaggccgaatttgacagctttgtagtaccgggtctgtggtcgtccgggttgtcaatcccgttgaggaccttttgggacagcggtg

SEQ ID NO: 6888 - DNA, 140 bp, Artificial Sequence
  Synthetic
caccgctgtcccaaaaggtcctcaacgggattgacaacccggacgaccacagacccggtactacaaagctgtcaaattcggcctgaaccttctggattgactgggtatcaggcctcttgtcatatcagcagccagggcct

SEQ ID NO: 6889 - DNA, 140 bp, Artificial Sequence
  Synthetic
aggccctggctgctgatatgagtgcggaagatcccgagagactcgctaattatgcgagaaagctagcatctgccgcaggaaaagtcctggacagaaacatctctggaaagatcggggactgaccttttgggacagcggtg

SEQ ID NO: 6890 - DNA, 140 bp, Artificial Sequence
  Synthetic
caccgctgtcccaaaaggtcagtccccgatctttccagagatgtttctgtccaggacttttcctgcggcagatgctagctttctcgcataattagcgagtctctcgggatcttccgcactcatatcagcagccagggcct

SEQ ID NO: 6891 - DNA, 140 bp, Artificial Sequence
  Synthetic
aggccctggctgctgatatgaatgccatggcgggtgcctacccctcatactcgacaaactgggcagatgagcaggtactgaaggctaagaacataggattatgttcaacagacctgacgggaccttttgggacagcggtg

SEQ ID NO: 6892 - DNA, 140 bp, Artificial Sequence
  Synthetic
caccgctgtcccaaaaggtcccgtcaggtctgttgaacataatcctatgttcttagccttcagtacctgctcatctgcccagtttgtcgagtatgaggggtaggcacccgccatggcattcatatcagcagccagggcct

SEQ ID NO: 6893 - DNA, 140 bp, Artificial Sequence
  Synthetic
aggccctggctgctgatatggcaggtactgaaggctaagaacataggattatgttcaacagacctgacggaaggtagacgaggcaagttgtctattatgagagggaaaaagctaaaaccggaccttttgggacagcggtg

SEQ ID NO: 6894 - DNA, 140 bp, Artificial Sequence
  Synthetic
caccgctgtcccaaaaggtccggttttagctttttccctctcataatagacaacttgcctcgtctaccttccgtcaggtctgttgaacataatcctatgttcttagccttcagtacctgccatatcagcagccagggcct

SEQ ID NO: 6895 - DNA, 140 bp, Artificial Sequence
  Synthetic
aggccctggctgctgatatgagttcgtaaacagaaagttacaccacattgcgatgcacggaccagccctgaacactgacgaagagtcgtatgagctggtgagggcagagaggacagaacagaccttttgggacagcggtg

SEQ ID NO: 6896 - DNA, 140 bp, Artificial Sequence
  Synthetic
caccgctgtcccaaaaggtctgttctgtcctctctgccctcaccagctcatacgactcttcgtcagtgttcagggctggtccgtgcatcgcaatgtggtgtaactttctgtttacgaactcatatcagcagccagggcct

SEQ ID NO: 6897 - DNA, 140 bp, Artificial Sequence
  Synthetic
aggccctggctgctgatatgaaggtagacgaggcaagttgtctattatgagagggaaaaagctaaaaccgtgcgaccgtgtgctgttctcagtagggtcaacgctctacccggaaagccggaccttttgggacagcggtg

SEQ ID NO: 6898 - DNA, 140 bp, Artificial Sequence
  Synthetic
caccgctgtcccaaaaggtccggctttccgggtagagcgttgaccctactgagaacagcacacggtcgcacggttttagctttttccctctcataatagacaacttgcctcgtctaccttcatatcagcagccagggcct

SEQ ID NO: 6899 - DNA, 140 bp, Artificial Sequence
  Synthetic
atacgccatgctgggtctcctcagcttcacatgccgctgtgatacagtggtttcgtgtgagggctacgtcgttaagagaataacgatgagcccaggcctttatggaaaaaccacagggcacgtacttgggagtcggccat

SEQ ID NO: 6900 - DNA, 140 bp, Artificial Sequence
  Synthetic
atggccgactcccaagtacgtgccctgtggtttttccataaaggcctgggctcatcgttattctcttaacgacgtagccctcacacgaaaccactgtatcacagcggcatgtgaagctgaggagacccagcatggcgtat

SEQ ID NO: 6901 - DNA, 140 bp, Artificial Sequence
  Synthetic
atacgccatgctgggtctcctgcggtaacccaccacgcagacggattcctgatgtgcaagactaccgacacggttgacggcgaaagagtgtcattctcggtgtgcacatacgtgccggcgcgtacttgggagtcggccat

SEQ ID NO: 6902 - DNA, 140 bp, Artificial Sequence
  Synthetic
atggccgactcccaagtacgcgccggcacgtatgtgcacaccgagaatgacactctttcgccgtcaaccgtgtcggtagtcttgcacatcaggaatccgtctgcgtggtgggttaccgcaggagacccagcatggcgtat

SEQ ID NO: 6903 - DNA, 140 bp, Artificial Sequence
  Synthetic
aggccctggctgctgatatgtgcacgtacggttgattcgctgctcttgaatggatgcaatagaccagtcgacgtgttgtacgtagacgaggcgtttgcgtgccactctggaacgttacttgaccttttgggacagcggtg

SEQ ID NO: 6904 - DNA, 140 bp, Artificial Sequence
  Synthetic
caccgctgtcccaaaaggtcaagtaacgttccagagtggcacgcaaacgcctcgtctacgtacaacacgtcgactggtctattgcatccattcaagagcagcgaatcaaccgtacgtgcacatatcagcagccagggcct

SEQ ID NO: 6905 - DNA, 140 bp, Artificial Sequence
  Synthetic
aggccctggctgctgatatggtcgcccaagccttcagtaagtgggcaaaggagtgccggaaagacatggaagatgaaaaactcctgggggtcagagaaagaacactgacctgctgctgtcgaccttttgggacagcggtg

SEQ ID NO: 6906 - DNA, 140 bp, Artificial Sequence
  Synthetic
caccgctgtcccaaaaggtcgacagcagcaggtcagtgttctttctctgacccccaggagtttttcatcttccatgtctttccggcactcctttgcccacttactgaaggcttgggcgaccatatcagcagccagggcct

SEQ ID NO: 6907 - DNA, 140 bp, Artificial Sequence
  Synthetic
aggccctggctgctgatatgacactgcctgtgactgccattgtgtcgtcgttgcattacgaaggcaaaatgcgcactacgaatgagtacaacatgccgattgtagtggacactacgggctgaccttttgggacagcggtg

SEQ ID NO: 6908 - DNA, 140 bp, Artificial Sequence
  Synthetic
caccgctgtcccaaaaggtcagcccgtagtgtccactacaatcggcatgttgtactcattcgtagtgcgcattttgccttcgtaatgcaacgacgacacaatggcagtcacaggcagtgtcatatcagcagccagggcct

SEQ ID NO: 6909 - DNA, 140 bp, Artificial Sequence
  Synthetic
aggccctggctgctgatatggttaaacaactgcaaattgactatcgtggacacgaggtcatgacagcagccgcatcccaagggttaaccagaaaaggagtttacgcagttaggcaaaaaggaccttttgggacagcggtg

SEQ ID NO: 6910 - DNA, 140 bp, Artificial Sequence
  Synthetic
caccgctgtcccaaaaggtcctttttgcctaactgcgtaaactccttttctggttaacccttgggatgcggctgctgtcatgacctcgtgtccacgatagtcaatttgcagttgtttaaccatatcagcagccagggcct

SEQ ID NO: 6911 - DNA, 140 bp, Artificial Sequence
  Synthetic
aggccctggctgctgatatgcccgaagtagccctgaatgaaatatgcacgcgcatgtatggggtggatctagacagcgggctattctctaaaccgttggtatctgtgtactacgcggatagaccttttgggacagcggtg

SEQ ID NO: 6912 - DNA, 140 bp, Artificial Sequence
  Synthetic
caccgctgtcccaaaaggtctatccgcgtagtacacagataccaacggtttagagaatagcccgctgtctagatccaccccatacatgcgcgtgcatatttcattcagggctacttcgggcatatcagcagccagggcct

SEQ ID NO: 6913 - DNA, 140 bp, Artificial Sequence
  Synthetic
aggccctggctgctgatatgctggtgggcgacttgactaatccgccctaccacgaattcgcatatgaagggctaaaaatccgccctgcctgcccatacaaaattgcagtcataggagtctgaccttttgggacagcggtg

SEQ ID NO: 6914 - DNA, 140 bp, Artificial Sequence
  Synthetic
caccgctgtcccaaaaggtcagactcctatgactgcaattttgtatgggcaggcagggcggatttttagcccttcatatgcgaattcgtggtagggcggattagtcaagtcgcccaccagcatatcagcagccagggcct

SEQ ID NO: 6915 - DNA, 140 bp, Artificial Sequence
  Synthetic
aggccctggctgctgatatggctaaaaatccgccctgcctgcccatacaaaattgcagtcataggagtcttcggagtaccgggatctggcaagtcagctattatcaagaacctagttaccgaccttttgggacagcggtg

SEQ ID NO: 6916 - DNA, 140 bp, Artificial Sequence
  Synthetic
caccgctgtcccaaaaggtcggtaactaggttcttgataatagctgacttgccagatcccggtactccgaagactcctatgactgcaattttgtatgggcaggcagggcggatttttagccatatcagcagccagggcct

SEQ ID NO: 6917 - DNA, 140 bp, Artificial Sequence
  Synthetic
atacgccatgctgggtctccaggcaggacctggtgactagcggaaagaaagaaaactgccaagaaatcaccaccgacgtgatgagacagagaggtctagagatatctgcacgtacggttgcgtacttgggagtcggccat

SEQ ID NO: 6918 - DNA, 140 bp, Artificial Sequence
  Synthetic
atggccgactcccaagtacgcaaccgtacgtgcagatatctctagacctctctgtctcatcacgtcggtggtgatttcttggcagttttctttctttccgctagtcaccaggtcctgcctggagacccagcatggcgtat

SEQ ID NO: 6919 - DNA, 140 bp, Artificial Sequence
  Synthetic
atacgccatgctgggtctcctttggctgcgtgagacacaagtagcctaccagtttcttactgctctactctgcaaagcaagagattaataacccatcatggatcctgtgtacgtggacatcgtacttgggagtcggccat

SEQ ID NO: 6920 - DNA, 140 bp, Artificial Sequence
  Synthetic
atggccgactcccaagtacgatgtccacgtacacaggatccatgatgggttattaatctcttgctttgcagagtagagcagtaagaaactggtaggctacttgtgtctcacgcagccaaaggagacccagcatggcgtat

SEQ ID NO: 6921 - DNA, 140 bp, Artificial Sequence
  Synthetic
aggccctggctgctgatatggcttcttcaatatgatgcagatgaaagtcaactataatcacaacatctgcacccaagtgtaccacaaaagtatctccaggcggtgtacactgcctgtgacgaccttttgggacagcggtg

SEQ ID NO: 6922 - DNA, 140 bp, Artificial Sequence
  Synthetic
caccgctgtcccaaaaggtcgtcacaggcagtgtacaccgcctggagatacttttgtggtacacttgggtgcagatgttgtgattatagttgactttcatctgcatcatattgaagaagccatatcagcagccagggcct

SEQ ID NO: 6923 - DNA, 140 bp, Artificial Sequence
  Synthetic
atacgccatgctgggtctccctcaaccatcctggatattggcagtgcgccagcaaggaggatgatgtcggacaggaagtaccactgcgtctgcccgatgcgcagtgcggaagaccccgagcgtacttgggagtcggccat

SEQ ID NO: 6924 - DNA, 140 bp, Artificial Sequence
  Synthetic
atggccgactcccaagtacgctcggggtcttccgcactgcgcatcgggcagacgcagtggtacttcctgtccgacatcatcctccttgctggcgcactgccaatatccaggatggttgagggagacccagcatggcgtat

SEQ ID NO: 6925 - DNA, 140 bp, Artificial Sequence
  Synthetic
aggccctggctgctgatatgcgccattgtgtcatcgttgcattacgaaggcaaaatgcgcactacgaatgagtacaacaagccgattgtagtggacactacaggctcaacaaaacctgacgaccttttgggacagcggtg

SEQ ID NO: 6926 - DNA, 140 bp, Artificial Sequence
  Synthetic
caccgctgtcccaaaaggtcgtcaggttttgttgagcctgtagtgtccactacaatcggcttgttgtactcattcgtagtgcgcattttgccttcgtaatgcaacgatgacacaatggcgcatatcagcagccagggcct

SEQ ID NO: 6927 - DNA, 140 bp, Artificial Sequence
  Synthetic
aggccctggctgctgatatgagtacaacaagccgattgtagtggacactacaggctcaacaaaacctgaccctggagacctcgtgttaacgtgcttcagagggtgggttaaacaactgcagaccttttgggacagcggtg

SEQ ID NO: 6928 - DNA, 140 bp, Artificial Sequence
  Synthetic
caccgctgtcccaaaaggtctgcagttgtttaacccaccctctgaagcacgttaacacgaggtctccagggtcaggttttgttgagcctgtagtgtccactacaatcggcttgttgtactcatatcagcagccagggcct

SEQ ID NO: 6929 - DNA, 140 bp, Artificial Sequence
  Synthetic
atacgccatgctgggtctcccatgaacaatcaactgaatgcagcctttgtaggacaggccacccgagcaggatgtgcaccatcgtaccgggtaaaacgcatggacatcgcgaagaacgatcgtacttgggagtcggccat

SEQ ID NO: 6930 - DNA, 140 bp, Artificial Sequence
  Synthetic
atggccgactcccaagtacgatcgttcttcgcgatgtccatgcgttttacccggtacgatggtgcacatcctgctcgggtggcctgtcctacaaaggctgcattcagttgattgttcatgggagacccagcatggcgtat

SEQ ID NO: 6931 - DNA, 140 bp, Artificial Sequence
  Synthetic
atacgccatgctgggtctccagactcgctaattatgcgagaaagctagcatctgccgcaggaaaagtcctggacagaaacatttctggaaagatcggggacttacaagcagtaatggccgcgtacttgggagtcggccat

SEQ ID NO: 6932 - DNA, 140 bp, Artificial Sequence
  Synthetic
atggccgactcccaagtacgcggccattactgcttgtaagtccccgatctttccagaaatgtttctgtccaggacttttcctgcggcagatgctagctttctcgcataattagcgagtctggagacccagcatggcgtat

SEQ ID NO: 6933 - DNA, 140 bp, Artificial Sequence
  Synthetic
aggccctggctgctgatatgggactcgacggatgcagacgtggtcatctactgccgagacaaggaatgggagaagaaaatatctgaggccatacagatgcggacccaagtggagctgctggaccttttgggacagcggtg

SEQ ID NO: 6934 - DNA, 140 bp, Artificial Sequence
  Synthetic
caccgctgtcccaaaaggtccagcagctccacttgggtccgcatctgtatggcctcagatattttcttctcccattccttgtctcggcagtagatgaccacgtctgcatccgtcgagtcccatatcagcagccagggcct

SEQ ID NO: 6935 - DNA, 140 bp, Artificial Sequence
  Synthetic
aggccctggctgctgatatgagaagaaaatatctgaggccatacagatgcggacccaagtggagctgctggatgagcacatctccatagactgcgatgtcattcgcgtgcaccctgacaggaccttttgggacagcggtg

SEQ ID NO: 6936 - DNA, 140 bp, Artificial Sequence
  Synthetic
caccgctgtcccaaaaggtcctgtcagggtgcacgcgaatgacatcgcagtctatggagatgtgctcatccagcagctccacttgggtccgcatctgtatggcctcagatattttcttctcatatcagcagccagggcct

SEQ ID NO: 6937 - DNA, 140 bp, Artificial Sequence
  Synthetic
atacgccatgctgggtctcctttctaaaccgtcggtgtctgtgtattacgcggataaccactgggataataggcctggagggaaaatgttcggatttaaccccgaggcagcatccattctcgtacttgggagtcggccat

SEQ ID NO: 6938 - DNA, 140 bp, Artificial Sequence
  Synthetic
atggccgactcccaagtacgagaatggatgctgcctcggggttaaatccgaacattttccctccaggcctattatcccagtggttatccgcgtaatacacagacaccgacggtttagaaaggagacccagcatggcgtat

SEQ ID NO: 6939 - DNA, 140 bp, Artificial Sequence
  Synthetic
atacgccatgctgggtctcctagtttggcaggcagaaaaggatacagcaccacggaaggcgcactgtattcatatctagaagggacacgttttcaccagacggcagtggatatggcagagcgtacttgggagtcggccat

SEQ ID NO: 6940 - DNA, 140 bp, Artificial Sequence
  Synthetic
atggccgactcccaagtacgctctgccatatccactgccgtctggtgaaaacgtgtcccttctagatatgaatacagtgcgccttccgtggtgctgtatccttttctgcctgccaaactaggagacccagcatggcgtat

SEQ ID NO: 6941 - DNA, 140 bp, Artificial Sequence
  Synthetic
atacgccatgctgggtctccatatataccatgtggccaaagcaaacagaggccaatgagcaagcctgcctatatgccctgggggaaagtattgaatcaatcaggcagaaatgcccggtggcgtacttgggagtcggccat

SEQ ID NO: 6942 - DNA, 140 bp, Artificial Sequence
  Synthetic
atggccgactcccaagtacgccaccgggcatttctgcctgattgattcaatactttcccccagggcatataggcaggcttgctcattggcctctgtttgctttggccacatggtatatatggagacccagcatggcgtat

SEQ ID NO: 6943 - DNA, 140 bp, Artificial Sequence
  Synthetic
aggccctggctgctgatatgataccggccaacaggagactaccacactcattagtggccgaacaccgcccagtaaaaggggaaagaatggaatggctggttaacaagataaacggccaccgaccttttgggacagcggtg

SEQ ID NO: 6944 - DNA, 140 bp, Artificial Sequence
  Synthetic
caccgctgtcccaaaaggtcggtggccgtttatcttgttaaccagccattccattctttccccttttactgggcggtgttcggccactaatgagtgtggtagtctcctgttggccggtatcatatcagcagccagggcct

SEQ ID NO: 6945 - DNA, 140 bp, Artificial Sequence
  Synthetic
aggccctggctgctgatatgatatgccctgggggaaagtattgaatcaatcaggcagaaatgcccggtggatgatgcagacgcatcatctcccccgaaaaccgtcccgtgcctttgccgtgaccttttgggacagcggtg

SEQ ID NO: 6946 - DNA, 140 bp, Artificial Sequence
  Synthetic
caccgctgtcccaaaaggtcacggcaaaggcacgggacggttttcgggggagatgatgcgtctgcatcatccaccgggcatttctgcctgattgattcaatactttcccccagggcatatcatatcagcagccagggcct

SEQ ID NO: 6947 - DNA, 140 bp, Artificial Sequence
  Synthetic
aggccctggctgctgatatgtatgccatgactcctgaacgcgtcacccgacttcgcatgaaccatgtcacaaatataattgtgtgttcttcatttccccttccaaagtacaagatagaaggaccttttgggacagcggtg

SEQ ID NO: 6948 - DNA, 140 bp, Artificial Sequence
  Synthetic
caccgctgtcccaaaaggtccttctatcttgtactttggaaggggaaatgaagaacacacaattatatttgtgacatggttcatgcgaagtcgggtgacgcgttcaggagtcatggcatacatatcagcagccagggcct

SEQ ID NO: 6949 - DNA, 140 bp, Artificial Sequence
  Synthetic
atacgccatgctgggtctccacgtggtcctggtcagtggctacaaccttgcactgcctattaagagagtcacttgggtagcgccgttaggtgtccgcggagcggactacacatacaacctcgtacttgggagtcggccat

SEQ ID NO: 6950 - DNA, 140 bp, Artificial Sequence
  Synthetic
atggccgactcccaagtacgaggttgtatgtgtagtccgctccgcggacacctaacggcgctacccaagtgactctcttaataggcagtgcaaggttgtagccactgaccaggaccacgtggagacccagcatggcgtat

SEQ ID NO: 6951 - DNA, 140 bp, Artificial Sequence
  Synthetic
aggccctggctgctgatatgtggacatagacgctgacagcgcctttttgaaggccctgcaacgtgcgtaccccatgtttgaggtggaatcaaggcaggtcacaccgaatgaccatgctaagaccttttgggacagcggtg

SEQ ID NO: 6952 - DNA, 140 bp, Artificial Sequence
  Synthetic
caccgctgtcccaaaaggtcttagcatggtcattcggtgtgacctgccttgattccacctcaaacatggggtacgcacgttgcagggccttcaaaaaggcgctgtcagcgtctatgtccacatatcagcagccagggcct

SEQ ID NO: 6953 - DNA, 140 bp, Artificial Sequence
  Synthetic
aggccctggctgctgatatgacatccacacaccttttcgcatacaccattaccaacagtgcgtcgaccacgcaatgaaactgcaaatgctcgggggtgactcattgagactgctcaaaccgaccttttgggacagcggtg

SEQ ID NO: 6954 - DNA, 140 bp, Artificial Sequence
  Synthetic
caccgctgtcccaaaaggtcggtttgagcagtctcaatgagtcacccccgagcatttgcagtttcattgcgtggtcgacgcactgttggtaatggtgtatgcgaaaaggtgtgtggatgtcatatcagcagccagggcct

SEQ ID NO: 6955 - DNA, 140 bp, Artificial Sequence
  Synthetic
aggccctggctgctgatatgacttgggtagcgccgttaggtgtccgcggagcggactacacatacaacctagagttgggtctgccagcaacgcttggtaggtacgaccttgtggtcataagaccttttgggacagcggtg

SEQ ID NO: 6956 - DNA, 140 bp, Artificial Sequence
  Synthetic
caccgctgtcccaaaaggtcttatgaccacaaggtcgtacctaccaagcgttgctggcagacccaactctaggttgtatgtgtagtccgctccgcggacacctaacggcgctacccaagtcatatcagcagccagggcct

SEQ ID NO: 6957 - DNA, 140 bp, Artificial Sequence
  Synthetic
atacgccatgctgggtctccgcgtactgggttgggttcgacacaaccccgttcatgtacgatgccatggcgggtgcctacccctcatactcgacaaactgggcagatgagcaggtactgacgtacttgggagtcggccat

SEQ ID NO: 6958 - DNA, 140 bp, Artificial Sequence
  Synthetic
atggccgactcccaagtacgtcagtacctgctcatctgcccagtttgtcgagtatgaggggtaggcacccgccatggcatcgtacatgaacggggttgtgtcgaacccaacccagtacgcggagacccagcatggcgtat

SEQ ID NO: 6959 - DNA, 140 bp, Artificial Sequence
  Synthetic
aggccctggctgctgatatggccctagaaccggccctagacgacggggcgatacatacgttaccaaccacaattggaaaccttgcggccgtgtctgactgggtaatgagcaccgtacctggaccttttgggacagcggtg

SEQ ID NO: 6960 - DNA, 140 bp, Artificial Sequence
  Synthetic
caccgctgtcccaaaaggtccaggtacggtgctcattacccagtcagacacggccgcaaggtttccaattgtggttggtaacgtatgtatcgccccgtcgtctagggccggttctagggccatatcagcagccagggcct

SEQ ID NO: 6961 - DNA, 140 bp, Artificial Sequence
  Synthetic
aggccctggctgctgatatgaaaccaccatgtgtcaccagcaacactgagatgtttttcctattcagcaactttgacaatggcagaaggaatttcacaactcatgtcatgaacaatcaacgaccttttgggacagcggtg

SEQ ID NO: 6962 - DNA, 140 bp, Artificial Sequence
  Synthetic
caccgctgtcccaaaaggtcgttgattgttcatgacatgagttgtgaaattccttctgccattgtcaaagttgctgaataggaaaaacatctcagtgttgctggtgacacatggtggtttcatatcagcagccagggcct

SEQ ID NO: 6963 - DNA, 140 bp, Artificial Sequence
  Synthetic
atacgccatgctgggtctccagagatgtgtccggccgtacaagaaacagcggagacgcgtgacacagctatttcccttcaggcaccgccaagtaccatcatggaactgagccatccaccgcgtacttgggagtcggccat

SEQ ID NO: 6964 - DNA, 140 bp, Artificial Sequence
  Synthetic
atggccgactcccaagtacgcggtggatggctcagttccatgatggtacttggcggtgcctgaagggaaatagctgtgtcacgcgtctccgctgtttcttgtacggccggacacatctctggagacccagcatggcgtat

SEQ ID NO: 6965 - DNA, 140 bp, Artificial Sequence
  Synthetic
aggccctggctgctgatatgcgacgaaggagaaatcgaaagcttgtcttctgagctactaactttcggagacttcctacccggtgaagtggatgatttgacagatagcgactggtccacggaccttttgggacagcggtg

SEQ ID NO: 6966 - DNA, 140 bp, Artificial Sequence
  Synthetic
caccgctgtcccaaaaggtccgtggaccagtcgctatctgtcaaatcatccacttcaccgggtaggaagtctccgaaagttagtagctcagaagacaagctttcgatttctccttcgtcgcatatcagcagccagggcct

SEQ ID NO: 6967 - DNA, 140 bp, Artificial Sequence
  Synthetic
aggccctggctgctgatatggtagctatacctctcctctccacaggtgtatactcaggagggaaagacaggctgacccagtcactgaaccacctctttacagccatggactcgacggatggaccttttgggacagcggtg

SEQ ID NO: 6968 - DNA, 140 bp, Artificial Sequence
  Synthetic
caccgctgtcccaaaaggtccatccgtcgagtccatggctgtaaagaggtggttcagtgactgggtcagcctgtctttccctcctgagtatacacctgtggagaggagaggtatagctaccatatcagcagccagggcct

SEQ ID NO: 6969 - DNA, 140 bp, Artificial Sequence
  Synthetic
aggccctggctgctgatatgccatcctggatatcggcagtgcgccagcaaggaggatgatgtcggacaggaagtaccactgcgtctgcccgatgcgcagtgcggaagatcccgagagactgaccttttgggacagcggtg

SEQ ID NO: 6970 - DNA, 140 bp, Artificial Sequence
  Synthetic
caccgctgtcccaaaaggtcagtctctcgggatcttccgcactgcgcatcgggcagacgcagtggtacttcctgtccgacatcatcctccttgctggcgcactgccgatatccaggatggcatatcagcagccagggcct

SEQ ID NO: 6971 - DNA, 140 bp, Artificial Sequence
  Synthetic
aggccctggctgctgatatgcatagactgcgatattgtccgcgtgcaccctgacagcagcttggcaggcagaaaaggatacagcaccacggaaggcgcactgtactcatatctagaaggggaccttttgggacagcggtg

SEQ ID NO: 6972 - DNA, 140 bp, Artificial Sequence
  Synthetic
caccgctgtcccaaaaggtccccttctagatatgagtacagtgcgccttccgtggtgctgtatccttttctgcctgccaagctgctgtcagggtgcacgcggacaatatcgcagtctatgcatatcagcagccagggcct

SEQ ID NO: 6973 - DNA, 140 bp, Artificial Sequence
  Synthetic
aggccctggctgctgatatgaaagtattgaatcgatcaggcagaaatgcccggtggatgatgcagacgcatcatctcccccaaaaactgtcccgtgcctttgccgttacgctatgactccgaccttttgggacagcggtg

SEQ ID NO: 6974 - DNA, 140 bp, Artificial Sequence
  Synthetic
caccgctgtcccaaaaggtcggagtcatagcgtaacggcaaaggcacgggacagtttttgggggagatgatgcgtctgcatcatccaccgggcatttctgcctgatcgattcaatactttcatatcagcagccagggcct

SEQ ID NO: 6975 - DNA, 140 bp, Artificial Sequence
  Synthetic
atacgccatgctgggtctccaaatgctctaaggtaatgctatttgaccataacgtgccatcgcgcgtaagtccaagggaatatagatcttcccaggagtctgcacaggaggcgagtacaacgtacttgggagtcggccat

SEQ ID NO: 6976 - DNA, 140 bp, Artificial Sequence
  Synthetic
atggccgactcccaagtacgttgtactcgcctcctgtgcagactcctgggaagatctatattcccttggacttacgcgcgatggcacgttatggtcaaatagcattaccttagagcatttggagacccagcatggcgtat

SEQ ID NO: 6977 - DNA, 140 bp, Artificial Sequence
  Synthetic
aggccctggctgctgatatgtcacgtcactgacgcatagtcaattcgacctaagcgttgatggcgagatactgcccgtcccgtcagacctggatgctgacgccccagccctagaaccagcgaccttttgggacagcggtg

SEQ ID NO: 6978 - DNA, 140 bp, Artificial Sequence
  Synthetic
caccgctgtcccaaaaggtcgctggttctagggctggggcgtcagcatccaggtctgacgggacgggcagtatctcgccatcaacgcttaggtcgaattgactatgcgtcagtgacgtgacatatcagcagccagggcct

SEQ ID NO: 6979 - DNA, 140 bp, Artificial Sequence
  Synthetic
aggccctggctgctgatatgggttaccgggtgacggtgtttgcaaggcagtatacaaaaaatggccggagtcctttaagaacagtgcaacaccagtgggaaccacaaaaacagttatgtggaccttttgggacagcggtg

SEQ ID NO: 6980 - DNA, 140 bp, Artificial Sequence
  Synthetic
caccgctgtcccaaaaggtccacataactgtttttgtggttcccactggtgttgcactgttcttaaaggactccggccattttttgtatactgccttgcaaacaccgtcacccggtaacccatatcagcagccagggcct

SEQ ID NO: 6981 - DNA, 140 bp, Artificial Sequence
  Synthetic
aggccctggctgctgatatgggttaccgggtgacggtgtttgcaaggcagtatacaaaaaatggccggagtcctttaagaacagtgcaacaccagtgggaacctcaaaaacagttatgtggaccttttgggacagcggtg

SEQ ID NO: 6982 - DNA, 140 bp, Artificial Sequence
  Synthetic
caccgctgtcccaaaaggtccacataactgtttttgaggttcccactggtgttgcactgttcttaaaggactccggccattttttgtatactgccttgcaaacaccgtcacccggtaacccatatcagcagccagggcct

SEQ ID NO: 6983 - DNA, 140 bp, Artificial Sequence
  Synthetic
aggccctggctgctgatatgggttaccgggtgacggtgtttgcaaggcagtatacaaaaaatggccggagtcctttaagaacagtgcaacaccagtgggaaccccaaaaacagttatgtggaccttttgggacagcggtg

SEQ ID NO: 6984 - DNA, 140 bp, Artificial Sequence
  Synthetic
caccgctgtcccaaaaggtccacataactgtttttggggttcccactggtgttgcactgttcttaaaggactccggccattttttgtatactgccttgcaaacaccgtcacccggtaacccatatcagcagccagggcct

SEQ ID NO: 6985 - DNA, 140 bp, Artificial Sequence
  Synthetic
aggccctggctgctgatatgggttaccgggtgacggtgtttgcaaggcagtatacaaaaaatggccggagtcctttaagaacagtgcaacaccagtgggaaccgcaaaaacagttatgtggaccttttgggacagcggtg

SEQ ID NO: 6986 - DNA, 140 bp, Artificial Sequence
  Synthetic
caccgctgtcccaaaaggtccacataactgtttttgcggttcccactggtgttgcactgttcttaaaggactccggccattttttgtatactgccttgcaaacaccgtcacccggtaacccatatcagcagccagggcct

SEQ ID NO: 6987 - DNA, 140 bp, Artificial Sequence
  Synthetic
aggccctggctgctgatatgtcgtacaagaaacagcggagacgcgtgacacagcaatgtctcttcaggcaccaccgagcaccgccacggaaccgaatcatccgccgatctccttcggagcgaccttttgggacagcggtg

SEQ ID NO: 6988 - DNA, 140 bp, Artificial Sequence
  Synthetic
caccgctgtcccaaaaggtcgctccgaaggagatcggcggatgattcggttccgtggcggtgctcggtggtgcctgaagagacattgctgtgtcacgcgtctccgctgtttcttgtacgacatatcagcagccagggcct

SEQ ID NO: 6989 - DNA, 140 bp, Artificial Sequence
  Synthetic
aggccctggctgctgatatgaaacggacatagcctcctttgataagagccaggatgattcacttgcgcttaccgccttaatgctgttagaagatttgggagtggatcactccctgttggagaccttttgggacagcggtg

SEQ ID NO: 6990 - DNA, 140 bp, Artificial Sequence
  Synthetic
caccgctgtcccaaaaggtctccaacagggagtgatccactcccaaatcttctaacagcattaaggcggtaagcgcaagtgaatcatcctggctcttatcaaaggaggctatgtccgtttcatatcagcagccagggcct

SEQ ID NO: 6991 - DNA, 140 bp, Artificial Sequence
  Synthetic
aggccctggctgctgatatgctgttcgtcaacacattgttaaatatcactatcgctagccgggtgttggaagatcgtctgacaaaatctgcatgcgcggccttcatcggcgacgacaacagaccttttgggacagcggtg

SEQ ID NO: 6992 - DNA, 140 bp, Artificial Sequence
  Synthetic
caccgctgtcccaaaaggtctgttgtcgtcgccgatgaaggccgcgcatgcagattttgtcagacgatcttccaacacccggctagcgatagtgatatttaacaatgtgttgacgaacagcatatcagcagccagggcct

SEQ ID NO: 6993 - DNA, 140 bp, Artificial Sequence
  Synthetic
aggccctggctgctgatatgggatgaagcaaaggagcaactattacttaagaaactccaggagagtgcatccatggccaacagaagcaggtatcagtcgcgcaaagtagaaaacatgaaagaccttttgggacagcggtg

SEQ ID NO: 6994 - DNA, 140 bp, Artificial Sequence
  Synthetic
caccgctgtcccaaaaggtctttcatgttttctactttgcgcgactgatacctgcttctgttggccatggatgcactctcctggagtttcttaagtaatagttgctcctttgcttcatcccatatcagcagccagggcct

SEQ ID NO: 6995 - DNA, 140 bp, Artificial Sequence
  Synthetic
aggccctggctgctgatatggcatgcaatgagttcttagctagaaactatccaactgtctcgtcataccaaattaccgacgagtatgatgcatatctagacatggtggacgggtcggagagaccttttgggacagcggtg

SEQ ID NO: 6996 - DNA, 140 bp, Artificial Sequence
  Synthetic
caccgctgtcccaaaaggtctctccgacccgtccaccatgtctagatatgcatcatactcgtcggtaatttggtatgacgagacagttggatagtttctagctaagaactcattgcatgccatatcagcagccagggcct

SEQ ID NO: 6997 - DNA, 140 bp, Artificial Sequence
  Synthetic
aggccctggctgctgatatgaattaccgacgagtatgatgcatatctagacatggtggacgggtcggagagttgcctggaccgagcgacatttaatccgtcaaaactcaggagctacccggaccttttgggacagcggtg

SEQ ID NO: 6998 - DNA, 140 bp, Artificial Sequence
  Synthetic
caccgctgtcccaaaaggtccgggtagctcctgagttttgacggattaaatgtcgctcggtccaggcaactctccgacccgtccaccatgtctagatatgcatcatactcgtcggtaattcatatcagcagccagggcct

SEQ ID NO: 6999 - DNA, 140 bp, Artificial Sequence
  Synthetic
atacgccatgctgggtctccaaacagcacgcttaccacgcgccctccatcagaagcgctgtaccgtccccattccagaacacactacagaatgtactggcagcagccacgaaaagaaactcgtacttgggagtcggccat

SEQ ID NO: 7000 - DNA, 140 bp, Artificial Sequence
  Synthetic
atggccgactcccaagtacgagtttcttttcgtggctgctgccagtacattctgtagtgtgttctggaatggggacggtacagcgcttctgatggagggcgcgtggtaagcgtgctgtttggagacccagcatggcgtat

SEQ ID NO: 7001 - DNA, 140 bp, Artificial Sequence
  Synthetic
aggccctggctgctgatatgatttgctgccagccctattaggataacaactgagaatttagcaacctatgttactaaactaaaagggccaaaagcagcagcgctattcgcaaaaacccatgaccttttgggacagcggtg

SEQ ID NO: 7002 - DNA, 140 bp, Artificial Sequence
  Synthetic
caccgctgtcccaaaaggtcatgggtttttgcgaatagcgctgctgcttttggcccttttagtttagtaacataggttgctaaattctcagttgttatcctaatagggctggcagcaaatcatatcagcagccagggcct

SEQ ID NO: 7003 - DNA, 140 bp, Artificial Sequence
  Synthetic
aggccctggctgctgatatgagtcattcatgtacgcacccatttcaccacgaccctcctgtgataggtcgggaaaaattccattcccgaccgcagcacggtaaagagctaccttgcagcagaccttttgggacagcggtg

SEQ ID NO: 7004 - DNA, 140 bp, Artificial Sequence
  Synthetic
caccgctgtcccaaaaggtctgctgcaaggtagctctttaccgtgctgcggtcgggaatggaatttttcccgacctatcacaggagggtcgtggtgaaatgggtgcgtacatgaatgactcatatcagcagccagggcct

SEQ ID NO: 7005 - DNA, 140 bp, Artificial Sequence
  Synthetic
aggccctggctgctgatatgaagcaaaagcaaaagcagcaggcgccacgaaacaatatgaatcaaaagaagcagccccctaaaaagaaacaggttcaaaagaaaaagaagccgggccgtagaccttttgggacagcggtg

SEQ ID NO: 7006 - DNA, 140 bp, Artificial Sequence
  Synthetic
caccgctgtcccaaaaggtctacggcccggcttctttttcttttgaacctgtttctttttagggggctgcttcttttgattcatattgtttcgtggcgcctgctgcttttgcttttgcttcatatcagcagccagggcct

SEQ ID NO: 7007 - DNA, 140 bp, Artificial Sequence
  Synthetic
aggccctggctgctgatatgaatctactgccactacaggaagtaccaatggataggttcacagtagatatgaaaagggacgtgaaggtgactcctggtacaaagcatacagaggaaagacgaccttttgggacagcggtg

SEQ ID NO: 7008 - DNA, 140 bp, Artificial Sequence
  Synthetic
caccgctgtcccaaaaggtcgtctttcctctgtatgctttgtaccaggagtcaccttcacgtcccttttcatatctactgtgaacctatccattggtacttcctgtagtggcagtagattcatatcagcagccagggcct

SEQ ID NO: 7009 - DNA, 140 bp, Artificial Sequence
  Synthetic
aggccctggctgctgatatggaaaagggacgtgaaggtgactcctggtacaaagcatacagaggaaagacctaaggtgcaggttatacaggcggctgaacccttggcgacagcatacctagaccttttgggacagcggtg

SEQ ID NO: 7010 - DNA, 140 bp, Artificial Sequence
  Synthetic
caccgctgtcccaaaaggtctaggtatgctgtcgccaagggttcagccgcctgtataacctgcaccttaggtctttcctctgtatgctttgtaccaggagtcaccttcacgtcccttttccatatcagcagccagggcct

SEQ ID NO: 7011 - DNA, 140 bp, Artificial Sequence
  Synthetic
aggccctggctgctgatatgttactaaactaaaagggccaaaagcagcagcgctattcgcaaaaacccataatctactgccactacaggaagtaccaatggataggttcacagtagatatgaccttttgggacagcggtg

SEQ ID NO: 7012 - DNA, 140 bp, Artificial Sequence
  Synthetic
caccgctgtcccaaaaggtcatatctactgtgaacctatccattggtacttcctgtagtggcagtagattatgggtttttgcgaatagcgctgctgcttttggcccttttagtttagtaacatatcagcagccagggcct

SEQ ID NO: 7013 - DNA, 140 bp, Artificial Sequence
  Synthetic
aggccctggctgctgatatgtcagtggccacgttcatactcctgtcaatggtgggtatggcagcggggatgtgcatgtgtgcacgacgcagatgcatcacaccgtatgaactgacaccaggaccttttgggacagcggtg

SEQ ID NO: 7014 - DNA, 140 bp, Artificial Sequence
  Synthetic
caccgctgtcccaaaaggtcctggtgtcagttcatacggtgtgatgcatctgcgtcgtgcacacatgcacatccccgctgccatacccaccattgacaggagtatgaacgtggccactgacatatcagcagccagggcct

SEQ ID NO: 7015 - DNA, 140 bp, Artificial Sequence
  Synthetic
aggccctggctgctgatatgctttcggagagatttccagctgtcacctaccgacaggtacgcgcttcaagttcggcgccatgatgaaatcaggtatgttcctaactctgttcgtcaacacgaccttttgggacagcggtg

SEQ ID NO: 7016 - DNA, 140 bp, Artificial Sequence
  Synthetic
caccgctgtcccaaaaggtcgtgttgacgaacagagttaggaacatacctgatttcatcatggcgccgaacttgaagcgcgtacctgtcggtaggtgacagctggaaatctctccgaaagcatatcagcagccagggcct

SEQ ID NO: 7017 - DNA, 140 bp, Artificial Sequence
  Synthetic
atacgccatgctgggtctccttcggcgccatgatgaaatcaggtatgttcctaactctgttcgtcaacacattgttaaacatcactatcgccagccgagtgctggaagatcgtctgacaacgtacttgggagtcggccat

SEQ ID NO: 7018 - DNA, 140 bp, Artificial Sequence
  Synthetic
atggccgactcccaagtacgttgtcagacgatcttccagcactcggctggcgatagtgatgtttaacaatgtgttgacgaacagagttaggaacatacctgatttcatcatggcgccgaaggagacccagcatggcgtat

SEQ ID NO: 7019 - DNA, 140 bp, Artificial Sequence
  Synthetic
atacgccatgctgggtctcctctccccgacgccagcgacgcagtattaaggacaacttcaatgtctataaagccacaagaccgtacctagctcactgtcccgactgtggagaagggcactcgtacttgggagtcggccat

SEQ ID NO: 7020 - DNA, 140 bp, Artificial Sequence
  Synthetic
atggccgactcccaagtacgagtgcccttctccacagtcgggacagtgagctaggtacggtcttgtggctttatagacattgaagttgtccttaatactgcgtcgctggcgtcggggagaggagacccagcatggcgtat

SEQ ID NO: 7021 - DNA, 140 bp, Artificial Sequence
  Synthetic
atacgccatgctgggtctccagtgaagatcatagatgcagttgtatccttgaaagccccttacttttgtggagggtttatactgcacgatactgtgacaggaacagcttgcagagtggcacgtacttgggagtcggccat

SEQ ID NO: 7022 - DNA, 140 bp, Artificial Sequence
  Synthetic
atggccgactcccaagtacgtgccactctgcaagctgttcctgtcacagtatcgtgcagtataaaccctccacaaaagtaaggggctttcaaggatacaactgcatctatgatcttcactggagacccagcatggcgtat

SEQ ID NO: 7023 - DNA, 140 bp, Artificial Sequence
  Synthetic
atacgccatgctgggtctccgggacgttgaaaatccaggtttccttgcaaatcggaataaagacggatgatagccatgattggaccaagctgcgttatatggacaatcacatgccagcagcgtacttgggagtcggccat

SEQ ID NO: 7024 - DNA, 140 bp, Artificial Sequence
  Synthetic
atggccgactcccaagtacgctgctggcatgtgattgtccatataacgcagcttggtccaatcatggctatcatccgtctttattccgatttgcaaggaaacctggattttcaacgtcccggagacccagcatggcgtat

SEQ ID NO: 7025 - DNA, 140 bp, Artificial Sequence
  Synthetic
aggccctggctgctgatatgggcaacgaacagggctaattgatgagctggagaaagcggtatactctaggtacgaagtgcagggtatatcagttgtggtaatgtccatggccacctttgcgaccttttgggacagcggtg

SEQ ID NO: 7026 - DNA, 140 bp, Artificial Sequence
  Synthetic
caccgctgtcccaaaaggtcgcaaaggtggccatggacattaccacaactgatataccctgcacttcgtacctagagtataccgctttctccagctcatcaattagccctgttcgttgcccatatcagcagccagggcct

SEQ ID NO: 7027 - DNA, 140 bp, Artificial Sequence
  Synthetic
atacgccatgctgggtctcctctgacggtgggattcactgacggtaggaagatcagtcactcatgcacgcacccatttcaccacgaccctcctgtgataggccgggaaaaattccattcccgtacttgggagtcggccat

SEQ ID NO: 7028 - DNA, 140 bp, Artificial Sequence
  Synthetic
atggccgactcccaagtacgggaatggaatttttcccggcctatcacaggagggtcgtggtgaaatgggtgcgtgcatgagtgactgatcttcctaccgtcagtgaatcccaccgtcagaggagacccagcatggcgtat

SEQ ID NO: 7029 - DNA, 140 bp, Artificial Sequence
  Synthetic
aggccctggctgctgatatgatctaaacactaatcagctacaatggagttcatcccaacccaaactttttacaataggaggtaccagcctcgaccctggactccgcgctctactatccaagaccttttgggacagcggtg

SEQ ID NO: 7030 - DNA, 140 bp, Artificial Sequence
  Synthetic
caccgctgtcccaaaaggtcttggatagtagagcgcggagtccagggtcgaggctggtacctcctattgtaaaaagtttgggttgggatgaactccattgtagctgattagtgtttagatcatatcagcagccagggcct

SEQ ID NO: 7031 - DNA, 140 bp, Artificial Sequence
  Synthetic
atacgccatgctgggtctccacaataggaggtaccagcctcgaccctggactccgcgctctactatccaaatcatcaggcccagaccgcgccctcagaggcaagctgggcaacttgcccacgtacttgggagtcggccat

SEQ ID NO: 7032 - DNA, 140 bp, Artificial Sequence
  Synthetic
atggccgactcccaagtacgtgggcaagttgcccagcttgcctctgagggcgcggtctgggcctgatgatttggatagtagagcgcggagtccagggtcgaggctggtacctcctattgtggagacccagcatggcgtat

SEQ ID NO: 7033 - DNA, 140 bp, Artificial Sequence
  Synthetic
atacgccatgctgggtctccgctgatctcagcagttaataaactgacaatgcgcgcggtaccccaacagaggccacgcaggaatcggaagaataagaagcaaaagcaaaaacaacaggcgcgtacttgggagtcggccat

SEQ ID NO: 7034 - DNA, 140 bp, Artificial Sequence
  Synthetic
atggccgactcccaagtacgcgcctgttgtttttgcttttgcttcttattcttccgattcctgcgtggcctctgttggggtaccgcgcgcattgtcagtttattaactgctgagatcagcggagacccagcatggcgtat

SEQ ID NO: 7035 - DNA, 140 bp, Artificial Sequence
  Synthetic
aggccctggctgctgatatgaaccactacagacaaagtgattaataactgcaaggttgatcaatgccatgccgcggtcaccaatcacaaaaaatggcagtataattcccctctggtcccggaccttttgggacagcggtg

SEQ ID NO: 7036 - DNA, 140 bp, Artificial Sequence
  Synthetic
caccgctgtcccaaaaggtccgggaccagaggggaattatactgccattttttgtgattggtgaccgcggcatggcattgatcaaccttgcagttattaatcactttgtctgtagtggttcatatcagcagccagggcct

SEQ ID NO: 7037 - DNA, 140 bp, Artificial Sequence
  Synthetic
atacgccatgctgggtctcccgcaatgctgaactcggggaccgaaaaggaaaagttcacattccgtttcctctggcaaatgtgacatgcagggtgcctaaagcaaggaaccccaccgtgacgtacttgggagtcggccat

SEQ ID NO: 7038 - DNA, 140 bp, Artificial Sequence
  Synthetic
atggccgactcccaagtacgtcacggtggggttccttgctttaggcaccctgcatgtcacatttgccagaggaaacggaatgtgaacttttccttttcggtccccgagttcagcattgcgggagacccagcatggcgtat

SEQ ID NO: 7039 - DNA, 140 bp, Artificial Sequence
  Synthetic
aggccctggctgctgatatgcgcagatgtattacaccgtacgaactgacaccaggagctaccgtccctttcctgcttagcctaatatgctgcattagaacagctaaagcggccacataccgaccttttgggacagcggtg

SEQ ID NO: 7040 - DNA, 140 bp, Artificial Sequence
  Synthetic
caccgctgtcccaaaaggtcggtatgtggccgctttagctgttctaatgcagcatattaggctaagcaggaaagggacggtagctcctggtgtcagttcgtacggtgtaatacatctgcgcatatcagcagccagggcct

SEQ ID NO: 7041 - DNA, 140 bp, Artificial Sequence
  Synthetic
atacgccatgctgggtctccggaaaccttacgcatgcttgaggacaacgtcatgagacctgggtactatcagctgctacaagcatccttaacatgttctccccaccgccagcgacgcagccgtacttgggagtcggccat

SEQ ID NO: 7042 - DNA, 140 bp, Artificial Sequence
  Synthetic
atggccgactcccaagtacggctgcgtcgctggcggtggggagaacatgttaaggatgcttgtagcagctgatagtacccaggtctcatgacgttgtcctcaagcatgcgtaaggtttccggagacccagcatggcgtat

SEQ ID NO: 7043 - DNA, 140 bp, Artificial Sequence
  Synthetic
aggccctggctgctgatatgtaagaacatcagcaccgtgtacgattactggaacaatgggacacttcatcctggcccgatgtccaaaaggggaaactctgacggtgggattcactgacaggaccttttgggacagcggtg

SEQ ID NO: 7044 - DNA, 140 bp, Artificial Sequence
  Synthetic
caccgctgtcccaaaaggtcctgtcagtgaatcccaccgtcagagtttccccttttggacatcgggccaggatgaagtgtcccattgttccagtaatcgtacacggtgctgatgttcttacatatcagcagccagggcct

SEQ ID NO: 7045 - DNA, 140 bp, Artificial Sequence
  Synthetic
aggccctggctgctgatatgctgtatctgcttatgcaaacggcgaccatgccgtcacagttaaggacgctaaattcatagtggggccaatgtcttcagcctggacacctttcgataataagaccttttgggacagcggtg

SEQ ID NO: 7046 - DNA, 140 bp, Artificial Sequence
  Synthetic
caccgctgtcccaaaaggtcttattatcgaaaggtgtccaggctgaagacattggccccactatgaatttagcgtccttaactgtgacggcatggtcgccgtttgcataagcagatacagcatatcagcagccagggcct

SEQ ID NO: 7047 - DNA, 140 bp, Artificial Sequence
  Synthetic
aggccctggctgctgatatgtaactgcaaggttgatcaatgtcatgccgcggtcaccaatcacaaaaagtggcagtataactcccctctggtcccgcgtaatgctgaacttggggaccgagaccttttgggacagcggtg

SEQ ID NO: 7048 - DNA, 140 bp, Artificial Sequence
  Synthetic
caccgctgtcccaaaaggtctcggtccccaagttcagcattacgcgggaccagaggggagttatactgccactttttgtgattggtgaccgcggcatgacattgatcaaccttgcagttacatatcagcagccagggcct

SEQ ID NO: 7049 - DNA, 140 bp, Artificial Sequence
  Synthetic
aggccctggctgctgatatgcaaatagcaacaaacccggtaagagcgatgaactgcgccgtagggaacatgcctatctccatcgacataccggacgcggccttcactagggtcgtcgacggaccttttgggacagcggtg

SEQ ID NO: 7050 - DNA, 140 bp, Artificial Sequence
  Synthetic
caccgctgtcccaaaaggtccgtcgacgaccctagtgaaggccgcgtccggtatgtcgatggagataggcatgttccctacggcgcagttcatcgctcttaccgggtttgttgctatttgcatatcagcagccagggcct

SEQ ID NO: 7051 - DNA, 140 bp, Artificial Sequence
  Synthetic
aggccctggctgctgatatgcgtataagtattggccgcagttatctacaaacggtacagcccatggccacccgcatgagataattctgtattattatgagctgtaccctactatgactgtgaccttttgggacagcggtg

SEQ ID NO: 7052 - DNA, 140 bp, Artificial Sequence
  Synthetic
caccgctgtcccaaaaggtcacagtcatagtagggtacagctcataataatacagaattatctcatgcgggtggccatgggctgtaccgtttgtagataactgcggccaatacttatacgcatatcagcagccagggcct

SEQ ID NO: 7053 - DNA, 140 bp, Artificial Sequence
  Synthetic
aggccctggctgctgatatgtaggaggtaccagcctcgaccctggactccgcgctctactatccaaatcatcaggcccagaccgcgccctcagaggcaagctgggcaacttgcccagctggaccttttgggacagcggtg

SEQ ID NO: 7054 - DNA, 140 bp, Artificial Sequence
  Synthetic
caccgctgtcccaaaaggtccagctgggcaagttgcccagcttgcctctgagggcgcggtctgggcctgatgatttggatagtagagcgcggagtccagggtcgaggctggtacctcctacatatcagcagccagggcct

SEQ ID NO: 7055 - DNA, 140 bp, Artificial Sequence
  Synthetic
atacgccatgctgggtctccctgacaccaggagctaccgtccctttcctgcttagcctaatatgctgcatcagaacagctaaagcggccacataccaagaggctgcgatatacctgtggacgtacttgggagtcggccat

SEQ ID NO: 7056 - DNA, 140 bp, Artificial Sequence
  Synthetic
atggccgactcccaagtacgtccacaggtatatcgcagcctcttggtatgtggccgctttagctgttctgatgcagcatattaggctaagcaggaaagggacggtagctcctggtgtcagggagacccagcatggcgtat

SEQ ID NO: 7057 - DNA, 140 bp, Artificial Sequence
  Synthetic
aggccctggctgctgatatgactaggtatgaaggcatatgcgtccctaaagagacacaccacatatagctaagaatcaatagataagtataggtaagaaggtatatgtgtcccctaagaggaccttttgggacagcggtg

SEQ ID NO: 7058 - DNA, 140 bp, Artificial Sequence
  Synthetic
caccgctgtcccaaaaggtcctcttaggggacacatataccttcttacctatacttatctattgattcttagctatatgtggtgtgtctctttagggacgcatatgccttcatacctagtcatatcagcagccagggcct

SEQ ID NO: 7059 - DNA, 140 bp, Artificial Sequence
  Synthetic
aggccctggctgctgatatggttggcttttttagccgtaatgagcgtcggtgcccacactgtgagcgcgtacgaacacgtaacagtgatcccgaacacggtgggagtaccgtataagactgaccttttgggacagcggtg

SEQ ID NO: 7060 - DNA, 140 bp, Artificial Sequence
  Synthetic
caccgctgtcccaaaaggtcagtcttatacggtactcccaccgtgttcgggatcactgttacgtgttcgtacgcgctcacagtgtgggcaccgacgctcattacggctaaaaaagccaaccatatcagcagccagggcct

SEQ ID NO: 7061 - DNA, 140 bp, Artificial Sequence
  Synthetic
aggccctggctgctgatatggaataacccctgaataataacaaaatataaaaatcaataaaaatcataaactagaaaaccataaacagaagtagttcaaagggctataaaacccctgaatgaccttttgggacagcggtg

SEQ ID NO: 7062 - DNA, 140 bp, Artificial Sequence
  Synthetic
caccgctgtcccaaaaggtcattcaggggttttatagccctttgaactacttctgtttatggttttctagtttatgatttttattgatttttatattttgttattattcaggggttattccatatcagcagccagggcct

SEQ ID NO: 7063 - DNA, 140 bp, Artificial Sequence
  Synthetic
aggccctggctgctgatatgaccatgccgtcacagttaaggacgccaaattcattgtggggccaatgtcttcagcctggacacctttcgacaacaaaattgtggtgtacaaaggtgacgtgaccttttgggacagcggtg

SEQ ID NO: 7064 - DNA, 140 bp, Artificial Sequence
  Synthetic
caccgctgtcccaaaaggtcacgtcacctttgtacaccacaattttgttgtcgaaaggtgtccaggctgaagacattggccccacaatgaatttggcgtccttaactgtgacggcatggtcatatcagcagccagggcct

SEQ ID NO: 7065 - DNA, 140 bp, Artificial Sequence
  Synthetic
aggccctggctgctgatatgcgtaggtacttaagcttcctaaaagcagccgaactcactttgagatgtaggcatagcataccgaactcttccacaattctccgtacccataggacgtagagaccttttgggacagcggtg

SEQ ID NO: 7066 - DNA, 140 bp, Artificial Sequence
  Synthetic
caccgctgtcccaaaaggtctctacgtcctatgggtacggagaattgtggaagagttcggtatgctatgcctacatctcaaagtgagttcggctgcttttaggaagcttaagtacctacgcatatcagcagccagggcct

SEQ ID NO: 7067 - DNA, 140 bp, Artificial Sequence
  Synthetic
aggccctggctgctgatatgtcagcctggacacctttcgacaacaaaattgtggtgtacaaaggtgacgtctataacatggactacccgccctttggcgcacgaagaccaggacaatttggaccttttgggacagcggtg

SEQ ID NO: 7068 - DNA, 140 bp, Artificial Sequence
  Synthetic
caccgctgtcccaaaaggtccaaattgtcctggtcttcgtgcgccaaagggcgggtagtccatgttatagacgtcacctttgtacaccacaattttgttgtcgaaaggtgtccaggctgacatatcagcagccagggcct

SEQ ID NO: 7069 - DNA, 140 bp, Artificial Sequence
  Synthetic
aggccctggctgctgatatggcgatatccaaagtcgcacacctgagagtaaagacgtctatgctaatacacaactggtactgcagagaccggctgtgggtacagtacacgtgccatactcgaccttttgggacagcggtg

SEQ ID NO: 7070 - DNA, 140 bp, Artificial Sequence
  Synthetic
caccgctgtcccaaaaggtcgagtatggcacgtgtactgtacccacagccggtctctgcagtaccagttgtgtattagcatagacgtctttactctcaggtgtgcgactttggatatcgccatatcagcagccagggcct

SEQ ID NO: 7071 - DNA, 140 bp, Artificial Sequence
  Synthetic
atacgccatgctgggtctcctggaataaagacattgtcactaaaatcacccccgaaggggccgaagagtggagtcttgccatcccagttatgtgcctgttggcgaacaccacgttcccctcgtacttgggagtcggccat

SEQ ID NO: 7072 - DNA, 140 bp, Artificial Sequence
  Synthetic
atggccgactcccaagtacgaggggaacgtggtgttcgccaacaggcacataactgggatggcaagactccactcttcggccccttcgggggtgattttagtgacaatgtctttattccaggagacccagcatggcgtat

SEQ ID NO: 7073 - DNA, 140 bp, Artificial Sequence
  Synthetic
aggccctggctgctgatatgaatggccgtgccagacaaggagacgccaacattctgcttacacacagacgtctcatgtagacagagagcagacgtcgctatataccaagacgtctatgctgaccttttgggacagcggtg

SEQ ID NO: 7074 - DNA, 140 bp, Artificial Sequence
  Synthetic
caccgctgtcccaaaaggtcagcatagacgtcttggtatatagcgacgtctgctctctgtctacatgagacgtctgtgtgtaagcagaatgttggcgtctccttgtctggcacggccattcatatcagcagccagggcct

SEQ ID NO: 7075 - DNA, 140 bp, Artificial Sequence
  Synthetic
aggccctggctgctgatatgattaaatatgcagccagcaagaaaggcaagtgtgcggtgcattcgatgactaacgccgtcactattcgggaagctgagatagaagttgaagggaattctcgaccttttgggacagcggtg

SEQ ID NO: 7076 - DNA, 140 bp, Artificial Sequence
  Synthetic
caccgctgtcccaaaaggtcgagaattcccttcaacttctatctcagcttcccgaatagtgacggcgttagtcatcgaatgcaccgcacacttgcctttcttgctggctgcatatttaatcatatcagcagccagggcct

SEQ ID NO: 7077 - DNA, 140 bp, Artificial Sequence
  Synthetic
aggccctggctgctgatatgtaacgccgtcactattcgggaagctgagatagaagttgaagggaattctcatctgcaaatctctttcgcgacggccttagccagcgccgaattccgcgaagaccttttgggacagcggtg

SEQ ID NO: 7078 - DNA, 140 bp, Artificial Sequence
  Synthetic
caccgctgtcccaaaaggtcttcgcggaattcggcgctggctaaggccgtcgcgaaagagatttgcagatgagaattcccttcaacttctatctcagcttcccgaatagtgacggcgttacatatcagcagccagggcct

SEQ ID NO: 7079 - DNA, 140 bp, Artificial Sequence
  Synthetic
atacgccatgctgggtctcccaagtctgttctacacaagtacagtgtgaagctgactgtcaccccccgaaggaccacatagtcaactaccgggcgtcacataccaccctcggggtccaggcgtacttgggagtcggccat

SEQ ID NO: 7080 - DNA, 140 bp, Artificial Sequence
  Synthetic
atggccgactcccaagtacgcctggaccccgagggtggtatgtgacgcccggtagttgactatgtggtccttcggggggtgacagtcagcttcacactgtacttgtgtagaacagacttgggagacccagcatggcgtat

SEQ ID NO: 7081 - DNA, 140 bp, Artificial Sequence
  Synthetic
aggccctggctgctgatatgggaccacatagtcaactaccgggcgtcacataccaccctcggggtccaggacatctccggtacggcgatgtcatgggtgcagaagatcacgggaggtgtggaccttttgggacagcggtg

SEQ ID NO: 7082 - DNA, 140 bp, Artificial Sequence
  Synthetic
caccgctgtcccaaaaggtccacacctcccgtgatcttctgcacccatgacatcgccgtaccggagatgtcctggaccccgagggtggtatgtgacgcccggtagttgactatgtggtcccatatcagcagccagggcct

SEQ ID NO: 7083 - DNA, 140 bp, Artificial Sequence
  Synthetic
aggccctggctgctgatatgccctaagagacacactgtacatagcaaataatctatagatcaaagggctacgcaacccctgaatagtaacaaaatacaaaatcactaaaaattataaaaagaccttttgggacagcggtg

SEQ ID NO: 7084 - DNA, 140 bp, Artificial Sequence
  Synthetic
caccgctgtcccaaaaggtctttttataatttttagtgattttgtattttgttactattcaggggttgcgtagccctttgatctatagattatttgctatgtacagtgtgtctcttagggcatatcagcagccagggcct

SEQ ID NO: 7085 - DNA, 140 bp, Artificial Sequence
  Synthetic
aggccctggctgctgatatgaagagatgtaggtacttaagcttcctaaaagcagccgaactcactttgagaagtaggcgtagcataccgaactcttccacgattctccgaacccacaggggaccttttgggacagcggtg

SEQ ID NO: 7086 - DNA, 140 bp, Artificial Sequence
  Synthetic
caccgctgtcccaaaaggtcccctgtgggttcggagaatcgtggaagagttcggtatgctacgcctacttctcaaagtgagttcggctgcttttaggaagcttaagtacctacatctcttcatatcagcagccagggcct

SEQ ID NO: 7087 - DNA, 140 bp, Artificial Sequence
  Synthetic
aggccctggctgctgatatgaagccttcagtaagtgggcaaaggagtgccggaaagacatggaagatgaaaaactcctgggggtcagagaaagaacactgacctgctgctgtctatgggcgaccttttgggacagcggtg

SEQ ID NO: 7088 - DNA, 140 bp, Artificial Sequence
  Synthetic
caccgctgtcccaaaaggtcgcccatagacagcagcaggtcagtgttctttctctgacccccaggagtttttcatcttccatgtctttccggcactcctttgcccacttactgaaggcttcatatcagcagccagggcct

SEQ ID NO: 7089 - DNA, 140 bp, Artificial Sequence
  Synthetic
atacgccatgctgggtctccggcaaacggaagagatgtaggtacttaagcttcctaaaagcagccgaactcactttgagaagtaggcatagcataccgaactcttccaggattctccgaacgtacttgggagtcggccat

SEQ ID NO: 7090 - DNA, 140 bp, Artificial Sequence
  Synthetic
atggccgactcccaagtacgttcggagaatcctggaagagttcggtatgctatgcctacttctcaaagtgagttcggctgcttttaggaagcttaagtacctacatctcttccgtttgccggagacccagcatggcgtat

SEQ ID NO: 7091 - DNA, 140 bp, Artificial Sequence
  Synthetic
aggccctggctgctgatatgtaacccatcatggattctgtgtacgtggatatagacgctgacagcgcctttttgaaggccctgcaacgtgcgtaccccatgtttgaggtggaacctaggcgaccttttgggacagcggtg

SEQ ID NO: 7092 - DNA, 140 bp, Artificial Sequence
  Synthetic
caccgctgtcccaaaaggtcgcctaggttccacctcaaacatggggtacgcacgttgcagggccttcaaaaaggcgctgtcagcgtctatatccacgtacacagaatccatgatgggttacatatcagcagccagggcct

SEQ ID NO: 7093 - DNA, 140 bp, Artificial Sequence
  Synthetic
atacgccatgctgggtctccattcaagaagcagaaaacacacacggtctacaagaggccggatacccagtcaattcagaaggttcaggccgagtttgacagctttgtggtaccgagtcagcgtacttgggagtcggccat

SEQ ID NO: 7094 - DNA, 140 bp, Artificial Sequence
  Synthetic
atggccgactcccaagtacgctgactcggtaccacaaagctgtcaaactcggcctgaaccttctgaattgactgggtatccggcctcttgtagaccgtgtgtgttttctgcttcttgaatggagacccagcatggcgtat

SEQ ID NO: 7095 - DNA, 140 bp, Artificial Sequence
  Synthetic
atacgccatgctgggtctccattcaagaagcagaaaacacacacggtctacaagaggccggatacccagtcaattcagaaggttcaggccgagtttgacagctttgtggtaccgagtctgcgtacttgggagtcggccat

SEQ ID NO: 7096 - DNA, 140 bp, Artificial Sequence
  Synthetic
atggccgactcccaagtacgcagactcggtaccacaaagctgtcaaactcggcctgaaccttctgaattgactgggtatccggcctcttgtagaccgtgtgtgttttctgcttcttgaatggagacccagcatggcgtat

SEQ ID NO: 7097 - DNA, 140 bp, Artificial Sequence
  Synthetic
atacgccatgctgggtctccattcaagaagcagaaaacacacacggtctacaagaggccggatacccagtcaattcagaaggttcaggccgagtttgacagctttgtggtaccgagtccgcgtacttgggagtcggccat

SEQ ID NO: 7098 - DNA, 140 bp, Artificial Sequence
  Synthetic
atggccgactcccaagtacgcggactcggtaccacaaagctgtcaaactcggcctgaaccttctgaattgactgggtatccggcctcttgtagaccgtgtgtgttttctgcttcttgaatggagacccagcatggcgtat

SEQ ID NO: 7099 - DNA, 140 bp, Artificial Sequence
  Synthetic
atacgccatgctgggtctccattcaagaagcagaaaacacacacggtctacaagaggccggatacccagtcaattcagaaggttcaggccgagtttgacagctttgtggtaccgagtcggcgtacttgggagtcggccat

SEQ ID NO: 7100 - DNA, 140 bp, Artificial Sequence
  Synthetic
atggccgactcccaagtacgccgactcggtaccacaaagctgtcaaactcggcctgaaccttctgaattgactgggtatccggcctcttgtagaccgtgtgtgttttctgcttcttgaatggagacccagcatggcgtat

SEQ ID NO: 7101 - DNA, 140 bp, Artificial Sequence
  Synthetic
aggccctggctgctgatatgaaaagctaaaaccgtgcgaccgtgtgctgttctcagtagggtcaacgctttacccggaaagccgcacgctacttaagagctggcacctaccatcggtgttgaccttttgggacagcggtg

SEQ ID NO: 7102 - DNA, 140 bp, Artificial Sequence
  Synthetic
caccgctgtcccaaaaggtcaacaccgatggtaggtgccagctcttaagtagcgtgcggctttccgggtaaagcgttgaccctactgagaacagcacacggtcgcacggttttagcttttcatatcagcagccagggcct

SEQ ID NO: 7103 - DNA, 140 bp, Artificial Sequence
  Synthetic
aggccctggctgctgatatggtgcaagactaccgacacggttgacggcgaaagagtgtcattctcggtgtgcacgtacgtgccggcgaccatttgtgatcaaatgaccggcatccttgctgaccttttgggacagcggtg

SEQ ID NO: 7104 - DNA, 140 bp, Artificial Sequence
  Synthetic
caccgctgtcccaaaaggtcagcaaggatgccggtcatttgatcacaaatggtcgccggcacgtacgtgcacaccgagaatgacactctttcgccgtcaaccgtgtcggtagtcttgcaccatatcagcagccagggcct

SEQ ID NO: 7105 - DNA, 140 bp, Artificial Sequence
  Synthetic
aggccctggctgctgatatgcgaaatcgacgtggaacagcttgaggacagagcgggcgcaggaataatagagactccgagaggagctatcaaagttactgcccaaccaacagaccacgtcgaccttttgggacagcggtg

SEQ ID NO: 7106 - DNA, 140 bp, Artificial Sequence
  Synthetic
caccgctgtcccaaaaggtcgacgtggtctgttggttgggcagtaactttgatagctcctctcggagtctctattattcctgcgcccgctctgtcctcaagctgttccacgtcgatttcgcatatcagcagccagggcct

SEQ ID NO: 7107 - DNA, 140 bp, Artificial Sequence
  Synthetic
aggccctggctgctgatatgccgttggtgtctgtgtattacgcggataaccactgggataataggcctggagggaaaatgttcggatttaaccccgaggcagcatccattctagaaagaagaccttttgggacagcggtg

SEQ ID NO: 7108 - DNA, 140 bp, Artificial Sequence
  Synthetic
caccgctgtcccaaaaggtcttctttctagaatggatgctgcctcggggttaaatccgaacattttccctccaggcctattatcccagtggttatccgcgtaatacacagacaccaacggcatatcagcagccagggcct

SEQ ID NO: 7109 - DNA, 140 bp, Artificial Sequence
  Synthetic
aggccctggctgctgatatggagaatagtggttaacggcagaacgcaacggaacacgaacaccatgaagaactatctacttcccgtggtcgcccaggccttcagtaagtgggcgaaggaggaccttttgggacagcggtg

SEQ ID NO: 7110 - DNA, 140 bp, Artificial Sequence
  Synthetic
caccgctgtcccaaaaggtcctccttcgcccacttactgaaggcctgggcgaccacgggaagtagatagttcttcatggtgttcgtgttccgttgcgttctgccgttaaccactattctccatatcagcagccagggcct

SEQ ID NO: 7111 - DNA, 140 bp, Artificial Sequence
  Synthetic
aggccctggctgctgatatgatctgcgtattgggacgcaagtttagatcgtctagagcgttgaaaccaccatgtgtcaccagcaacactgagatgtttttcctattcagtaactttgacagaccttttgggacagcggtg

SEQ ID NO: 7112 - DNA, 140 bp, Artificial Sequence
  Synthetic
caccgctgtcccaaaaggtctgtcaaagttactgaataggaaaaacatctcagtgttgctggtgacacatggtggtttcaacgctctagacgatctaaacttgcgtcccaatacgcagatcatatcagcagccagggcct

SEQ ID NO: 7113 - DNA, 140 bp, Artificial Sequence
  Synthetic
aggccctggctgctgatatgtttcccctcccaaagtacaaaatagaaggagtgcaaaaagtcaaatgctctaaggtaatgctatttgaccacaacgtgccatcgcgcgtaagtccaaggggaccttttgggacagcggtg

SEQ ID NO: 7114 - DNA, 140 bp, Artificial Sequence
  Synthetic
caccgctgtcccaaaaggtccccttggacttacgcgcgatggcacgttgtggtcaaatagcattaccttagagcatttgactttttgcactccttctattttgtactttgggaggggaaacatatcagcagccagggcct

SEQ ID NO: 7115 - DNA, 140 bp, Artificial Sequence
  Synthetic
aggccctggctgctgatatggcacgtacgtgccggcgaccatttgtgatcaaatgaccggcatccttgctacagaagtcacgccggaggatgcacagaagctgttggtggggctgaaccagaccttttgggacagcggtg

SEQ ID NO: 7116 - DNA, 140 bp, Artificial Sequence
  Synthetic
caccgctgtcccaaaaggtctggttcagccccaccaacagcttctgtgcatcctccggcgtgacttctgtagcaaggatgccggtcatttgatcacaaatggtcgccggcacgtacgtgccatatcagcagccagggcct

SEQ ID NO: 7117 - DNA, 140 bp, Artificial Sequence
  Synthetic
aggccctggctgctgatatgatagagctggtgctggaataatagagactccgagaggcgctattaaagttactgcccaactaacagaccacgtcgtgggggagtacctggtactttccccgaccttttgggacagcggtg

SEQ ID NO: 7118 - DNA, 140 bp, Artificial Sequence
  Synthetic
caccgctgtcccaaaaggtcggggaaagtaccaggtactcccccacgacgtggtctgttagttgggcagtaactttaatagcgcctctcggagtctctattattccagcaccagctctatcatatcagcagccagggcct

SEQ ID NO: 7119 - DNA, 140 bp, Artificial Sequence
  Synthetic
atacgccatgctgggtctccactgcccaactaacagaccacgtcgtgggggagtacctggtactttccccgcagaccgtactacgcagccagaagctcagcctgatccacgctttagcggcgtacttgggagtcggccat

SEQ ID NO: 7120 - DNA, 140 bp, Artificial Sequence
  Synthetic
atggccgactcccaagtacgccgctaaagcgtggatcaggctgagcttctggctgcgtagtacggtctgcggggaaagtaccaggtactcccccacgacgtggtctgttagttgggcagtggagacccagcatggcgtat

SEQ ID NO: 7121 - DNA, 140 bp, Artificial Sequence
  Synthetic
aggccctggctgctgatatgagcaagtgaagacgtgtacgcatagcggacgagcagggaggtatgcggtcgaagcgtacgatggccgagtcctagtgccctcaggctatgcaatttcgccgaccttttgggacagcggtg

SEQ ID NO: 7122 - DNA, 140 bp, Artificial Sequence
  Synthetic
caccgctgtcccaaaaggtcggcgaaattgcatagcctgagggcactaggactcggccatcgtacgcttcgaccgcatacctccctgctcgtccgctatgcgtacacgtcttcacttgctcatatcagcagccagggcct

SEQ ID NO: 7123 - DNA, 140 bp, Artificial Sequence
  Synthetic
atacgccatgctgggtctccacacgagtacgtctacgacgtggaccagagaagatgctgtaagaaggaagaagctgcaggactggtactggtgggcgacttgactaatccgccctaccaccgtacttgggagtcggccat

SEQ ID NO: 7124 - DNA, 140 bp, Artificial Sequence
  Synthetic
atggccgactcccaagtacggtggtagggcggattagtcaagtcgcccaccagtaccagtcctgcagcttcttccttcttacagcatcttctctggtccacgtcgtagacgtactcgtgtggagacccagcatggcgtat

SEQ ID NO: 7125 - DNA, 140 bp, Artificial Sequence
  Synthetic
atacgccatgctgggtctccgaattcgcatacgaagggctaaaaattcgccccgcttgcccatacaaaattgcagtcataggagtcttcggggtaccaggatctggtaagtcagccattacgtacttgggagtcggccat

SEQ ID NO: 7126 - DNA, 140 bp, Artificial Sequence
  Synthetic
atggccgactcccaagtacgtaatggctgacttaccagatcctggtaccccgaagactcctatgactgcaattttgtatgggcaagcggggcgaatttttagcccttcgtatgcgaattcggagacccagcatggcgtat

SEQ ID NO: 7127 - DNA, 140 bp, Artificial Sequence
  Synthetic
aggccctggctgctgatatgtgcagtcataggagtcttcggggtaccaggatctggtaagtcagccattatcaagaacctagttaccaggcaagacctggtgactagcggaaagaaagaagaccttttgggacagcggtg

SEQ ID NO: 7128 - DNA, 140 bp, Artificial Sequence
  Synthetic
caccgctgtcccaaaaggtcttctttctttccgctagtcaccaggtcttgcctggtaactaggttcttgataatggctgacttaccagatcctggtaccccgaagactcctatgactgcacatatcagcagccagggcct

SEQ ID NO: 7129 - DNA, 140 bp, Artificial Sequence
  Synthetic
aggccctggctgctgatatggtgtcatcgttgcattacgaaggcaaaatgcgcactacgaatgagtacaacaagccgattgtagtggacactacaggctcaacaaaacctgaccctggaggaccttttgggacagcggtg

SEQ ID NO: 7130 - DNA, 140 bp, Artificial Sequence
  Synthetic
caccgctgtcccaaaaggtcctccagggtcaggttttgttgagcctgtagtgtccactacaatcggcttgttgtactcattcgtagtgcgcattttgccttcgtaatgcaacgatgacaccatatcagcagccagggcct

SEQ ID NO: 7131 - DNA, 140 bp, Artificial Sequence
  Synthetic
aggccctggctgctgatatgtgggttaaacaactgcaaattgactatcgtggacacgaggtcatgacagcagccgcatcccaagggttaaccagaaaaggagtttacgcagttaggcaaagaccttttgggacagcggtg

SEQ ID NO: 7132 - DNA, 140 bp, Artificial Sequence
  Synthetic
caccgctgtcccaaaaggtctttgcctaactgcgtaaactccttttctggttaacccttgggatgcggctgctgtcatgacctcgtgtccacgatagtcaatttgcagttgtttaacccacatatcagcagccagggcct

SEQ ID NO: 7133 - DNA, 140 bp, Artificial Sequence
  Synthetic
aggccctggctgctgatatggtagtagttgtgtcagtggccacgttcatactcctgtcgatggtgggtatggcagcggggatgtgcatgtgtgcacgacgcagatgcatcacaccgtatggaccttttgggacagcggtg

SEQ ID NO: 7134 - DNA, 140 bp, Artificial Sequence
  Synthetic
caccgctgtcccaaaaggtccatacggtgtgatgcatctgcgtcgtgcacacatgcacatccccgctgccatacccaccatcgacaggagtatgaacgtggccactgacacaactactaccatatcagcagccagggcct

SEQ ID NO: 7135 - DNA, 140 bp, Artificial Sequence
  Synthetic
aggccctggctgctgatatgctattaaggagtgggaggtggagcacgcatcgataatggcgggcatctgcagtcaccaagtgacctttgacacgttccaaaacaaagccaacgtttgctggaccttttgggacagcggtg

SEQ ID NO: 7136 - DNA, 140 bp, Artificial Sequence
  Synthetic
caccgctgtcccaaaaggtccagcaaacgttggctttgttttggaacgtgtcaaaggtcacttggtgactgcagatgcccgccattatcgatgcgtgctccacctcccactccttaatagcatatcagcagccagggcct

SEQ ID NO: 7137 - DNA, 140 bp, Artificial Sequence
  Synthetic
atacgccatgctgggtctcctcacccgaagtagccttgaatgaaatatgcacgcgcatgtatggggtggatctagacagcgggctattctctaaaccgttggtgtctgtgtgttacgcggcgtacttgggagtcggccat

SEQ ID NO: 7138 - DNA, 140 bp, Artificial Sequence
  Synthetic
atggccgactcccaagtacgccgcgtaacacacagacaccaacggtttagagaatagcccgctgtctagatccaccccatacatgcgcgtgcatatttcattcaaggctacttcgggtgaggagacccagcatggcgtat

SEQ ID NO: 7139 - DNA, 140 bp, Artificial Sequence
  Synthetic
aggccctggctgctgatatgataaccattgggataataggccgggaggaaagatgttcggattcaaccctgaggcagcgtccattctagaaagaaagtacccatttacaaaaggaaagtggaccttttgggacagcggtg

SEQ ID NO: 7140 - DNA, 140 bp, Artificial Sequence
  Synthetic
caccgctgtcccaaaaggtccactttccttttgtaaatgggtactttctttctagaatggacgctgcctcagggttgaatccgaacatctttcctcccggcctattatcccaatggttatcatatcagcagccagggcct

SEQ ID NO: 7141 - DNA, 140 bp, Artificial Sequence
  Synthetic
aggccctggctgctgatatggaggcagcgtccattctagaaagaaagtacccatttacaaaaggaaagtggaacatcaacaagcagatctgcgtgactaccaggaggatagaagacttcagaccttttgggacagcggtg

SEQ ID NO: 7142 - DNA, 140 bp, Artificial Sequence
  Synthetic
caccgctgtcccaaaaggtctgaagtcttctatcctcctggtagtcacgcagatctgcttgttgatgttccactttccttttgtaaatgggtactttctttctagaatggacgctgcctccatatcagcagccagggcct

SEQ ID NO: 7143 - DNA, 140 bp, Artificial Sequence
  Synthetic
aggccctggctgctgatatggactaccaggaggatagaagactttaaccctaccaccaacatcataccggccaacaggagactaccacactcattagtggccgaacaccgcccagtaaaagaccttttgggacagcggtg

SEQ ID NO: 7144 - DNA, 140 bp, Artificial Sequence
  Synthetic
caccgctgtcccaaaaggtcttttactgggcggtgttcggccactaatgagtgtggtagtctcctgttggccggtatgatgttggtggtagggttaaagtcttctatcctcctggtagtccatatcagcagccagggcct

SEQ ID NO: 7145 - DNA, 140 bp, Artificial Sequence
  Synthetic
atacgccatgctgggtctccacactaatcagctacagcgattaagggcccaattgcctagggtttaaactccggacctgcagggcccgagctccagatccaacttcgagaagctcagaggcgtacttgggagtcggccat

SEQ ID NO: 7146 - DNA, 140 bp, Artificial Sequence
  Synthetic
atggccgactcccaagtacgcctctgagcttctcgaagttggatctggagctcgggccctgcaggtccggagtttaaaccctaggcaattgggcccttaatcgctgtagctgattagtgtggagacccagcatggcgtat

SEQ ID NO: 7147 - DNA, 140 bp, Artificial Sequence
  Synthetic
aggccctggctgctgatatgcgcagatagaaccagtgaacgagtcatctgcgtactgggacgcaagtttagatcgtctagagcattgaaaccaccatgtatcaccagtaatactgagatggaccttttgggacagcggtg

SEQ ID NO: 7148 - DNA, 140 bp, Artificial Sequence
  Synthetic
caccgctgtcccaaaaggtccatctcagtattactggtgatacatggtggtttcaatgctctagacgatctaaacttgcgtcccagtacgcagatgactcgttcactggttctatctgcgcatatcagcagccagggcct

SEQ ID NO: 7149 - DNA, 140 bp, Artificial Sequence
  Synthetic
aggccctggctgctgatatgtggagttcatcccaacccaaactttttacaataggaggtaccagcctcgaccctggactccgcgctctactatccaagtcatcaggcccagaccgcgcccgaccttttgggacagcggtg

SEQ ID NO: 7150 - DNA, 140 bp, Artificial Sequence
  Synthetic
caccgctgtcccaaaaggtcgggcgcggtctgggcctgatgacttggatagtagagcgcggagtccagggtcgaggctggtacctcctattgtaaaaagtttgggttgggatgaactccacatatcagcagccagggcct

SEQ ID NO: 7151 - DNA, 140 bp, Artificial Sequence
  Synthetic
atacgccatgctgggtctccttcttcctatttagcaattttgacaatggcagaaggaattttacaacgcatgtcatgaacaatcaactgaatgcagccttcgtagggcaggccacccgagcgtacttgggagtcggccat

SEQ ID NO: 7152 - DNA, 140 bp, Artificial Sequence
  Synthetic
atggccgactcccaagtacgctcgggtggcctgccctacgaaggctgcattcagttgattgttcatgacatgcgttgtaaaattccttctgccattgtcaaaattgctaaataggaagaaggagacccagcatggcgtat

SEQ ID NO: 7153 - DNA, 140 bp, Artificial Sequence
  Synthetic
aggccctggctgctgatatgggtctgccagcaacgcttggtaggtatgaccttgtggtcataaacatccacacaccttttcgcatacaccattaccaacagtgcgtcgaccacgcaatgagaccttttgggacagcggtg

SEQ ID NO: 7154 - DNA, 140 bp, Artificial Sequence
  Synthetic
caccgctgtcccaaaaggtctcattgcgtggtcgacgcactgttggtaatggtgtatgcgaaaaggtgtgtggatgtttatgaccacaaggtcatacctaccaagcgttgctggcagacccatatcagcagccagggcct

SEQ ID NO: 7155 - DNA, 140 bp, Artificial Sequence
  Synthetic
aggccctggctgctgatatgcaggatgtgcaccatcgtaccgggtaaaacgcatggacatcgcgaagaacgatgaagagtgcgtggttaacgccgccaaccctcgcgggttaccaggtgagaccttttgggacagcggtg

SEQ ID NO: 7156 - DNA, 140 bp, Artificial Sequence
  Synthetic
caccgctgtcccaaaaggtctcacctggtaacccgcgagggttggcggcgttaaccacgcactcttcatcgttcttcgcgatgtccatgcgttttacccggtacgatggtgcacatcctgcatatcagcagccagggcct

SEQ ID NO: 7157 - DNA, 140 bp, Artificial Sequence
  Synthetic
atacgccatgctgggtctcccggtgtttgcaaggcagtatataaaaagtggccggagtcctttaaaaacagtgcaacaccagtaggaaccgcaaaaacagttatgtgcggtacatatccacgtacttgggagtcggccat

SEQ ID NO: 7158 - DNA, 140 bp, Artificial Sequence
  Synthetic
atggccgactcccaagtacgtggatatgtaccgcacataactgtttttgcggttcctactggtgttgcactgtttttaaaggactccggccactttttatatactgccttgcaaacaccgggagacccagcatggcgtat

SEQ ID NO: 7159 - DNA, 140 bp, Artificial Sequence
  Synthetic
aggccctggctgctgatatgcttccacgattctccgaacccacagggacgtaggagatgttattttgtttttaatatttcaaaaaaaaaaaaaaaaaaaaaaaaaaaaaaaaaaaaaaaagaccttttgggacagcggtg

SEQ ID NO: 7160 - DNA, 140 bp, Artificial Sequence
  Synthetic
caccgctgtcccaaaaggtcttttttttttttttttttttttttttttttttttttttttgaaatattaaaaacaaaataacatctcctacgtccctgtgggttcggagaatcgtggaagcatatcagcagccagggcct

SEQ ID NO: 7161 - DNA, 140 bp, Artificial Sequence
  Synthetic
aggccctggctgctgatatgaatggcagaaggaatttcacaactcatgtcatgaacaatcaactgaatgcagccttcgtaggacaggtcacccgagcaggatgtgcaccgtcgtaccggggaccttttgggacagcggtg

SEQ ID NO: 7162 - DNA, 140 bp, Artificial Sequence
  Synthetic
caccgctgtcccaaaaggtccccggtacgacggtgcacatcctgctcgggtgacctgtcctacgaaggctgcattcagttgattgttcatgacatgagttgtgaaattccttctgccattcatatcagcagccagggcct

SEQ ID NO: 7163 - DNA, 140 bp, Artificial Sequence
  Synthetic
aggccctggctgctgatatgagccttcgtaggacaggtcacccgagcaggatgtgcaccgtcgtaccgggtaaaacgcatggacatcgcgaagaacgatgaagagtgcgtagtcaacgccgaccttttgggacagcggtg

SEQ ID NO: 7164 - DNA, 140 bp, Artificial Sequence
  Synthetic
caccgctgtcccaaaaggtcggcgttgactacgcactcttcatcgttcttcgcgatgtccatgcgttttacccggtacgacggtgcacatcctgctcgggtgacctgtcctacgaaggctcatatcagcagccagggcct

SEQ ID NO: 7165 - DNA, 140 bp, Artificial Sequence
  Synthetic
atacgccatgctgggtctccggagctgttcaccggggtggtgcccatcctggtcgagctggacggcgacgtaaacggccacaagttcagcgtgtccggcgagggcgagggcgatgccacccgtacttgggagtcggccat

SEQ ID NO: 7166 - DNA, 140 bp, Artificial Sequence
  Synthetic
atggccgactcccaagtacgggtggcatcgccctcgccctcgccggacacgctgaacttgtggccgtttacgtcgccgtccagctcgaccaggatgggcaccaccccggtgaacagctccggagacccagcatggcgtat

SEQ ID NO: 7167 - DNA, 140 bp, Artificial Sequence
  Synthetic
aggccctggctgctgatatgggtacgcactacagctacctattttgcagaagccgacagcaagtatctaaacactaatcagctacagcgatcgcgccgccaccatggtgagcaagggcgagaccttttgggacagcggtg

SEQ ID NO: 7168 - DNA, 140 bp, Artificial Sequence
  Synthetic
caccgctgtcccaaaaggtctcgcccttgctcaccatggtggcggcgcgatcgctgtagctgattagtgtttagatacttgctgtcggcttctgcaaaataggtagctgtagtgcgtacccatatcagcagccagggcct

SEQ ID NO: 7169 - DNA, 140 bp, Artificial Sequence
  Synthetic
aggccctggctgctgatatgattcatatctagaagggacacgttttcaccagacggcagtggatatggcagagatatatactatgtggccaaagcaaacagaggccaatgagcaagtctggaccttttgggacagcggtg

SEQ ID NO: 7170 - DNA, 140 bp, Artificial Sequence
  Synthetic
caccgctgtcccaaaaggtccagacttgctcattggcctctgtttgctttggccacatagtatatatctctgccatatccactgccgtctggtgaaaacgtgtcccttctagatatgaatcatatcagcagccagggcct

SEQ ID NO: 7171 - DNA, 140 bp, Artificial Sequence
  Synthetic
atacgccatgctgggtctccgccctggcccaccctcgtgaccaccctgacctacggcgtgcagtgcttcagccgctaccccgaccacatgaagcagcacgacttcttcaagtccgccatgcgtacttgggagtcggccat

SEQ ID NO: 7172 - DNA, 140 bp, Artificial Sequence
  Synthetic
atggccgactcccaagtacgcatggcggacttgaagaagtcgtgctgcttcatgtggtcggggtagcggctgaagcactgcacgccgtaggtcagggtggtcacgagggtgggccagggcggagacccagcatggcgtat

SEQ ID NO: 7173 - DNA, 140 bp, Artificial Sequence
  Synthetic
aggccctggctgctgatatgtaaacggccacaagttcagcgtgtccggcgagggcgagggcgatgccacctacggcaagctgaccctgaagttcatctgcaccaccggcaagctgcccgtgaccttttgggacagcggtg

SEQ ID NO: 7174 - DNA, 140 bp, Artificial Sequence
  Synthetic
caccgctgtcccaaaaggtcacgggcagcttgccggtggtgcagatgaacttcagggtcagcttgccgtaggtggcatcgccctcgccctcgccggacacgctgaacttgtggccgtttacatatcagcagccagggcct

SEQ ID NO: 7175 - DNA, 140 bp, Artificial Sequence
  Synthetic
aggccctggctgctgatatggccgctaccccgaccacatgaagcagcacgacttcttcaagtccgccatgcccgaaggctacgtccaggagcgcaccatcttcttcaaggacgacggcaagaccttttgggacagcggtg

SEQ ID NO: 7176 - DNA, 140 bp, Artificial Sequence
  Synthetic
caccgctgtcccaaaaggtcttgccgtcgtccttgaagaagatggtgcgctcctggacgtagccttcgggcatggcggacttgaagaagtcgtgctgcttcatgtggtcggggtagcggccatatcagcagccagggcct

SEQ ID NO: 7177 - DNA, 140 bp, Artificial Sequence
  Synthetic
atacgccatgctgggtctccctacaagacccgcgccgaggtgaagttcgagggcgacaccctggtgaaccgcatcgagctgaagggcatcgacttcaaggaggacggcaacatcctggggcgtacttgggagtcggccat

SEQ ID NO: 7178 - DNA, 140 bp, Artificial Sequence
  Synthetic
atggccgactcccaagtacgccccaggatgttgccgtcctccttgaagtcgatgcccttcagctcgatgcggttcaccagggtgtcgccctcgaacttcacctcggcgcgggtcttgtagggagacccagcatggcgtat

SEQ ID NO: 7179 - DNA, 140 bp, Artificial Sequence
  Synthetic
aggccctggctgctgatatggcatcgagctgaagggcatcgacttcaaggaggacggcaacatcctggggcacaagctggagtacaactacaacagccacaacgtctatatcatggccgagaccttttgggacagcggtg

SEQ ID NO: 7180 - DNA, 140 bp, Artificial Sequence
  Synthetic
caccgctgtcccaaaaggtctcggccatgatatagacgttgtggctgttgtagttgtactccagcttgtgccccaggatgttgccgtcctccttgaagtcgatgcccttcagctcgatgccatatcagcagccagggcct

SEQ ID NO: 7181 - DNA, 140 bp, Artificial Sequence
  Synthetic
aggccctggctgctgatatgacaggaagtgagtacgacaacgtcattgacgcatagccagtttgatctaagcgccgatggcgagacactgcctgtcccgtcagacctggatgctgacgccgaccttttgggacagcggtg

SEQ ID NO: 7182 - DNA, 140 bp, Artificial Sequence
  Synthetic
caccgctgtcccaaaaggtcggcgtcagcatccaggtctgacgggacaggcagtgtctcgccatcggcgcttagatcaaactggctatgcgtcaatgacgttgtcgtactcacttcctgtcatatcagcagccagggcct

SEQ ID NO: 7183 - DNA, 140 bp, Artificial Sequence
  Synthetic
atacgccatgctgggtctcccaagcagaagaacggcatcaaggtgaacttcaagatccgccacaacatcgaggacggcagcgtgcagctcgccgaccactaccagcagaacacccccatccgtacttgggagtcggccat

SEQ ID NO: 7184 - DNA, 140 bp, Artificial Sequence
  Synthetic
atggccgactcccaagtacggatgggggtgttctgctggtagtggtcggcgagctgcacgctgccgtcctcgatgttgtggcggatcttgaagttcaccttgatgccgttcttctgcttgggagacccagcatggcgtat

SEQ ID NO: 7185 - DNA, 140 bp, Artificial Sequence
  Synthetic
aggccctggctgctgatatgaggacggcagcgtgcagctcgccgaccactaccagcagaacacccccatcggcgacggccccgtgctgctgcccgacaaccactacctgagcacccagtcgaccttttgggacagcggtg

SEQ ID NO: 7186 - DNA, 140 bp, Artificial Sequence
  Synthetic
caccgctgtcccaaaaggtcgactgggtgctcaggtagtggttgtcgggcagcagcacggggccgtcgccgatgggggtgttctgctggtagtggtcggcgagctgcacgctgccgtcctcatatcagcagccagggcct

SEQ ID NO: 7187 - DNA, 140 bp, Artificial Sequence
  Synthetic
aggccctggctgctgatatgctgtcgcgccgcctagaagaaggagagggagaaacctgactgtgacatgtgacgagagagaagggaatataacacccatggctagcgtccgattctttaggaccttttgggacagcggtg

SEQ ID NO: 7188 - DNA, 140 bp, Artificial Sequence
  Synthetic
caccgctgtcccaaaaggtcctaaagaatcggacgctagccatgggtgttatattcccttctctctcgtcacatgtcacagtcaggtttctccctctccttcttctaggcggcgcgacagcatatcagcagccagggcct

SEQ ID NO: 7189 - DNA, 140 bp, Artificial Sequence
  Synthetic
atacgccatgctgggtctccgacgagagagaagggaatataacacccatggctagcgtccgattctttagagcagagctgtgtccggccgtacaagaaacagcggagacgcgtgacacagcgtacttgggagtcggccat

SEQ ID NO: 7190 - DNA, 140 bp, Artificial Sequence
  Synthetic
atggccgactcccaagtacgctgtgtcacgcgtctccgctgtttcttgtacggccggacacagctctgctctaaagaatcggacgctagccatgggtgttatattcccttctctctcgtcggagacccagcatggcgtat

SEQ ID NO: 7191 - DNA, 140 bp, Artificial Sequence
  Synthetic
atacgccatgctgggtctcccgccctgagcaaagaccccaacgagaagcgcgatcacatggtcctgctggagttcgtgaccgccgccgggatcactctcggcatggacgagctgtacaagcgtacttgggagtcggccat

SEQ ID NO: 7192 - DNA, 140 bp, Artificial Sequence
  Synthetic
atggccgactcccaagtacgcttgtacagctcgtccatgccgagagtgatcccggcggcggtcacgaactccagcaggaccatgtgatcgcgcttctcgttggggtctttgctcagggcgggagacccagcatggcgtat

SEQ ID NO: 7193 - DNA, 140 bp, Artificial Sequence
  Synthetic
atacgccatgctgggtctcctaattaattaagggcccaattgcctagggtttaaactccggacctgcagggcccgagctccagatccaacttcgagaagctcagaggacccgtcataactcgtacttgggagtcggccat

SEQ ID NO: 7194 - DNA, 140 bp, Artificial Sequence
  Synthetic
atggccgactcccaagtacgagttatgacgggtcctctgagcttctcgaagttggatctggagctcgggccctgcaggtccggagtttaaaccctaggcaattgggcccttaattaattaggagacccagcatggcgtat

SEQ ID NO: 7195 - DNA, 140 bp, Artificial Sequence
  Synthetic
aggccctggctgctgatatgagcagagctgtgtccggccgtacaagaaacagcggagacgcgtgacacagctatttcccttcaggcaccgccaagtaccatcatggaactgagccatccagaccttttgggacagcggtg

SEQ ID NO: 7196 - DNA, 140 bp, Artificial Sequence
  Synthetic
caccgctgtcccaaaaggtctggatggctcagttccatgatggtacttggcggtgcctgaagggaaatagctgtgtcacgcgtctccgctgtttcttgtacggccggacacagctctgctcatatcagcagccagggcct

SEQ ID NO: 7197 - DNA, 140 bp, Artificial Sequence
  Synthetic
aggccctggctgctgatatggcgccgatggcgagacactgcctgtcccgtcagacctggatgctgacgccccagccctagaaccggccctagacgacggggcggtacatacattaccaacgaccttttgggacagcggtg

SEQ ID NO: 7198 - DNA, 140 bp, Artificial Sequence
  Synthetic
caccgctgtcccaaaaggtcgttggtaatgtatgtaccgccccgtcgtctagggccggttctagggctggggcgtcagcatccaggtctgacgggacaggcagtgtctcgccatcggcgccatatcagcagccagggcct

SEQ ID NO: 7199 - DNA, 140 bp, Artificial Sequence
  Synthetic
aggccctggctgctgatatgtgttacccacctaagctggatgaattaaaggagcaactactacttaagaaactccaggagagtgcgtccacggccaatagaagcaggtatcagtcacgcagaccttttgggacagcggtg

SEQ ID NO: 7200 - DNA, 140 bp, Artificial Sequence
  Synthetic
caccgctgtcccaaaaggtctgcgtgactgatacctgcttctattggccgtggacgcactctcctggagtttcttaagtagtagttgctcctttaattcatccagcttaggtgggtaacacatatcagcagccagggcct

SEQ ID NO: 7201 - DNA, 140 bp, Artificial Sequence
  Synthetic
aggccctggctgctgatatggacggggcgacacacacgctgccatccacaaccggaaaccttgcggccgtgtctgactgggtaatgagcaccgtacctgtcgcgccgcccagaagaaggcgaccttttgggacagcggtg

SEQ ID NO: 7202 - DNA, 140 bp, Artificial Sequence
  Synthetic
caccgctgtcccaaaaggtcgccttcttctgggcggcgcgacaggtacggtgctcattacccagtcagacacggccgcaaggtttccggttgtggatggcagcgtgtgtgtcgccccgtccatatcagcagccagggcct

SEQ ID NO: 7203 - DNA, 140 bp, Artificial Sequence
  Synthetic
aggccctggctgctgatatgaaactgtatttaatggcagagaccccgaaagtcccgacttatcggaccatatacccggcgcccgtgtactcgcctccgatcaacgtccgattgtccaaccgaccttttgggacagcggtg

SEQ ID NO: 7204 - DNA, 140 bp, Artificial Sequence
  Synthetic
caccgctgtcccaaaaggtcggttggacaatcggacgttgatcggaggcgagtacacgggcgccgggtatatggtccgataagtcgggactttcggggtctctgccattaaatacagtttcatatcagcagccagggcct

SEQ ID NO: 7205 - DNA, 140 bp, Artificial Sequence
  Synthetic
atacgccatgctgggtctccccgagtccgcagtggcagcatgtaatgagttcttagctagaaactacccaactgtttcatcataccaaatcaccgatgagtatgatgcatatctagacatcgtacttgggagtcggccat

SEQ ID NO: 7206 - DNA, 140 bp, Artificial Sequence
  Synthetic
atggccgactcccaagtacgatgtctagatatgcatcatactcatcggtgatttggtatgatgaaacagttgggtagtttctagctaagaactcattacatgctgccactgcggactcggggagacccagcatggcgtat

SEQ ID NO: 7207 - DNA, 140 bp, Artificial Sequence
  Synthetic
aggccctggctgctgatatgactgtttcatcataccaaatcaccgatgagtatgatgcatatctagacatggtggacgggtcggagagttgcttggaccgagcgacattcaatccgtcaagaccttttgggacagcggtg

SEQ ID NO: 7208 - DNA, 140 bp, Artificial Sequence
  Synthetic
caccgctgtcccaaaaggtcttgacggattgaatgtcgctcggtccaagcaactctccgacccgtccaccatgtctagatatgcatcatactcatcggtgatttggtatgatgaaacagtcatatcagcagccagggcct

SEQ ID NO: 7209 - DNA, 140 bp, Artificial Sequence
  Synthetic
aggccctggctgctgatatgagcgctgtaccttccccattccagaacacactacagaatgtactggcagcagccacgaaaaggaactgcaatgtcacacagatgagggaattacccacttgaccttttgggacagcggtg

SEQ ID NO: 7210 - DNA, 140 bp, Artificial Sequence
  Synthetic
caccgctgtcccaaaaggtcaagtgggtaattccctcatctgtgtgacattgcagttccttttcgtggctgctgccagtacattctgtagtgtgttctggaatggggaaggtacagcgctcatatcagcagccagggcct

SEQ ID NO: 7211 - DNA, 140 bp, Artificial Sequence
  Synthetic
aggccctggctgctgatatggagacgttccccattacatttggggacttcaacgaaggagaaatcgaaagcttgtcttctgagctactaactttcggagacttcttaccaggagaagtgggaccttttgggacagcggtg

SEQ ID NO: 7212 - DNA, 140 bp, Artificial Sequence
  Synthetic
caccgctgtcccaaaaggtcccacttctcctggtaagaagtctccgaaagttagtagctcagaagacaagctttcgatttctccttcgttgaagtccccaaatgtaatggggaacgtctccatatcagcagccagggcct

SEQ ID NO: 7213 - DNA, 140 bp, Artificial Sequence
  Synthetic
aggccctggctgctgatatgtggactcagcagtattcaacgtggagtgttttaaaaaattcgcatgcaaccgagaatactgggaagaatttgctgccagccctatcaggataacaactgagaccttttgggacagcggtg

SEQ ID NO: 7214 - DNA, 140 bp, Artificial Sequence
  Synthetic
caccgctgtcccaaaaggtctcagttgttatcctgatagggctggcagcaaattcttcccagtattctcggttgcatgcgaattttttaaaacactccacgttgaatactgctgagtccacatatcagcagccagggcct

SEQ ID NO: 7215 - DNA, 140 bp, Artificial Sequence
  Synthetic
aggccctggctgctgatatgcgagaatactgggaagaatttgctgccagccctatcaggataacaactgagaatctaacaacctatgtcactaaactaaaggggccaaaagcagcagcgtgaccttttgggacagcggtg

SEQ ID NO: 7216 - DNA, 140 bp, Artificial Sequence
  Synthetic
caccgctgtcccaaaaggtcacgctgctgcttttggcccctttagtttagtgacataggttgttagattctcagttgttatcctgatagggctggcagcaaattcttcccagtattctcgcatatcagcagccagggcct

SEQ ID NO: 7217 - DNA, 140 bp, Artificial Sequence
  Synthetic
atacgccatgctgggtctcctgtttgcaaaaacccataatctgctgccactgcaggatgtaccaatggataggttcacagtagatatgaaaagggatgtgaaggtaactcctggtacaaacgtacttgggagtcggccat

SEQ ID NO: 7218 - DNA, 140 bp, Artificial Sequence
  Synthetic
atggccgactcccaagtacgtttgtaccaggagttaccttcacatcccttttcatatctactgtgaacctatccattggtacatcctgcagtggcagcagattatgggtttttgcaaacaggagacccagcatggcgtat

SEQ ID NO: 7219 - DNA, 140 bp, Artificial Sequence
  Synthetic
atacgccatgctgggtctccggacttcgatgccattatagccgcacactttaagccaggagacgctgttttagaaacggacatagcctcctttgataagagccaggatgattcacttgcgcgtacttgggagtcggccat

SEQ ID NO: 7220 - DNA, 140 bp, Artificial Sequence
  Synthetic
atggccgactcccaagtacgcgcaagtgaatcatcctggctcttatcaaaggaggctatgtccgtttctaaaacagcgtctcctggcttaaagtgtgcggctataatggcatcgaagtccggagacccagcatggcgtat

SEQ ID NO: 7221 - DNA, 140 bp, Artificial Sequence
  Synthetic
atacgccatgctgggtctccactctgttcgtcaacacattgttaaatatcaccatcgctagccgggtgttggaagatcgtctgacaaaatctgcatgcgcggccttcatcggcgacgacacgtacttgggagtcggccat

SEQ ID NO: 7222 - DNA, 140 bp, Artificial Sequence
  Synthetic
atggccgactcccaagtacgtgtcgtcgccgatgaaggccgcgcatgcagattttgtcagacgatcttccaacacccggctagcgatggtgatatttaacaatgtgttgacgaacagagtggagacccagcatggcgtat

SEQ ID NO: 7223 - DNA, 140 bp, Artificial Sequence
  Synthetic
aggccctggctgctgatatgacataatacatggtgtcgtctccgatgaattgatggcagctagatgcgctacttggatgaacatggaagtgaagatcatagatgcagttgtatcccagaagaccttttgggacagcggtg

SEQ ID NO: 7224 - DNA, 140 bp, Artificial Sequence
  Synthetic
caccgctgtcccaaaaggtcttctgggatacaactgcatctatgatcttcacttccatgttcatccaagtagcgcatctagctgccatcaattcatcggagacgacaccatgtattatgtcatatcagcagccagggcct

SEQ ID NO: 7225 - DNA, 140 bp, Artificial Sequence
  Synthetic
aggccctggctgctgatatgagctccttacttttgtggagggtttatactgcatgatactgtgacaggaacagcttgcagagtggcggacccgctaaaaaggttatttaaactgggcaaagaccttttgggacagcggtg

SEQ ID NO: 7226 - DNA, 140 bp, Artificial Sequence
  Synthetic
caccgctgtcccaaaaggtctttgcccagtttaaataacctttttagcgggtccgccactctgcaagctgttcctgtcacagtatcatgcagtataaaccctccacaaaagtaaggagctcatatcagcagccagggcct

SEQ ID NO: 7227 - DNA, 140 bp, Artificial Sequence
  Synthetic
atacgccatgctgggtctccccgttagcggcaggtgacgaacaagatgaagacagaagacgggcgctggctgatgaagtaatcagatggcaacgaacagggctaatagatgagctggagacgtacttgggagtcggccat

SEQ ID NO: 7228 - DNA, 140 bp, Artificial Sequence
  Synthetic
atggccgactcccaagtacgtctccagctcatctattagccctgttcgttgccatctgattacttcatcagccagcgcccgtcttctgtcttcatcttgttcgtcacctgccgctaacggggagacccagcatggcgtat

SEQ ID NO: 7229 - DNA, 140 bp, Artificial Sequence
  Synthetic
aggccctggctgctgatatgtgccactacaggaagtaccaatggataggttcacagtagatatgaaaagggacgtgaaggtgactcctggtacaaagcatacagaggaaagacctaaggtgaccttttgggacagcggtg

SEQ ID NO: 7230 - DNA, 140 bp, Artificial Sequence
  Synthetic
caccgctgtcccaaaaggtcaccttaggtctttcctctgtatgctttgtaccaggagtcaccttcacgtcccttttcatatctactgtgaacctatccattggtacttcctgtagtggcacatatcagcagccagggcct

SEQ ID NO: 7231 - DNA, 140 bp, Artificial Sequence
  Synthetic
aggccctggctgctgatatgacccgtcataactttgtacggcggtcctaaataggtacgcactacagctacctattttgcagaagccgacagcaggtacctaagtaccaatcagccataagaccttttgggacagcggtg

SEQ ID NO: 7232 - DNA, 140 bp, Artificial Sequence
  Synthetic
caccgctgtcccaaaaggtcttatggctgattggtacttaggtacctgctgtcggcttctgcaaaataggtagctgtagtgcgtacctatttaggaccgccgtacaaagttatgacgggtcatatcagcagccagggcct

SEQ ID NO: 7233 - DNA, 140 bp, Artificial Sequence
  Synthetic
aggccctggctgctgatatgtgacaatgcgcgcggtacctcaacagaagccgcgcaagaatcggaagaataagaagcaaaagcaaaagcagcaggcgccacgaaacaatatgaatcaaaagaccttttgggacagcggtg

SEQ ID NO: 7234 - DNA, 140 bp, Artificial Sequence
  Synthetic
caccgctgtcccaaaaggtcttttgattcatattgtttcgtggcgcctgctgcttttgcttttgcttcttattcttccgattcttgcgcggcttctgttgaggtaccgcgcgcattgtcacatatcagcagccagggcct

SEQ ID NO: 7235 - DNA, 140 bp, Artificial Sequence
  Synthetic
aggccctggctgctgatatgaagaagcaaaagcaaaagcagcaggcgccacgaaacaatatgaatcaaaagaagcagccccctaaaaagaaaccggttcaaaagaaaaagaagccgggccgaccttttgggacagcggtg

SEQ ID NO: 7236 - DNA, 140 bp, Artificial Sequence
  Synthetic
caccgctgtcccaaaaggtcggcccggcttctttttcttttgaaccggtttctttttagggggctgcttcttttgattcatattgtttcgtggcgcctgctgcttttgcttttgcttcttcatatcagcagccagggcct

SEQ ID NO: 7237 - DNA, 140 bp, Artificial Sequence
  Synthetic
atacgccatgctgggtctccgaagcagccccctaaaaagaaaccggttcaaaagaaaaagaagccgggccgtagagagagaatgtgcatgaaaatcgaaaatgattgcatcttcgaagtccgtacttgggagtcggccat

SEQ ID NO: 7238 - DNA, 140 bp, Artificial Sequence
  Synthetic
atggccgactcccaagtacggacttcgaagatgcaatcattttcgattttcatgcacattctctctctacggcccggcttctttttcttttgaaccggtttctttttagggggctgcttcggagacccagcatggcgtat

SEQ ID NO: 7239 - DNA, 140 bp, Artificial Sequence
  Synthetic
aggccctggctgctgatatgaattggccttcaagcggtcatctaagtacgaccttgaatgcgcgcagatacccgtgcacatgaagtccgacgcttcgaagtttacccatgagaaaccggagaccttttgggacagcggtg

SEQ ID NO: 7240 - DNA, 140 bp, Artificial Sequence
  Synthetic
caccgctgtcccaaaaggtctccggtttctcatgggtaaacttcgaagcgtcggacttcatgtgcacgggtatctgcgcgcattcaaggtcgtacttagatgaccgcttgaaggccaattcatatcagcagccagggcct

SEQ ID NO: 7241 - DNA, 140 bp, Artificial Sequence
  Synthetic
aggccctggctgctgatatgggggtactacaactggcaccacggagcagtacagtactcaggaggccggttcaccatccctacaggtgcgggcaaaccaggggatagcggtagaccgatcgaccttttgggacagcggtg

SEQ ID NO: 7242 - DNA, 140 bp, Artificial Sequence
  Synthetic
caccgctgtcccaaaaggtcgatcggtctaccgctatcccctggtttgcccgcacctgtagggatggtgaaccggcctcctgagtactgtactgctccgtggtgccagttgtagtacccccatatcagcagccagggcct

SEQ ID NO: 7243 - DNA, 140 bp, Artificial Sequence
  Synthetic
aggccctggctgctgatatgaggagcccgtacagccctctcggtggtgacctggaacaaagacatcgtcacgaaaatcacccctgagggggccgaagaatggagtcttgccattccagttgaccttttgggacagcggtg

SEQ ID NO: 7244 - DNA, 140 bp, Artificial Sequence
  Synthetic
caccgctgtcccaaaaggtcaactggaatggcaagactccattcttcggccccctcaggggtgattttcgtgacgatgtctttgttccaggtcaccaccgagagggctgtacgggctcctcatatcagcagccagggcct

SEQ ID NO: 7245 - DNA, 140 bp, Artificial Sequence
  Synthetic
aggccctggctgctgatatgatgtgcctgctggcaaataccacgttcccctgctcccagcccccttgcacaccctgctgctacgaaaaagagccggagaaaaccctgcgcatgcttgaaggaccttttgggacagcggtg

SEQ ID NO: 7246 - DNA, 140 bp, Artificial Sequence
  Synthetic
caccgctgtcccaaaaggtccttcaagcatgcgcagggttttctccggctctttttcgtagcagcagggtgtgcaagggggctgggagcaggggaacgtggtatttgccagcaggcacatcatatcagcagccagggcct

SEQ ID NO: 7247 - DNA, 140 bp, Artificial Sequence
  Synthetic
aggccctggctgctgatatgcagacgcagagcgggccgggctatttgtaagaacgtcagcaccgtgcacgattactggaacaatgggacacttcattctggcccgatgtccgaaaggagagaccttttgggacagcggtg

SEQ ID NO: 7248 - DNA, 140 bp, Artificial Sequence
  Synthetic
caccgctgtcccaaaaggtctctcctttcggacatcgggccagaatgaagtgtcccattgttccagtaatcgtgcacggtgctgacgttcttacaaatagcccggcccgctctgcgtctgcatatcagcagccagggcct

SEQ ID NO: 7249 - DNA, 140 bp, Artificial Sequence
  Synthetic
aggccctggctgctgatatggtcttcaccggcgtctacccatttatgtggggcggcgcctactgcttctgcgacgctgaaaacacgcagttgagcgaagcacatgtggagaagtccgaatgaccttttgggacagcggtg

SEQ ID NO: 7250 - DNA, 140 bp, Artificial Sequence
  Synthetic
caccgctgtcccaaaaggtcattcggacttctccacatgtgcttcgctcaactgcgtgttttcagcgtcgcagaagcagtaggcgccgccccacataaatgggtagacgccggtgaagaccatatcagcagccagggcct

SEQ ID NO: 7251 - DNA, 140 bp, Artificial Sequence
  Synthetic
atacgccatgctgggtctcctcccgaccgcagcacggtagagaactaccttgcagcacgtacgcgcagagcaccgctgcaactgccgaggagatagaggtacatatgcccccagacaccccgtacttgggagtcggccat

SEQ ID NO: 7252 - DNA, 140 bp, Artificial Sequence
  Synthetic
atggccgactcccaagtacggggtgtctgggggcatatgtacctctatctcctcggcagttgcagcggtgctctgcgcgtacgtgctgcaaggtagttctctaccgtgctgcggtcgggaggagacccagcatggcgtat

SEQ ID NO: 7253 - DNA, 140 bp, Artificial Sequence
  Synthetic
aggccctggctgctgatatgatgccgcggtcaccaatcacaaaaaatggcagtataattcccctctggtcccgcgcaatgctgaactcggggaccgaaaaggaaaagttcacattccgttgaccttttgggacagcggtg

SEQ ID NO: 7254 - DNA, 140 bp, Artificial Sequence
  Synthetic
caccgctgtcccaaaaggtcaacggaatgtgaacttttccttttcggtccccgagttcagcattgcgcgggaccagaggggaattatactgccattttttgtgattggtgaccgcggcatcatatcagcagccagggcct

SEQ ID NO: 7255 - DNA, 140 bp, Artificial Sequence
  Synthetic
aggccctggctgctgatatgtgacgtacggaaaaaaccaagtcatcatgctgctgtatcctgaccacccaacgctcctgtcctaccggaatatgggagaagaaccaaactatcaagaagagaccttttgggacagcggtg

SEQ ID NO: 7256 - DNA, 140 bp, Artificial Sequence
  Synthetic
caccgctgtcccaaaaggtctcttcttgatagtttggttcttctcccatattccggtaggacaggagcgttgggtggtcaggatacagcagcatgatgacttggttttttccgtacgtcacatatcagcagccagggcct

SEQ ID NO: 7257 - DNA, 140 bp, Artificial Sequence
  Synthetic
aggccctggctgctgatatggtgggtgacgcataagaaggagatcaggttaaccgtgccgactgaagggctcgaggtcacgtggggcaacaatgagccgtacaagtattggccgcagttagaccttttgggacagcggtg

SEQ ID NO: 7258 - DNA, 140 bp, Artificial Sequence
  Synthetic
caccgctgtcccaaaaggtctaactgcggccaatacttgtacggctcattgttgccccacgtgacctcgagcccttcagtcggcacggttaacctgatctccttcttatgcgtcacccaccatatcagcagccagggcct

SEQ ID NO: 7259 - DNA, 140 bp, Artificial Sequence
  Synthetic
aggccctggctgctgatatgtcgaagttcacccatgagaaaccggaggggtactacaactggcaccacggagcagtacagtactcaggaggccggttcaccatccctacaggtgctggcagaccttttgggacagcggtg

SEQ ID NO: 7260 - DNA, 140 bp, Artificial Sequence
  Synthetic
caccgctgtcccaaaaggtctgccagcacctgtagggatggtgaaccggcctcctgagtactgtactgctccgtggtgccagttgtagtacccctccggtttctcatgggtgaacttcgacatatcagcagccagggcct

SEQ ID NO: 7261 - DNA, 140 bp, Artificial Sequence
  Synthetic
aggccctggctgctgatatgagcagtacagtactcaggaggccggttcaccatccctacaggtgctggcaaaccaggggacagcggcagaccgatcttcgacaacaagggacgcgtggtggaccttttgggacagcggtg

SEQ ID NO: 7262 - DNA, 140 bp, Artificial Sequence
  Synthetic
caccgctgtcccaaaaggtccaccacgcgtcccttgttgtcgaagatcggtctgccgctgtcccctggtttgccagcacctgtagggatggtgaaccggcctcctgagtactgtactgctcatatcagcagccagggcct

SEQ ID NO: 7263 - DNA, 140 bp, Artificial Sequence
  Synthetic
aggccctggctgctgatatgtccacaaacggtacagcccacggccacccgcatgagataattttgtattattatgagctgtaccctactatgactgtggtagtggtgtcagtggcctcgtgaccttttgggacagcggtg

SEQ ID NO: 7264 - DNA, 140 bp, Artificial Sequence
  Synthetic
caccgctgtcccaaaaggtcacgaggccactgacaccactaccacagtcatagtagggtacagctcataataatacaaaattatctcatgcgggtggccgtgggctgtaccgtttgtggacatatcagcagccagggcct

SEQ ID NO: 7265 - DNA, 140 bp, Artificial Sequence
  Synthetic
aggccctggctgctgatatgtcgtactcctgtcgatggtgggtgtggcagtggggatgtgcatgtgtgcacgacgcagatgtattacaccgtacgaactgacaccaggagctaccgtcccgaccttttgggacagcggtg

SEQ ID NO: 7266 - DNA, 140 bp, Artificial Sequence
  Synthetic
caccgctgtcccaaaaggtcgggacggtagctcctggtgtcagttcgtacggtgtaatacatctgcgtcgtgcacacatgcacatccccactgccacacccaccatcgacaggagtacgacatatcagcagccagggcct

SEQ ID NO: 7267 - DNA, 140 bp, Artificial Sequence
  Synthetic
aggccctggctgctgatatgctgcaagcccttattccgctggcagccctgattgtcctatgaaactgtctgagactcttaccatgctgttgtaaaacgttgacttttttagccgtactgagaccttttgggacagcggtg

SEQ ID NO: 7268 - DNA, 140 bp, Artificial Sequence
  Synthetic
caccgctgtcccaaaaggtctcagtacggctaaaaaagtcaacgttttacaacagcatggtaagagtctcagacagtttcataggacaatcagggctgccagcggaataagggcttgcagcatatcagcagccagggcct

SEQ ID NO: 7269 - DNA, 140 bp, Artificial Sequence
  Synthetic
aggccctggctgctgatatgctgcaagcccttattccgctggcagccctgattgtcctatgtaactgtctgagactcttaccatgctgttgtaaaacgttgacttttttagccgtactgagaccttttgggacagcggtg

SEQ ID NO: 7270 - DNA, 140 bp, Artificial Sequence
  Synthetic
caccgctgtcccaaaaggtctcagtacggctaaaaaagtcaacgttttacaacagcatggtaagagtctcagacagttacataggacaatcagggctgccagcggaataagggcttgcagcatatcagcagccagggcct

SEQ ID NO: 7271 - DNA, 140 bp, Artificial Sequence
  Synthetic
aggccctggctgctgatatgctgcaagcccttattccgctggcagccctgattgtcctatgcaactgtctgagactcttaccatgctgttgtaaaacgttgacttttttagccgtactgagaccttttgggacagcggtg

SEQ ID NO: 7272 - DNA, 140 bp, Artificial Sequence
  Synthetic
caccgctgtcccaaaaggtctcagtacggctaaaaaagtcaacgttttacaacagcatggtaagagtctcagacagttgcataggacaatcagggctgccagcggaataagggcttgcagcatatcagcagccagggcct

SEQ ID NO: 7273 - DNA, 140 bp, Artificial Sequence
  Synthetic
aggccctggctgctgatatgctgcaagcccttattccgctggcagccctgattgtcctatggaactgtctgagactcttaccatgctgttgtaaaacgttgacttttttagccgtactgagaccttttgggacagcggtg

SEQ ID NO: 7274 - DNA, 140 bp, Artificial Sequence
  Synthetic
caccgctgtcccaaaaggtctcagtacggctaaaaaagtcaacgttttacaacagcatggtaagagtctcagacagttccataggacaatcagggctgccagcggaataagggcttgcagcatatcagcagccagggcct

SEQ ID NO: 7275 - DNA, 140 bp, Artificial Sequence
  Synthetic
atacgccatgctgggtctcctaccgcatccgcatcagctaagctccgcgtcctttaccaaggaaataatgttactgtatctgcttatgcaaacggcgaccatgccgtcacagttaaggaccgtacttgggagtcggccat

SEQ ID NO: 7276 - DNA, 140 bp, Artificial Sequence
  Synthetic
atggccgactcccaagtacggtccttaactgtgacggcatggtcgccgtttgcataagcagatacagtaacattatttccttggtaaaggacgcggagcttagctgatgcggatgcggtaggagacccagcatggcgtat

SEQ ID NO: 7277 - DNA, 140 bp, Artificial Sequence
  Synthetic
aggccctggctgctgatatgtagaacgcatcagaaatgaagcgacagacgggacgctgaaaatccaggtctccttgcaaatcggaataaagacggatgacagccacgattggaccaagctgaccttttgggacagcggtg

SEQ ID NO: 7278 - DNA, 140 bp, Artificial Sequence
  Synthetic
caccgctgtcccaaaaggtcagcttggtccaatcgtggctgtcatccgtctttattccgatttgcaaggagacctggattttcagcgtcccgtctgtcgcttcatttctgatgcgttctacatatcagcagccagggcct

SEQ ID NO: 7279 - DNA, 140 bp, Artificial Sequence
  Synthetic
atacgccatgctgggtctccgctaaattcatagtggggccaatgtcttcagcctggacacctttcgacaataaaatcgtggtgtacaaaggcgacgtctacaacatggactacccgccctcgtacttgggagtcggccat

SEQ ID NO: 7280 - DNA, 140 bp, Artificial Sequence
  Synthetic
atggccgactcccaagtacgagggcgggtagtccatgttgtagacgtcgcctttgtacaccacgattttattgtcgaaaggtgtccaggctgaagacattggccccactatgaatttagcggagacccagcatggcgtat

SEQ ID NO: 7281 - DNA, 140 bp, Artificial Sequence
  Synthetic
aggccctggctgctgatatgcatgcctatctccatcgacataccggacgcggccttcactagggtcgtcgacgcgccatcattaacggacatgtcgtgtgaggtaccagcctgcacccatgaccttttgggacagcggtg

SEQ ID NO: 7282 - DNA, 140 bp, Artificial Sequence
  Synthetic
caccgctgtcccaaaaggtcatgggtgcaggctggtacctcacacgacatgtccgttaatgatggcgcgtcgacgaccctagtgaaggccgcgtccggtatgtcgatggagataggcatgcatatcagcagccagggcct

SEQ ID NO: 7283 - DNA, 140 bp, Artificial Sequence
  Synthetic
aggccctggctgctgatatgaaaaattataaaaacagaaaaatacataaataggtatacgtgtcccctaagagacacattgtatgtaggtgataagtatagatcaaagggccgaataaccgaccttttgggacagcggtg

SEQ ID NO: 7284 - DNA, 140 bp, Artificial Sequence
  Synthetic
caccgctgtcccaaaaggtcggttattcggccctttgatctatacttatcacctacatacaatgtgtctcttaggggacacgtatacctatttatgtatttttctgtttttataatttttcatatcagcagccagggcct

SEQ ID NO: 7285 - DNA, 140 bp, Artificial Sequence
  Synthetic
atacgccatgctgggtctcctcctcagactttgggggcgtagccatcattaaatatgcagccagcaagaaaggcaagtgtgcggtgcattcgatgactaacgccgtcactattcgggaagcgtacttgggagtcggccat

SEQ ID NO: 7286 - DNA, 140 bp, Artificial Sequence
  Synthetic
atggccgactcccaagtacgcttcccgaatagtgacggcgttagtcatcgaatgcaccgcacacttgcctttcttgctggctgcatatttaatgatggctacgcccccaaagtctgaggaggagacccagcatggcgtat

SEQ ID NO: 7287 - DNA, 140 bp, Artificial Sequence
  Synthetic
atacgccatgctgggtctccactgatcctaatcgtggtgctatgcgtgtcgtttagcaggcactaacttgacaactaggtatgaaggcatatgcgtccctaaagagacacaccacatatacgtacttgggagtcggccat

SEQ ID NO: 7288 - DNA, 140 bp, Artificial Sequence
  Synthetic
atggccgactcccaagtacgtatatgtggtgtgtctctttagggacgcatatgccttcatacctagttgtcaagttagtgcctgctaaacgacacgcatagcaccacgattaggatcagtggagacccagcatggcgtat

SEQ ID NO: 7289 - DNA, 140 bp, Artificial Sequence
  Synthetic
aggccctggctgctgatatgacaactaggtatgaaggcatatgcgtccctaaagagacacaccacatataactaagaatcaatagataagtatagatcaaagggctgaacaacccctgaagaccttttgggacagcggtg

SEQ ID NO: 7290 - DNA, 140 bp, Artificial Sequence
  Synthetic
caccgctgtcccaaaaggtcttcaggggttgttcagccctttgatctatacttatctattgattcttagttatatgtggtgtgtctctttagggacgcatatgccttcatacctagttgtcatatcagcagccagggcct

SEQ ID NO: 7291 - DNA, 140 bp, Artificial Sequence
  Synthetic
aggccctggctgctgatatgatcctggcccgatgtccaaaaggggaaactctgacggtgggattcactgacagtaggaagattagtcattcatgtacgcacccatttcaccacgaccctcgaccttttgggacagcggtg

SEQ ID NO: 7292 - DNA, 140 bp, Artificial Sequence
  Synthetic
caccgctgtcccaaaaggtcgagggtcgtggtgaaatgggtgcgtacatgaatgactaatcttcctactgtcagtgaatcccaccgtcagagtttccccttttggacatcgggccaggatcatatcagcagccagggcct

SEQ ID NO: 7293 - DNA, 140 bp, Artificial Sequence
  Synthetic
atacgccatgctgggtctcctagtaacaaaatataaaaatcaacaaaaatcataaaatagaaaaccagaaatagaagtaggtaagaaggtatatgtgtcccctaagagacacaccatatacgtacttgggagtcggccat

SEQ ID NO: 7294 - DNA, 140 bp, Artificial Sequence
  Synthetic
atggccgactcccaagtacgtatatggtgtgtctcttaggggacacatataccttcttacctacttctatttctggttttctattttatgatttttgttgatttttatattttgttactaggagacccagcatggcgtat

SEQ ID NO: 7295 - DNA, 140 bp, Artificial Sequence
  Synthetic
atacgccatgctgggtctccaaagcgagagattaataacccatcatggattctgtgtacgtggatatagacgctgacagcgcctttttgaaggccctgcaacgtgcgtaccccatgtttgcgtacttgggagtcggccat

SEQ ID NO: 7296 - DNA, 140 bp, Artificial Sequence
  Synthetic
atggccgactcccaagtacgcaaacatggggtacgcacgttgcagggccttcaaaaaggcgctgtcagcgtctatatccacgtacacagaatccatgatgggttattaatctctcgctttggagacccagcatggcgtat

SEQ ID NO: 7297 - DNA, 140 bp, Artificial Sequence
  Synthetic
aggccctggctgctgatatgaaacagaagtagttcaaagggctataaaacccctgaatagtaacaaaacataaaactaataaaaatcaaatgaataccataattggcaatcggaagagatgaccttttgggacagcggtg

SEQ ID NO: 7298 - DNA, 140 bp, Artificial Sequence
  Synthetic
caccgctgtcccaaaaggtcatctcttccgattgccaattatggtattcatttgatttttattagttttatgttttgttactattcaggggttttatagccctttgaactacttctgtttcatatcagcagccagggcct

SEQ ID NO: 7299 - DNA, 140 bp, Artificial Sequence
  Synthetic
aggccctggctgctgatatgttctcgcatctagccataaaactaatagagcaggaaattgatcccgactcaaccatcctggatataggtagtgcaccagcaaggaggatgatgtcggacagaccttttgggacagcggtg

SEQ ID NO: 7300 - DNA, 140 bp, Artificial Sequence
  Synthetic
caccgctgtcccaaaaggtctgtccgacatcatcctccttgctggtgcactacctatatccaggatggttgagtcgggatcaatttcctgctctattagttttatggctagatgcgagaacatatcagcagccagggcct

SEQ ID NO: 7301 - DNA, 140 bp, Artificial Sequence
  Synthetic
aggccctggctgctgatatgtcatgctactgtatcctgaccacccaacactcctgtcctaccggaatatgggagaagaaccaaactatcaagaagagtgggtgatgcataagaaggaagtgaccttttgggacagcggtg

SEQ ID NO: 7302 - DNA, 140 bp, Artificial Sequence
  Synthetic
caccgctgtcccaaaaggtcacttccttcttatgcatcacccactcttcttgatagtttggttcttctcccatattccggtaggacaggagtgttgggtggtcaggatacagtagcatgacatatcagcagccagggcct

SEQ ID NO: 7303 - DNA, 140 bp, Artificial Sequence
  Synthetic
atacgccatgctgggtctccagatgttcaaagtgactataaaaccctgaacagtaataaaacataaaattaataaggagtaccataattggcaaacggaagagacgtaggtacttaagctcgtacttgggagtcggccat

SEQ ID NO: 7304 - DNA, 140 bp, Artificial Sequence
  Synthetic
atggccgactcccaagtacgagcttaagtacctacgtctcttccgtttgccaattatggtactccttattaattttatgttttattactgttcagggttttatagtcactttgaacatctggagacccagcatggcgtat

SEQ ID NO: 7305 - DNA, 140 bp, Artificial Sequence
  Synthetic
aggccctggctgctgatatgagccgtataagtattggccgcagttatctacaaacggtacagcccatggccacccgcatgaaataattctgtattattatgagctgtaccctactatgacgaccttttgggacagcggtg

SEQ ID NO: 7306 - DNA, 140 bp, Artificial Sequence
  Synthetic
caccgctgtcccaaaaggtcgtcatagtagggtacagctcataataatacagaattatttcatgcgggtggccatgggctgtaccgtttgtagataactgcggccaatacttatacggctcatatcagcagccagggcct

SEQ ID NO: 7307 - DNA, 140 bp, Artificial Sequence
  Synthetic
aggccctggctgctgatatgcagagagcagacgtcgcgatataccaagacgtctatgctgtacatgcacccacgtcgctatatcaccaggcgattaaaggagtccgagtggcgtactggggaccttttgggacagcggtg

SEQ ID NO: 7308 - DNA, 140 bp, Artificial Sequence
  Synthetic
caccgctgtcccaaaaggtccccagtacgccactcggactcctttaatcgcctggtgatatagcgacgtgggtgcatgtacagcatagacgtcttggtatatcgcgacgtctgctctctgcatatcagcagccagggcct

SEQ ID NO: 7309 - DNA, 140 bp, Artificial Sequence
  Synthetic
aggccctggctgctgatatgctctgcaaagcaagagattaataacccatcatggatcctgtgtacgtggacatagacgctgacagcgcctttttgaaggccctgcaacgtgcgtaccccagaccttttgggacagcggtg

SEQ ID NO: 7310 - DNA, 140 bp, Artificial Sequence
  Synthetic
caccgctgtcccaaaaggtctggggtacgcacgttgcagggccttcaaaaaggcgctgtcagcgtctatgtccacgtacacaggatccatgatgggttattaatctcttgctttgcagagcatatcagcagccagggcct

SEQ ID NO: 7311 - DNA, 140 bp, Artificial Sequence
  Synthetic
aggccctggctgctgatatgccctcatactcgacaaattgggcggatgagcaggtactgaaggctaagaacataggattatgttcaacagacctgacagaaggtagacgaggcaaattgtgaccttttgggacagcggtg

SEQ ID NO: 7312 - DNA, 140 bp, Artificial Sequence
  Synthetic
caccgctgtcccaaaaggtcacaatttgcctcgtctaccttctgtcaggtctgttgaacataatcctatgttcttagccttcagtacctgctcatccgcccaatttgtcgagtatgagggcatatcagcagccagggcct

SEQ ID NO: 7313 - DNA, 140 bp, Artificial Sequence
  Synthetic
aggccctggctgctgatatgagttgtctattatgagagggaaaaagctaaaaccgtgcgaccgtgtgctgttctcagtagggtcaacgctctacccggaaagccgcaagctacttaagaggaccttttgggacagcggtg

SEQ ID NO: 7314 - DNA, 140 bp, Artificial Sequence
  Synthetic
caccgctgtcccaaaaggtcctcttaagtagcttgcggctttccgggtagagcgttgaccctactgagaacagcacacggtcgcacggttttagctttttccctctcataatagacaactcatatcagcagccagggcct

SEQ ID NO: 7315 - DNA, 140 bp, Artificial Sequence
  Synthetic
aggccctggctgctgatatggctgttggtggggctgaaccagagaatagtggttaacggcagaacgcaacggaatatgaacaccatgaaaaattatctgcttcccgtggtcgcccaagccgaccttttgggacagcggtg

SEQ ID NO: 7316 - DNA, 140 bp, Artificial Sequence
  Synthetic
caccgctgtcccaaaaggtcggcttgggcgaccacgggaagcagataatttttcatggtgttcatattccgttgcgttctgccgttaaccactattctctggttcagccccaccaacagccatatcagcagccagggcct

SEQ ID NO: 7317 - DNA, 140 bp, Artificial Sequence
  Synthetic
atacgccatgctgggtctccctatgcaatttcgcccgaagacttccagagtctaagcgaaagcgcaacgatggtgtacaacgaaagagagttcgtaaacagaaagttacaccacattgcgcgtacttgggagtcggccat

SEQ ID NO: 7318 - DNA, 140 bp, Artificial Sequence
  Synthetic
atggccgactcccaagtacgcgcaatgtggtgtaactttctgtttacgaactctctttcgttgtacaccatcgttgcgctttcgcttagactctggaagtcttcgggcgaaattgcatagggagacccagcatggcgtat

SEQ ID NO: 7319 - DNA, 140 bp, Artificial Sequence
  Synthetic
aggccctggctgctgatatgctcagctgcaaatctctttctcgacggccttagccagcgccgaattccgcgtacaagtctgttctacacaagtacactgtgcagctgagtgccaccccccgaccttttgggacagcggtg

SEQ ID NO: 7320 - DNA, 140 bp, Artificial Sequence
  Synthetic
caccgctgtcccaaaaggtcggggggtggcactcagctgcacagtgtacttgtgtagaacagacttgtacgcggaattcggcgctggctaaggccgtcgagaaagagatttgcagctgagcatatcagcagccagggcct

SEQ ID NO: 7321 - DNA, 140 bp, Artificial Sequence
  Synthetic
aggccctggctgctgatatgagttgtactttgtggtgacccgaagcagtgcggcttcttcaatatgatgcagatgaaagtcaactacaatcataacatctgcactcaagtgtaccacaaagaccttttgggacagcggtg

SEQ ID NO: 7322 - DNA, 140 bp, Artificial Sequence
  Synthetic
caccgctgtcccaaaaggtctttgtggtacacttgagtgcagatgttatgattgtagttgactttcatctgcatcatattgaagaagccgcactgcttcgggtcaccacaaagtacaactcatatcagcagccagggcct

SEQ ID NO: 7323 - DNA, 140 bp, Artificial Sequence
  Synthetic
atacgccatgctgggtctccagactcgctaattatgcgagaaagctagcatctgtcgcaggaaaagtcctggacagaaacatctctggaaagatcggggacttacaagcagtgatggccgcgtacttgggagtcggccat

SEQ ID NO: 7324 - DNA, 140 bp, Artificial Sequence
  Synthetic
atggccgactcccaagtacgcggccatcactgcttgtaagtccccgatctttccagagatgtttctgtccaggacttttcctgcgacagatgctagctttctcgcataattagcgagtctggagacccagcatggcgtat

SEQ ID NO: 7325 - DNA, 140 bp, Artificial Sequence
  Synthetic
atacgccatgctgggtctccacgtgcttcagagggtgggttaaacaactgcaaattgactatcgtggacacgaggtcatgacagcagctgcatcccaagggttaaccagaaaaggagtttcgtacttgggagtcggccat

SEQ ID NO: 7326 - DNA, 140 bp, Artificial Sequence
  Synthetic
atggccgactcccaagtacgaaactccttttctggttaacccttgggatgcagctgctgtcatgacctcgtgtccacgatagtcaatttgcagttgtttaacccaccctctgaagcacgtggagacccagcatggcgtat

SEQ ID NO: 7327 - DNA, 140 bp, Artificial Sequence
  Synthetic
atacgccatgctgggtctcctcaataatggcgggcatctgcagtcaccaaatgaccttcgatacattccaaaataaagccaacgtttgttgggctaagagcttggtccctatcctcgaaacgtacttgggagtcggccat

SEQ ID NO: 7328 - DNA, 140 bp, Artificial Sequence
  Synthetic
atggccgactcccaagtacgtttcgaggatagggaccaagctcttagcccaacaaacgttggctttattttggaatgtatcgaaggtcatttggtgactgcagatgcccgccattattgaggagacccagcatggcgtat

SEQ ID NO: 7329 - DNA, 140 bp, Artificial Sequence
  Synthetic
aggccctggctgctgatatgaacacttggtaggtatgacctagtggtcataaacatccacacaccttttcgcatacaccattaccaacagtgcgtagatcacgcaatgaaactgcaaatggaccttttgggacagcggtg

SEQ ID NO: 7330 - DNA, 140 bp, Artificial Sequence
  Synthetic
caccgctgtcccaaaaggtccatttgcagtttcattgcgtgatctacgcactgttggtaatggtgtatgcgaaaaggtgtgtggatgtttatgaccactaggtcatacctaccaagtgttcatatcagcagccagggcct

SEQ ID NO: 7331 - DNA, 140 bp, Artificial Sequence
  Synthetic
aggccctggctgctgatatggtccacgtgctcagacacggacgacgagttatgactagacagggcaggtgggtatatattctcgtcggacaccggtccaggtcatttacaacagaagtcagaccttttgggacagcggtg

SEQ ID NO: 7332 - DNA, 140 bp, Artificial Sequence
  Synthetic
caccgctgtcccaaaaggtctgacttctgttgtaaatgacctggaccggtgtccgacgagaatatatacccacctgccctgtctagtcataactcgtcgtccgtgtctgagcacgtggaccatatcagcagccagggcct

SEQ ID NO: 7333 - DNA, 140 bp, Artificial Sequence
  Synthetic
atacgccatgctgggtctccgcatacaccattaccaacagtgcgtagatcacgcaatgaaactgcaaatgctaggaggtgactcactgagactgctcaaaccgggtggctctctattgatcgtacttgggagtcggccat

SEQ ID NO: 7334 - DNA, 140 bp, Artificial Sequence
  Synthetic
atggccgactcccaagtacgatcaatagagagccacccggtttgagcagtctcagtgagtcacctcctagcatttgcagtttcattgcgtgatctacgcactgttggtaatggtgtatgcggagacccagcatggcgtat

SEQ ID NO: 7335 - DNA, 140 bp, Artificial Sequence
  Synthetic
aggccctggctgctgatatgacctgagagtaaagacatctatgctaatacacaactggtactgcagagaccggctgcgggtacggtacacgtgccatactctcaggcaccatctggctttgaccttttgggacagcggtg

SEQ ID NO: 7336 - DNA, 140 bp, Artificial Sequence
  Synthetic
caccgctgtcccaaaaggtcaaagccagatggtgcctgagagtatggcacgtgtaccgtacccgcagccggtctctgcagtaccagttgtgtattagcatagatgtctttactctcaggtcatatcagcagccagggcct

SEQ ID NO: 7337 - DNA, 140 bp, Artificial Sequence
  Synthetic
aggccctggctgctgatatgagtcctttaaaaatagtgcaacaccagtaggaaccgcaaaaacagttatgtgcggtacatatccagtaatccatgccgtaggaccaaacttctcaaattagaccttttgggacagcggtg

SEQ ID NO: 7338 - DNA, 140 bp, Artificial Sequence
  Synthetic
caccgctgtcccaaaaggtctaatttgagaagtttggtcctacggcatggattactggatatgtaccgcacataactgtttttgcggttcctactggtgttgcactatttttaaaggactcatatcagcagccagggcct

SEQ ID NO: 7339 - DNA, 140 bp, Artificial Sequence
  Synthetic
aggccctggctgctgatatgaagtcgcaaaggaagtaactaggctgggagtaaatagtgtagctatacctctcctctccacaggtgtatactcaggagggaaagacaggctgacccagtcgaccttttgggacagcggtg

SEQ ID NO: 7340 - DNA, 140 bp, Artificial Sequence
  Synthetic
caccgctgtcccaaaaggtcgactgggtcagcctgtctttccctcctgagtatacacctgtggagaggagaggtatagctacactatttactcccagcctagttacttcctttgcgacttcatatcagcagccagggcct

SEQ ID NO: 7341 - DNA, 140 bp, Artificial Sequence
  Synthetic
atacgccatgctgggtctccggcagaaatgcccggtggatgatgcagatgcatcatctcccccgaaaaccgtcccgtgcctttgccgttatgccatgactcctgaacgcgtcacccgactcgtacttgggagtcggccat

SEQ ID NO: 7342 - DNA, 140 bp, Artificial Sequence
  Synthetic
atggccgactcccaagtacgagtcgggtgacgcgttcaggagtcatggcataacggcaaaggcacgggacggttttcgggggagatgatgcatctgcatcatccaccgggcatttctgccggagacccagcatggcgtat

SEQ ID NO: 7343 - DNA, 140 bp, Artificial Sequence
  Synthetic
aggccctggctgctgatatggtcccgtgcctttgccgttatgccatgactcctgaacgcgtcacccgacttcgcatgaaccatgtcacaaatataattgtgtgttcttcatttccccttcgaccttttgggacagcggtg

SEQ ID NO: 7344 - DNA, 140 bp, Artificial Sequence
  Synthetic
caccgctgtcccaaaaggtcgaaggggaaatgaagaacacacaattatatttgtgacatggttcatgcgaagtcgggtgacgcgttcaggagtcatggcataacggcaaaggcacgggaccatatcagcagccagggcct

SEQ ID NO: 7345 - DNA, 140 bp, Artificial Sequence
  Synthetic
aggccctggctgctgatatgtctactgccgcgacaaagaatgggagaagaaaatatctgaggccatacagatgcggacccaagtagagctgctggatgagcacatctccatagactgcgagaccttttgggacagcggtg

SEQ ID NO: 7346 - DNA, 140 bp, Artificial Sequence
  Synthetic
caccgctgtcccaaaaggtctcgcagtctatggagatgtgctcatccagcagctctacttgggtccgcatctgtatggcctcagatattttcttctcccattctttgtcgcggcagtagacatatcagcagccagggcct

SEQ ID NO: 7347 - DNA, 140 bp, Artificial Sequence
  Synthetic
atacgccatgctgggtctcccacagatgagggaattacccactttggactcagcaatattcaacgtggagtgtttcaaaaaattcgcatgcaaccaagagtactgggaagaatttgctgccgtacttgggagtcggccat

SEQ ID NO: 7348 - DNA, 140 bp, Artificial Sequence
  Synthetic
atggccgactcccaagtacggcagcaaattcttcccagtactcttggttgcatgcgaattttttgaaacactccacgttgaatattgctgagtccaaagtgggtaattccctcatctgtgggagacccagcatggcgtat

SEQ ID NO: 7349 - DNA, 140 bp, Artificial Sequence
  Synthetic
atacgccatgctgggtctcccacagatgagggaattacccactttggactcagcattattcaacgtggagtgtttcaaaaaattcgcatgcaaccaagagtactgggaagaatttgctgccgtacttgggagtcggccat

SEQ ID NO: 7350 - DNA, 140 bp, Artificial Sequence
  Synthetic
atggccgactcccaagtacggcagcaaattcttcccagtactcttggttgcatgcgaattttttgaaacactccacgttgaataatgctgagtccaaagtgggtaattccctcatctgtgggagacccagcatggcgtat

SEQ ID NO: 7351 - DNA, 140 bp, Artificial Sequence
  Synthetic
atacgccatgctgggtctcccacagatgagggaattacccactttggactcagcactattcaacgtggagtgtttcaaaaaattcgcatgcaaccaagagtactgggaagaatttgctgccgtacttgggagtcggccat

SEQ ID NO: 7352 - DNA, 140 bp, Artificial Sequence
  Synthetic
atggccgactcccaagtacggcagcaaattcttcccagtactcttggttgcatgcgaattttttgaaacactccacgttgaatagtgctgagtccaaagtgggtaattccctcatctgtgggagacccagcatggcgtat

SEQ ID NO: 7353 - DNA, 140 bp, Artificial Sequence
  Synthetic
atacgccatgctgggtctcccacagatgagggaattacccactttggactcagcagtattcaacgtggagtgtttcaaaaaattcgcatgcaaccaagagtactgggaagaatttgctgccgtacttgggagtcggccat

SEQ ID NO: 7354 - DNA, 140 bp, Artificial Sequence
  Synthetic
atggccgactcccaagtacggcagcaaattcttcccagtactcttggttgcatgcgaattttttgaaacactccacgttgaatactgctgagtccaaagtgggtaattccctcatctgtgggagacccagcatggcgtat

SEQ ID NO: 7355 - DNA, 140 bp, Artificial Sequence
  Synthetic
aggccctggctgctgatatgttatttgatcacaatgtgccatcgcgcgtaagtccaagggaatacagatcttcccaggagtctgtacgggaagtgagtatgacaacgtcattgacgcatagaccttttgggacagcggtg

SEQ ID NO: 7356 - DNA, 140 bp, Artificial Sequence
  Synthetic
caccgctgtcccaaaaggtctatgcgtcaatgacgttgtcatactcacttcccgtacagactcctgggaagatctgtattcccttggacttacgcgcgatggcacattgtgatcaaataacatatcagcagccagggcct

SEQ ID NO: 7357 - DNA, 140 bp, Artificial Sequence
  Synthetic
aggccctggctgctgatatggcaccacggaaggcgcactgtactcatatctagaagggacccgttttcatcagacggctgtggatatggcggagatacatactatgtggccaaagcaaacgaccttttgggacagcggtg

SEQ ID NO: 7358 - DNA, 140 bp, Artificial Sequence
  Synthetic
caccgctgtcccaaaaggtcgtttgctttggccacatagtatgtatctccgccatatccacagccgtctgatgaaaacgggtcccttctagatatgagtacagtgcgccttccgtggtgccatatcagcagccagggcct

SEQ ID NO: 7359 - DNA, 140 bp, Artificial Sequence
  Synthetic
atacgccatgctgggtctcccagacggctgtggatatggcggagatacatactatgtggccaaagcaaacagaggccaatgagcaagtctgcctatatgccctgggggaaagtattgaatcgtacttgggagtcggccat

SEQ ID NO: 7360 - DNA, 140 bp, Artificial Sequence
  Synthetic
atggccgactcccaagtacgattcaatactttcccccagggcatataggcagacttgctcattggcctctgtttgctttggccacatagtatgtatctccgccatatccacagccgtctgggagacccagcatggcgtat

SEQ ID NO: 7361 - DNA, 140 bp, Artificial Sequence
  Synthetic
aggccctggctgctgatatgagaggccaatgagcaagtctgcctatatgccctgggggaaagtattgaatcgatcaggcagaaatgcccggtggatgatgcagacgcatcatctccccccgaccttttgggacagcggtg

SEQ ID NO: 7362 - DNA, 140 bp, Artificial Sequence
  Synthetic
caccgctgtcccaaaaggtcggggggagatgatgcgtctgcatcatccaccgggcatttctgcctgatcgattcaatactttcccccagggcatataggcagacttgctcattggcctctcatatcagcagccagggcct

SEQ ID NO: 7363 - DNA, 140 bp, Artificial Sequence
  Synthetic
atacgccatgctgggtctcccgatcaggcagaaatgcccggtggatgatgcagacgcatcatctccccccaaaactgtcccgtgcctttgccgttacgctatgactccagaacgcgtcaccgtacttgggagtcggccat

SEQ ID NO: 7364 - DNA, 140 bp, Artificial Sequence
  Synthetic
atggccgactcccaagtacggtgacgcgttctggagtcatagcgtaacggcaaaggcacgggacagttttggggggagatgatgcgtctgcatcatccaccgggcatttctgcctgatcgggagacccagcatggcgtat

SEQ ID NO: 7365 - DNA, 140 bp, Artificial Sequence
  Synthetic
aggccctggctgctgatatgctggatgctgacgccccagccctagaaccggccctagacgacggggcgatacatacgaccggaaaccttgcggccgtgtctgactgggtaatgagcaccggaccttttgggacagcggtg

SEQ ID NO: 7366 - DNA, 140 bp, Artificial Sequence
  Synthetic
caccgctgtcccaaaaggtccggtgctcattacccagtcagacacggccgcaaggtttccggtcgtatgtatcgccccgtcgtctagggccggttctagggctggggcgtcagcatccagcatatcagcagccagggcct

SEQ ID NO: 7367 - DNA, 140 bp, Artificial Sequence
  Synthetic
aggccctggctgctgatatgtaaaagggccaaaagcagcagcgctattcgcaaaaacccataatctactgccactacaggaagtaccaatggataggttcacagtagatatgaaaagggagaccttttgggacagcggtg

SEQ ID NO: 7368 - DNA, 140 bp, Artificial Sequence
  Synthetic
caccgctgtcccaaaaggtctcccttttcatatctactgtgaacctatccattggtacttcctgtagtggcagtagattatgggtttttgcgaatagcgctgctgcttttggcccttttacatatcagcagccagggcct

SEQ ID NO: 7369 - DNA, 140 bp, Artificial Sequence
  Synthetic
aggccctggctgctgatatgaagtgttacccacctaagctggatgaattaaaggagcaactactacttaagaaactccaggagagtgcgtccacggccaatagaagcaggtatcaatcacgaccttttgggacagcggtg

SEQ ID NO: 7370 - DNA, 140 bp, Artificial Sequence
  Synthetic
caccgctgtcccaaaaggtcgtgattgatacctgcttctattggccgtggacgcactctcctggagtttcttaagtagtagttgctcctttaattcatccagcttaggtgggtaacacttcatatcagcagccagggcct

SEQ ID NO: 7371 - DNA, 140 bp, Artificial Sequence
  Synthetic
aggccctggctgctgatatgggacagaaacatctctggaaagatcggggacttacgagcagtaatggccgtgccagacaaggagacgccaacattctgcttacacacagacgtctcatgcgaccttttgggacagcggtg

SEQ ID NO: 7372 - DNA, 140 bp, Artificial Sequence
  Synthetic
caccgctgtcccaaaaggtcgcatgagacgtctgtgtgtaagcagaatgttggcgtctccttgtctggcacggccattactgctcgtaagtccccgatctttccagagatgtttctgtcccatatcagcagccagggcct

SEQ ID NO: 7373 - DNA, 140 bp, Artificial Sequence
  Synthetic
atacgccatgctgggtctccgcaaagtggaaaatatgaaagcaacaatcatccagagactaaagagaggctgtaaactgtatttaatggcagagaccccgaaagtcccgacttatcggaccgtacttgggagtcggccat

SEQ ID NO: 7374 - DNA, 140 bp, Artificial Sequence
  Synthetic
atggccgactcccaagtacggtccgataagtcgggactttcggggtctctgccattaaatacagtttacagcctctctttagtctctggatgattgttgctttcatattttccactttgcggagacccagcatggcgtat

SEQ ID NO: 7375 - DNA, 140 bp, Artificial Sequence
  Synthetic
aggccctggctgctgatatgtgtaaactgtatttaatggcagagaccccgaaagtcccgacttatcggaccgtatacccggcgcctgtgtactcgcctccgatcaacgtccgattgtccagaccttttgggacagcggtg

SEQ ID NO: 7376 - DNA, 140 bp, Artificial Sequence
  Synthetic
caccgctgtcccaaaaggtctggacaatcggacgttgatcggaggcgagtacacaggcgccgggtatacggtccgataagtcgggactttcggggtctctgccattaaatacagtttacacatatcagcagccagggcct

SEQ ID NO: 7377 - DNA, 140 bp, Artificial Sequence
  Synthetic
aggccctggctgctgatatgcctatatgccctgggggaaagtattgaatcaatcaggcagaaatgcccggtggatgatgcagacgcatcatctcccccgaaaaccgtcccgtgtctttgcgaccttttgggacagcggtg

SEQ ID NO: 7378 - DNA, 140 bp, Artificial Sequence
  Synthetic
caccgctgtcccaaaaggtcgcaaagacacgggacggttttcgggggagatgatgcgtctgcatcatccaccgggcatttctgcctgattgattcaatactttcccccagggcatataggcatatcagcagccagggcct

SEQ ID NO: 7379 - DNA, 140 bp, Artificial Sequence
  Synthetic
aggccctggctgctgatatgtgcagatgaaagtcaactataatcacaacatctgcacccaagtgtaccacaaaagcatctccaggcggtgtacactgcctgtgaccgccattgtgtcatcgaccttttgggacagcggtg

SEQ ID NO: 7380 - DNA, 140 bp, Artificial Sequence
  Synthetic
caccgctgtcccaaaaggtcgatgacacaatggcggtcacaggcagtgtacaccgcctggagatgcttttgtggtacacttgggtgcagatgttgtgattatagttgactttcatctgcacatatcagcagccagggcct

SEQ ID NO: 7381 - DNA, 140 bp, Artificial Sequence
  Synthetic
aggccctggctgctgatatgcagagactaaagagaggctgtagactatacttaatgtcagagaccccaaaagtccctacttaccggactacatatccggcgcctgtgtactcgcctccgagaccttttgggacagcggtg

SEQ ID NO: 7382 - DNA, 140 bp, Artificial Sequence
  Synthetic
caccgctgtcccaaaaggtctcggaggcgagtacacaggcgccggatatgtagtccggtaagtagggacttttggggtctctgacattaagtatagtctacagcctctctttagtctctgcatatcagcagccagggcct

SEQ ID NO: 7383 - DNA, 140 bp, Artificial Sequence
  Synthetic
aggccctggctgctgatatgaaccgagaatactgggaagaatttgctgccagccctatcaggataacgactgagaatctaacaacctatgtcactaaattaaaggggccaaaagcagcaggaccttttgggacagcggtg

SEQ ID NO: 7384 - DNA, 140 bp, Artificial Sequence
  Synthetic
caccgctgtcccaaaaggtcctgctgcttttggcccctttaatttagtgacataggttgttagattctcagtcgttatcctgatagggctggcagcaaattcttcccagtattctcggttcatatcagcagccagggcct

SEQ ID NO: 7385 - DNA, 140 bp, Artificial Sequence
  Synthetic
atacgccatgctgggtctccatgttcggatttaaccccgaggcagcatccattctagaaagaaagtatccattcacaaaaaggaagtggaacatcaacaagcagatctgcgtgactaccacgtacttgggagtcggccat

SEQ ID NO: 7386 - DNA, 140 bp, Artificial Sequence
  Synthetic
atggccgactcccaagtacgtggtagtcacgcagatctgcttgttgatgttccacttcctttttgtgaatggatactttctttctagaatggatgctgcctcggggttaaatccgaacatggagacccagcatggcgtat

SEQ ID NO: 7387 - DNA, 140 bp, Artificial Sequence
  Synthetic
aggccctggctgctgatatgtaccacgcgccctccatcagaagcgctgtaccgtccccattccagaacacactacagaatgtactggcagcagccacgaaaagaaactgcaacgtcacacgaccttttgggacagcggtg

SEQ ID NO: 7388 - DNA, 140 bp, Artificial Sequence
  Synthetic
caccgctgtcccaaaaggtcgtgtgacgttgcagtttcttttcgtggctgctgccagtacattctgtagtgtgttctggaatggggacggtacagcgcttctgatggagggcgcgtggtacatatcagcagccagggcct

SEQ ID NO: 7389 - DNA, 140 bp, Artificial Sequence
  Synthetic
aggccctggctgctgatatgcggccttcatcggcgacgacaacataatacatggagtcgtctccgatgaattgatggcagccagatgtgccacttggatgaacatggaagtgaagatcatgaccttttgggacagcggtg

SEQ ID NO: 7390 - DNA, 140 bp, Artificial Sequence
  Synthetic
caccgctgtcccaaaaggtcatgatcttcacttccatgttcatccaagtggcacatctggctgccatcaattcatcggagacgactccatgtattatgttgtcgtcgccgatgaaggccgcatatcagcagccagggcct

SEQ ID NO: 7391 - DNA, 140 bp, Artificial Sequence
  Synthetic
aggccctggctgctgatatgcgaccttggactccgcgccctactatccaagtcatcagacccagaccacgtccgcaaaggaaggccgggcaacttgcccagctgatctcagcagttaatagaccttttgggacagcggtg

SEQ ID NO: 7392 - DNA, 140 bp, Artificial Sequence
  Synthetic
caccgctgtcccaaaaggtctattaactgctgagatcagctgggcaagttgcccggccttcctttgcggacgtggtctgggtctgatgacttggatagtagggcgcggagtccaaggtcgcatatcagcagccagggcct

SEQ ID NO: 7393 - DNA, 140 bp, Artificial Sequence
  Synthetic
aggccctggctgctgatatgcttaagcttcctaaaagcagccgaactcactttgagaagtaggcatagcataccgaactcttccatgattctccgaacccacagggacgtggagatgttagaccttttgggacagcggtg

SEQ ID NO: 7394 - DNA, 140 bp, Artificial Sequence
  Synthetic
caccgctgtcccaaaaggtctaacatctccacgtccctgtgggttcggagaatcatggaagagttcggtatgctatgcctacttctcaaagtgagttcggctgcttttaggaagcttaagcatatcagcagccagggcct

SEQ ID NO: 7395 - DNA, 140 bp, Artificial Sequence
  Synthetic
atacgccatgctgggtctccaataagaagcaaaagcaaaagcagcaggcgccacgaaacaatacgaatcaaaagaagcagccccctaaaaagaaaccggttcaaaagaaaaagaagccggcgtacttgggagtcggccat

SEQ ID NO: 7396 - DNA, 140 bp, Artificial Sequence
  Synthetic
atggccgactcccaagtacgccggcttctttttcttttgaaccggtttctttttagggggctgcttcttttgattcgtattgtttcgtggcgcctgctgcttttgcttttgcttcttattggagacccagcatggcgtat

SEQ ID NO: 7397 - DNA, 140 bp, Artificial Sequence
  Synthetic
aggccctggctgctgatatgaataggtacgcactacagctacctattttgcagaagccgacagcaagtatctaaacactaatcagctacaatggagttcatcccaacccaaactttttacgaccttttgggacagcggtg

SEQ ID NO: 7398 - DNA, 140 bp, Artificial Sequence
  Synthetic
caccgctgtcccaaaaggtcgtaaaaagtttgggttgggatgaactccattgtagctgattagtgtttagatacttgctgtcggcttctgcaaaataggtagctgtagtgcgtacctattcatatcagcagccagggcct

SEQ ID NO: 7399 - DNA, 140 bp, Artificial Sequence
  Synthetic
aggccctggctgctgatatgaattgggcggatgagcaggtactgaaggctaagaacataggattatgttcaacagacctgacggaaggtagactaggcaaattgtctatcatgagagggagaccttttgggacagcggtg

SEQ ID NO: 7400 - DNA, 140 bp, Artificial Sequence
  Synthetic
caccgctgtcccaaaaggtctccctctcatgatagacaatttgcctagtctaccttccgtcaggtctgttgaacataatcctatgttcttagccttcagtacctgctcatccgcccaattcatatcagcagccagggcct

SEQ ID NO: 7401 - DNA, 140 bp, Artificial Sequence
  Synthetic
aggccctggctgctgatatgctaaacactaatcagctacaatggagttcatcccaacccaaactttttacaataggaggtaccagcctcgaccctggactccgcgttctactatccaaatgaccttttgggacagcggtg

SEQ ID NO: 7402 - DNA, 140 bp, Artificial Sequence
  Synthetic
caccgctgtcccaaaaggtcatttggatagtagaacgcggagtccagggtcgaggctggtacctcctattgtaaaaagtttgggttgggatgaactccattgtagctgattagtgtttagcatatcagcagccagggcct

SEQ ID NO: 7403 - DNA, 140 bp, Artificial Sequence
  Synthetic
aggccctggctgctgatatgcatcaggcccagaccgcgccctcagaggcaagctgggcaacttgcccagctgatctcagcagttaataaactgacaatgcgcgcggtaccccaacagaaggaccttttgggacagcggtg

SEQ ID NO: 7404 - DNA, 140 bp, Artificial Sequence
  Synthetic
caccgctgtcccaaaaggtccttctgttggggtaccgcgcgcattgtcagtttattaactgctgagatcagctgggcaagttgcccagcttgcctctgagggcgcggtctgggcctgatgcatatcagcagccagggcct

SEQ ID NO: 7405 - DNA, 140 bp, Artificial Sequence
  Synthetic
aggccctggctgctgatatggagaatagtggttaacggcagaacgcaacggaacacgaacaccatgaagaactacctgcttcctgtggtcgcccaggccttcagtaagtgggcaaaggaggaccttttgggacagcggtg

SEQ ID NO: 7406 - DNA, 140 bp, Artificial Sequence
  Synthetic
caccgctgtcccaaaaggtcctcctttgcccacttactgaaggcctgggcgaccacaggaagcaggtagttcttcatggtgttcgtgttccgttgcgttctgccgttaaccactattctccatatcagcagccagggcct

SEQ ID NO: 7407 - DNA, 140 bp, Artificial Sequence
  Synthetic
atacgccatgctgggtctccggcagcacaggaagatgtccaggtcgaaatcgacgtggaacagcttgaggatagagctggtgcaggaataatagagactccgagaggcgctatcaaagttcgtacttgggagtcggccat

SEQ ID NO: 7408 - DNA, 140 bp, Artificial Sequence
  Synthetic
atggccgactcccaagtacgaactttgatagcgcctctcggagtctctattattcctgcaccagctctatcctcaagctgttccacgtcgatttcgacctggacatcttcctgtgctgccggagacccagcatggcgtat

SEQ ID NO: 7409 - DNA, 140 bp, Artificial Sequence
  Synthetic
aggccctggctgctgatatggcgccgatggcgagacactgcctgtcccgtcagacctggatgctgacgccccagccctagaaccggccctagacgacggggcggtacacacattaccaacgaccttttgggacagcggtg

SEQ ID NO: 7410 - DNA, 140 bp, Artificial Sequence
  Synthetic
caccgctgtcccaaaaggtcgttggtaatgtgtgtaccgccccgtcgtctagggccggttctagggctggggcgtcagcatccaggtctgacgggacaggcagtgtctcgccatcggcgccatatcagcagccagggcct

SEQ ID NO: 7411 - DNA, 140 bp, Artificial Sequence
  Synthetic
atacgccatgctgggtctccagcagagctgtgtccagccgtacaagaaacagcggagacgcgtgacacagctatttcccttcaggcaccgccaagtaccaccatggaactgagccatccacgtacttgggagtcggccat

SEQ ID NO: 7412 - DNA, 140 bp, Artificial Sequence
  Synthetic
atggccgactcccaagtacgtggatggctcagttccatggtggtacttggcggtgcctgaagggaaatagctgtgtcacgcgtctccgctgtttcttgtacggctggacacagctctgctggagacccagcatggcgtat

SEQ ID NO: 7413 - DNA, 140 bp, Artificial Sequence
  Synthetic
aggccctggctgctgatatgaggattaaccactacagataaagtgattaataactgcaaggtcgatcaatgccatgccgcggtcaccaatcacaaaaaatggcagtacaattcccctctggaccttttgggacagcggtg

SEQ ID NO: 7414 - DNA, 140 bp, Artificial Sequence
  Synthetic
caccgctgtcccaaaaggtccagaggggaattgtactgccattttttgtgattggtgaccgcggcatggcattgatcgaccttgcagttattaatcactttatctgtagtggttaatcctcatatcagcagccagggcct

SEQ ID NO: 7415 - DNA, 140 bp, Artificial Sequence
  Synthetic
atacgccatgctgggtctccccgatctccttcggagcaccaagcgagacgttccccattacatttggggacttcgacgaaggagaaatcgaaagcttgtcttctgagctactaactttcgcgtacttgggagtcggccat

SEQ ID NO: 7416 - DNA, 140 bp, Artificial Sequence
  Synthetic
atggccgactcccaagtacgcgaaagttagtagctcagaagacaagctttcgatttctccttcgtcgaagtccccaaatgtaatggggaacgtctcgcttggtgctccgaaggagatcggggagacccagcatggcgtat

SEQ ID NO: 7417 - DNA, 140 bp, Artificial Sequence
  Synthetic
aggccctggctgctgatatgatatggacaaccacatgccagcagacgcagagagggcggggctatttgtaagaacatcagcaccgtgtacgattactggaacaatgggacacttcatcctgaccttttgggacagcggtg

SEQ ID NO: 7418 - DNA, 140 bp, Artificial Sequence
  Synthetic
caccgctgtcccaaaaggtcaggatgaagtgtcccattgttccagtaatcgtacacggtgctgatgttcttacaaatagccccgccctctctgcgtctgctggcatgtggttgtccatatcatatcagcagccagggcct

SEQ ID NO: 7419 - DNA, 140 bp, Artificial Sequence
  Synthetic
atacgccatgctgggtctccactccaggagagtgcgtccatggccaatagaagcaggtatcagtcacgcaaagtggaaaatatgaaagcaacaatcatccagagactaaagagaggctgtcgtacttgggagtcggccat

SEQ ID NO: 7420 - DNA, 140 bp, Artificial Sequence
  Synthetic
atggccgactcccaagtacgacagcctctctttagtctctggatgattgttgctttcatattttccactttgcgtgactgatacctgcttctattggccatggacgcactctcctggagtggagacccagcatggcgtat

SEQ ID NO: 7421 - DNA, 140 bp, Artificial Sequence
  Synthetic
atacgccatgctgggtctccatacccggcgcctgtgtactcgcctccgatcaatgtccgattgtccaaccccgagtccgcagtggcagcatgtaatgagttcttagctagaaactacccacgtacttgggagtcggccat

SEQ ID NO: 7422 - DNA, 140 bp, Artificial Sequence
  Synthetic
atggccgactcccaagtacgtgggtagtttctagctaagaactcattacatgctgccactgcggactcggggttggacaatcggacattgatcggaggcgagtacacaggcgccgggtatggagacccagcatggcgtat

SEQ ID NO: 7423 - DNA, 140 bp, Artificial Sequence
  Synthetic
aggccctggctgctgatatgttatccacaaacggtacagcccacggccacccgcatgagataattctgtattattatgagctgtacccaactatgactgtggtagttttgtcagtggcctgaccttttgggacagcggtg

SEQ ID NO: 7424 - DNA, 140 bp, Artificial Sequence
  Synthetic
caccgctgtcccaaaaggtcaggccactgacaaaactaccacagtcatagttgggtacagctcataataatacagaattatctcatgcgggtggccgtgggctgtaccgtttgtggataacatatcagcagccagggcct

SEQ ID NO: 7425 - DNA, 140 bp, Artificial Sequence
  Synthetic
aggccctggctgctgatatgaggttcacagtagatatgaaaagggatgtgaaggtaactcctggtacaaagcacacagaggaaagacctaaggtgcaggttatacaggcggctgaaccctgaccttttgggacagcggtg

SEQ ID NO: 7426 - DNA, 140 bp, Artificial Sequence
  Synthetic
caccgctgtcccaaaaggtcagggttcagccgcctgtataacctgcaccttaggtctttcctctgtgtgctttgtaccaggagttaccttcacatcccttttcatatctactgtgaacctcatatcagcagccagggcct

SEQ ID NO: 7427 - DNA, 140 bp, Artificial Sequence
  Synthetic
aggccctggctgctgatatgccctttcctgcttagcctaatatgctgcattagaacagctaaagcggccacataccaggaggccgcggtatacctgtggaacgagcagcagcctttatttgaccttttgggacagcggtg

SEQ ID NO: 7428 - DNA, 140 bp, Artificial Sequence
  Synthetic
caccgctgtcccaaaaggtcaaataaaggctgctgctcgttccacaggtataccgcggcctcctggtatgtggccgctttagctgttctaatgcagcatattaggctaagcaggaaagggcatatcagcagccagggcct

SEQ ID NO: 7429 - DNA, 140 bp, Artificial Sequence
  Synthetic
aggccctggctgctgatatgaggaaaaattcacatcccgtttccgctggcaaatgtaacatgcagggtgcctaaagcaaggaaccccaccgtgacgtacgggaaaaaccaagtcatcatggaccttttgggacagcggtg

SEQ ID NO: 7430 - DNA, 140 bp, Artificial Sequence
  Synthetic
caccgctgtcccaaaaggtccatgatgacttggtttttcccgtacgtcacggtggggttccttgctttaggcaccctgcatgttacatttgccagcggaaacgggatgtgaatttttcctcatatcagcagccagggcct

SEQ ID NO: 7431 - DNA, 140 bp, Artificial Sequence
  Synthetic
atacgccatgctgggtctcccctattttgcagaagccgacagcaggtacctaaataccaatcagccataatggagtttatcccaacccaaactttctaaaataggaggtaccagcctcgacgtacttgggagtcggccat

SEQ ID NO: 7432 - DNA, 140 bp, Artificial Sequence
  Synthetic
atggccgactcccaagtacgtcgaggctggtacctcctattttagaaagtttgggttgggataaactccattatggctgattggtatttaggtacctgctgtcggcttctgcaaaataggggagacccagcatggcgtat

SEQ ID NO: 7433 - DNA, 140 bp, Artificial Sequence
  Synthetic
atacgccatgctgggtctcccctattttgcagaagccgacagcaggtacctaaataccaatcagccataatggagtttatcccaacccaaactttctataataggaggtaccagcctcgacgtacttgggagtcggccat

SEQ ID NO: 7434 - DNA, 140 bp, Artificial Sequence
  Synthetic
atggccgactcccaagtacgtcgaggctggtacctcctattatagaaagtttgggttgggataaactccattatggctgattggtatttaggtacctgctgtcggcttctgcaaaataggggagacccagcatggcgtat

SEQ ID NO: 7435 - DNA, 140 bp, Artificial Sequence
  Synthetic
atacgccatgctgggtctcccctattttgcagaagccgacagcaggtacctaaataccaatcagccataatggagtttatcccaacccaaactttctacaataggaggtaccagcctcgacgtacttgggagtcggccat

SEQ ID NO: 7436 - DNA, 140 bp, Artificial Sequence
  Synthetic
atggccgactcccaagtacgtcgaggctggtacctcctattgtagaaagtttgggttgggataaactccattatggctgattggtatttaggtacctgctgtcggcttctgcaaaataggggagacccagcatggcgtat

SEQ ID NO: 7437 - DNA, 140 bp, Artificial Sequence
  Synthetic
atacgccatgctgggtctcccctattttgcagaagccgacagcaggtacctaaataccaatcagccataatggagtttatcccaacccaaactttctagaataggaggtaccagcctcgacgtacttgggagtcggccat

SEQ ID NO: 7438 - DNA, 140 bp, Artificial Sequence
  Synthetic
atggccgactcccaagtacgtcgaggctggtacctcctattctagaaagtttgggttgggataaactccattatggctgattggtatttaggtacctgctgtcggcttctgcaaaataggggagacccagcatggcgtat

SEQ ID NO: 7439 - DNA, 140 bp, Artificial Sequence
  Synthetic
aggccctggctgctgatatgtgattacagctgtaaggtcttcaccggcgtctacccattcatgtggggcggcgcctactgcttctgcgacaccgaaaatacgcaactgagcgaagcacatgaccttttgggacagcggtg

SEQ ID NO: 7440 - DNA, 140 bp, Artificial Sequence
  Synthetic
caccgctgtcccaaaaggtcatgtgcttcgctcagttgcgtattttcggtgtcgcagaagcagtaggcgccgccccacatgaatgggtagacgccggtgaagaccttacagctgtaatcacatatcagcagccagggcct

SEQ ID NO: 7441 - DNA, 140 bp, Artificial Sequence
  Synthetic
atacgccatgctgggtctcccagacgcagagagggccgggctatttgtaagaacgtcagcaccgtgcacgattactggaacaatgggacacttcatcctggcccgatgtccgaaaggagacgtacttgggagtcggccat

SEQ ID NO: 7442 - DNA, 140 bp, Artificial Sequence
  Synthetic
atggccgactcccaagtacgtctcctttcggacatcgggccaggatgaagtgtcccattgttccagtaatcgtgcacggtgctgacgttcttacaaatagcccggccctctctgcgtctgggagacccagcatggcgtat

SEQ ID NO: 7443 - DNA, 140 bp, Artificial Sequence
  Synthetic
aggccctggctgctgatatggtggagaagtccgaatcatgcaaaacagaatttgcatcagcatacagggctcataccgcatccgcatcagctaagctccgcgtcctttaccaaggaaatagaccttttgggacagcggtg

SEQ ID NO: 7444 - DNA, 140 bp, Artificial Sequence
  Synthetic
caccgctgtcccaaaaggtctatttccttggtaaaggacgcggagcttagctgatgcggatgcggtatgagccctgtatgctgatgcaaattctgttttgcatgattcggacttctccaccatatcagcagccagggcct

SEQ ID NO: 7445 - DNA, 140 bp, Artificial Sequence
  Synthetic
aggccctggctgctgatatgtcataccgcatccgcatcagctaagctccgcgtcctttaccaaggaaataatatcactgtagctgcttatgcaaacggcgaccatgccgtcacagttaaggaccttttgggacagcggtg

SEQ ID NO: 7446 - DNA, 140 bp, Artificial Sequence
  Synthetic
caccgctgtcccaaaaggtccttaactgtgacggcatggtcgccgtttgcataagcagctacagtgatattatttccttggtaaaggacgcggagcttagctgatgcggatgcggtatgacatatcagcagccagggcct

SEQ ID NO: 7447 - DNA, 140 bp, Artificial Sequence
  Synthetic
aggccctggctgctgatatgaatagtcagacggtgcggtacaagtgtaattgcggtgactcaaatgaaggactaaccactacagacaaagtgattaataactgcggggttgatcaatgccgaccttttgggacagcggtg

SEQ ID NO: 7448 - DNA, 140 bp, Artificial Sequence
  Synthetic
caccgctgtcccaaaaggtcggcattgatcaaccccgcagttattaatcactttgtctgtagtggttagtccttcatttgagtcaccgcaattacacttgtaccgcaccgtctgactattcatatcagcagccagggcct

SEQ ID NO: 7449 - DNA, 140 bp, Artificial Sequence
  Synthetic
atacgccatgctgggtctccatgccgcggtcaccaatcacaaaaaatggcagtataattcccctctggtcccgcgtaatgctgaactcggggaccgaaaaggaaaaattcacattccgttcgtacttgggagtcggccat

SEQ ID NO: 7450 - DNA, 140 bp, Artificial Sequence
  Synthetic
atggccgactcccaagtacgaacggaatgtgaatttttccttttcggtccccgagttcagcattacgcgggaccagaggggaattatactgccattttttgtgattggtgaccgcggcatggagacccagcatggcgtat

SEQ ID NO: 7451 - DNA, 140 bp, Artificial Sequence
  Synthetic
atacgccatgctgggtctcctaaaatcgtggtgtacaaaggcgacgtctacaacatggactacccgcccttcggcgcaggaagaccaggacagtttggcgacatccaaagtcgcacgcctcgtacttgggagtcggccat

SEQ ID NO: 7452 - DNA, 140 bp, Artificial Sequence
  Synthetic
atggccgactcccaagtacgaggcgtgcgactttggatgtcgccaaactgtcctggtcttcctgcgccgaagggcgggtagtccatgttgtagacgtcgcctttgtacaccacgattttaggagacccagcatggcgtat

SEQ ID NO: 7453 - DNA, 140 bp, Artificial Sequence
  Synthetic
aggccctggctgctgatatgaaagatcggggacttacaagcggtgatggccgtgccagacacggagacgccaacattttgcttacacacagatgtctcatgtagacagagagcagacgtcgaccttttgggacagcggtg

SEQ ID NO: 7454 - DNA, 140 bp, Artificial Sequence
  Synthetic
caccgctgtcccaaaaggtcgacgtctgctctctgtctacatgagacatctgtgtgtaagcaaaatgttggcgtctccgtgtctggcacggccatcaccgcttgtaagtccccgatctttcatatcagcagccagggcct

SEQ ID NO: 7455 - DNA, 140 bp, Artificial Sequence
  Synthetic
aggccctggctgctgatatgggctgtcaaatagcaacaaacccggtaagagcgatgaactgcgccgtagggaacatgcctatctccatcgacataccggacgcggcctttactagggtcggaccttttgggacagcggtg

SEQ ID NO: 7456 - DNA, 140 bp, Artificial Sequence
  Synthetic
caccgctgtcccaaaaggtccgaccctagtaaaggccgcgtccggtatgtcgatggagataggcatgttccctacggcgcagttcatcgctcttaccgggtttgttgctatttgacagcccatatcagcagccagggcct

SEQ ID NO: 7457 - DNA, 140 bp, Artificial Sequence
  Synthetic
atacgccatgctgggtctccacaactaggtatgaaggtatatgtgtcccctaagagacacaccacatatagctaagaatcaatagataagtatagatcaaagggctgaacaacccctgaacgtacttgggagtcggccat

SEQ ID NO: 7458 - DNA, 140 bp, Artificial Sequence
  Synthetic
atggccgactcccaagtacgttcaggggttgttcagccctttgatctatacttatctattgattcttagctatatgtggtgtgtctcttaggggacacatataccttcatacctagttgtggagacccagcatggcgtat

SEQ ID NO: 7459 - DNA, 140 bp, Artificial Sequence
  Synthetic
aggccctggctgctgatatggctaagaatcaatagataagtatagatcaaagggctgaacaacccctgaatagtaacaaaatataaaaaatcaataaaaatcataaaatagaaaaccagagaccttttgggacagcggtg

SEQ ID NO: 7460 - DNA, 140 bp, Artificial Sequence
  Synthetic
caccgctgtcccaaaaggtctctggttttctattttatgatttttattgattttttatattttgttactattcaggggttgttcagccctttgatctatacttatctattgattcttagccatatcagcagccagggcct

SEQ ID NO: 7461 - DNA, 140 bp, Artificial Sequence
  Synthetic
aggccctggctgctgatatgcagttgagcgaagcacatgtggagaagtccgaatcatgcaaaacagaatttgcatcagcgtacagggctcataccgcatctgcatcagctaagctccgcggaccttttgggacagcggtg

SEQ ID NO: 7462 - DNA, 140 bp, Artificial Sequence
  Synthetic
caccgctgtcccaaaaggtccgcggagcttagctgatgcagatgcggtatgagccctgtacgctgatgcaaattctgttttgcatgattcggacttctccacatgtgcttcgctcaactgcatatcagcagccagggcct

SEQ ID NO: 7463 - DNA, 140 bp, Artificial Sequence
  Synthetic
aggccctggctgctgatatgcggcgtcacacaccaccctcggggtccaagacatttccgctacggcgatgtcatgggtgcagaagatcacgggaggtatgggactggttgtcgctgttgcgaccttttgggacagcggtg

SEQ ID NO: 7464 - DNA, 140 bp, Artificial Sequence
  Synthetic
caccgctgtcccaaaaggtcgcaacagcgacaaccagtcccatacctcccgtgatcttctgcacccatgacatcgccgtagcggaaatgtcttggaccccgagggtggtgtgtgacgccgcatatcagcagccagggcct

SEQ ID NO: 7465 - DNA, 140 bp, Artificial Sequence
  Synthetic
aggccctggctgctgatatgttgacaactaggtatgaaggcatacgcgtccctaaagagacacaccgcatatagctaggaatcaatagataagtatagatctaagggctgaacaacccctgaccttttgggacagcggtg

SEQ ID NO: 7466 - DNA, 140 bp, Artificial Sequence
  Synthetic
caccgctgtcccaaaaggtcaggggttgttcagcccttagatctatacttatctattgattcctagctatatgcggtgtgtctctttagggacgcgtatgccttcatacctagttgtcaacatatcagcagccagggcct

SEQ ID NO: 7467 - DNA, 140 bp, Artificial Sequence
  Synthetic
aggccctggctgctgatatgtgtaggtacttaagcttcctaaaagcagccgaactcgctttgagatgtaggcgtagcacaccgaactcttccataattctccgaacccacagggacgtaggaccttttgggacagcggtg

SEQ ID NO: 7468 - DNA, 140 bp, Artificial Sequence
  Synthetic
caccgctgtcccaaaaggtcctacgtccctgtgggttcggagaattatggaagagttcggtgtgctacgcctacatctcaaagcgagttcggctgcttttaggaagcttaagtacctacacatatcagcagccagggcct

SEQ ID NO: 7469 - DNA, 140 bp, Artificial Sequence
  Synthetic
aggccctggctgctgatatgataacatggactacccgccctttggcgcaggaagaccaggacaatttggcgatatccaaagtcgcacacctgagagtaaagacgtctatgctaatacacagaccttttgggacagcggtg

SEQ ID NO: 7470 - DNA, 140 bp, Artificial Sequence
  Synthetic
caccgctgtcccaaaaggtctgtgtattagcatagacgtctttactctcaggtgtgcgactttggatatcgccaaattgtcctggtcttcctgcgccaaagggcgggtagtccatgttatcatatcagcagccagggcct

SEQ ID NO: 7471 - DNA, 140 bp, Artificial Sequence
  Synthetic
atacgccatgctgggtctccggatagtaacaaaatataaaaatcaacaaaaatcataaaatagaaaactagaaatagaagtaggtaagaaggtaaatgtgtcccctaagagacacaccatcgtacttgggagtcggccat

SEQ ID NO: 7472 - DNA, 140 bp, Artificial Sequence
  Synthetic
atggccgactcccaagtacgatggtgtgtctcttaggggacacatttaccttcttacctacttctatttctagttttctattttatgatttttgttgatttttatattttgttactatccggagacccagcatggcgtat

SEQ ID NO: 7473 - DNA, 140 bp, Artificial Sequence
  Synthetic
atacgccatgctgggtctccggatagtaacaaaatataaaaatcaacaaaaatcataaaatagaaaactagaaatagaagtaggtaagaaggtatatgtgtcccctaagagacacaccatcgtacttgggagtcggccat

SEQ ID NO: 7474 - DNA, 140 bp, Artificial Sequence
  Synthetic
atggccgactcccaagtacgatggtgtgtctcttaggggacacatataccttcttacctacttctatttctagttttctattttatgatttttgttgatttttatattttgttactatccggagacccagcatggcgtat

SEQ ID NO: 7475 - DNA, 140 bp, Artificial Sequence
  Synthetic
atacgccatgctgggtctccggatagtaacaaaatataaaaatcaacaaaaatcataaaatagaaaactagaaatagaagtaggtaagaaggtacatgtgtcccctaagagacacaccatcgtacttgggagtcggccat

SEQ ID NO: 7476 - DNA, 140 bp, Artificial Sequence
  Synthetic
atggccgactcccaagtacgatggtgtgtctcttaggggacacatgtaccttcttacctacttctatttctagttttctattttatgatttttgttgatttttatattttgttactatccggagacccagcatggcgtat

SEQ ID NO: 7477 - DNA, 140 bp, Artificial Sequence
  Synthetic
atacgccatgctgggtctccggatagtaacaaaatataaaaatcaacaaaaatcataaaatagaaaactagaaatagaagtaggtaagaaggtagatgtgtcccctaagagacacaccatcgtacttgggagtcggccat

SEQ ID NO: 7478 - DNA, 140 bp, Artificial Sequence
  Synthetic
atggccgactcccaagtacgatggtgtgtctcttaggggacacatctaccttcttacctacttctatttctagttttctattttatgatttttgttgatttttatattttgttactatccggagacccagcatggcgtat

SEQ ID NO: 7479 - DNA, 140 bp, Artificial Sequence
  Synthetic
aggccctggctgctgatatggcgtagcacaccgaactcttccataattctccgaacccacagggacgtaggagatgttcaaagtggctataaaaccctgaatagtaataaaacataaaatgaccttttgggacagcggtg

SEQ ID NO: 7480 - DNA, 140 bp, Artificial Sequence
  Synthetic
caccgctgtcccaaaaggtcattttatgttttattactattcagggttttatagccactttgaacatctcctacgtccctgtgggttcggagaattatggaagagttcggtgtgctacgccatatcagcagccagggcct

SEQ ID NO: 7481 - DNA, 140 bp, Artificial Sequence
  Synthetic
aggccctggctgctgatatggaagagatgtaggtacttaagcttcctaaaagcagccgaactcactttgagatgtaggcatagcataccgaactcttccacaattctccgaacccatagggaccttttgggacagcggtg

SEQ ID NO: 7482 - DNA, 140 bp, Artificial Sequence
  Synthetic
caccgctgtcccaaaaggtccctatgggttcggagaattgtggaagagttcggtatgctatgcctacatctcaaagtgagttcggctgcttttaggaagcttaagtacctacatctcttccatatcagcagccagggcct

SEQ ID NO: 7483 - DNA, 140 bp, Artificial Sequence
  Synthetic
atacgccatgctgggtctccgaaaagaaaattaataaacccatcatggatcctgtgtacgtggacatagacgctgacagcgcctttttgaaggccctgcaacgtgcgtaccccatgtttgcgtacttgggagtcggccat

SEQ ID NO: 7484 - DNA, 140 bp, Artificial Sequence
  Synthetic
atggccgactcccaagtacgcaaacatggggtacgcacgttgcagggccttcaaaaaggcgctgtcagcgtctatgtccacgtacacaggatccatgatgggtttattaattttcttttcggagacccagcatggcgtat

SEQ ID NO: 7485 - DNA, 140 bp, Artificial Sequence
  Synthetic
aggccctggctgctgatatgagcctggacacctttcgacaacaaaattgtggtgtacaaaggtgacgtctataacatggactacccgccctttggcgcaggaagaccaggacaatttggcgaccttttgggacagcggtg

SEQ ID NO: 7486 - DNA, 140 bp, Artificial Sequence
  Synthetic
caccgctgtcccaaaaggtcgccaaattgtcctggtcttcctgcgccaaagggcgggtagtccatgttatagacgtcacctttgtacaccacaattttgttgtcgaaaggtgtccaggctcatatcagcagccagggcct

SEQ ID NO: 7487 - DNA, 140 bp, Artificial Sequence
  Synthetic
aggccctggctgctgatatgacgccgtcactattcgggaagctgagatagaagttgaagggaattctcagctgcaaatctctttctcgacggccttagccagcgccgaattccgcgtacagaccttttgggacagcggtg

SEQ ID NO: 7488 - DNA, 140 bp, Artificial Sequence
  Synthetic
caccgctgtcccaaaaggtctgtacgcggaattcggcgctggctaaggccgtcgagaaagagatttgcagctgagaattcccttcaacttctatctcagcttcccgaatagtgacggcgtcatatcagcagccagggcct

SEQ ID NO: 7489 - DNA, 140 bp, Artificial Sequence
  Synthetic
aggccctggctgctgatatgggaagtaccactgcgtctgcccgatgcgcagtgcggaagatcccgagagactcgctaattatgcgagaaagctagcatctgccgcaggaaaagtcctggagaccttttgggacagcggtg

SEQ ID NO: 7490 - DNA, 140 bp, Artificial Sequence
  Synthetic
caccgctgtcccaaaaggtctccaggacttttcctgcggcagatgctagctttctcgcataattagcgagtctctcgggatcttccgcactgcgcatcgggcagacgcagtggtacttcccatatcagcagccagggcct

SEQ ID NO: 7491 - DNA, 140 bp, Artificial Sequence
  Synthetic
aggccctggctgctgatatgccaacattctgcttacacacagacgtctcatgtagacagagagcagacgtcgctatataccaagacgtctatgatgtacacgcacccacgtcgctataccgaccttttgggacagcggtg

SEQ ID NO: 7492 - DNA, 140 bp, Artificial Sequence
  Synthetic
caccgctgtcccaaaaggtcggtatagcgacgtgggtgcgtgtacatcatagacgtcttggtatatagcgacgtctgctctctgtctacatgagacgtctgtgtgtaagcagaatgttggcatatcagcagccagggcct

SEQ ID NO: 7493 - DNA, 140 bp, Artificial Sequence
  Synthetic
aggccctggctgctgatatgccaacattctgcttacacacagacgtctcatgtagacagagagcagacgtcgctatataccaagacgtctatgttgtacacgcacccacgtcgctataccgaccttttgggacagcggtg

SEQ ID NO: 7494 - DNA, 140 bp, Artificial Sequence
  Synthetic
caccgctgtcccaaaaggtcggtatagcgacgtgggtgcgtgtacaacatagacgtcttggtatatagcgacgtctgctctctgtctacatgagacgtctgtgtgtaagcagaatgttggcatatcagcagccagggcct

SEQ ID NO: 7495 - DNA, 140 bp, Artificial Sequence
  Synthetic
aggccctggctgctgatatgccaacattctgcttacacacagacgtctcatgtagacagagagcagacgtcgctatataccaagacgtctatgctgtacacgcacccacgtcgctataccgaccttttgggacagcggtg

SEQ ID NO: 7496 - DNA, 140 bp, Artificial Sequence
  Synthetic
caccgctgtcccaaaaggtcggtatagcgacgtgggtgcgtgtacagcatagacgtcttggtatatagcgacgtctgctctctgtctacatgagacgtctgtgtgtaagcagaatgttggcatatcagcagccagggcct

SEQ ID NO: 7497 - DNA, 140 bp, Artificial Sequence
  Synthetic
aggccctggctgctgatatgccaacattctgcttacacacagacgtctcatgtagacagagagcagacgtcgctatataccaagacgtctatggtgtacacgcacccacgtcgctataccgaccttttgggacagcggtg

SEQ ID NO: 7498 - DNA, 140 bp, Artificial Sequence
  Synthetic
caccgctgtcccaaaaggtcggtatagcgacgtgggtgcgtgtacaccatagacgtcttggtatatagcgacgtctgctctctgtctacatgagacgtctgtgtgtaagcagaatgttggcatatcagcagccagggcct

SEQ ID NO: 7499 - DNA, 140 bp, Artificial Sequence
  Synthetic
aggccctggctgctgatatgcaacccctgaatagtaacaaaatacaaaatcactaaaaattataaaaacagaaaaatacataaataggtatacgtgtcccctaagagacacattgtgtgtgaccttttgggacagcggtg

SEQ ID NO: 7500 - DNA, 140 bp, Artificial Sequence
  Synthetic
caccgctgtcccaaaaggtcacacacaatgtgtctcttaggggacacgtatacctatttatgtatttttctgtttttataatttttagtgattttgtattttgttactattcaggggttgcatatcagcagccagggcct

SEQ ID NO: 7501 - DNA, 140 bp, Artificial Sequence
  Synthetic
aggccctggctgctgatatgaaaatcaaatgaataccataattggcaaacggaagagatgtaggtacttaagcttcctaaaagcagccgaactcactttgagaagtaggcatagcataccgaccttttgggacagcggtg

SEQ ID NO: 7502 - DNA, 140 bp, Artificial Sequence
  Synthetic
caccgctgtcccaaaaggtcggtatgctatgcctacttctcaaagtgagttcggctgcttttaggaagcttaagtacctacatctcttccgtttgccaattatggtattcatttgattttcatatcagcagccagggcct

SEQ ID NO: 7503 - DNA, 140 bp, Artificial Sequence
  Synthetic
aggccctggctgctgatatgcaaagcaagagattaataacccatcatggatcctgtgtacgtggacatagacgctgacagcgcctttttgaaggccctgcaacgtgcgtaccccatgtttgaccttttgggacagcggtg

SEQ ID NO: 7504 - DNA, 140 bp, Artificial Sequence
  Synthetic
caccgctgtcccaaaaggtcaaacatggggtacgcacgttgcagggccttcaaaaaggcgctgtcagcgtctatgtccacgtacacaggatccatgatgggttattaatctcttgctttgcatatcagcagccagggcct

SEQ ID NO: 7505 - DNA, 140 bp, Artificial Sequence
  Synthetic
aggccctggctgctgatatgctcacctgaagtagccctgaatgaaatatgtacgcgcatgtatggggtggatctagacagcgggctattttctaaaccgttggtgtctgtgtattacgcggaccttttgggacagcggtg

SEQ ID NO: 7506 - DNA, 140 bp, Artificial Sequence
  Synthetic
caccgctgtcccaaaaggtccgcgtaatacacagacaccaacggtttagaaaatagcccgctgtctagatccaccccatacatgcgcgtacatatttcattcagggctacttcaggtgagcatatcagcagccagggcct

SEQ ID NO: 7507 - DNA, 140 bp, Artificial Sequence
  Synthetic
aggccctggctgctgatatgctcacctgaagtagccctgaatgaaatatgtacgcgcatgtatggggtggatctagacagcgggctattttctaaaccgttggtgtctgtgttttacgcggaccttttgggacagcggtg

SEQ ID NO: 7508 - DNA, 140 bp, Artificial Sequence
  Synthetic
caccgctgtcccaaaaggtccgcgtaaaacacagacaccaacggtttagaaaatagcccgctgtctagatccaccccatacatgcgcgtacatatttcattcagggctacttcaggtgagcatatcagcagccagggcct

SEQ ID NO: 7509 - DNA, 140 bp, Artificial Sequence
  Synthetic
aggccctggctgctgatatgctcacctgaagtagccctgaatgaaatatgtacgcgcatgtatggggtggatctagacagcgggctattttctaaaccgttggtgtctgtgtcttacgcggaccttttgggacagcggtg

SEQ ID NO: 7510 - DNA, 140 bp, Artificial Sequence
  Synthetic
caccgctgtcccaaaaggtccgcgtaagacacagacaccaacggtttagaaaatagcccgctgtctagatccaccccatacatgcgcgtacatatttcattcagggctacttcaggtgagcatatcagcagccagggcct

SEQ ID NO: 7511 - DNA, 140 bp, Artificial Sequence
  Synthetic
aggccctggctgctgatatgctcacctgaagtagccctgaatgaaatatgtacgcgcatgtatggggtggatctagacagcgggctattttctaaaccgttggtgtctgtgtgttacgcggaccttttgggacagcggtg

SEQ ID NO: 7512 - DNA, 140 bp, Artificial Sequence
  Synthetic
caccgctgtcccaaaaggtccgcgtaacacacagacaccaacggtttagaaaatagcccgctgtctagatccaccccatacatgcgcgtacatatttcattcagggctacttcaggtgagcatatcagcagccagggcct

SEQ ID NO: 7513 - DNA, 140 bp, Artificial Sequence
  Synthetic
aggccctggctgctgatatgcaaaaaccgacctgatcccatacagcggagacgcccgagaagcccgggacgcagaaaaagaagcagaggaagaacgagaagcagaactgactcgcgaagcgaccttttgggacagcggtg

SEQ ID NO: 7514 - DNA, 140 bp, Artificial Sequence
  Synthetic
caccgctgtcccaaaaggtcgcttcgcgagtcagttctgcttctcgttcttcctctgcttctttttctgcgtcccgggcttctcgggcgtctccgctgtatgggatcaggtcggtttttgcatatcagcagccagggcct

SEQ ID NO: 7515 - DNA, 140 bp, Artificial Sequence
  Synthetic
aggccctggctgctgatatgttcacgctttggcggagcaagtgaagacgtgcacgcacaacggacgagcagggaggtatgcggtcgaagcgtacgacggccgagtcctagtgccctcagggaccttttgggacagcggtg

SEQ ID NO: 7516 - DNA, 140 bp, Artificial Sequence
  Synthetic
caccgctgtcccaaaaggtccctgagggcactaggactcggccgtcgtacgcttcgaccgcatacctccctgctcgtccgttgtgcgtgcacgtcttcacttgctccgccaaagcgtgaacatatcagcagccagggcct

SEQ ID NO: 7517 - DNA, 140 bp, Artificial Sequence
  Synthetic
aggccctggctgctgatatgcgtgtgagggctacgtcgttaagagaataacgatgagcccaggcctttatggaaaaaccacagggtatgcggtaacccaccacgcagacggattcttgatgaccttttgggacagcggtg

SEQ ID NO: 7518 - DNA, 140 bp, Artificial Sequence
  Synthetic
caccgctgtcccaaaaggtcatcaagaatccgtctgcgtggtgggttaccgcataccctgtggtttttccataaaggcctgggctcatcgttattctcttaacgacgtagccctcacacgcatatcagcagccagggcct

SEQ ID NO: 7519 - DNA, 140 bp, Artificial Sequence
  Synthetic
aggccctggctgctgatatgctaccacactcattagtggccgaacaccgcccagtaaaaggggaaagaatggaatggctggttaacaagataaacggccaccacgtgctcctggtcagtggaccttttgggacagcggtg

SEQ ID NO: 7520 - DNA, 140 bp, Artificial Sequence
  Synthetic
caccgctgtcccaaaaggtccactgaccaggagcacgtggtggccgtttatcttgttaaccagccattccattctttccccttttactgggcggtgttcggccactaatgagtgtggtagcatatcagcagccagggcct

SEQ ID NO: 7521 - DNA, 140 bp, Artificial Sequence
  Synthetic
aggccctggctgctgatatgggaatggctggttaacaagataaacggccaccacgtgctcctggtcagtggctacaaccttgcactgcctactaagagagtcacttgggtagcgccgttagaccttttgggacagcggtg

SEQ ID NO: 7522 - DNA, 140 bp, Artificial Sequence
  Synthetic
caccgctgtcccaaaaggtctaacggcgctacccaagtgactctcttagtaggcagtgcaaggttgtagccactgaccaggagcacgtggtggccgtttatcttgttaaccagccattcccatatcagcagccagggcct

SEQ ID NO: 7523 - DNA, 140 bp, Artificial Sequence
  Synthetic
aggccctggctgctgatatgggccttagccagcgccgaattccgcgtacaagtctgttctacacaagtacactgtgcagctgagtgccaccccccgaaggaccacatagtcaactacccggaccttttgggacagcggtg

SEQ ID NO: 7524 - DNA, 140 bp, Artificial Sequence
  Synthetic
caccgctgtcccaaaaggtccgggtagttgactatgtggtccttcggggggtggcactcagctgcacagtgtacttgtgtagaacagacttgtacgcggaattcggcgctggctaaggcccatatcagcagccagggcct

SEQ ID NO: 7525 - DNA, 140 bp, Artificial Sequence
  Synthetic
atacgccatgctgggtctccgtagtggacactacaggctcaacaaaacctgaccctggagacctcgtgttaacgtgcttcagagggtgggttaaacaactgcaaattgactatcgtggatcgtacttgggagtcggccat

SEQ ID NO: 7526 - DNA, 140 bp, Artificial Sequence
  Synthetic
atggccgactcccaagtacgatccacgatagtcaatttgcagttgtttaacccaccctctgaagcacgttaacacgaggtctccagggtcaggttttgttgagcctgtagtgtccactacggagacccagcatggcgtat

SEQ ID NO: 7527 - DNA, 140 bp, Artificial Sequence
  Synthetic
atacgccatgctgggtctccgttcggatttaaccccgaggcagcatccattctagaaagaaagtatccattcacaaaagggaagtggaacatcaacaagcagatctgcgtgactaccaggcgtacttgggagtcggccat

SEQ ID NO: 7528 - DNA, 140 bp, Artificial Sequence
  Synthetic
atggccgactcccaagtacgcctggtagtcacgcagatctgcttgttgatgttccacttcccttttgtgaatggatactttctttctagaatggatgctgcctcggggttaaatccgaacggagacccagcatggcgtat

SEQ ID NO: 7529 - DNA, 140 bp, Artificial Sequence
  Synthetic
aggccctggctgctgatatgtggaatggctggttaacaagataaacggccaccacgtgctcctggtcagtggcaataaccttgcactgcctactaagagagtcacttgggtagcgccgttgaccttttgggacagcggtg

SEQ ID NO: 7530 - DNA, 140 bp, Artificial Sequence
  Synthetic
caccgctgtcccaaaaggtcaacggcgctacccaagtgactctcttagtaggcagtgcaaggttattgccactgaccaggagcacgtggtggccgtttatcttgttaaccagccattccacatatcagcagccagggcct

SEQ ID NO: 7531 - DNA, 140 bp, Artificial Sequence
  Synthetic
aggccctggctgctgatatgctgactgtgacatgtgacgagagagaagggaatataacacccatggctagcgtccgattctttagggcagagctgtgtccggtcgtacaagaaacagcgggaccttttgggacagcggtg

SEQ ID NO: 7532 - DNA, 140 bp, Artificial Sequence
  Synthetic
caccgctgtcccaaaaggtcccgctgtttcttgtacgaccggacacagctctgccctaaagaatcggacgctagccatgggtgttatattcccttctctctcgtcacatgtcacagtcagcatatcagcagccagggcct

SEQ ID NO: 7533 - DNA, 140 bp, Artificial Sequence
  Synthetic
aggccctggctgctgatatggacacacacgctgccatccacaaccggaaaccttgcggccgtgtctgattgggtaatgagcaccgtacctgtcgcgccgcccagaagaaggcgagggagagaccttttgggacagcggtg

SEQ ID NO: 7534 - DNA, 140 bp, Artificial Sequence
  Synthetic
caccgctgtcccaaaaggtctctccctcgccttcttctgggcggcgcgacaggtacggtgctcattacccaatcagacacggccgcaaggtttccggttgtggatggcagcgtgtgtgtccatatcagcagccagggcct

SEQ ID NO: 7535 - DNA, 140 bp, Artificial Sequence
  Synthetic
aggccctggctgctgatatgggtatcagtcgcgcaaagtagaaaacatgaaagcagcaatcatccagagactaaagagtggctgtagactatacttaatgtcagagaccccaaaagtcccgaccttttgggacagcggtg

SEQ ID NO: 7536 - DNA, 140 bp, Artificial Sequence
  Synthetic
caccgctgtcccaaaaggtcgggacttttggggtctctgacattaagtatagtctacagccactctttagtctctggatgattgctgctttcatgttttctactttgcgcgactgatacccatatcagcagccagggcct

SEQ ID NO: 7537 - DNA, 140 bp, Artificial Sequence
  Synthetic
aggccctggctgctgatatgttcgcatgaaccacgtcacaagcataattgtgtgttcttcgtttcccctcccaaagtacaaaatagaaggagtgcaaaaagtcaaatgctctaaggtaatgaccttttgggacagcggtg

SEQ ID NO: 7538 - DNA, 140 bp, Artificial Sequence
  Synthetic
caccgctgtcccaaaaggtcattaccttagagcatttgactttttgcactccttctattttgtactttgggaggggaaacgaagaacacacaattatgcttgtgacgtggttcatgcgaacatatcagcagccagggcct

SEQ ID NO: 7539 - DNA, 140 bp, Artificial Sequence
  Synthetic
atacgccatgctgggtctccgctatttgaccacaacgtgccatcgcgcgtaagtccaagggaatatagatcttcccaggagtctgcacaggaggcgagtacaatcacgtcactgacgcatcgtacttgggagtcggccat

SEQ ID NO: 7540 - DNA, 140 bp, Artificial Sequence
  Synthetic
atggccgactcccaagtacgatgcgtcagtgacgtgattgtactcgcctcctgtgcagactcctgggaagatctatattcccttggacttacgcgcgatggcacgttgtggtcaaatagcggagacccagcatggcgtat

SEQ ID NO: 7541 - DNA, 140 bp, Artificial Sequence
  Synthetic
atacgccatgctgggtctccagtcaattcgacctaagcgttgatggcgagatactgcccgtcccgtcagacctggatgctgacgccccagccctagaaccagcactagacgacggggcgacgtacttgggagtcggccat

SEQ ID NO: 7542 - DNA, 140 bp, Artificial Sequence
  Synthetic
atggccgactcccaagtacgtcgccccgtcgtctagtgctggttctagggctggggcgtcagcatccaggtctgacgggacgggcagtatctcgccatcaacgcttaggtcgaattgactggagacccagcatggcgtat

SEQ ID NO: 7543 - DNA, 140 bp, Artificial Sequence
  Synthetic
aggccctggctgctgatatggcgccctccatcagaagcgctgtaccgtccccattccagaacacactacagaatgtactggcagcagccacgaaaagaaactgcaacgtcacacagatgagaccttttgggacagcggtg

SEQ ID NO: 7544 - DNA, 140 bp, Artificial Sequence
  Synthetic
caccgctgtcccaaaaggtctcatctgtgtgacgttgcagtttcttttcgtggctgctgccagtacattctgtagtgtgttctggaatggggacggtacagcgcttctgatggagggcgccatatcagcagccagggcct

SEQ ID NO: 7545 - DNA, 140 bp, Artificial Sequence
  Synthetic
aggccctggctgctgatatgaccgaatcatccgccgatctccttcggagcatcaagcgagacgttccccattacatttggggacttcaacgaaggagaaatcgaaagcttgtcttctgaggaccttttgggacagcggtg

SEQ ID NO: 7546 - DNA, 140 bp, Artificial Sequence
  Synthetic
caccgctgtcccaaaaggtcctcagaagacaagctttcgatttctccttcgttgaagtccccaaatgtaatggggaacgtctcgcttgatgctccgaaggagatcggcggatgattcggtcatatcagcagccagggcct

SEQ ID NO: 7547 - DNA, 140 bp, Artificial Sequence
  Synthetic
aggccctggctgctgatatgttacatttggggacttcaacgaaggagaaatcgaaagcttgtcttctgagctactaactttcggagacttcttaccaggagaagtggatgacttgacagagaccttttgggacagcggtg

SEQ ID NO: 7548 - DNA, 140 bp, Artificial Sequence
  Synthetic
caccgctgtcccaaaaggtctctgtcaagtcatccacttctcctggtaagaagtctccgaaagttagtagctcagaagacaagctttcgatttctccttcgttgaagtccccaaatgtaacatatcagcagccagggcct

SEQ ID NO: 7549 - DNA, 140 bp, Artificial Sequence
  Synthetic
aggccctggctgctgatatgcataattggcaaacggaagagatgtaggtacttgcataccgaactcttccacgattctccgaacccacagggacgtaggagatgttattttgtttttaatgaccttttgggacagcggtg

SEQ ID NO: 7550 - DNA, 140 bp, Artificial Sequence
  Synthetic
caccgctgtcccaaaaggtcattaaaaacaaaataacatctcctacgtccctgtgggttcggagaatcgtggaagagttcggtatgcaagtacctacatctcttccgtttgccaattatgcatatcagcagccagggcct

SEQ ID NO: 7551 - DNA, 140 bp, Artificial Sequence
  Synthetic
atacgccatgctgggtctcccaggagacactgttttggaaacggacatagcctcctttgataagagccaagacgattcgcttgcgcttactgctttgatgctgttagaggatttaggggtcgtacttgggagtcggccat

SEQ ID NO: 7552 - DNA, 140 bp, Artificial Sequence
  Synthetic
atggccgactcccaagtacgacccctaaatcctctaacagcatcaaagcagtaagcgcaagcgaatcgtcttggctcttatcaaaggaggctatgtccgtttccaaaacagtgtctcctgggagacccagcatggcgtat

SEQ ID NO: 7553 - DNA, 140 bp, Artificial Sequence
  Synthetic
aggccctggctgctgatatgccacgaggagaagtgttacccacctaagctggatgaagcaaaggagcaactattacttaagaaactccaggagagtgcatccatggccaacagaagcagggaccttttgggacagcggtg

SEQ ID NO: 7554 - DNA, 140 bp, Artificial Sequence
  Synthetic
caccgctgtcccaaaaggtccctgcttctgttggccatggatgcactctcctggagtttcttaagtaatagttgctcctttgcttcatccagcttaggtgggtaacacttctcctcgtggcatatcagcagccagggcct

SEQ ID NO: 7555 - DNA, 140 bp, Artificial Sequence
  Synthetic
aggccctggctgctgatatgtattacttaagaaactccaggagagtgcatccatggccaacagaagcaggtatcagtcgcgcaaagtagaaaacatgaaagcagcaatcatccagagactgaccttttgggacagcggtg

SEQ ID NO: 7556 - DNA, 140 bp, Artificial Sequence
  Synthetic
caccgctgtcccaaaaggtcagtctctggatgattgctgctttcatgttttctactttgcgcgactgatacctgcttctgttggccatggatgcactctcctggagtttcttaagtaatacatatcagcagccagggcct

SEQ ID NO: 7557 - DNA, 140 bp, Artificial Sequence
  Synthetic
aggccctggctgctgatatgcgattgtccaatcccgagtccgcagtggcagcatgcaatgagttcttagctagaaactatccaactgtctcatcataccaaattaccgacgagtatgatggaccttttgggacagcggtg

SEQ ID NO: 7558 - DNA, 140 bp, Artificial Sequence
  Synthetic
caccgctgtcccaaaaggtccatcatactcgtcggtaatttggtatgatgagacagttggatagtttctagctaagaactcattgcatgctgccactgcggactcgggattggacaatcgcatatcagcagccagggcct

SEQ ID NO: 7559 - DNA, 140 bp, Artificial Sequence
  Synthetic
atacgccatgctgggtctccattggctgcgtgagacacacgtagcctaccagtttcttactgctctactctgcaaagcaagagattaagaacccatcatggatcctgtgtacgtggacatcgtacttgggagtcggccat

SEQ ID NO: 7560 - DNA, 140 bp, Artificial Sequence
  Synthetic
atggccgactcccaagtacgatgtccacgtacacaggatccatgatgggttcttaatctcttgctttgcagagtagagcagtaagaaactggtaggctacgtgtgtctcacgcagccaatggagacccagcatggcgtat

SEQ ID NO: 7561 - DNA, 140 bp, Artificial Sequence
  Synthetic
aggccctggctgctgatatggcgttctcgcatctagctataaaactaatagagcaggaaattgatcccgactcaaccatcctggatattggtagtgcgccagcaaggaggatgatgtcgggaccttttgggacagcggtg

SEQ ID NO: 7562 - DNA, 140 bp, Artificial Sequence
  Synthetic
caccgctgtcccaaaaggtcccgacatcatcctccttgctggcgcactaccaatatccaggatggttgagtcgggatcaatttcctgctctattagttttatagctagatgcgagaacgccatatcagcagccagggcct

SEQ ID NO: 7563 - DNA, 140 bp, Artificial Sequence
  Synthetic
atacgccatgctgggtctcctttaaactgggcaaaccgctagcggcaggtgacgaacaagatgaagatagaagacgagcgctggctgacgaagtgatcagatggcaacgaacagggctaacgtacttgggagtcggccat

SEQ ID NO: 7564 - DNA, 140 bp, Artificial Sequence
  Synthetic
atggccgactcccaagtacgttagccctgttcgttgccatctgatcacttcgtcagccagcgctcgtcttctatcttcatcttgttcgtcacctgccgctagcggtttgcccagtttaaaggagacccagcatggcgtat

SEQ ID NO: 7565 - DNA, 140 bp, Artificial Sequence
  Synthetic
atacgccatgctgggtctccacaggaagtaccactgcgtttgcccgatgcgcagtgcagaagatcccgagagactcgccaattatgcgagaaagctagcatctgccgcaggaaaagtcctcgtacttgggagtcggccat

SEQ ID NO: 7566 - DNA, 140 bp, Artificial Sequence
  Synthetic
atggccgactcccaagtacgaggacttttcctgcggcagatgctagctttctcgcataattggcgagtctctcgggatcttctgcactgcgcatcgggcaaacgcagtggtacttcctgtggagacccagcatggcgtat

SEQ ID NO: 7567 - DNA, 140 bp, Artificial Sequence
  Synthetic
aggccctggctgctgatatgattcgcatgcaaccaagaatactgggaagaatttgctgccagccctattaggataacaactgagaatttagcaacctatgttactaaactaaaagggccagaccttttgggacagcggtg

SEQ ID NO: 7568 - DNA, 140 bp, Artificial Sequence
  Synthetic
caccgctgtcccaaaaggtctggcccttttagtttagtaacataggttgctaaattctcagttgttatcctaatagggctggcagcaaattcttcccagtattcttggttgcatgcgaatcatatcagcagccagggcct

SEQ ID NO: 7569 - DNA, 140 bp, Artificial Sequence
  Synthetic
atacgccatgctgggtctcctgccagacacggagacgccaacattctgcttacacacagatgtatcatgtagacagagagcagacgtcgcgatataccaagacgtctatgctgtacacgccgtacttgggagtcggccat

SEQ ID NO: 7570 - DNA, 140 bp, Artificial Sequence
  Synthetic
atggccgactcccaagtacggcgtgtacagcatagacgtcttggtatatcgcgacgtctgctctctgtctacatgatacatctgtgtgtaagcagaatgttggcgtctccgtgtctggcaggagacccagcatggcgtat

SEQ ID NO: 7571 - DNA, 140 bp, Artificial Sequence
  Synthetic
aggccctggctgctgatatgatgtactggcagcagccacgaaaagaaactgcaacgtcacacagatgagggaattacccactttggactcagcagtattcaacgtggagtgtttcaaaaagaccttttgggacagcggtg

SEQ ID NO: 7572 - DNA, 140 bp, Artificial Sequence
  Synthetic
caccgctgtcccaaaaggtctttttgaaacactccacgttgaatactgctgagtccaaagtgggtaattccctcatctgtgtgacgttgcagtttcttttcgtggctgctgccagtacatcatatcagcagccagggcct

SEQ ID NO: 7573 - DNA, 140 bp, Artificial Sequence
  Synthetic
atacgccatgctgggtctccagtaccaatggataggttcacagtagatatgaaaagggacgtaaaggtgactcctggtacaaagcatacagaggaaagacctaaggtgcaggttatacagcgtacttgggagtcggccat

SEQ ID NO: 7574 - DNA, 140 bp, Artificial Sequence
  Synthetic
atggccgactcccaagtacgctgtataacctgcaccttaggtctttcctctgtatgctttgtaccaggagtcacctttacgtcccttttcatatctactgtgaacctatccattggtactggagacccagcatggcgtat

SEQ ID NO: 7575 - DNA, 140 bp, Artificial Sequence
  Synthetic
atacgccatgctgggtctccgggtagggtttgacacaaccccgttcatgtacaatgccatggcgggtgcctacccctcatactcgacaaattgggcagatgagcaggtactgaaggctaacgtacttgggagtcggccat

SEQ ID NO: 7576 - DNA, 140 bp, Artificial Sequence
  Synthetic
atggccgactcccaagtacgttagccttcagtacctgctcatctgcccaatttgtcgagtatgaggggtaggcacccgccatggcattgtacatgaacggggttgtgtcaaaccctacccggagacccagcatggcgtat

SEQ ID NO: 7577 - DNA, 140 bp, Artificial Sequence
  Synthetic
aggccctggctgctgatatggaattacccactttggactcagcagtattcaacgtggagtgtttcaaaaaattcgcatgcaaccaagaatactgggaagaatttgctgccagccctattagaccttttgggacagcggtg

SEQ ID NO: 7578 - DNA, 140 bp, Artificial Sequence
  Synthetic
caccgctgtcccaaaaggtctaatagggctggcagcaaattcttcccagtattcttggttgcatgcgaattttttgaaacactccacgttgaatactgctgagtccaaagtgggtaattccatatcagcagccagggcct

SEQ ID NO: 7579 - DNA, 140 bp, Artificial Sequence
  Synthetic
aggccctggctgctgatatggcccagaccgcgccctcagaggcaagctgggcaacttgcccagctgatctcagcagttaataaactgacaatgcgcgcggtaccccaacagaagccacgcgaccttttgggacagcggtg

SEQ ID NO: 7580 - DNA, 140 bp, Artificial Sequence
  Synthetic
caccgctgtcccaaaaggtcgcgtggcttctgttggggtaccgcgcgcattgtcagtttattaactgctgagatcagctgggcaagttgcccagcttgcctctgagggcgcggtctgggccatatcagcagccagggcct

SEQ ID NO: 7581 - DNA, 140 bp, Artificial Sequence
  Synthetic
aggccctggctgctgatatgcagcagttaataaactgacaatgcgcgcggtaccccaacagaagccacgcaggaatcggaagaataagaagcaaaagcaaaaacaacaggcgccacaaaagaccttttgggacagcggtg

SEQ ID NO: 7582 - DNA, 140 bp, Artificial Sequence
  Synthetic
caccgctgtcccaaaaggtcttttgtggcgcctgttgtttttgcttttgcttcttattcttccgattcctgcgtggcttctgttggggtaccgcgcgcattgtcagtttattaactgctgcatatcagcagccagggcct

SEQ ID NO: 7583 - DNA, 140 bp, Artificial Sequence
  Synthetic
aggccctggctgctgatatgacatgtctgccgaggatttcgatgccatcatagccgcacactttaagccaggagacactgttttggaaacggacatagcctcctttgataagagccaagagaccttttgggacagcggtg

SEQ ID NO: 7584 - DNA, 140 bp, Artificial Sequence
  Synthetic
caccgctgtcccaaaaggtctcttggctcttatcaaaggaggctatgtccgtttccaaaacagtgtctcctggcttaaagtgtgcggctatgatggcatcgaaatcctcggcagacatgtcatatcagcagccagggcct

SEQ ID NO: 7585 - DNA, 140 bp, Artificial Sequence
  Synthetic
aggccctggctgctgatatgatcactccctgctggacttgatagaggctgctttcggagagatttccagctgtcacctaccgacaggtacgcgcttcaagttcggcgccatgatgaaatcgaccttttgggacagcggtg

SEQ ID NO: 7586 - DNA, 140 bp, Artificial Sequence
  Synthetic
caccgctgtcccaaaaggtcgatttcatcatggcgccgaacttgaagcgcgtacctgtcggtaggtgacagctggaaatctctccgaaagcagcctctatcaagtccagcagggagtgatcatatcagcagccagggcct

SEQ ID NO: 7587 - DNA, 140 bp, Artificial Sequence
  Synthetic
aggccctggctgctgatatgaaaagaagccgggccgcagagagaggatgtgcatgaaaatcgaaaatgattgtattttcgaagtcaagcacgaaggtaaggtaacaggttacgcgtgcctgaccttttgggacagcggtg

SEQ ID NO: 7588 - DNA, 140 bp, Artificial Sequence
  Synthetic
caccgctgtcccaaaaggtcaggcacgcgtaacctgttaccttaccttcgtgcttgacttcgaaaatacaatcattttcgattttcatgcacatcctctctctgcggcccggcttcttttcatatcagcagccagggcct

SEQ ID NO: 7589 - DNA, 140 bp, Artificial Sequence
  Synthetic
aggccctggctgctgatatgagccagatgtgccacttggatgaacatggaagtgaagatcatagatgcagttgtatccttgaaagccccttacttttgtggagggtttatactgcacgatgaccttttgggacagcggtg

SEQ ID NO: 7590 - DNA, 140 bp, Artificial Sequence
  Synthetic
caccgctgtcccaaaaggtcatcgtgcagtataaaccctccacaaaagtaaggggctttcaaggatacaactgcatctatgatcttcacttccatgttcatccaagtggcacatctggctcatatcagcagccagggcct

SEQ ID NO: 7591 - DNA, 140 bp, Artificial Sequence
  Synthetic
aggccctggctgctgatatgttgtatccttgaaagccccttacttttgtggagggtttatactgcacgatactgtgacaggaacagcttgcagagtggcagacccgctaaaaaggcttttgaccttttgggacagcggtg

SEQ ID NO: 7592 - DNA, 140 bp, Artificial Sequence
  Synthetic
caccgctgtcccaaaaggtcaaaagcctttttagcgggtctgccactctgcaagctgttcctgtcacagtatcgtgcagtataaaccctccacaaaagtaaggggctttcaaggatacaacatatcagcagccagggcct

SEQ ID NO: 7593 - DNA, 140 bp, Artificial Sequence
  Synthetic
aggccctggctgctgatatgagcggcagaccgatcttcgacaacaagggacgcgtggtggccatagtcttaggaggagctaatgaaggagcccgtacagccctctcggtggtgacctggagaccttttgggacagcggtg

SEQ ID NO: 7594 - DNA, 140 bp, Artificial Sequence
  Synthetic
caccgctgtcccaaaaggtctccaggtcaccaccgagagggctgtacgggctccttcattagctcctcctaagactatggccaccacgcgtcccttgttgtcgaagatcggtctgccgctcatatcagcagccagggcct

SEQ ID NO: 7595 - DNA, 140 bp, Artificial Sequence
  Synthetic
aggccctggctgctgatatgtaaactgggcaaaccgctagcggcaggtgacgaacaagatgaagatagaagacgagcgctggctgacgaagtgatcagatggcaacgaacagggctaattgaccttttgggacagcggtg

SEQ ID NO: 7596 - DNA, 140 bp, Artificial Sequence
  Synthetic
caccgctgtcccaaaaggtcaattagccctgttcgttgccatctgatcacttcgtcagccagcgctcgtcttctatcttcatcttgttcgtcacctgccgctagcggtttgcccagtttacatatcagcagccagggcct

SEQ ID NO: 7597 - DNA, 140 bp, Artificial Sequence
  Synthetic
aggccctggctgctgatatgactgtgacaggaacagcttgcagagtggcagacccgctaaaaaggctttttaaactgggcaaaccgctagcggcaggtgacgaacaagatgaagatagaagaccttttgggacagcggtg

SEQ ID NO: 7598 - DNA, 140 bp, Artificial Sequence
  Synthetic
caccgctgtcccaaaaggtcttctatcttcatcttgttcgtcacctgccgctagcggtttgcccagtttaaaaagcctttttagcgggtctgccactctgcaagctgttcctgtcacagtcatatcagcagccagggcct

SEQ ID NO: 7599 - DNA, 140 bp, Artificial Sequence
  Synthetic
aggccctggctgctgatatggacgcagaaaaagaagcagaggaagaacgagaagcagaactgactcttgaagccctaccaccccttcaggcagcacaggaagatgttcaggtcgaaatcggaccttttgggacagcggtg

SEQ ID NO: 7600 - DNA, 140 bp, Artificial Sequence
  Synthetic
caccgctgtcccaaaaggtccgatttcgacctgaacatcttcctgtgctgcctgaaggggtggtagggcttcaagagtcagttctgcttctcgttcttcctctgcttctttttctgcgtccatatcagcagccagggcct

SEQ ID NO: 7601 - DNA, 140 bp, Artificial Sequence
  Synthetic
aggccctggctgctgatatgccagcccccttgcacgccctgctgctacgaaaaggaaccggaggaaaccctacgcatgcttgaggacaacgtcatgagacctgggtactatcagctgctagaccttttgggacagcggtg

SEQ ID NO: 7602 - DNA, 140 bp, Artificial Sequence
  Synthetic
caccgctgtcccaaaaggtctagcagctgatagtacccaggtctcatgacgttgtcctcaagcatgcgtagggtttcctccggttccttttcgtagcagcagggcgtgcaagggggctggcatatcagcagccagggcct

SEQ ID NO: 7603 - DNA, 140 bp, Artificial Sequence
  Synthetic
aggccctggctgctgatatgtaatcagctacaatggagttcatcccaacccaaactttttacaataggaggtaccagcctcgaccctggactccgcgccctactatccaagtcatcaggcgaccttttgggacagcggtg

SEQ ID NO: 7604 - DNA, 140 bp, Artificial Sequence
  Synthetic
caccgctgtcccaaaaggtcgcctgatgacttggatagtagggcgcggagtccagggtcgaggctggtacctcctattgtaaaaagtttgggttgggatgaactccattgtagctgattacatatcagcagccagggcct

SEQ ID NO: 7605 - DNA, 140 bp, Artificial Sequence
  Synthetic
atacgccatgctgggtctccgtaccagcctcgaccctggactccgcgccctactatccaagtcatcaggcccagaccgcgccctcagaggcaagctgggcaacttgcccagctgatctcacgtacttgggagtcggccat

SEQ ID NO: 7606 - DNA, 140 bp, Artificial Sequence
  Synthetic
atggccgactcccaagtacgtgagatcagctgggcaagttgcccagcttgcctctgagggcgcggtctgggcctgatgacttggatagtagggcgcggagtccagggtcgaggctggtacggagacccagcatggcgtat

SEQ ID NO: 7607 - DNA, 140 bp, Artificial Sequence
  Synthetic
aggccctggctgctgatatgcggaataaagacggatgacagccacgattggaccaagctgcgttatatggacaaccacatgccagcagacgcagagagggcggggctatttgtaagaacagaccttttgggacagcggtg

SEQ ID NO: 7608 - DNA, 140 bp, Artificial Sequence
  Synthetic
caccgctgtcccaaaaggtctgttcttacaaatagccccgccctctctgcgtctgctggcatgtggttgtccatataacgcagcttggtccaatcgtggctgtcatccgtctttattccgcatatcagcagccagggcct

SEQ ID NO: 7609 - DNA, 140 bp, Artificial Sequence
  Synthetic
aggccctggctgctgatatggagggcagagaggacagaacacgagtacgtctacgacgtggaccagagaagatgctgtaagaaggaagaagctgcaggactggtactggtgggcgacttggaccttttgggacagcggtg

SEQ ID NO: 7610 - DNA, 140 bp, Artificial Sequence
  Synthetic
caccgctgtcccaaaaggtccaagtcgcccaccagtaccagtcctgcagcttcttccttcttacagcatcttctctggtccacgtcgtagacgtactcgtgttctgtcctctctgccctccatatcagcagccagggcct

SEQ ID NO: 7611 - DNA, 140 bp, Artificial Sequence
  Synthetic
aggccctggctgctgatatgatggatgtaacagaccagtcgacgtgttgtacgtagacgaggcgtttgcgtgccactctggaacgttacttgcattgatcgccttggtgagaccaagacagaccttttgggacagcggtg

SEQ ID NO: 7612 - DNA, 140 bp, Artificial Sequence
  Synthetic
caccgctgtcccaaaaggtctgtcttggtctcaccaaggcgatcaatgcaagtaacgttccagagtggcacgcaaacgcctcgtctacgtacaacacgtcgactggtctgttacatccatcatatcagcagccagggcct

SEQ ID NO: 7613 - DNA, 140 bp, Artificial Sequence
  Synthetic
aggccctggctgctgatatgttagtcattcatgtacgcacccatttcaccacgaccctcctgtgataggtcgggaaaaattccattcccgaccgcagcacggtaaagagctaccttgcaggaccttttgggacagcggtg

SEQ ID NO: 7614 - DNA, 140 bp, Artificial Sequence
  Synthetic
caccgctgtcccaaaaggtcctgcaaggtagctctttaccgtgctgcggtcgggaatggaatttttcccgacctatcacaggagggtcgtggtgaaatgggtgcgtacatgaatgactaacatatcagcagccagggcct

SEQ ID NO: 7615 - DNA, 140 bp, Artificial Sequence
  Synthetic
atacgccatgctgggtctccttaacgtgcttcagaggatgggttaaacaactgcaaattgactatcgtggacacgaggtcatgacagcagccgcatcccaagggttaaccagaaaaggagcgtacttgggagtcggccat

SEQ ID NO: 7616 - DNA, 140 bp, Artificial Sequence
  Synthetic
atggccgactcccaagtacgctccttttctggttaacccttgggatgcggctgctgtcatgacctcgtgtccacgatagtcaatttgcagttgtttaacccatcctctgaagcacgttaaggagacccagcatggcgtat

SEQ ID NO: 7617 - DNA, 140 bp, Artificial Sequence
  Synthetic
aggccctggctgctgatatggaggagctaatgaaggagcccgtacagccctctcggtggtgacctggaataaagacattgtcactaaaatcacccccgagggggccgaagagtggagtctgaccttttgggacagcggtg

SEQ ID NO: 7618 - DNA, 140 bp, Artificial Sequence
  Synthetic
caccgctgtcccaaaaggtcagactccactcttcggccccctcgggggtgattttagtgacaatgtctttattccaggtcaccaccgagagggctgtacgggctccttcattagctcctccatatcagcagccagggcct

SEQ ID NO: 7619 - DNA, 140 bp, Artificial Sequence
  Synthetic
atacgccatgctgggtctccaactcccctctggtcccgcgtaatgctgaacttggggaccgacaaggaaaaattcacatcccgtttccgctggcaaatgtaacatgcagggtgcctaaagcgtacttgggagtcggccat

SEQ ID NO: 7620 - DNA, 140 bp, Artificial Sequence
  Synthetic
atggccgactcccaagtacgctttaggcaccctgcatgttacatttgccagcggaaacgggatgtgaatttttccttgtcggtccccaagttcagcattacgcgggaccagaggggagttggagacccagcatggcgtat

SEQ ID NO: 7621 - DNA, 140 bp, Artificial Sequence
  Synthetic
aggccctggctgctgatatgcgcatgcttgaggacaacgtcatgagacctgggtactatcagctgctacaagcatccttaacatgttctccccaccgccagcgacgcagcaccaaggacagaccttttgggacagcggtg

SEQ ID NO: 7622 - DNA, 140 bp, Artificial Sequence
  Synthetic
caccgctgtcccaaaaggtctgtccttggtgctgcgtcgctggcggtggggagaacatgttaaggatgcttgtagcagctgatagtacccaggtctcatgacgttgtcctcaagcatgcgcatatcagcagccagggcct

SEQ ID NO: 7623 - DNA, 140 bp, Artificial Sequence
  Synthetic
aggccctggctgctgatatgtattggccgcagttatctacaaacggtacagcccatggccacccgcatgagataattctgtattattatgagctgtaccctactatgactgtagtagttggaccttttgggacagcggtg

SEQ ID NO: 7624 - DNA, 140 bp, Artificial Sequence
  Synthetic
caccgctgtcccaaaaggtccaactactacagtcatagtagggtacagctcataataatacagaattatctcatgcgggtggccatgggctgtaccgtttgtagataactgcggccaatacatatcagcagccagggcct

SEQ ID NO: 7625 - DNA, 140 bp, Artificial Sequence
  Synthetic
aggccctggctgctgatatgatgttcggattcaaccccgaggcagcatccattctagaaagaaagtatccatttacaaaagggaagtggaacatcaacaagcagatctgcgtgactaccagaccttttgggacagcggtg

SEQ ID NO: 7626 - DNA, 140 bp, Artificial Sequence
  Synthetic
caccgctgtcccaaaaggtctggtagtcacgcagatctgcttgttgatgttccacttcccttttgtaaatggatactttctttctagaatggatgctgcctcggggttgaatccgaacatcatatcagcagccagggcct

SEQ ID NO: 7627 - DNA, 140 bp, Artificial Sequence
  Synthetic
aggccctggctgctgatatgaaatgaagcgacagacgggacgctgaaaatccaggtctccttgcaaatcggaataaagacggatgacagccacgattggaccaagctgcgttatatggacgaccttttgggacagcggtg

SEQ ID NO: 7628 - DNA, 140 bp, Artificial Sequence
  Synthetic
caccgctgtcccaaaaggtcgtccatataacgcagcttggtccaatcgtggctgtcatccgtctttattccgatttgcaaggagacctggattttcagcgtcccgtctgtcgcttcatttcatatcagcagccagggcct

SEQ ID NO: 7629 - DNA, 140 bp, Artificial Sequence
  Synthetic
atacgccatgctgggtctccagcaccgtgtacgattactggaacaatgggacacttcatcctggcccgatgtccaaaaggggaaactctgacggtgggattcactgacagtaggaagattcgtacttgggagtcggccat

SEQ ID NO: 7630 - DNA, 140 bp, Artificial Sequence
  Synthetic
atggccgactcccaagtacgaatcttcctactgtcagtgaatcccaccgtcagagtttccccttttggacatcgggccaggatgaagtgtcccattgttccagtaatcgtacacggtgctggagacccagcatggcgtat

SEQ ID NO: 7631 - DNA, 140 bp, Artificial Sequence
  Synthetic
aggccctggctgctgatatgtctatgcaactgtctgagactcttaccatgctgctgtaaaacgttggcttttttagccgtaatgagcgtcggtgcccacactgtgagcgcgtacgaacacgaccttttgggacagcggtg

SEQ ID NO: 7632 - DNA, 140 bp, Artificial Sequence
  Synthetic
caccgctgtcccaaaaggtcgtgttcgtacgcgctcacagtgtgggcaccgacgctcattacggctaaaaaagccaacgttttacagcagcatggtaagagtctcagacagttgcatagacatatcagcagccagggcct

SEQ ID NO: 7633 - DNA, 140 bp, Artificial Sequence
  Synthetic
aggccctggctgctgatatggttgatcaatgtcatgccgcggtcaccaatcacaaaaagtggcagtataactcccctctggtcccgcgtaatgctgaacttggggaccgaaaaggaaaaagaccttttgggacagcggtg

SEQ ID NO: 7634 - DNA, 140 bp, Artificial Sequence
  Synthetic
caccgctgtcccaaaaggtctttttccttttcggtccccaagttcagcattacgcgggaccagaggggagttatactgccactttttgtgattggtgaccgcggcatgacattgatcaaccatatcagcagccagggcct

SEQ ID NO: 7635 - DNA, 140 bp, Artificial Sequence
  Synthetic
aggccctggctgctgatatgctcccctctggtcccgcgtaatgctgaacttggggaccgaaaaggaaaaattcacatcccgtttccgctggcaaatgtaacatgcagggtgcctaaagcagaccttttgggacagcggtg

SEQ ID NO: 7636 - DNA, 140 bp, Artificial Sequence
  Synthetic
caccgctgtcccaaaaggtctgctttaggcaccctgcatgttacatttgccagcggaaacgggatgtgaatttttccttttcggtccccaagttcagcattacgcgggaccagaggggagcatatcagcagccagggcct

SEQ ID NO: 7637 - DNA, 140 bp, Artificial Sequence
  Synthetic
aggccctggctgctgatatgactgccgcgacaaagaatgggagaagaaaatatctgaggccatacagatgcggacccaagtggagctgctggatgagcacatctccatagactgcgatgtgaccttttgggacagcggtg

SEQ ID NO: 7638 - DNA, 140 bp, Artificial Sequence
  Synthetic
caccgctgtcccaaaaggtcacatcgcagtctatggagatgtgctcatccagcagctccacttgggtccgcatctgtatggcctcagatattttcttctcccattctttgtcgcggcagtcatatcagcagccagggcct

SEQ ID NO: 7639 - DNA, 140 bp, Artificial Sequence
  Synthetic
aggccctggctgctgatatgtggactacccgccctttggcgcaggaagaccaggacaatttggcgatatccaaagtcgcacacctgagagtaaagacgtctatgctaatacacaactggtgaccttttgggacagcggtg

SEQ ID NO: 7640 - DNA, 140 bp, Artificial Sequence
  Synthetic
caccgctgtcccaaaaggtcaccagttgtgtattagcatagacgtctttactctcaggtgtgcgactttggatatcgccaaattgtcctggtcttcctgcgccaaagggcgggtagtccacatatcagcagccagggcct

SEQ ID NO: 7641 - DNA, 140 bp, Artificial Sequence
  Synthetic
aggccctggctgctgatatgacggcagtggatatggcagagatatatactatgtggccaaagcaaacagaggccaacgagcaagtttgcctatatgccctgggggaaagtattgaatcgagaccttttgggacagcggtg

SEQ ID NO: 7642 - DNA, 140 bp, Artificial Sequence
  Synthetic
caccgctgtcccaaaaggtctcgattcaatactttcccccagggcatataggcaaacttgctcgttggcctctgtttgctttggccacatagtatatatctctgccatatccactgccgtcatatcagcagccagggcct

SEQ ID NO: 7643 - DNA, 140 bp, Artificial Sequence
  Synthetic
atacgccatgctgggtctcctaattctgtattattatgagctgtaccccactatgactgtagtagttgtgtcagtggccacgttcatactcctgtcgatggtgggtatggcagcggggatcgtacttgggagtcggccat

SEQ ID NO: 7644 - DNA, 140 bp, Artificial Sequence
  Synthetic
atggccgactcccaagtacgatccccgctgccatacccaccatcgacaggagtatgaacgtggccactgacacaactactacagtcatagtggggtacagctcataataatacagaattaggagacccagcatggcgtat

SEQ ID NO: 7645 - DNA, 140 bp, Artificial Sequence
  Synthetic
aggccctggctgctgatatgcatctggctttaagtattggctaaaagaacgcggggcgtcactgcagcacacagcaccatttggctgccaaatagcaacaaacccggtaagagcggtgaagaccttttgggacagcggtg

SEQ ID NO: 7646 - DNA, 140 bp, Artificial Sequence
  Synthetic
caccgctgtcccaaaaggtcttcaccgctcttaccgggtttgttgctatttggcagccaaatggtgctgtgtgctgcagtgacgccccgcgttcttttagccaatacttaaagccagatgcatatcagcagccagggcct

SEQ ID NO: 7647 - DNA, 140 bp, Artificial Sequence
  Synthetic
aggccctggctgctgatatgactgcagagaccggctgtgggtacggtacacgtgccatactctcaggcaccatctggctttaagtattggctaaaagaacgcggggcgtcactgcagcacgaccttttgggacagcggtg

SEQ ID NO: 7648 - DNA, 140 bp, Artificial Sequence
  Synthetic
caccgctgtcccaaaaggtcgtgctgcagtgacgccccgcgttcttttagccaatacttaaagccagatggtgcctgagagtatggcacgtgtaccgtacccacagccggtctctgcagtcatatcagcagccagggcct

SEQ ID NO: 7649 - DNA, 140 bp, Artificial Sequence
  Synthetic
aggccctggctgctgatatgaacagtgatcccgaacacggtgggagtaccgtataagactctagtcaatagacctggctacagccccatggtattggagatggaactactgtcagtcactgaccttttgggacagcggtg

SEQ ID NO: 7650 - DNA, 140 bp, Artificial Sequence
  Synthetic
caccgctgtcccaaaaggtcagtgactgacagtagttccatctccaataccatggggctgtagccaggtctattgactagagtcttatacggtactcccaccgtgttcgggatcactgttcatatcagcagccagggcct

SEQ ID NO: 7651 - DNA, 140 bp, Artificial Sequence
  Synthetic
atacgccatgctgggtctccgacctggctacagccccatggtattggagatggaactactgtcagtcactttggagccaacactatcgcttgattacatcacgtgcgagtacaaaaccgtcgtacttgggagtcggccat

SEQ ID NO: 7652 - DNA, 140 bp, Artificial Sequence
  Synthetic
atggccgactcccaagtacgacggttttgtactcgcacgtgatgtaatcaagcgatagtgttggctccaaagtgactgacagtagttccatctccaataccatggggctgtagccaggtcggagacccagcatggcgtat

SEQ ID NO: 7653 - DNA, 140 bp, Artificial Sequence
  Synthetic
aggccctggctgctgatatgttggagccaacactatcgcttgattacatcacgtgcgagtacaaaaccgtcatcccgtctccgtacgtgaagtgctgcggtacagcagagtgcaaggacagaccttttgggacagcggtg

SEQ ID NO: 7654 - DNA, 140 bp, Artificial Sequence
  Synthetic
caccgctgtcccaaaaggtctgtccttgcactctgctgtaccgcagcacttcacgtacggagacgggatgacggttttgtactcgcacgtgatgtaatcaagcgatagtgttggctccaacatatcagcagccagggcct

SEQ ID NO: 7655 - DNA, 140 bp, Artificial Sequence
  Synthetic
atacgccatgctgggtctcctgttgctgttgccgcactgattctaatcgtggtgctatgcgtgtcgttcagcaggcactaacttgacaattaagtatgaaggcatatgtgtcccctaagacgtacttgggagtcggccat

SEQ ID NO: 7656 - DNA, 140 bp, Artificial Sequence
  Synthetic
atggccgactcccaagtacgtcttaggggacacatatgccttcatacttaattgtcaagttagtgcctgctgaacgacacgcatagcaccacgattagaatcagtgcggcaacagcaacaggagacccagcatggcgtat

SEQ ID NO: 7657 - DNA, 140 bp, Artificial Sequence
  Synthetic
aggccctggctgctgatatgacggaactgagtcacccgccgatctccttcggtgcaccaagcgagacgttccccatcacatttggggacttcaacgaaggagaaatcgaaagcttgtcttgaccttttgggacagcggtg

SEQ ID NO: 7658 - DNA, 140 bp, Artificial Sequence
  Synthetic
caccgctgtcccaaaaggtcaagacaagctttcgatttctccttcgttgaagtccccaaatgtgatggggaacgtctcgcttggtgcaccgaaggagatcggcgggtgactcagttccgtcatatcagcagccagggcct

SEQ ID NO: 7659 - DNA, 140 bp, Artificial Sequence
  Synthetic
aggccctggctgctgatatgcaaggaaataacatcactgtaactgcctatgcaaacggcgaccatgccgtcacagttaaggacgccaaattcattgtggggccaatgtcttcagcctggagaccttttgggacagcggtg

SEQ ID NO: 7660 - DNA, 140 bp, Artificial Sequence
  Synthetic
caccgctgtcccaaaaggtctccaggctgaagacattggccccacaatgaatttggcgtccttaactgtgacggcatggtcgccgtttgcataggcagttacagtgatgttatttccttgcatatcagcagccagggcct

SEQ ID NO: 7661 - DNA, 140 bp, Artificial Sequence
  Synthetic
aggccctggctgctgatatgaagtcgcacacctgagagtaaagacgtctatgctaatacacaactggtactgcagagaccggctgtgggtacggtacacgtgccatactctcaggcaccagaccttttgggacagcggtg

SEQ ID NO: 7662 - DNA, 140 bp, Artificial Sequence
  Synthetic
caccgctgtcccaaaaggtctggtgcctgagagtatggcacgtgtaccgtacccacagccggtctctgcagtaccagttgtgtattagcatagacgtctttactctcaggtgtgcgacttcatatcagcagccagggcct

SEQ ID NO: 7663 - DNA, 140 bp, Artificial Sequence
  Synthetic
atacgccatgctgggtctccgcaactactacttaagaaactccaggagagtgcatccatggccaacagaagcaggtatcagtcgcgcaaagtagaaaacatgaaagcaacaatcatccagcgtacttgggagtcggccat

SEQ ID NO: 7664 - DNA, 140 bp, Artificial Sequence
  Synthetic
atggccgactcccaagtacgctggatgattgttgctttcatgttttctactttgcgcgactgatacctgcttctgttggccatggatgcactctcctggagtttcttaagtagtagttgcggagacccagcatggcgtat

SEQ ID NO: 7665 - DNA, 140 bp, Artificial Sequence
  Synthetic
atacgccatgctgggtctcccaggtcacaccgaatgaccatgccaatgctagagcattctcgcatctagctataaaactaatagagcaggaaattgatcccgactcaaccatcctggacacgtacttgggagtcggccat

SEQ ID NO: 7666 - DNA, 140 bp, Artificial Sequence
  Synthetic
atggccgactcccaagtacgtgtccaggatggttgagtcgggatcaatttcctgctctattagttttatagctagatgcgagaatgctctagcattggcatggtcattcggtgtgacctgggagacccagcatggcgtat

SEQ ID NO: 7667 - DNA, 140 bp, Artificial Sequence
  Synthetic
atacgccatgctgggtctccaaattaaatgaataccataattggcaaacggaagagatgtaggtacttaagcttcctaaaagcagccgaactcactttgagaagtaggcgtagcataccgcgtacttgggagtcggccat

SEQ ID NO: 7668 - DNA, 140 bp, Artificial Sequence
  Synthetic
atggccgactcccaagtacgcggtatgctacgcctacttctcaaagtgagttcggctgcttttaggaagcttaagtacctacatctcttccgtttgccaattatggtattcatttaatttggagacccagcatggcgtat

SEQ ID NO: 7669 - DNA, 140 bp, Artificial Sequence
  Synthetic
aggccctggctgctgatatggcgccgtagggaacatgcccatctccatcgacataccggaagcggccttcactagggtcgtcgacgcgccctctttaacggacatgtcgtgcgaggtaccgaccttttgggacagcggtg

SEQ ID NO: 7670 - DNA, 140 bp, Artificial Sequence
  Synthetic
caccgctgtcccaaaaggtcggtacctcgcacgacatgtccgttaaagagggcgcgtcgacgaccctagtgaaggccgcttccggtatgtcgatggagatgggcatgttccctacggcgccatatcagcagccagggcct

SEQ ID NO: 7671 - DNA, 140 bp, Artificial Sequence
  Synthetic
atacgccatgctgggtctccgaaaaatcggagatctacaagcagtaatggccgtaccagacgcagaaacgcccacattctgcttgcacactgacgtctcatgtagacaaagggcggacgtcgtacttgggagtcggccat

SEQ ID NO: 7672 - DNA, 140 bp, Artificial Sequence
  Synthetic
atggccgactcccaagtacgacgtccgccctttgtctacatgagacgtcagtgtgcaagcagaatgtgggcgtttctgcgtctggtacggccattactgcttgtagatctccgatttttcggagacccagcatggcgtat

SEQ ID NO: 7673 - DNA, 140 bp, Artificial Sequence
  Synthetic
aggccctggctgctgatatgcccacattctgcttgcacactgacgtctcatgtagacaaagggcggacgtcgctatataccaggacgtttacgccgtgcatgcaccaacatcgctataccgaccttttgggacagcggtg

SEQ ID NO: 7674 - DNA, 140 bp, Artificial Sequence
  Synthetic
caccgctgtcccaaaaggtcggtatagcgatgttggtgcatgcacggcgtaaacgtcctggtatatagcgacgtccgccctttgtctacatgagacgtcagtgtgcaagcagaatgtgggcatatcagcagccagggcct

SEQ ID NO: 7675 - DNA, 140 bp, Artificial Sequence
  Synthetic
atacgccatgctgggtctcctgatgcatatctagacatggtggacgggtcggagagttgtctggaccgggcgacgttcaatccgtcaaaacttaggagctacccaaaacagcacgcttaccgtacttgggagtcggccat

SEQ ID NO: 7676 - DNA, 140 bp, Artificial Sequence
  Synthetic
atggccgactcccaagtacggtaagcgtgctgttttgggtagctcctaagttttgacggattgaacgtcgcccggtccagacaactctccgacccgtccaccatgtctagatatgcatcaggagacccagcatggcgtat

SEQ ID NO: 7677 - DNA, 140 bp, Artificial Sequence
  Synthetic
aggccctggctgctgatatgaccccgttcatgtataatgccatggcaggtgcatacccctcgtactcgacaaactgggcagatgagcaggtgctgaaggcaaagaacataggattatgctgaccttttgggacagcggtg

SEQ ID NO: 7678 - DNA, 140 bp, Artificial Sequence
  Synthetic
caccgctgtcccaaaaggtcagcataatcctatgttctttgccttcagcacctgctcatctgcccagtttgtcgagtacgaggggtatgcacctgccatggcattatacatgaacggggtcatatcagcagccagggcct

SEQ ID NO: 7679 - DNA, 140 bp, Artificial Sequence
  Synthetic
aggccctggctgctgatatgcagccagcaagaaaggcaagtgtgcggtgcattcgatgactaacgccgtcactattcgggaagctgagatagaagttgaagggaattctcagctgcaaatgaccttttgggacagcggtg

SEQ ID NO: 7680 - DNA, 140 bp, Artificial Sequence
  Synthetic
caccgctgtcccaaaaggtcatttgcagctgagaattcccttcaacttctatctcagcttcccgaatagtgacggcgttagtcatcgaatgcaccgcacacttgcctttcttgctggctgcatatcagcagccagggcct

SEQ ID NO: 7681 - DNA, 140 bp, Artificial Sequence
  Synthetic
aggccctggctgctgatatgtcgtgtgaaggctatgtcgttaagagaataacgattagcccgggcctctacggtaaaaccacagggtacgcagtaacccaccatgcagacggattcataagaccttttgggacagcggtg

SEQ ID NO: 7682 - DNA, 140 bp, Artificial Sequence
  Synthetic
caccgctgtcccaaaaggtcttatgaatccgtctgcatggtgggttactgcgtaccctgtggttttaccgtagaggcccgggctaatcgttattctcttaacgacatagccttcacacgacatatcagcagccagggcct

SEQ ID NO: 7683 - DNA, 140 bp, Artificial Sequence
  Synthetic
aggccctggctgctgatatgactattcgggaagctgagatagaagttgaagggaattctcagctgcaaatctctttctcgacggccttagccagcgccgaattccgcgtacaagtctgttgaccttttgggacagcggtg

SEQ ID NO: 7684 - DNA, 140 bp, Artificial Sequence
  Synthetic
caccgctgtcccaaaaggtcaacagacttgtacgcggaattcggcgctggctaaggccgtcgagaaagagatttgcagctgagaattcccttcaacttctatctcagcttcccgaatagtcatatcagcagccagggcct

SEQ ID NO: 7685 - DNA, 140 bp, Artificial Sequence
  Synthetic
atacgccatgctgggtctccaattacttgcttcctgtggtagcccaagccttcagtaagtgggcaaaggaatgccggaaagatatggaagatgaaaaacttttgggcatcagagaaaggacgtacttgggagtcggccat

SEQ ID NO: 7686 - DNA, 140 bp, Artificial Sequence
  Synthetic
atggccgactcccaagtacgtcctttctctgatgcccaaaagtttttcatcttccatatctttccggcattcctttgcccacttactgaaggcttgggctaccacaggaagcaagtaattggagacccagcatggcgtat

SEQ ID NO: 7687 - DNA, 140 bp, Artificial Sequence
  Synthetic
aggccctggctgctgatatgatgccggaaagatatggaagatgaaaaacttttgggcatcagagaaaggacactgacatgctgctgcctttgggcgtttaagaagcagaagacacacacggaccttttgggacagcggtg

SEQ ID NO: 7688 - DNA, 140 bp, Artificial Sequence
  Synthetic
caccgctgtcccaaaaggtccgtgtgtgtcttctgcttcttaaacgcccaaaggcagcagcatgtcagtgtcctttctctgatgcccaaaagtttttcatcttccatatctttccggcatcatatcagcagccagggcct

SEQ ID NO: 7689 - DNA, 140 bp, Artificial Sequence
  Synthetic
aggccctggctgctgatatgcataaataggtatacgtgtcccctaagagacacattgtatgtaggtgataagtatagatcaaagggccgaataacccctgaatagtaacaaaatatgaaagaccttttgggacagcggtg

SEQ ID NO: 7690 - DNA, 140 bp, Artificial Sequence
  Synthetic
caccgctgtcccaaaaggtctttcatattttgttactattcaggggttattcggccctttgatctatacttatcacctacatacaatgtgtctcttaggggacacgtatacctatttatgcatatcagcagccagggcct

SEQ ID NO: 7691 - DNA, 140 bp, Artificial Sequence
  Synthetic
atacgccatgctgggtctccagaagaagaacgagaagcggagctaactcgcgaggcactaccaccactacaggcggcacaggatgacgtccaggtcgaaattgacgtggaacagctcgaacgtacttgggagtcggccat

SEQ ID NO: 7692 - DNA, 140 bp, Artificial Sequence
  Synthetic
atggccgactcccaagtacgttcgagctgttccacgtcaatttcgacctggacgtcatcctgtgccgcctgtagtggtggtagtgcctcgcgagttagctccgcttctcgttcttcttctggagacccagcatggcgtat

SEQ ID NO: 7693 - DNA, 140 bp, Artificial Sequence
  Synthetic
aggccctggctgctgatatgaaatcaataaaaatcataaaatagaaaaaccataaacagaagtagttcaaagggctataaaacccctgaatagtaacaaaacataaaattaataaaaatcgaccttttgggacagcggtg

SEQ ID NO: 7694 - DNA, 140 bp, Artificial Sequence
  Synthetic
caccgctgtcccaaaaggtcgatttttattaattttatgttttgttactattcaggggttttatagccctttgaactacttctgtttatggtttttctattttatgatttttattgatttcatatcagcagccagggcct

SEQ ID NO: 7695 - DNA, 140 bp, Artificial Sequence
  Synthetic
atacgccatgctgggtctccgacagagctggggcaggaataattgaaactccaagaggagccatcaaagtcactgcccaaccaacagaccacgtcgtgggagagtacttggtactttccccgtacttgggagtcggccat

SEQ ID NO: 7696 - DNA, 140 bp, Artificial Sequence
  Synthetic
atggccgactcccaagtacggggaaagtaccaagtactctcccacgacgtggtctgttggttgggcagtgactttgatggctcctcttggagtttcaattattcctgccccagctctgtcggagacccagcatggcgtat

SEQ ID NO: 7697 - DNA, 140 bp, Artificial Sequence
  Synthetic
aggccctggctgctgatatgcactgcccaaccaacagaccacgtcgtgggagagtacttggtactttccccgcagaccgtgttacgaagccaaaagctcagcctgatccacgcattggcggaccttttgggacagcggtg

SEQ ID NO: 7698 - DNA, 140 bp, Artificial Sequence
  Synthetic
caccgctgtcccaaaaggtccgccaatgcgtggatcaggctgagcttttggcttcgtaacacggtctgcggggaaagtaccaagtactctcccacgacgtggtctgttggttgggcagtgcatatcagcagccagggcct

SEQ ID NO: 7699 - DNA, 140 bp, Artificial Sequence
  Synthetic
aggccctggctgctgatatgagggcagagaggacagaacacgagtacgtctacgacgtggatcagagaagatgctgtaagaaggaagaagccgcaggactggtactggcgggcgacttgagaccttttgggacagcggtg

SEQ ID NO: 7700 - DNA, 140 bp, Artificial Sequence
  Synthetic
caccgctgtcccaaaaggtctcaagtcgcccgccagtaccagtcctgcggcttcttccttcttacagcatcttctctgatccacgtcgtagacgtactcgtgttctgtcctctctgccctcatatcagcagccagggcct

SEQ ID NO: 7701 - DNA, 140 bp, Artificial Sequence
  Synthetic
atacgccatgctgggtctccgaacaagtgaagacatgcacacacagcggacgagcaggaaggtacgcggtcgaagcatacgacggcagaatccttgtgccctcaggctatgcaatatcaccgtacttgggagtcggccat

SEQ ID NO: 7702 - DNA, 140 bp, Artificial Sequence
  Synthetic
atggccgactcccaagtacggtgatattgcatagcctgagggcacaaggattctgccgtcgtatgcttcgaccgcgtaccttcctgctcgtccgctgtgtgtgcatgtcttcacttgttcggagacccagcatggcgtat

SEQ ID NO: 7703 - DNA, 140 bp, Artificial Sequence
  Synthetic
aggccctggctgctgatatgcgaagcatacgacggcagaatccttgtgccctcaggctatgcaatatcacctgaagacttccagagcctgagcgaaagtgcgacgatggtgtataatgaagaccttttgggacagcggtg

SEQ ID NO: 7704 - DNA, 140 bp, Artificial Sequence
  Synthetic
caccgctgtcccaaaaggtcttcattatacaccatcgtcgcactttcgctcaggctctggaagtcttcaggtgatattgcatagcctgagggcacaaggattctgccgtcgtatgcttcgcatatcagcagccagggcct

SEQ ID NO: 7705 - DNA, 140 bp, Artificial Sequence
  Synthetic
atacgccatgctgggtctccaattgatgagttggagaaagcggtacactccaggtatgaagtgcagggtatatcagttgtggtaatgtccatggccacctttgcaagctccagatccaaccgtacttgggagtcggccat

SEQ ID NO: 7706 - DNA, 140 bp, Artificial Sequence
  Synthetic
atggccgactcccaagtacggttggatctggagcttgcaaaggtggccatggacattaccacaactgatataccctgcacttcatacctggagtgtaccgctttctccaactcatcaattggagacccagcatggcgtat

SEQ ID NO: 7707 - DNA, 140 bp, Artificial Sequence
  Synthetic
atacgccatgctgggtctccagcatgagtacgtctatgatgtggaccaaagaaggtgctgcaagaaagaggaggcagccgggctggtactggtcggtgacttgaccaacccgccctaccacgtacttgggagtcggccat

SEQ ID NO: 7708 - DNA, 140 bp, Artificial Sequence
  Synthetic
atggccgactcccaagtacgtggtagggcgggttggtcaagtcaccgaccagtaccagcccggctgcctcctctttcttgcagcaccttctttggtccacatcatagacgtactcatgctggagacccagcatggcgtat

SEQ ID NO: 7709 - DNA, 140 bp, Artificial Sequence
  Synthetic
aggccctggctgctgatatgctatttaaactgggcaaaccgctagcggcaggtgacgaacaagatgaggatagaagacgagcgctggctgacgaagggtcagatggcaacgaacagggctgaccttttgggacagcggtg

SEQ ID NO: 7710 - DNA, 140 bp, Artificial Sequence
  Synthetic
caccgctgtcccaaaaggtcagccctgttcgttgccatctgacccttcgtcagccagcgctcgtcttctatcctcatcttgttcgtcacctgccgctagcggtttgcccagtttaaatagcatatcagcagccagggcct

SEQ ID NO: 7711 - DNA, 140 bp, Artificial Sequence
  Synthetic
aggccctggctgctgatatggcaggaatcggaagaataagaagcaaaagcaaaagcaacaggcgccacaaaacaacacaaaccaaaagaagcagccacctaaaaagaagccgggccgcaggaccttttgggacagcggtg

SEQ ID NO: 7712 - DNA, 140 bp, Artificial Sequence
  Synthetic
caccgctgtcccaaaaggtcctgcggcccggcttctttttaggtggctgcttcttttggtttgtgttgttttgtggcgcctgttgcttttgcttttgcttcttattcttccgattcctgccatatcagcagccagggcct

SEQ ID NO: 7713 - DNA, 140 bp, Artificial Sequence
  Synthetic
atacgccatgctgggtctccattaagaacctggttaccaggcaagacctcgtgaccagtggaaagaaagaaaattgccaagaaatctccactgatgtgatgcgacagaggaacctggagacgtacttgggagtcggccat

SEQ ID NO: 7714 - DNA, 140 bp, Artificial Sequence
  Synthetic
atggccgactcccaagtacgtctccaggttcctctgtcgcatcacatcagtggagatttcttggcaattttctttctttccactggtcacgaggtcttgcctggtaaccaggttcttaatggagacccagcatggcgtat

SEQ ID NO: 7715 - DNA, 140 bp, Artificial Sequence
  Synthetic
aggccctggctgctgatatgaaattgccaagaaatctccactgatgtgatgcgacagaggaacctggagatatctgcacgcacggtcgactcactgctcttgaacggatgcaacagaccagaccttttgggacagcggtg

SEQ ID NO: 7716 - DNA, 140 bp, Artificial Sequence
  Synthetic
caccgctgtcccaaaaggtctggtctgttgcatccgttcaagagcagtgagtcgaccgtgcgtgcagatatctccaggttcctctgtcgcatcacatcagtggagatttcttggcaatttcatatcagcagccagggcct

SEQ ID NO: 7717 - DNA, 140 bp, Artificial Sequence
  Synthetic
atacgccatgctgggtctccaaaccagcacacgtaaaggggaccatcgataacgcggacctggccaaattggcctttaagcggtcatctaagtacgaccttgaatgcgcgcagatacccgcgtacttgggagtcggccat

SEQ ID NO: 7718 - DNA, 140 bp, Artificial Sequence
  Synthetic
atggccgactcccaagtacgcgggtatctgcgcgcattcaaggtcgtacttagatgaccgcttaaaggccaatttggccaggtccgcgttatcgatggtcccctttacgtgtgctggtttggagacccagcatggcgtat

SEQ ID NO: 7719 - DNA, 140 bp, Artificial Sequence
  Synthetic
atacgccatgctgggtctccgtcgacgtgttgtacgtcgacgaagcgtttgcgtgccattctggcacgctacttgctctgatagccttggtgagaccgaggcagaaagtcgtgctatgcgcgtacttgggagtcggccat

SEQ ID NO: 7720 - DNA, 140 bp, Artificial Sequence
  Synthetic
atggccgactcccaagtacgcgcatagcacgactttctgcctcggtctcaccaaggctatcagagcaagtagcgtgccagaatggcacgcaaacgcttcgtcgacgtacaacacgtcgacggagacccagcatggcgtat

SEQ ID NO: 7721 - DNA, 140 bp, Artificial Sequence
  Synthetic
aggccctggctgctgatatgacttgctctgatagccttggtgagaccgaggcagaaagtcgtgctatgcggtgatccgaaacagtgcggcttcttcaatatgatgcagatgaaagttaacgaccttttgggacagcggtg

SEQ ID NO: 7722 - DNA, 140 bp, Artificial Sequence
  Synthetic
caccgctgtcccaaaaggtcgttaactttcatctgcatcatattgaagaagccgcactgtttcggatcaccgcatagcacgactttctgcctcggtctcaccaaggctatcagagcaagtcatatcagcagccagggcct

SEQ ID NO: 7723 - DNA, 140 bp, Artificial Sequence
  Synthetic
aggccctggctgctgatatgtactacaactggcaccacggagcagtacagtactcaggaggccggttcaccatccctacaggtgcgggcaaaccaggggacagcggtagaccgatcttcggaccttttgggacagcggtg

SEQ ID NO: 7724 - DNA, 140 bp, Artificial Sequence
  Synthetic
caccgctgtcccaaaaggtccgaagatcggtctaccgctgtcccctggtttgcccgcacctgtagggatggtgaaccggcctcctgagtactgtactgctccgtggtgccagttgtagtacatatcagcagccagggcct

SEQ ID NO: 7725 - DNA, 140 bp, Artificial Sequence
  Synthetic
aggccctggctgctgatatgggcctttaagcggtcatctaagtacgaccttgaatgcgcgcagatacccgtgcacatgaagtccgacgcttcgaagttcacccatgagaaaccggagggggaccttttgggacagcggtg

SEQ ID NO: 7726 - DNA, 140 bp, Artificial Sequence
  Synthetic
caccgctgtcccaaaaggtccccctccggtttctcatgggtgaacttcgaagcgtcggacttcatgtgcacgggtatctgcgcgcattcaaggtcgtacttagatgaccgcttaaaggcccatatcagcagccagggcct

SEQ ID NO: 7727 - DNA, 140 bp, Artificial Sequence
  Synthetic
atacgccatgctgggtctccgtgatccgaaacagtgcggcttcttcaatatgatgcagatgaaagttaactacaaccataacatctgcacccaggtgtaccataaaagtatttccaggcgcgtacttgggagtcggccat

SEQ ID NO: 7728 - DNA, 140 bp, Artificial Sequence
  Synthetic
atggccgactcccaagtacgcgcctggaaatacttttatggtacacctgggtgcagatgttatggttgtagttaactttcatctgcatcatattgaagaagccgcactgtttcggatcacggagacccagcatggcgtat

SEQ ID NO: 7729 - DNA, 140 bp, Artificial Sequence
  Synthetic
atacgccatgctgggtctccgtgggttaagcaactgcaaattgactatcgtggacacgaggtcatgacagcagctgcatcccaggggctaaccagaaaaggggtctatgccgtcaggcaacgtacttgggagtcggccat

SEQ ID NO: 7730 - DNA, 140 bp, Artificial Sequence
  Synthetic
atggccgactcccaagtacgttgcctgacggcatagaccccttttctggttagcccctgggatgcagctgctgtcatgacctcgtgtccacgatagtcaatttgcagttgcttaacccacggagacccagcatggcgtat

SEQ ID NO: 7731 - DNA, 140 bp, Artificial Sequence
  Synthetic
atacgccatgctgggtctccaaagtcaatgaaaaccccctttacgcatcaacatcagagcacgtgaacgtgctgctgacgcgtacggaaggcaaactagtatggaagacactttctggagcgtacttgggagtcggccat

SEQ ID NO: 7732 - DNA, 140 bp, Artificial Sequence
  Synthetic
atggccgactcccaagtacgctccagaaagtgtcttccatactagtttgccttccgtacgcgtcagcagcacgttcacgtgctctgatgttgatgcgtaaagggggttttcattgactttggagacccagcatggcgtat

SEQ ID NO: 7733 - DNA, 140 bp, Artificial Sequence
  Synthetic
aggccctggctgctgatatgcatgcccccagacacccctgatcgcacattaatgtcacaacagtccggcaacgtaaagatcacagtcaatggccagacggtgcggtacaagtgtaattgcgaccttttgggacagcggtg

SEQ ID NO: 7734 - DNA, 140 bp, Artificial Sequence
  Synthetic
caccgctgtcccaaaaggtcgcaattacacttgtaccgcaccgtctggccattgactgtgatctttacgttgccggactgttgtgacattaatgtgcgatcaggggtgtctgggggcatgcatatcagcagccagggcct

SEQ ID NO: 7735 - DNA, 140 bp, Artificial Sequence
  Synthetic
aggccctggctgctgatatgtaaccaccaagtgacctttgacacgttccagaataaagccaatgtctgctgggcgaagagcttagtccccatcctagaaacagcagggataaaactaaacgaccttttgggacagcggtg

SEQ ID NO: 7736 - DNA, 140 bp, Artificial Sequence
  Synthetic
caccgctgtcccaaaaggtcgtttagttttatccctgctgtttctaggatggggactaagctcttcgcccagcagacattggctttattctggaacgtgtcaaaggtcacttggtggttacatatcagcagccagggcct

SEQ ID NO: 7737 - DNA, 140 bp, Artificial Sequence
  Synthetic
atacgccatgctgggtctccgacaggcagtggtcccagataatccaggcttttaaagaagacagagcatactcacccgaggtggccctgaatgagatatgcacgcgcatgtacggggtagcgtacttgggagtcggccat

SEQ ID NO: 7738 - DNA, 140 bp, Artificial Sequence
  Synthetic
atggccgactcccaagtacgctaccccgtacatgcgcgtgcatatctcattcagggccacctcgggtgagtatgctctgtcttctttaaaagcctggattatctgggaccactgcctgtcggagacccagcatggcgtat

SEQ ID NO: 7739 - DNA, 140 bp, Artificial Sequence
  Synthetic
aggccctggctgctgatatgctcacccgaggtggccctgaatgagatatgcacgcgcatgtacggggtagacctggacagcggactgttctctaaaccactggtgtccgtgcattatgcggaccttttgggacagcggtg

SEQ ID NO: 7740 - DNA, 140 bp, Artificial Sequence
  Synthetic
caccgctgtcccaaaaggtccgcataatgcacggacaccagtggtttagagaacagtccgctgtccaggtctaccccgtacatgcgcgtgcatatctcattcagggccacctcgggtgagcatatcagcagccagggcct

SEQ ID NO: 7741 - DNA, 140 bp, Artificial Sequence
  Synthetic
atacgccatgctgggtctccgataatcactgggacaacaggccgggagggaagatgttcggattcaaccccgaagcggtgtccatactggagaggaaatacccgtttacaaaagggaagtcgtacttgggagtcggccat

SEQ ID NO: 7742 - DNA, 140 bp, Artificial Sequence
  Synthetic
atggccgactcccaagtacgacttcccttttgtaaacgggtatttcctctccagtatggacaccgcttcggggttgaatccgaacatcttccctcccggcctgttgtcccagtgattatcggagacccagcatggcgtat

SEQ ID NO: 7743 - DNA, 140 bp, Artificial Sequence
  Synthetic
aggccctggctgctgatatgcgaagcggtgtccatactggagaggaaatacccgtttacaaaagggaagtggaataccaacaagcaaatctgtgtgactactagaaggattgaagattttgaccttttgggacagcggtg

SEQ ID NO: 7744 - DNA, 140 bp, Artificial Sequence
  Synthetic
caccgctgtcccaaaaggtcaaaatcttcaatccttctagtagtcacacagatttgcttgttggtattccacttcccttttgtaaacgggtatttcctctccagtatggacaccgcttcgcatatcagcagccagggcct

SEQ ID NO: 7745 - DNA, 140 bp, Artificial Sequence
  Synthetic
aggccctggctgctgatatgaacccgaacatcaacattatacctgccaacaggagactaccgcattcattggtggccgaacatcgcccggtaaaaggggagaggatggaatggttggtcagaccttttgggacagcggtg

SEQ ID NO: 7746 - DNA, 140 bp, Artificial Sequence
  Synthetic
caccgctgtcccaaaaggtctgaccaaccattccatcctctccccttttaccgggcgatgttcggccaccaatgaatgcggtagtctcctgttggcaggtataatgttgatgttcgggttcatatcagcagccagggcct

SEQ ID NO: 7747 - DNA, 140 bp, Artificial Sequence
  Synthetic
aggccctggctgctgatatgacaaaataaatggccaccatgtgctcctggtcagcggctacaacctcgttctgcccactaagagagtcacctgggtggcgccgctgggcattcggggagcgaccttttgggacagcggtg

SEQ ID NO: 7748 - DNA, 140 bp, Artificial Sequence
  Synthetic
caccgctgtcccaaaaggtcgctccccgaatgcccagcggcgccacccaggtgactctcttagtgggcagaacgaggttgtagccgctgaccaggagcacatggtggccatttattttgtcatatcagcagccagggcct

SEQ ID NO: 7749 - DNA, 140 bp, Artificial Sequence
  Synthetic
aggccctggctgctgatatgctgcccactaagagagtcacctgggtggcgccgctgggcattcggggagctgactacacgtataacctagagttaggcctaccagcaacgctcggtaggtgaccttttgggacagcggtg

SEQ ID NO: 7750 - DNA, 140 bp, Artificial Sequence
  Synthetic
caccgctgtcccaaaaggtcacctaccgagcgttgctggtaggcctaactctaggttatacgtgtagtcagctccccgaatgcccagcggcgccacccaggtgactctcttagtgggcagcatatcagcagccagggcct

SEQ ID NO: 7751 - DNA, 140 bp, Artificial Sequence
  Synthetic
atacgccatgctgggtctcccctgagactgctcaagccgggtggttcattactgatcagggcatacggctacgcagacagaacaagcgaacgagtagtctgcgtactgggacgcaagttccgtacttgggagtcggccat

SEQ ID NO: 7752 - DNA, 140 bp, Artificial Sequence
  Synthetic
atggccgactcccaagtacggaacttgcgtcccagtacgcagactactcgttcgcttgttctgtctgcgtagccgtatgccctgatcagtaatgaaccacccggcttgagcagtctcaggggagacccagcatggcgtat

SEQ ID NO: 7753 - DNA, 140 bp, Artificial Sequence
  Synthetic
atacgccatgctgggtctcccgatcatccagagcgttgaaaccgccgtgcgtcactagtaacaccgagatgtttttcttgttcagcaactttgataacggcagaaggaactttaccacgccgtacttgggagtcggccat

SEQ ID NO: 7754 - DNA, 140 bp, Artificial Sequence
  Synthetic
atggccgactcccaagtacggcgtggtaaagttccttctgccgttatcaaagttgctgaacaagaaaaacatctcggtgttactagtgacgcacggcggtttcaacgctctggatgatcgggagacccagcatggcgtat

SEQ ID NO: 7755 - DNA, 140 bp, Artificial Sequence
  Synthetic
aggccctggctgctgatatgcgcggtcaccaatcacaaaaagtggcagtataactcccctctggtcccgcgtaacgctgaactcggggacccaaaaggaaaaattcacatcccgtttccggaccttttgggacagcggtg

SEQ ID NO: 7756 - DNA, 140 bp, Artificial Sequence
  Synthetic
caccgctgtcccaaaaggtccggaaacgggatgtgaatttttccttttgggtccccgagttcagcgttacgcgggaccagaggggagttatactgccactttttgtgattggtgaccgcgcatatcagcagccagggcct

SEQ ID NO: 7757 - DNA, 140 bp, Artificial Sequence
  Synthetic
atacgccatgctgggtctccacgtaatgaacaaccagctgaatgccgcttttgttggtcaggccacccgagcagggtgtgcaccgtcgtaccgggtcaaacgcatggacatcgcaaagaacgtacttgggagtcggccat

SEQ ID NO: 7758 - DNA, 140 bp, Artificial Sequence
  Synthetic
atggccgactcccaagtacgttctttgcgatgtccatgcgtttgacccggtacgacggtgcacaccctgctcgggtggcctgaccaacaaaagcggcattcagctggttgttcattacgtggagacccagcatggcgtat

SEQ ID NO: 7759 - DNA, 140 bp, Artificial Sequence
  Synthetic
atacgccatgctgggtctccgtaacgctgaactcggggacccaaaaggaaaaattcacatcccgtttccgctggcaaatgtgacatgcagggtgcctaaagcaaggaaccccaccgtgaccgtacttgggagtcggccat

SEQ ID NO: 7760 - DNA, 140 bp, Artificial Sequence
  Synthetic
atggccgactcccaagtacggtcacggtggggttccttgctttaggcaccctgcatgtcacatttgccagcggaaacgggatgtgaatttttccttttgggtccccgagttcagcgttacggagacccagcatggcgtat

SEQ ID NO: 7761 - DNA, 140 bp, Artificial Sequence
  Synthetic
aggccctggctgctgatatggagaccgggagttggcagctgcttaccgagaagtcgctaaggaggtgactagactaggagtaaacagcgtagctataccgctcctttccaccggtgtgtagaccttttgggacagcggtg

SEQ ID NO: 7762 - DNA, 140 bp, Artificial Sequence
  Synthetic
caccgctgtcccaaaaggtctacacaccggtggaaaggagcggtatagctacgctgtttactcctagtctagtcacctccttagcgacttctcggtaagcagctgccaactcccggtctccatatcagcagccagggcct

SEQ ID NO: 7763 - DNA, 140 bp, Artificial Sequence
  Synthetic
aggccctggctgctgatatgatagcataccgaactcttccacgattctccgaacccacagggacgtaggagatgttattttgtttttaatatttcaaaaaaaaaaaaaaaaaaaaaaaaagaccttttgggacagcggtg

SEQ ID NO: 7764 - DNA, 140 bp, Artificial Sequence
  Synthetic
caccgctgtcccaaaaggtctttttttttttttttttttttttttgaaatattaaaaacaaaataacatctcctacgtccctgtgggttcggagaatcgtggaagagttcggtatgctatcatatcagcagccagggcct

SEQ ID NO: 7765 - DNA, 140 bp, Artificial Sequence
  Synthetic
atacgccatgctgggtctccagactaggagtaaacagcgtagctataccgctcctttccaccggtgtgtactctggaggaaaagacaggctgactcagtcattaaaccacctatttacagcgtacttgggagtcggccat

SEQ ID NO: 7766 - DNA, 140 bp, Artificial Sequence
  Synthetic
atggccgactcccaagtacgctgtaaataggtggtttaatgactgagtcagcctgtcttttcctccagagtacacaccggtggaaaggagcggtatagctacgctgtttactcctagtctggagacccagcatggcgtat

SEQ ID NO: 7767 - DNA, 140 bp, Artificial Sequence
  Synthetic
atacgccatgctgggtctccgagctgtaccctactatgactgtagtagttgtgtcagtggcctcgttcatactcctgtcgatggtgggtatggcagtggggatgtgcatgtgtgcacgaccgtacttgggagtcggccat

SEQ ID NO: 7768 - DNA, 140 bp, Artificial Sequence
  Synthetic
atggccgactcccaagtacggtcgtgcacacatgcacatccccactgccatacccaccatcgacaggagtatgaacgaggccactgacacaactactacagtcatagtagggtacagctcggagacccagcatggcgtat

SEQ ID NO: 7769 - DNA, 140 bp, Artificial Sequence
  Synthetic
aggccctggctgctgatatgactcctgtcgatggtgggtatggcagtggggatgtgcatgtgtgcacgacgcagatgcatcacaccatacgaactgacaccaggagctaccgtccctttcgaccttttgggacagcggtg

SEQ ID NO: 7770 - DNA, 140 bp, Artificial Sequence
  Synthetic
caccgctgtcccaaaaggtcgaaagggacggtagctcctggtgtcagttcgtatggtgtgatgcatctgcgtcgtgcacacatgcacatccccactgccatacccaccatcgacaggagtcatatcagcagccagggcct

SEQ ID NO: 7771 - DNA, 140 bp, Artificial Sequence
  Synthetic
aggccctggctgctgatatgaggtcacaccgaatgaccatgctaatgctagagcgttctcgcatctagctataaaactaatagagcaggaaattgatcccgactcaaccatcctggatatgaccttttgggacagcggtg

SEQ ID NO: 7772 - DNA, 140 bp, Artificial Sequence
  Synthetic
caccgctgtcccaaaaggtcatatccaggatggttgagtcgggatcaatttcctgctctattagttttatagctagatgcgagaacgctctagcattagcatggtcattcggtgtgacctcatatcagcagccagggcct

SEQ ID NO: 7773 - DNA, 140 bp, Artificial Sequence
  Synthetic
aggccctggctgctgatatgataaaactaatagagcaggaaattgatcccgactcaaccatcctggatatcggtagtgcgccagcaaggaggatgatgtcggacaggaagtaccactgcggaccttttgggacagcggtg

SEQ ID NO: 7774 - DNA, 140 bp, Artificial Sequence
  Synthetic
caccgctgtcccaaaaggtccgcagtggtacttcctgtccgacatcatcctccttgctggcgcactaccgatatccaggatggttgagtcgggatcaatttcctgctctattagttttatcatatcagcagccagggcct

SEQ ID NO: 7775 - DNA, 140 bp, Artificial Sequence
  Synthetic
aggccctggctgctgatatgtactcctacttggaagggacacggttccatcagacggcagtggacatggcagaagtatacaccatgtggccaaagcagacggaggctaatgaacaagtttgaccttttgggacagcggtg

SEQ ID NO: 7776 - DNA, 140 bp, Artificial Sequence
  Synthetic
caccgctgtcccaaaaggtcaaacttgttcattagcctccgtctgctttggccacatggtgtatacttctgccatgtccactgccgtctgatggaaccgtgtcccttccaagtaggagtacatatcagcagccagggcct

SEQ ID NO: 7777 - DNA, 140 bp, Artificial Sequence
  Synthetic
atacgccatgctgggtctccacagcagtctggcaggtagaaaagggtacagcactacagaaggttcactgtactcctacttggaagggacacggttccatcagacggcagtggacatggccgtacttgggagtcggccat

SEQ ID NO: 7778 - DNA, 140 bp, Artificial Sequence
  Synthetic
atggccgactcccaagtacggccatgtccactgccgtctgatggaaccgtgtcccttccaagtaggagtacagtgaaccttctgtagtgctgtacccttttctacctgccagactgctgtggagacccagcatggcgtat

SEQ ID NO: 7779 - DNA, 140 bp, Artificial Sequence
  Synthetic
aggccctggctgctgatatgagaaagctagcatctgccgcaggaaaagtcctggacagaaacatctctggaaagatcggggacttacaagcagtaatggccgtgccagacacggagacgcgaccttttgggacagcggtg

SEQ ID NO: 7780 - DNA, 140 bp, Artificial Sequence
  Synthetic
caccgctgtcccaaaaggtcgcgtctccgtgtctggcacggccattactgcttgtaagtccccgatctttccagagatgtttctgtccaggacttttcctgcggcagatgctagctttctcatatcagcagccagggcct

SEQ ID NO: 7781 - DNA, 140 bp, Artificial Sequence
  Synthetic
atacgccatgctgggtctcccattagattcaactgatgctgatgtggttatctactgccgtgacaaggagtgggagaagaaaatagccgaggccatacaaatgaggacccaagtggaactcgtacttgggagtcggccat

SEQ ID NO: 7782 - DNA, 140 bp, Artificial Sequence
  Synthetic
atggccgactcccaagtacgagttccacttgggtcctcatttgtatggcctcggctattttcttctcccactccttgtcacggcagtagataaccacatcagcatcagttgaatctaatgggagacccagcatggcgtat

SEQ ID NO: 7783 - DNA, 140 bp, Artificial Sequence
  Synthetic
atacgccatgctgggtctccccgttatgccatgacacccgaacgagtcaccaggcttcgtatgaaccatgtcacaagcataatagtatgctcatcattcccccttccaaagtacaaaatacgtacttgggagtcggccat

SEQ ID NO: 7784 - DNA, 140 bp, Artificial Sequence
  Synthetic
atggccgactcccaagtacgtattttgtactttggaagggggaatgatgagcatactattatgcttgtgacatggttcatacgaagcctggtgactcgttcgggtgtcatggcataacggggagacccagcatggcgtat

SEQ ID NO: 7785 - DNA, 140 bp, Artificial Sequence
  Synthetic
aggccctggctgctgatatgtgggagaagaaaatagccgaggccatacaaatgaggacccaagtggaactgctagacgaacacatctctgtagactgcgatatcatccgagtgcaccctggaccttttgggacagcggtg

SEQ ID NO: 7786 - DNA, 140 bp, Artificial Sequence
  Synthetic
caccgctgtcccaaaaggtccagggtgcactcggatgatatcgcagtctacagagatgtgttcgtctagcagttccacttgggtcctcatttgtatggcctcggctattttcttctcccacatatcagcagccagggcct

SEQ ID NO: 7787 - DNA, 140 bp, Artificial Sequence
  Synthetic
atacgccatgctgggtctccccaggcgattaaaggggtccgagtggcgtactgggtagggtttgacacaaccccgttcatgtacaatgccatggcgggtgcctacccctcatactcgacacgtacttgggagtcggccat

SEQ ID NO: 7788 - DNA, 140 bp, Artificial Sequence
  Synthetic
atggccgactcccaagtacgtgtcgagtatgaggggtaggcacccgccatggcattgtacatgaacggggttgtgtcaaaccctacccagtacgccactcggacccctttaatcgcctggggagacccagcatggcgtat

SEQ ID NO: 7789 - DNA, 140 bp, Artificial Sequence
  Synthetic
atacgccatgctgggtctccgaaggagtgcagaaagtcaagtgctctaaagtgatgctgttcgaccataacgtgccatcacgcgttagtccaagggaatataaatcacctcaggagaccgcgtacttgggagtcggccat

SEQ ID NO: 7790 - DNA, 140 bp, Artificial Sequence
  Synthetic
atggccgactcccaagtacgcggtctcctgaggtgatttatattcccttggactaacgcgtgatggcacgttatggtcgaacagcatcactttagagcacttgactttctgcactccttcggagacccagcatggcgtat

SEQ ID NO: 7791 - DNA, 140 bp, Artificial Sequence
  Synthetic
aggccctggctgctgatatgaattgggcagatgagcaggtactgaaggctaagaacataggattatgttcaacagacctgacggaaggtagacgaggcaaattgtctattatgagaggaagaccttttgggacagcggtg

SEQ ID NO: 7792 - DNA, 140 bp, Artificial Sequence
  Synthetic
caccgctgtcccaaaaggtcttcctctcataatagacaatttgcctcgtctaccttccgtcaggtctgttgaacataatcctatgttcttagccttcagtacctgctcatctgcccaattcatatcagcagccagggcct

SEQ ID NO: 7793 - DNA, 140 bp, Artificial Sequence
  Synthetic
atacgccatgctgggtctcccacaagaagtaagttcgaccacgtcactgacgcacagccaattcgaccttagcgttgacggtgaggaactgcccgctccgtctgacttggaagctgatgccgtacttgggagtcggccat

SEQ ID NO: 7794 - DNA, 140 bp, Artificial Sequence
  Synthetic
atggccgactcccaagtacggcatcagcttccaagtcagacggagcgggcagttcctcaccgtcaacgctaaggtcgaattggctgtgcgtcagtgacgtggtcgaacttacttcttgtgggagacccagcatggcgtat

SEQ ID NO: 7795 - DNA, 140 bp, Artificial Sequence
  Synthetic
aggccctggctgctgatatgagctgtaaggtcttcaccggcgtctacccatttatgtggggcggcgcctactgcttctgcgacgctgaaaacacgcaattgagcgaagcacatgtggagagaccttttgggacagcggtg

SEQ ID NO: 7796 - DNA, 140 bp, Artificial Sequence
  Synthetic
caccgctgtcccaaaaggtctctccacatgtgcttcgctcaattgcgtgttttcagcgtcgcagaagcagtaggcgccgccccacataaatgggtagacgccggtgaagaccttacagctcatatcagcagccagggcct

SEQ ID NO: 7797 - DNA, 140 bp, Artificial Sequence
  Synthetic
atacgccatgctgggtctccccacgattgaaaatttttcggctgtgtcagactgggtaatgaataccgcgccagtcgcaccacccagaagaagacgtgggaaaaacctgaatgtcacctgcgtacttgggagtcggccat

SEQ ID NO: 7798 - DNA, 140 bp, Artificial Sequence
  Synthetic
atggccgactcccaagtacgcaggtgacattcaggtttttcccacgtcttcttctgggtggtgcgactggcgcggtattcattacccagtctgacacagccgaaaaattttcaatcgtggggagacccagcatggcgtat

SEQ ID NO: 7799 - DNA, 140 bp, Artificial Sequence
  Synthetic
atacgccatgctgggtctccccatttaaagggcaagctcagcttcacatgccgctgtgatacagtggtttcgtgcgaaggctacgtcgttaagagaataacgatgagcccaggcctttaccgtacttgggagtcggccat

SEQ ID NO: 7800 - DNA, 140 bp, Artificial Sequence
  Synthetic
atggccgactcccaagtacggtaaaggcctgggctcatcgttattctcttaacgacgtagccttcgcacgaaaccactgtatcacagcggcatgtgaagctgagcttgccctttaaatggggagacccagcatggcgtat

SEQ ID NO: 7801 - DNA, 140 bp, Artificial Sequence
  Synthetic
aggccctggctgctgatatgagcgttgacggtgaggaactgcccgctccgtctgacttggaagctgatgctccaattccggaaccaacaccagacgacagagcggtacttactttgcctcgaccttttgggacagcggtg

SEQ ID NO: 7802 - DNA, 140 bp, Artificial Sequence
  Synthetic
caccgctgtcccaaaaggtcgaggcaaagtaagtaccgctctgtcgtctggtgttggttccggaattggagcatcagcttccaagtcagacggagcgggcagttcctcaccgtcaacgctcatatcagcagccagggcct

SEQ ID NO: 7803 - DNA, 140 bp, Artificial Sequence
  Synthetic
atacgccatgctgggtctccgagcggacctgcactccatcgaacaggaaacggcagagatacgcgatacggctgcgtccctccaggcgcccctgagtgtcgctacagaactaaatcaactcgtacttgggagtcggccat

SEQ ID NO: 7804 - DNA, 140 bp, Artificial Sequence
  Synthetic
atggccgactcccaagtacgagttgatttagttctgtagcgacactcaggggcgcctggagggacgcagccgtatcgcgtatctctgccgtttcctgttcgatggagtgcaggtccgctcggagacccagcatggcgtat

SEQ ID NO: 7805 - DNA, 140 bp, Artificial Sequence
  Synthetic
aggccctggctgctgatatggtgcaagaccaccgacacggttgacggcgaaagagtgtcattctcggtgtgcacgtacgtgccggcgaccatttgtgatcaaatgaccggcatccttgctgaccttttgggacagcggtg

SEQ ID NO: 7806 - DNA, 140 bp, Artificial Sequence
  Synthetic
caccgctgtcccaaaaggtcagcaaggatgccggtcatttgatcacaaatggtcgccggcacgtacgtgcacaccgagaatgacactctttcgccgtcaaccgtgtcggtggtcttgcaccatatcagcagccagggcct

SEQ ID NO: 7807 - DNA, 140 bp, Artificial Sequence
  Synthetic
atacgccatgctgggtctccggtacggtacacgtgccatactctcaggcaccatctggctttaagtattggttaaaagaacgaggggcgtcgctacagcacacagcaccatttggctgcccgtacttgggagtcggccat

SEQ ID NO: 7808 - DNA, 140 bp, Artificial Sequence
  Synthetic
atggccgactcccaagtacgggcagccaaatggtgctgtgtgctgtagcgacgcccctcgttcttttaaccaatacttaaagccagatggtgcctgagagtatggcacgtgtaccgtaccggagacccagcatggcgtat

SEQ ID NO: 7809 - DNA, 140 bp, Artificial Sequence
  Synthetic
aggccctggctgctgatatggagaatagtggttaacggcagaacgcaacggaatacgaacaccatgaaaaactatctgcttcccgtggtcgcccaagccttcagtaagtgggcaaaggaggaccttttgggacagcggtg

SEQ ID NO: 7810 - DNA, 140 bp, Artificial Sequence
  Synthetic
caccgctgtcccaaaaggtcctcctttgcccacttactgaaggcttgggcgaccacgggaagcagatagtttttcatggtgttcgtattccgttgcgttctgccgttaaccactattctccatatcagcagccagggcct

SEQ ID NO: 7811 - DNA, 140 bp, Artificial Sequence
  Synthetic
atacgccatgctgggtctccactttgatgaaggggagattgaaagcttgtcctctgagttactgacctttggggacttctcgccgggcgaagtggatgatctgacagacagcgactggtccgtacttgggagtcggccat

SEQ ID NO: 7812 - DNA, 140 bp, Artificial Sequence
  Synthetic
atggccgactcccaagtacggaccagtcgctgtctgtcagatcatccacttcgcccggcgagaagtccccaaaggtcagtaactcagaggacaagctttcaatctccccttcatcaaagtggagacccagcatggcgtat

SEQ ID NO: 7813 - DNA, 140 bp, Artificial Sequence
  Synthetic
atacgccatgctgggtctccactatctgcttcccgtggtcgcccaagccttcagtaagtgggcaaaggagtgccggaaagacatggaagatgaaaaactcctgggggtcagagaaagaaccgtacttgggagtcggccat

SEQ ID NO: 7814 - DNA, 140 bp, Artificial Sequence
  Synthetic
atggccgactcccaagtacggttctttctctgacccccaggagtttttcatcttccatgtctttccggcactcctttgcccacttactgaaggcttgggcgaccacgggaagcagatagtggagacccagcatggcgtat

SEQ ID NO: 7815 - DNA, 140 bp, Artificial Sequence
  Synthetic
aggccctggctgctgatatgccagtcgcaccacccagaagaagacgtgggaaaaacctgaatgtcacctgcgacgagagagaagggaacgtacttcccatggctagcgttcggtttttcagaccttttgggacagcggtg

SEQ ID NO: 7816 - DNA, 140 bp, Artificial Sequence
  Synthetic
caccgctgtcccaaaaggtctgaaaaaccgaacgctagccatgggaagtacgttcccttctctctcgtcgcaggtgacattcaggtttttcccacgtcttcttctgggtggtgcgactggcatatcagcagccagggcct

SEQ ID NO: 7817 - DNA, 140 bp, Artificial Sequence
  Synthetic
aggccctggctgctgatatggctgcgtccctccaggcgcccctgagtgtcgctacagaactaaatcaactgccgatctcattcggagcaccaaacgagactttccccataacgtttgggggaccttttgggacagcggtg

SEQ ID NO: 7818 - DNA, 140 bp, Artificial Sequence
  Synthetic
caccgctgtcccaaaaggtcccccaaacgttatggggaaagtctcgtttggtgctccgaatgagatcggcagttgatttagttctgtagcgacactcaggggcgcctggagggacgcagccatatcagcagccagggcct

SEQ ID NO: 7819 - DNA, 140 bp, Artificial Sequence
  Synthetic
aggccctggctgctgatatgggggacttctcgccgggcgaagtggatgatctgacagacagcgactggtccacgtgttcagacacggacgatgaattaagactagatagggcaggtgggtgaccttttgggacagcggtg

SEQ ID NO: 7820 - DNA, 140 bp, Artificial Sequence
  Synthetic
caccgctgtcccaaaaggtcacccacctgccctatctagtcttaattcatcgtccgtgtctgaacacgtggaccagtcgctgtctgtcagatcatccacttcgcccggcgagaagtcccccatatcagcagccagggcct

SEQ ID NO: 7821 - DNA, 140 bp, Artificial Sequence
  Synthetic
aggccctggctgctgatatgggggacttctcgccgggcgaagtggatgatctgacagacagcgactggtccacgtgttcagacacggacgatgaattatgactagatagggcaggtgggtgaccttttgggacagcggtg

SEQ ID NO: 7822 - DNA, 140 bp, Artificial Sequence
  Synthetic
caccgctgtcccaaaaggtcacccacctgccctatctagtcataattcatcgtccgtgtctgaacacgtggaccagtcgctgtctgtcagatcatccacttcgcccggcgagaagtcccccatatcagcagccagggcct

SEQ ID NO: 7823 - DNA, 140 bp, Artificial Sequence
  Synthetic
aggccctggctgctgatatgggggacttctcgccgggcgaagtggatgatctgacagacagcgactggtccacgtgttcagacacggacgatgaattacgactagatagggcaggtgggtgaccttttgggacagcggtg

SEQ ID NO: 7824 - DNA, 140 bp, Artificial Sequence
  Synthetic
caccgctgtcccaaaaggtcacccacctgccctatctagtcgtaattcatcgtccgtgtctgaacacgtggaccagtcgctgtctgtcagatcatccacttcgcccggcgagaagtcccccatatcagcagccagggcct

SEQ ID NO: 7825 - DNA, 140 bp, Artificial Sequence
  Synthetic
aggccctggctgctgatatgggggacttctcgccgggcgaagtggatgatctgacagacagcgactggtccacgtgttcagacacggacgatgaattaggactagatagggcaggtgggtgaccttttgggacagcggtg

SEQ ID NO: 7826 - DNA, 140 bp, Artificial Sequence
  Synthetic
caccgctgtcccaaaaggtcacccacctgccctatctagtcctaattcatcgtccgtgtctgaacacgtggaccagtcgctgtctgtcagatcatccacttcgcccggcgagaagtcccccatatcagcagccagggcct

SEQ ID NO: 7827 - DNA, 140 bp, Artificial Sequence
  Synthetic
atacgccatgctgggtctccgaggactagaatcaaatggttgttaagcaaggtgccaaaaaccgacctgaccccatacagcggggacgcccaagaagcccgggacgcagaaaaagaagcacgtacttgggagtcggccat

SEQ ID NO: 7828 - DNA, 140 bp, Artificial Sequence
  Synthetic
atggccgactcccaagtacgtgcttctttttctgcgtcccgggcttcttgggcgtccccgctgtatggggtcaggtcggtttttggcaccttgcttaacaaccatttgattctagtcctcggagacccagcatggcgtat

SEQ ID NO: 7829 - DNA, 140 bp, Artificial Sequence
  Synthetic
atacgccatgctgggtctccaactccaagaaagtgcgtccatggccaacagaagcaggtaccaatcccgcaaagtagagaacacgaaagcaacaatagtccaaaggctgaagggtggctgcgtacttgggagtcggccat

SEQ ID NO: 7830 - DNA, 140 bp, Artificial Sequence
  Synthetic
atggccgactcccaagtacgcagccacccttcagcctttggactattgttgctttcgtgttctctactttgcgggattggtacctgcttctgttggccatggacgcactttcttggagttggagacccagcatggcgtat

SEQ ID NO: 7831 - DNA, 140 bp, Artificial Sequence
  Synthetic
atacgccatgctgggtctcccaaactttatttaatgtcggagaccccgaaagttcctacttaccgaactacatatccggcaccagtgtactcacccccaatcaatatccgactgtccaaccgtacttgggagtcggccat

SEQ ID NO: 7832 - DNA, 140 bp, Artificial Sequence
  Synthetic
atggccgactcccaagtacggttggacagtcggatattgattgggggtgagtacactggtgccggatatgtagttcggtaagtaggaactttcggggtctccgacattaaataaagtttgggagacccagcatggcgtat

SEQ ID NO: 7833 - DNA, 140 bp, Artificial Sequence
  Synthetic
atacgccatgctgggtctccggcagcacaggaagatgttcaggtcgaaatcgacgtggaacagcttgaggacagagcgggtgcaggaataatagagactccgagaggagctatcaaagttcgtacttgggagtcggccat

SEQ ID NO: 7834 - DNA, 140 bp, Artificial Sequence
  Synthetic
atggccgactcccaagtacgaactttgatagctcctctcggagtctctattattcctgcacccgctctgtcctcaagctgttccacgtcgatttcgacctgaacatcttcctgtgctgccggagacccagcatggcgtat

SEQ ID NO: 7835 - DNA, 140 bp, Artificial Sequence
  Synthetic
atacgccatgctgggtctccgaggaagaacgagaagcagaactgactcgtgaagccctaccaccccttcaggcagcacaggaagatgttcaggtcgaaatcgacgtggaacagcttgaggcgtacttgggagtcggccat

SEQ ID NO: 7836 - DNA, 140 bp, Artificial Sequence
  Synthetic
atggccgactcccaagtacgcctcaagctgttccacgtcgatttcgacctgaacatcttcctgtgctgcctgaaggggtggtagggcttcacgagtcagttctgcttctcgttcttcctcggagacccagcatggcgtat

SEQ ID NO: 7837 - DNA, 140 bp, Artificial Sequence
  Synthetic
atacgccatgctgggtctccactgcccaaccaacagaccacgtcgtgggagagtacttggttctttccccgcagaccgtactacgtagccaaaagcttagcctgattcacgctttggcggcgtacttgggagtcggccat

SEQ ID NO: 7838 - DNA, 140 bp, Artificial Sequence
  Synthetic
atggccgactcccaagtacgccgccaaagcgtgaatcaggctaagcttttggctacgtagtacggtctgcggggaaagaaccaagtactctcccacgacgtggtctgttggttgggcagtggagacccagcatggcgtat

SEQ ID NO: 7839 - DNA, 140 bp, Artificial Sequence
  Synthetic
atacgccatgctgggtctccgacagttgcgtcgtaccaaatcaccgatgagtacgatgcatacctggatatggtggacgggtcggaaagttgccttgaccgggcgacgtttaatccatcacgtacttgggagtcggccat

SEQ ID NO: 7840 - DNA, 140 bp, Artificial Sequence
  Synthetic
atggccgactcccaagtacgtgatggattaaacgtcgcccggtcaaggcaactttccgacccgtccaccatatccaggtatgcatcgtactcatcggtgatttggtacgacgcaactgtcggagacccagcatggcgtat

SEQ ID NO: 7841 - DNA, 140 bp, Artificial Sequence
  Synthetic
atacgccatgctgggtctccagcaagtgaagacgtgcacgcacagcggacgagcagggaggtatgcggtcgaagcgtacgacggcagagtcctagtgccctcaggctacgcaatctcgcccgtacttgggagtcggccat

SEQ ID NO: 7842 - DNA, 140 bp, Artificial Sequence
  Synthetic
atggccgactcccaagtacgggcgagattgcgtagcctgagggcactaggactctgccgtcgtacgcttcgaccgcatacctccctgctcgtccgctgtgcgtgcacgtcttcacttgctggagacccagcatggcgtat

SEQ ID NO: 7843 - DNA, 140 bp, Artificial Sequence
  Synthetic
atacgccatgctgggtctccaagcttagaagttatccaaaacagcactcctaccatgcacctacaatcagaagtgccgtaccttccccgttccagaacacgctgcagaacgtactggctgcgtacttgggagtcggccat

SEQ ID NO: 7844 - DNA, 140 bp, Artificial Sequence
  Synthetic
atggccgactcccaagtacgcagccagtacgttctgcagcgtgttctggaacggggaaggtacggcacttctgattgtaggtgcatggtaggagtgctgttttggataacttctaagcttggagacccagcatggcgtat

SEQ ID NO: 7845 - DNA, 140 bp, Artificial Sequence
  Synthetic
aggccctggctgctgatatgcatatccggcaccagtgtactcacccccaatcaatatccgactgtccaaccctgagtctgctgtggcagcgtgcaatgagttcctagcaaggaactacccgaccttttgggacagcggtg

SEQ ID NO: 7846 - DNA, 140 bp, Artificial Sequence
  Synthetic
caccgctgtcccaaaaggtcgggtagttccttgctaggaactcattgcacgctgccacagcagactcagggttggacagtcggatattgattgggggtgagtacactggtgccggatatgcatatcagcagccagggcct

SEQ ID NO: 7847 - DNA, 140 bp, Artificial Sequence
  Synthetic
atacgccatgctgggtctcctcaagaatactggaaggaatttgccgccagtcctattaggataacgactgagaacttgacaacttatgtcacaaaactaaaaggaccaaaagcagcagctcgtacttgggagtcggccat

SEQ ID NO: 7848 - DNA, 140 bp, Artificial Sequence
  Synthetic
atggccgactcccaagtacgagctgctgcttttggtccttttagttttgtgacataagttgtcaagttctcagtcgttatcctaataggactggcggcaaattccttccagtattcttgaggagacccagcatggcgtat

SEQ ID NO: 7849 - DNA, 140 bp, Artificial Sequence
  Synthetic
atacgccatgctgggtctccttatttgccaagacacataacctgctaccactgcaggaggtgccgatggacaggtttactgtagacatgaaaagggatgtgaaggtgactccggggacgacgtacttgggagtcggccat

SEQ ID NO: 7850 - DNA, 140 bp, Artificial Sequence
  Synthetic
atggccgactcccaagtacgtcgtccccggagtcaccttcacatcccttttcatgtctacagtaaacctgtccatcggcacctcctgcagtggtagcaggttatgtgtcttggcaaataaggagacccagcatggcgtat

SEQ ID NO: 7851 - DNA, 140 bp, Artificial Sequence
  Synthetic
aggccctggctgctgatatgcaggtttactgtagacatgaaaagggatgtgaaggtgactccggggacgaagcacactgaggaaagacctaaagtgcaggtcatacaggcagccgaacctgaccttttgggacagcggtg

SEQ ID NO: 7852 - DNA, 140 bp, Artificial Sequence
  Synthetic
caccgctgtcccaaaaggtcaggttcggctgcctgtatgacctgcactttaggtctttcctcagtgtgcttcgtccccggagtcaccttcacatcccttttcatgtctacagtaaacctgcatatcagcagccagggcct

SEQ ID NO: 7853 - DNA, 140 bp, Artificial Sequence
  Synthetic
aggccctggctgctgatatgaagtgccgtaccttccccgttccagaacacgctgcagaacgtactggctgctgccacgaaaagaaattgcaacgtcacacagatgagagaactgcctactgaccttttgggacagcggtg

SEQ ID NO: 7854 - DNA, 140 bp, Artificial Sequence
  Synthetic
caccgctgtcccaaaaggtcagtaggcagttctctcatctgtgtgacgttgcaatttcttttcgtggcagcagccagtacgttctgcagcgtgttctggaacggggaaggtacggcacttcatatcagcagccagggcct

SEQ ID NO: 7855 - DNA, 140 bp, Artificial Sequence
  Synthetic
atacgccatgctgggtctccttggcaacagcatatctgtgtgggatccacagagagttggttagaagactgaatgcagttcttctacctaatgtacacacgctgtttgacatgtctgccgcgtacttgggagtcggccat

SEQ ID NO: 7856 - DNA, 140 bp, Artificial Sequence
  Synthetic
atggccgactcccaagtacgcggcagacatgtcaaacagcgtgtgtacattaggtagaagaactgcattcagtcttctaaccaactctctgtggatcccacacagatatgctgttgccaaggagacccagcatggcgtat

SEQ ID NO: 7857 - DNA, 140 bp, Artificial Sequence
  Synthetic
atacgccatgctgggtctcctgcagtcataggagtcttcggagtaccaggatctggcaagtcagctattatcaagaacctagttaccaggcaagacctggtgactagcggaaagaaagaacgtacttgggagtcggccat

SEQ ID NO: 7858 - DNA, 140 bp, Artificial Sequence
  Synthetic
atggccgactcccaagtacgttctttctttccgctagtcaccaggtcttgcctggtaactaggttcttgataatagctgacttgccagatcctggtactccgaagactcctatgactgcaggagacccagcatggcgtat

SEQ ID NO: 7859 - DNA, 140 bp, Artificial Sequence
  Synthetic
aggccctggctgctgatatgaggactttgacgccattattgccgcgcacttcaagccgggggacgccgtattggaaaccgatatagcctcctttgacaagagccaagacgactcattggcgaccttttgggacagcggtg

SEQ ID NO: 7860 - DNA, 140 bp, Artificial Sequence
  Synthetic
caccgctgtcccaaaaggtcgccaatgagtcgtcttggctcttgtcaaaggaggctatatcggtttccaatacggcgtcccccggcttgaagtgcgcggcaataatggcgtcaaagtcctcatatcagcagccagggcct

SEQ ID NO: 7861 - DNA, 140 bp, Artificial Sequence
  Synthetic
atacgccatgctgggtctccatctgcacgtacggttgactcgctgctcttgaatggatgtaacagaccagtcgacgtgttgtacgtagacgaggcgtttgcgtgccactctggaacgttacgtacttgggagtcggccat

SEQ ID NO: 7862 - DNA, 140 bp, Artificial Sequence
  Synthetic
atggccgactcccaagtacgtaacgttccagagtggcacgcaaacgcctcgtctacgtacaacacgtcgactggtctgttacatccattcaagagcagcgagtcaaccgtacgtgcagatggagacccagcatggcgtat

SEQ ID NO: 7863 - DNA, 140 bp, Artificial Sequence
  Synthetic
atacgccatgctgggtctcctggacttgatagaggctgccttcggggagatctccagctgccacctaccgacgggcacccgttttaagttcggcgccatgatgaagtctggtatgttcctcgtacttgggagtcggccat

SEQ ID NO: 7864 - DNA, 140 bp, Artificial Sequence
  Synthetic
atggccgactcccaagtacgaggaacataccagacttcatcatggcgccgaacttaaaacgggtgcccgtcggtaggtggcagctggagatctccccgaaggcagcctctatcaagtccaggagacccagcatggcgtat

SEQ ID NO: 7865 - DNA, 140 bp, Artificial Sequence
  Synthetic
atacgccatgctgggtctccacgggcacccgttttaagttcggcgccatgatgaagtctggtatgttcctaaccctgttcgtcaacacactgctaaacatcaccatagccagccgggtgccgtacttgggagtcggccat

SEQ ID NO: 7866 - DNA, 140 bp, Artificial Sequence
  Synthetic
atggccgactcccaagtacggcacccggctggctatggtgatgtttagcagtgtgttgacgaacagggttaggaacataccagacttcatcatggcgccgaacttaaaacgggtgcccgtggagacccagcatggcgtat

SEQ ID NO: 7867 - DNA, 140 bp, Artificial Sequence
  Synthetic
atacgccatgctgggtctcctggaggaccgcttgacaaagtctgcgtgcgcggccttcatcggcgacgacaatataatacatggggttgtctctgacgaactgatggcagcaagatgtgccgtacttgggagtcggccat

SEQ ID NO: 7868 - DNA, 140 bp, Artificial Sequence
  Synthetic
atggccgactcccaagtacggcacatcttgctgccatcagttcgtcagagacaaccccatgtattatattgtcgtcgccgatgaaggccgcgcacgcagactttgtcaagcggtcctccaggagacccagcatggcgtat

SEQ ID NO: 7869 - DNA, 140 bp, Artificial Sequence
  Synthetic
aggccctggctgctgatatgtgacccgaagcagtgcggcttcttcaatatgatgcagatgaaagtcaactataatcacaacatctgcacccaagtgtaccacaaaagtatctccaggcgggaccttttgggacagcggtg

SEQ ID NO: 7870 - DNA, 140 bp, Artificial Sequence
  Synthetic
caccgctgtcccaaaaggtcccgcctggagatacttttgtggtacacttgggtgcagatgttgtgattatagttgactttcatctgcatcatattgaagaagccgcactgcttcgggtcacatatcagcagccagggcct

SEQ ID NO: 7871 - DNA, 140 bp, Artificial Sequence
  Synthetic
atacgccatgctgggtctccacggcctgcagagtggcagacccgttaaagcggctgttcaagctgggcaaaccgctggcggcgggagatgaacaagacgacgatagaagacgtgcactggcgtacttgggagtcggccat

SEQ ID NO: 7872 - DNA, 140 bp, Artificial Sequence
  Synthetic
atggccgactcccaagtacgccagtgcacgtcttctatcgtcgtcttgttcatctcccgccgccagcggtttgcccagcttgaacagccgctttaacgggtctgccactctgcaggccgtggagacccagcatggcgtat

SEQ ID NO: 7873 - DNA, 140 bp, Artificial Sequence
  Synthetic
aggccctggctgctgatatgctgacgaagtggttagatggcaacgaacagggctaactgatgagctagaaaaagcggtacactccaggtatgaagtgcagggcatatctgtcgtggtaatgaccttttgggacagcggtg

SEQ ID NO: 7874 - DNA, 140 bp, Artificial Sequence
  Synthetic
caccgctgtcccaaaaggtcattaccacgacagatatgccctgcacttcatacctggagtgtaccgctttttctagctcatcagttagccctgttcgttgccatctaaccacttcgtcagcatatcagcagccagggcct

SEQ ID NO: 7875 - DNA, 140 bp, Artificial Sequence
  Synthetic
atacgccatgctgggtctccaagttaacgaaaacccgctttatgcatcaacgtcagagcacgtcaacgtactcctaacgcgtacggaaggtaaactggtatggaagacactctccggtgacgtacttgggagtcggccat

SEQ ID NO: 7876 - DNA, 140 bp, Artificial Sequence
  Synthetic
atggccgactcccaagtacgtcaccggagagtgtcttccataccagtttaccttccgtacgcgttaggagtacgttgacgtgctctgacgttgatgcataaagcgggttttcgttaacttggagacccagcatggcgtat

SEQ ID NO: 7877 - DNA, 140 bp, Artificial Sequence
  Synthetic
aggccctggctgctgatatgctcctaacgcgtacggaaggtaaactggtatggaagacactctccggtgacccgtggataaagacgctgcagaacccaccgaaaggaaacttcaaagcaagaccttttgggacagcggtg

SEQ ID NO: 7878 - DNA, 140 bp, Artificial Sequence
  Synthetic
caccgctgtcccaaaaggtcttgctttgaagtttcctttcggtgggttctgcagcgtctttatccacgggtcaccggagagtgtcttccataccagtttaccttccgtacgcgttaggagcatatcagcagccagggcct

SEQ ID NO: 7879 - DNA, 140 bp, Artificial Sequence
  Synthetic
atacgccatgctgggtctccgtctatggccacctttgcaagctctagatctaactttgaaaagctcaggggacccatcgtaaccctgtacggtggtcctaaataggtacgcactacagctcgtacttgggagtcggccat

SEQ ID NO: 7880 - DNA, 140 bp, Artificial Sequence
  Synthetic
atggccgactcccaagtacgagctgtagtgcgtacctatttaggaccaccgtacagggttacgatgggtcccctgagcttttcaaagttagatctagagcttgcaaaggtggccatagacggagacccagcatggcgtat

SEQ ID NO: 7881 - DNA, 140 bp, Artificial Sequence
  Synthetic
aggccctggctgctgatatggacccatcgtaaccctgtacggtggtcctaaataggtacgcactacagctacctatttcgtcagaaaccaatcgcagctactcgcacacctaccagctacgaccttttgggacagcggtg

SEQ ID NO: 7882 - DNA, 140 bp, Artificial Sequence
  Synthetic
caccgctgtcccaaaaggtcgtagctggtaggtgtgcgagtagctgcgattggtttctgacgaaataggtagctgtagtgcgtacctatttaggaccaccgtacagggttacgatgggtccatatcagcagccagggcct

SEQ ID NO: 7883 - DNA, 140 bp, Artificial Sequence
  Synthetic
aggccctggctgctgatatgaatggagttcatcccgacgcaaactttctataacagaaggtaccaaccccgaccctgggccccacgccctacaattcaagtaattagacctagaccacgtgaccttttgggacagcggtg

SEQ ID NO: 7884 - DNA, 140 bp, Artificial Sequence
  Synthetic
caccgctgtcccaaaaggtcacgtggtctaggtctaattacttgaattgtagggcgtggggcccagggtcggggttggtaccttctgttatagaaagtttgcgtcgggatgaactccattcatatcagcagccagggcct

SEQ ID NO: 7885 - DNA, 140 bp, Artificial Sequence
  Synthetic
aggccctggctgctgatatgagtcaccaaatgacctttgatacattccaaaacaaagccaacgtttgttgggctaagagtttggtccctatcctcgaaacagcggggataaaactaaacggaccttttgggacagcggtg

SEQ ID NO: 7886 - DNA, 140 bp, Artificial Sequence
  Synthetic
caccgctgtcccaaaaggtccgtttagttttatccccgctgtttcgaggatagggaccaaactcttagcccaacaaacgttggctttgttttggaatgtatcaaaggtcatttggtgactcatatcagcagccagggcct

SEQ ID NO: 7887 - DNA, 140 bp, Artificial Sequence
  Synthetic
atacgccatgctgggtctccccacagaggcaggcagggcaactcgcccagctgatctctgcagtcaataaattgaccatgcgcgcggtacctcaacagaagcctcgcagaaatcggaaaacgtacttgggagtcggccat

SEQ ID NO: 7888 - DNA, 140 bp, Artificial Sequence
  Synthetic
atggccgactcccaagtacgttttccgatttctgcgaggcttctgttgaggtaccgcgcgcatggtcaatttattgactgcagagatcagctgggcgagttgccctgcctgcctctgtggggagacccagcatggcgtat

SEQ ID NO: 7889 - DNA, 140 bp, Artificial Sequence
  Synthetic
aggccctggctgctgatatgattgaccatgcgcgcggtacctcaacagaagcctcgcagaaatcggaaaaacaagaagcaaaggcagaagaagcaggcgtcgcaaaacgacccaaagcaagaccttttgggacagcggtg

SEQ ID NO: 7890 - DNA, 140 bp, Artificial Sequence
  Synthetic
caccgctgtcccaaaaggtcttgctttgggtcgttttgcgacgcctgcttcttctgcctttgcttcttgtttttccgatttctgcgaggcttctgttgaggtaccgcgcgcatggtcaatcatatcagcagccagggcct

SEQ ID NO: 7891 - DNA, 140 bp, Artificial Sequence
  Synthetic
aggccctggctgctgatatgaagaagcaaccaccacaaaagaagccggctcaaaagaagaagaaaccaggccgtagggagagaatgtgcatgaaaattgaaaatgattgcatcttcgaaggaccttttgggacagcggtg

SEQ ID NO: 7892 - DNA, 140 bp, Artificial Sequence
  Synthetic
caccgctgtcccaaaaggtccttcgaagatgcaatcattttcaattttcatgcacattctctccctacggcctggtttcttcttcttttgagccggcttcttttgtggtggttgcttcttcatatcagcagccagggcct

SEQ ID NO: 7893 - DNA, 140 bp, Artificial Sequence
  Synthetic
aggccctggctgctgatatgtcaagcatgaaggcaaagtgatgggctacgcatgcctggtgggggataaagtaatgaaaccagcacatgtgaagggaactatcgacaatgccgatctggcgaccttttgggacagcggtg

SEQ ID NO: 7894 - DNA, 140 bp, Artificial Sequence
  Synthetic
caccgctgtcccaaaaggtcgccagatcggcattgtcgatagttcccttcacatgtgctggtttcattactttatcccccaccaggcatgcgtagcccatcactttgccttcatgcttgacatatcagcagccagggcct

SEQ ID NO: 7895 - DNA, 140 bp, Artificial Sequence
  Synthetic
aggccctggctgctgatatgaccctaccaccaacattataccggccaacaggagactaccacactcattagtggccgaacaccgcccagtaaaaggggaaagaatggaatggctggttaagaccttttgggacagcggtg

SEQ ID NO: 7896 - DNA, 140 bp, Artificial Sequence
  Synthetic
caccgctgtcccaaaaggtcttaaccagccattccattctttccccttttactgggcggtgttcggccactaatgagtgtggtagtctcctgttggccggtataatgttggtggtagggtcatatcagcagccagggcct

SEQ ID NO: 7897 - DNA, 140 bp, Artificial Sequence
  Synthetic
atacgccatgctgggtctcctaaactggccttcaagcggtcatctaaatacgatcttgaatgtgcacagataccagtgcacatgaagtctgatgcctcgaagttcacccacgagaaaccccgtacttgggagtcggccat

SEQ ID NO: 7898 - DNA, 140 bp, Artificial Sequence
  Synthetic
atggccgactcccaagtacggggtttctcgtgggtgaacttcgaggcatcagacttcatgtgcactggtatctgtgcacattcaagatcgtatttagatgaccgcttgaaggccagtttaggagacccagcatggcgtat

SEQ ID NO: 7899 - DNA, 140 bp, Artificial Sequence
  Synthetic
atacgccatgctgggtctcctcttgtgcctgttggcaaacactacattcccctgctctcagccaccttgcacaccctgctgctacgaaaaggaaccggaaagcaccttgcgcatgcttgacgtacttgggagtcggccat

SEQ ID NO: 7900 - DNA, 140 bp, Artificial Sequence
  Synthetic
atggccgactcccaagtacgtcaagcatgcgcaaggtgctttccggttccttttcgtagcagcagggtgtgcaaggtggctgagagcaggggaatgtagtgtttgccaacaggcacaagaggagacccagcatggcgtat

SEQ ID NO: 7901 - DNA, 140 bp, Artificial Sequence
  Synthetic
atacgccatgctgggtctccggacaacgtgatgagacccggatactaccagctgctaaaagcatcgctgacttgctctccccaccgccaaagacgcagtactaaggacaattttaatgtccgtacttgggagtcggccat

SEQ ID NO: 7902 - DNA, 140 bp, Artificial Sequence
  Synthetic
atggccgactcccaagtacggacattaaaattgtccttagtactgcgtctttggcggtggggagagcaagtcagcgatgcttttagcagctggtagtatccgggtctcatcacgttgtccggagacccagcatggcgtat

SEQ ID NO: 7903 - DNA, 140 bp, Artificial Sequence
  Synthetic
atacgccatgctgggtctccaacagtgcgtagaccacgcaatgaaactgcaaatgctcgggggtgactcattgagactgctcaaaccgggtggctctctattgatcagagcatatggttacgtacttgggagtcggccat

SEQ ID NO: 7904 - DNA, 140 bp, Artificial Sequence
  Synthetic
atggccgactcccaagtacgtaaccatatgctctgatcaatagagagccacccggtttgagcagtctcaatgagtcacccccgagcatttgcagtttcattgcgtggtctacgcactgttggagacccagcatggcgtat

SEQ ID NO: 7905 - DNA, 140 bp, Artificial Sequence
  Synthetic
aggccctggctgctgatatgcttgctctccccaccgccaaagacgcagtactaaggacaattttaatgtctataaagccacaagaccatacctagctcattgtcctgactgcggagaagggaccttttgggacagcggtg

SEQ ID NO: 7906 - DNA, 140 bp, Artificial Sequence
  Synthetic
caccgctgtcccaaaaggtcccttctccgcagtcaggacaatgagctaggtatggtcttgtggctttatagacattaaaattgtccttagtactgcgtctttggcggtggggagagcaagcatatcagcagccagggcct

SEQ ID NO: 7907 - DNA, 140 bp, Artificial Sequence
  Synthetic
atacgccatgctgggtctccgcattcgtgccatagccctatcgcattggagcgcattagaaatgaagcaacggacggaacgctgaaaatccaggtctctttgcagatcgggataaagacacgtacttgggagtcggccat

SEQ ID NO: 7908 - DNA, 140 bp, Artificial Sequence
  Synthetic
atggccgactcccaagtacgtgtctttatcccgatctgcaaagagacctggattttcagcgttccgtccgttgcttcatttctaatgcgctccaatgcgatagggctatggcacgaatgcggagacccagcatggcgtat

SEQ ID NO: 7909 - DNA, 140 bp, Artificial Sequence
  Synthetic
atacgccatgctgggtctccgatgacagccacgattggactaagctgcgctatatggatagccacacgccagcggacgcggagcgagccggactgcttgtaaggacttcagcaccgtgcacgtacttgggagtcggccat

SEQ ID NO: 7910 - DNA, 140 bp, Artificial Sequence
  Synthetic
atggccgactcccaagtacgtgcacggtgctgaagtccttacaagcagtccggctcgctccgcgtccgctggcgtgtggctatccatatagcgcagcttagtccaatcgtggctgtcatcggagacccagcatggcgtat

SEQ ID NO: 7911 - DNA, 140 bp, Artificial Sequence
  Synthetic
aggccctggctgctgatatggatgaagagtgcgtagtcaacgccgccaaccctcgcgggttaccaggtgacggtgtttgcaaggcagtatacaaaaaatggccggagtcctttaagaacagaccttttgggacagcggtg

SEQ ID NO: 7912 - DNA, 140 bp, Artificial Sequence
  Synthetic
caccgctgtcccaaaaggtctgttcttaaaggactccggccattttttgtatactgccttgcaaacaccgtcacctggtaacccgcgagggttggcggcgttgactacgcactcttcatccatatcagcagccagggcct

SEQ ID NO: 7913 - DNA, 140 bp, Artificial Sequence
  Synthetic
atacgccatgctgggtctccactctcgaccacaacatggtaaagagttaccttgcagcacgtacgtgcagagcaccgctgccactgccgaagagatagaggtgcatatgcccccagataccgtacttgggagtcggccat

SEQ ID NO: 7914 - DNA, 140 bp, Artificial Sequence
  Synthetic
atggccgactcccaagtacggtatctgggggcatatgcacctctatctcttcggcagtggcagcggtgctctgcacgtacgtgctgcaaggtaactctttaccatgttgtggtcgagagtggagacccagcatggcgtat

SEQ ID NO: 7915 - DNA, 140 bp, Artificial Sequence
  Synthetic
aggccctggctgctgatatgagcaccgctgccactgccgaagagatagaggtgcatatgcccccagatactcctgaccgcacgctgatgacacagcagtctggcaacgtgaagatcacaggaccttttgggacagcggtg

SEQ ID NO: 7916 - DNA, 140 bp, Artificial Sequence
  Synthetic
caccgctgtcccaaaaggtcctgtgatcttcacgttgccagactgctgtgtcatcagcgtgcggtcaggagtatctgggggcatatgcacctctatctcttcggcagtggcagcggtgctcatatcagcagccagggcct

SEQ ID NO: 7917 - DNA, 140 bp, Artificial Sequence
  Synthetic
aggccctggctgctgatatggtgcaacaccagtgggaaccgcaaaaacagtcatgtgcggtacgtatccagtaatccacgccgttggaccaaacttctctaattattcggagtctgaagggaccttttgggacagcggtg

SEQ ID NO: 7918 - DNA, 140 bp, Artificial Sequence
  Synthetic
caccgctgtcccaaaaggtcccttcagactccgaataattagagaagtttggtccaacggcgtggattactggatacgtaccgcacatgactgtttttgcggttcccactggtgttgcaccatatcagcagccagggcct

SEQ ID NO: 7919 - DNA, 140 bp, Artificial Sequence
  Synthetic
atacgccatgctgggtctccttaatgggcagacggtgcggtacaagtgcaactgcggtggctcaaacgagggactgacaaccacagacaaagtgatcaataattgcaaaattgatcagtgcgtacttgggagtcggccat

SEQ ID NO: 7920 - DNA, 140 bp, Artificial Sequence
  Synthetic
atggccgactcccaagtacgcactgatcaattttgcaattattgatcactttgtctgtggttgtcagtccctcgtttgagccaccgcagttgcacttgtaccgcaccgtctgcccattaaggagacccagcatggcgtat

SEQ ID NO: 7921 - DNA, 140 bp, Artificial Sequence
  Synthetic
aggccctggctgctgatatgggactgacaaccacagacaaagtgatcaataattgcaaaattgatcagtgccatgctgcagtcactaatcacaagaagtggcaatacaactcccctttgggaccttttgggacagcggtg

SEQ ID NO: 7922 - DNA, 140 bp, Artificial Sequence
  Synthetic
caccgctgtcccaaaaggtcccaaaggggagttgtattgccacttcttgtgattagtgactgcagcatggcactgatcaattttgcaattattgatcactttgtctgtggttgtcagtcccatatcagcagccagggcct

SEQ ID NO: 7923 - DNA, 140 bp, Artificial Sequence
  Synthetic
aggccctggctgctgatatgtcccgcgcaacgctgaactcggggaccgtaaaggaaagattcacatcccattcccattggcaaacgtgacttgcagagtgccaaaagcaagaaaccccacgaccttttgggacagcggtg

SEQ ID NO: 7924 - DNA, 140 bp, Artificial Sequence
  Synthetic
caccgctgtcccaaaaggtcgtggggtttcttgcttttggcactctgcaagtcacgtttgccaatgggaatgggatgtgaatctttcctttacggtccccgagttcagcgttgcgcgggacatatcagcagccagggcct

SEQ ID NO: 7925 - DNA, 140 bp, Artificial Sequence
  Synthetic
atacgccatgctgggtctccagtaacgtacggaaaaaaccaagtcaccatgctgctgtatcctgaccatccgacactcttgtcttatcgtaacatgggacaggaaccaaattaccacgagcgtacttgggagtcggccat

SEQ ID NO: 7926 - DNA, 140 bp, Artificial Sequence
  Synthetic
atggccgactcccaagtacgctcgtggtaatttggttcctgtcccatgttacgataagacaagagtgtcggatggtcaggatacagcagcatggtgacttggttttttccgtacgttactggagacccagcatggcgtat

SEQ ID NO: 7927 - DNA, 140 bp, Artificial Sequence
  Synthetic
atacgccatgctgggtctccgagatatatactatgtggccaaagcaaacagaggccaacgagcaagtttgcctatatgccctgggggaaagtattgaatcgatcaggcagaaatgcccggcgtacttgggagtcggccat

SEQ ID NO: 7928 - DNA, 140 bp, Artificial Sequence
  Synthetic
atggccgactcccaagtacgccgggcatttctgcctgatcgattcaatactttcccccagggcatataggcaaacttgctcgttggcctctgtttgctttggccacatagtatatatctcggagacccagcatggcgtat

SEQ ID NO: 7929 - DNA, 140 bp, Artificial Sequence
  Synthetic
atacgccatgctgggtctccgagtgggtgacacacaagaaggaggtcaccttgaccgtgcctactgagggtctggaggtcacttggggcaacaacgaaccatacaagtactggccgcagacgtacttgggagtcggccat

SEQ ID NO: 7930 - DNA, 140 bp, Artificial Sequence
  Synthetic
atggccgactcccaagtacgtctgcggccagtacttgtatggttcgttgttgccccaagtgacctccagaccctcagtaggcacggtcaaggtgacctccttcttgtgtgtcacccactcggagacccagcatggcgtat

SEQ ID NO: 7931 - DNA, 140 bp, Artificial Sequence
  Synthetic
atacgccatgctgggtctcctggatgatgcagatgcatcatctcccccgaaaactgtcccgtgcctctgccgttacgccatgacaccagaacgcgttacccgacttcgcatgaaccatgtcgtacttgggagtcggccat

SEQ ID NO: 7932 - DNA, 140 bp, Artificial Sequence
  Synthetic
atggccgactcccaagtacgacatggttcatgcgaagtcgggtaacgcgttctggtgtcatggcgtaacggcagaggcacgggacagttttcgggggagatgatgcatctgcatcatccaggagacccagcatggcgtat

SEQ ID NO: 7933 - DNA, 140 bp, Artificial Sequence
  Synthetic
aggccctggctgctgatatgtctggaggtcacttggggcaacaacgaaccatacaagtactggccgcagatgtctacgaacggtactgctcatggtcatccacatgagataatcttgtacgaccttttgggacagcggtg

SEQ ID NO: 7934 - DNA, 140 bp, Artificial Sequence
  Synthetic
caccgctgtcccaaaaggtcgtacaagattatctcatgtggatgaccatgagcagtaccgttcgtagacatctgcggccagtacttgtatggttcgttgttgccccaagtgacctccagacatatcagcagccagggcct

SEQ ID NO: 7935 - DNA, 140 bp, Artificial Sequence
  Synthetic
atacgccatgctgggtctcccacaagcataattgtgtgttcttcgtttccccttccaaagtacaaaatagaaggagtgcaaaaagtcaaatgctccaaggtaatgctatttgaccacaaccgtacttgggagtcggccat

SEQ ID NO: 7936 - DNA, 140 bp, Artificial Sequence
  Synthetic
atggccgactcccaagtacggttgtggtcaaatagcattaccttggagcatttgactttttgcactccttctattttgtactttggaaggggaaacgaagaacacacaattatgcttgtgggagacccagcatggcgtat

SEQ ID NO: 7937 - DNA, 140 bp, Artificial Sequence
  Synthetic
atacgccatgctgggtctcccacggcgcagatgcattacaccatatgaattaacaccaggagccactgttccctttctgctcagcctgctatgctgcgtcagaacgaccaaggcggccaccgtacttgggagtcggccat

SEQ ID NO: 7938 - DNA, 140 bp, Artificial Sequence
  Synthetic
atggccgactcccaagtacggtggccgccttggtcgttctgacgcagcatagcaggctgagcagaaagggaacagtggctcctggtgttaattcatatggtgtaatgcatctgcgccgtgggagacccagcatggcgtat

SEQ ID NO: 7939 - DNA, 140 bp, Artificial Sequence
  Synthetic
aggccctggctgctgatatgtattatgagctgtaccccactatgactgtagtcattgtgtcggtggcctcgttcgtgcttctgtcgatggtgggcacagcagtggggatgtgtgtatgcggaccttttgggacagcggtg

SEQ ID NO: 7940 - DNA, 140 bp, Artificial Sequence
  Synthetic
caccgctgtcccaaaaggtccgcatacacacatccccactgctgtgcccaccatcgacagaagcacgaacgaggccaccgacacaatgactacagtcatagtggggtacagctcataatacatatcagcagccagggcct

SEQ ID NO: 7941 - DNA, 140 bp, Artificial Sequence
  Synthetic
atacgccatgctgggtctccatattacgaggctgcggcatacctatggaacgaacagcagcccctgttctggttgcaggctcttatcccgctggccgccttgatcgtcctgtgcaactgtcgtacttgggagtcggccat

SEQ ID NO: 7942 - DNA, 140 bp, Artificial Sequence
  Synthetic
atggccgactcccaagtacgacagttgcacaggacgatcaaggcggccagcgggataagagcctgcaaccagaacaggggctgctgttcgttccataggtatgccgcagcctcgtaatatggagacccagcatggcgtat

SEQ ID NO: 7943 - DNA, 140 bp, Artificial Sequence
  Synthetic
aggccctggctgctgatatggcgttgacggcgagatactgcccgtcccgtcagacctggatgctgacgccccagccctagaaccagcccttgacgacggggcgatacacacgttgccatcgaccttttgggacagcggtg

SEQ ID NO: 7944 - DNA, 140 bp, Artificial Sequence
  Synthetic
caccgctgtcccaaaaggtcgatggcaacgtgtgtatcgccccgtcgtcaagggctggttctagggctggggcgtcagcatccaggtctgacgggacgggcagtatctcgccgtcaacgccatatcagcagccagggcct

SEQ ID NO: 7945 - DNA, 140 bp, Artificial Sequence
  Synthetic
aggccctggctgctgatatgggttgcaggctcttatcccgctggccgccttgatcgtcctgtgcaactgtctgaggctcttgccatgctgctgtaagaccctggcttttttagccgtaatgaccttttgggacagcggtg

SEQ ID NO: 7946 - DNA, 140 bp, Artificial Sequence
  Synthetic
caccgctgtcccaaaaggtcattacggctaaaaaagccagggtcttacagcagcatggcaagagcctcagacagttgcacaggacgatcaaggcggccagcgggataagagcctgcaacccatatcagcagccagggcct

SEQ ID NO: 7947 - DNA, 140 bp, Artificial Sequence
  Synthetic
aggccctggctgctgatatgcgaacacggtgggagtaccgtataagactcttgtcaacagaccgggttacagccccatggtattggagatggagctacaatcagttaccttggaaccaacgaccttttgggacagcggtg

SEQ ID NO: 7948 - DNA, 140 bp, Artificial Sequence
  Synthetic
caccgctgtcccaaaaggtcgttggttccaaggtaactgattgtagctccatctccaataccatggggctgtaacccggtctgttgacaagagtcttatacggtactcccaccgtgttcgcatatcagcagccagggcct

SEQ ID NO: 7949 - DNA, 140 bp, Artificial Sequence
  Synthetic
atacgccatgctgggtctccctgtcgcgccgcccagaagaaggcgagggagaaacctgactgtgacatgcgacgagagagaagggaatataacacccatggctagcgtccgattctttagcgtacttgggagtcggccat

SEQ ID NO: 7950 - DNA, 140 bp, Artificial Sequence
  Synthetic
atggccgactcccaagtacgctaaagaatcggacgctagccatgggtgttatattcccttctctctcgtcgcatgtcacagtcaggtttctccctcgccttcttctgggcggcgcgacagggagacccagcatggcgtat

SEQ ID NO: 7951 - DNA, 140 bp, Artificial Sequence
  Synthetic
atacgccatgctgggtctccattgtcacttgactacatcacgtgcgagtacaaaactgtcatcccctccccgtacgtgaagtgctgtggtacagcagagtgcaaggacaagagcctaccacgtacttgggagtcggccat

SEQ ID NO: 7952 - DNA, 140 bp, Artificial Sequence
  Synthetic
atggccgactcccaagtacgtggtaggctcttgtccttgcactctgctgtaccacagcacttcacgtacggggaggggatgacagttttgtactcgcacgtgatgtagtcaagtgacaatggagacccagcatggcgtat

SEQ ID NO: 7953 - DNA, 140 bp, Artificial Sequence
  Synthetic
atacgccatgctgggtctccggcagagctgtgtccagtcgtacaagaaacagcggagacgcgtgacacagctatgtctcttcaggcaccgccgagtaccgccacggaactgagtcacccgcgtacttgggagtcggccat

SEQ ID NO: 7954 - DNA, 140 bp, Artificial Sequence
  Synthetic
atggccgactcccaagtacgcgggtgactcagttccgtggcggtactcggcggtgcctgaagagacatagctgtgtcacgcgtctccgctgtttcttgtacgactggacacagctctgccggagacccagcatggcgtat

SEQ ID NO: 7955 - DNA, 140 bp, Artificial Sequence
  Synthetic
atacgccatgctgggtctccgactacagttgcaaggtctttactggagtctacccatttatgtggggcggcgcctattgcttttgcgacgccgaaaatacgcaattgagcgaggcacacgcgtacttgggagtcggccat

SEQ ID NO: 7956 - DNA, 140 bp, Artificial Sequence
  Synthetic
atggccgactcccaagtacgcgtgtgcctcgctcaattgcgtattttcggcgtcgcaaaagcaataggcgccgccccacataaatgggtagactccagtaaagaccttgcaactgtagtcggagacccagcatggcgtat

SEQ ID NO: 7957 - DNA, 140 bp, Artificial Sequence
  Synthetic
atacgccatgctgggtctcccttcaacgaaggagaaatcgaaagcttgtcttctgagctactaactttcggagacttcctacccggagaagtggatgatttgacagatagcgactggtcccgtacttgggagtcggccat

SEQ ID NO: 7958 - DNA, 140 bp, Artificial Sequence
  Synthetic
atggccgactcccaagtacgggaccagtcgctatctgtcaaatcatccacttctccgggtaggaagtctccgaaagttagtagctcagaagacaagctttcgatttctccttcgttgaagggagacccagcatggcgtat

SEQ ID NO: 7959 - DNA, 140 bp, Artificial Sequence
  Synthetic
aggccctggctgctgatatgcacaccgcatcggcgtcggcgaagctccgcgtcctttaccaaggaaacaacattaccgtagctgcctacgctaacggcgaccatgccgtcacagtaaagggaccttttgggacagcggtg

SEQ ID NO: 7960 - DNA, 140 bp, Artificial Sequence
  Synthetic
caccgctgtcccaaaaggtccctttactgtgacggcatggtcgccgttagcgtaggcagctacggtaatgttgtttccttggtaaaggacgcggagcttcgccgacgccgatgcggtgtgcatatcagcagccagggcct

SEQ ID NO: 7961 - DNA, 140 bp, Artificial Sequence
  Synthetic
atacgccatgctgggtctccgtattggctgaaggaaagaggagcatcgctacagcacacggcaccgttcggttgccagattgcgacaaacccggtaagagctataaattgcgctgtggggcgtacttgggagtcggccat

SEQ ID NO: 7962 - DNA, 140 bp, Artificial Sequence
  Synthetic
atggccgactcccaagtacgccccacagcgcaatttatagctcttaccgggtttgtcgcaatctggcaaccgaacggtgccgtgtgctgtagcgatgctcctctttccttcagccaatacggagacccagcatggcgtat

SEQ ID NO: 7963 - DNA, 140 bp, Artificial Sequence
  Synthetic
aggccctggctgctgatatggccagtcagtgctgccggtgaacaccctggaggaagtccacgaggagaagtgttacccacctaagctggatgaagcaaaggagcaactactacttaagaagaccttttgggacagcggtg

SEQ ID NO: 7964 - DNA, 140 bp, Artificial Sequence
  Synthetic
caccgctgtcccaaaaggtcttcttaagtagtagttgctcctttgcttcatccagcttaggtgggtaacacttctcctcgtggacttcctccagggtgttcaccggcagcactgactggccatatcagcagccagggcct

SEQ ID NO: 7965 - DNA, 140 bp, Artificial Sequence
  Synthetic
aggccctggctgctgatatgactcctccgactttgggggcgtcgccatcatcaaatacacagctagcaagaaaggtaaatgtgcagtacattcgatgaccaacgccgttaccattcgagagaccttttgggacagcggtg

SEQ ID NO: 7966 - DNA, 140 bp, Artificial Sequence
  Synthetic
caccgctgtcccaaaaggtctctcgaatggtaacggcgttggtcatcgaatgtactgcacatttacctttcttgctagctgtgtatttgatgatggcgacgcccccaaagtcggaggagtcatatcagcagccagggcct

SEQ ID NO: 7967 - DNA, 140 bp, Artificial Sequence
  Synthetic
atacgccatgctgggtctccaaaggtaaatgtgcagtacattcgatgaccaacgccgttaccattcgagaagtcgacgtagaagtagaggggaactcccagctgcaaatatccttctcaacgtacttgggagtcggccat

SEQ ID NO: 7968 - DNA, 140 bp, Artificial Sequence
  Synthetic
atggccgactcccaagtacgttgagaaggatatttgcagctgggagttcccctctacttctacgtcgacttctcgaatggtaacggcgttggtcatcgaatgtactgcacatttacctttggagacccagcatggcgtat

SEQ ID NO: 7969 - DNA, 140 bp, Artificial Sequence
  Synthetic
atacgccatgctgggtctccactgtttcatcataccaaatcaccgacgagtatgatgcatatctagacatggtggacgggtcggagagttgcctggaccgagcgacattcaatccgtcaacgtacttgggagtcggccat

SEQ ID NO: 7970 - DNA, 140 bp, Artificial Sequence
  Synthetic
atggccgactcccaagtacgttgacggattgaatgtcgctcggtccaggcaactctccgacccgtccaccatgtctagatatgcatcatactcgtcggtgatttggtatgatgaaacagtggagacccagcatggcgtat

SEQ ID NO: 7971 - DNA, 140 bp, Artificial Sequence
  Synthetic
atacgccatgctgggtctccagcatcacacaccacccttggggtccaggatatatccacaacggcaatgtcttgggtgcagaagattacgggaggagtaggattaattgttgctgttgctcgtacttgggagtcggccat

SEQ ID NO: 7972 - DNA, 140 bp, Artificial Sequence
  Synthetic
atggccgactcccaagtacgagcaacagcaacaattaatcctactcctcccgtaatcttctgcacccaagacattgccgttgtggatatatcctggaccccaagggtggtgtgtgatgctggagacccagcatggcgtat

SEQ ID NO: 7973 - DNA, 140 bp, Artificial Sequence
  Synthetic
atacgccatgctgggtctccgccttaatcttaattgtggtgctatgcgtgtcgtttagcaggcactaaaccgatgataaggcacgaagtaactaaatagcaaaagtagaaagtacataatcgtacttgggagtcggccat

SEQ ID NO: 7974 - DNA, 140 bp, Artificial Sequence
  Synthetic
atggccgactcccaagtacgattatgtactttctacttttgctatttagttacttcgtgccttatcatcggtttagtgcctgctaaacgacacgcatagcaccacaattaagattaaggcggagacccagcatggcgtat

SEQ ID NO: 7975 - DNA, 140 bp, Artificial Sequence
  Synthetic
atacgccatgctgggtctcccaggtatatgtgccccctaagaggcacaatatatatagctaagcactattagatcaaagggctatacaacccctgaatagtaacaaaacacaaaaatcaacgtacttgggagtcggccat

SEQ ID NO: 7976 - DNA, 140 bp, Artificial Sequence
  Synthetic
atggccgactcccaagtacgttgatttttgtgttttgttactattcaggggttgtatagccctttgatctaatagtgcttagctatatatattgtgcctcttagggggcacatatacctgggagacccagcatggcgtat

SEQ ID NO: 7977 - DNA, 140 bp, Artificial Sequence
  Synthetic
aggccctggctgctgatatgagatcaaagggctatacaacccctgaatagtaacaaaacacaaaaatcaataaaaatcataaaaagaaaatctcataaacaggtataagtgtcccctaaggaccttttgggacagcggtg

SEQ ID NO: 7978 - DNA, 140 bp, Artificial Sequence
  Synthetic
caccgctgtcccaaaaggtccttaggggacacttatacctgtttatgagattttctttttatgatttttattgatttttgtgttttgttactattcaggggttgtatagccctttgatctcatatcagcagccagggcct

SEQ ID NO: 7979 - DNA, 140 bp, Artificial Sequence
  Synthetic
aggccctggctgctgatatgagacacattgtatgtaggtagtaagtatagatcaaagggctatattaacccctgaatagtaacaaaacacaaaaacaataaaaactacaaaatagaaaatgaccttttgggacagcggtg

SEQ ID NO: 7980 - DNA, 140 bp, Artificial Sequence
  Synthetic
caccgctgtcccaaaaggtcattttctattttgtagtttttattgtttttgtgttttgttactattcaggggttaatatagccctttgatctatacttactacctacatacaatgtgtctcatatcagcagccagggcct

SEQ ID NO: 7981 - DNA, 140 bp, Artificial Sequence
  Synthetic
atacgccatgctgggtctccaggttcacagtagacatgaaaagggatgtgaaggtgactcctggtacaaagcacacagaggaaagacctaaggtacaggttatacaggcggctgaaccctcgtacttgggagtcggccat

SEQ ID NO: 7982 - DNA, 140 bp, Artificial Sequence
  Synthetic
atggccgactcccaagtacgagggttcagccgcctgtataacctgtaccttaggtctttcctctgtgtgctttgtaccaggagtcaccttcacatcccttttcatgtctactgtgaacctggagacccagcatggcgtat

SEQ ID NO: 7983 - DNA, 140 bp, Artificial Sequence
  Synthetic
atacgccatgctgggtctccctataaacaaaagtagttcaaagggctacaaaacccctgaatagtaacaaaacataaaatgtaataaaaattaagtgtgtacccgaaagaggtacagtaacgtacttgggagtcggccat

SEQ ID NO: 7984 - DNA, 140 bp, Artificial Sequence
  Synthetic
atggccgactcccaagtacgttactgtacctctttcgggtacacacttaatttttattacattttatgttttgttactattcaggggttttgtagccctttgaactacttttgtttatagggagacccagcatggcgtat

SEQ ID NO: 7985 - DNA, 140 bp, Artificial Sequence
  Synthetic
atacgccatgctgggtctccgaatcagtgaataccacaattggcgacgagaagagacgtaggtatttaagcttcctaaaagcagccgaactcactttgagacgtaggcatagcataccgacgtacttgggagtcggccat

SEQ ID NO: 7986 - DNA, 140 bp, Artificial Sequence
  Synthetic
atggccgactcccaagtacgtcggtatgctatgcctacgtctcaaagtgagttcggctgcttttaggaagcttaaatacctacgtctcttctcgtcgccaattgtggtattcactgattcggagacccagcatggcgtat

SEQ ID NO: 7987 - DNA, 140 bp, Artificial Sequence
  Synthetic
aggccctggctgctgatatggagacgtaggtatttaagcttcctaaaagcagccgaactcactttgagacgtaggcatagcataccgaactcttccactattctccgaacccatagggacgaccttttgggacagcggtg

SEQ ID NO: 7988 - DNA, 140 bp, Artificial Sequence
  Synthetic
caccgctgtcccaaaaggtcgtccctatgggttcggagaatagtggaagagttcggtatgctatgcctacgtctcaaagtgagttcggctgcttttaggaagcttaaatacctacgtctccatatcagcagccagggcct

SEQ ID NO: 7989 - DNA, 140 bp, Artificial Sequence
  Synthetic
atacgccatgctgggtctccatggctgcgtgagacacacatagcctaccagtttcttactgctctactctgcaaagcaagagattaataacccatcatggatcctgtgtacgtggacatacgtacttgggagtcggccat

SEQ ID NO: 7990 - DNA, 140 bp, Artificial Sequence
  Synthetic
atggccgactcccaagtacgtatgtccacgtacacaggatccatgatgggttattaatctcttgctttgcagagtagagcagtaagaaactggtaggctatgtgtgtctcacgcagccatggagacccagcatggcgtat

SEQ ID NO: 7991 - DNA, 140 bp, Artificial Sequence
  Synthetic
aggccctggctgctgatatggaggatagaagactttaaccctaccaccaacatcataccggccaacaggagactaccacactcattagtggccgaacaccgcacagtaaaaggggaaagagaccttttgggacagcggtg

SEQ ID NO: 7992 - DNA, 140 bp, Artificial Sequence
  Synthetic
caccgctgtcccaaaaggtctctttccccttttactgtgcggtgttcggccactaatgagtgtggtagtctcctgttggccggtatgatgttggtggtagggttaaagtcttctatcctccatatcagcagccagggcct

SEQ ID NO: 7993 - DNA, 140 bp, Artificial Sequence
  Synthetic
aggccctggctgctgatatgggacttgatagaggctgctttcggagagatttccagctgtcatctaccgacaggtacgcgcttcaagttcggcgccatgatgaaatctggtatgttcctagaccttttgggacagcggtg

SEQ ID NO: 7994 - DNA, 140 bp, Artificial Sequence
  Synthetic
caccgctgtcccaaaaggtctaggaacataccagatttcatcatggcgccgaacttgaagcgcgtacctgtcggtagatgacagctggaaatctctccgaaagcagcctctatcaagtcccatatcagcagccagggcct

SEQ ID NO: 7995 - DNA, 140 bp, Artificial Sequence
  Synthetic
aggccctggctgctgatatgcccattacatttggggacttcaacgaaggagaaatcgaaagcttatcttctgagctactaactttcggagacttcttaccaggagaagtggatgacttgagaccttttgggacagcggtg

SEQ ID NO: 7996 - DNA, 140 bp, Artificial Sequence
  Synthetic
caccgctgtcccaaaaggtctcaagtcatccacttctcctggtaagaagtctccgaaagttagtagctcagaagataagctttcgatttctccttcgttgaagtccccaaatgtaatgggcatatcagcagccagggcct

SEQ ID NO: 7997 - DNA, 140 bp, Artificial Sequence
  Synthetic
aggccctggctgctgatatgacttggatgaacatggaagtgaagatcatagatgcagttgtatcccagaaagccccttacttttgtggagggtttatactgcacgataccgtgacaggaagaccttttgggacagcggtg

SEQ ID NO: 7998 - DNA, 140 bp, Artificial Sequence
  Synthetic
caccgctgtcccaaaaggtcttcctgtcacggtatcgtgcagtataaaccctccacaaaagtaaggggctttctgggatacaactgcatctatgatcttcacttccatgttcatccaagtcatatcagcagccagggcct

SEQ ID NO: 7999 - DNA, 140 bp, Artificial Sequence
  Synthetic
aggccctggctgctgatatgcagcttgcagagtggcagacccgctaaaaaggctatttaaactgggcaaaccgctagcggcaggtgacgaacaagatgaggatagaagacgagcgctggcgaccttttgggacagcggtg

SEQ ID NO: 8000 - DNA, 140 bp, Artificial Sequence
  Synthetic
caccgctgtcccaaaaggtcgccagcgctcgtcttctatcctcatcttgttcgtcacctgccgctagcggtttgcccagtttaaatagcctttttagcgggtctgccactctgcaagctgcatatcagcagccagggcct

SEQ ID NO: 8001 - DNA, 140 bp, Artificial Sequence
  Synthetic
aggccctggctgctgatatgccgctagcggcaggtgacgaacaagatgaggatagaagacgagcgctggctgacgaagtggtcagatggcaacgaacagggctaattgatgagttggagagaccttttgggacagcggtg

SEQ ID NO: 8002 - DNA, 140 bp, Artificial Sequence
  Synthetic
caccgctgtcccaaaaggtctctccaactcatcaattagccctgttcgttgccatctgaccacttcgtcagccagcgctcgtcttctatcctcatcttgttcgtcacctgccgctagcggcatatcagcagccagggcct

SEQ ID NO: 8003 - DNA, 140 bp, Artificial Sequence
  Synthetic
aggccctggctgctgatatgagattaataacccatcatggatcctgtgtacgtggacatagacgctgacagcgcctttttgaaggccctgcaacgtgcgtaccccatgtttgaggtggaagaccttttgggacagcggtg

SEQ ID NO: 8004 - DNA, 140 bp, Artificial Sequence
  Synthetic
caccgctgtcccaaaaggtcttccacctcaaacatggggtacgcacgttgcagggccttcaaaaaggcgctgtcagcgtctatgtccacgtacacaggatccatgatgggttattaatctcatatcagcagccagggcct

SEQ ID NO: 8005 - DNA, 140 bp, Artificial Sequence
  Synthetic
atacgccatgctgggtctccaagcggtatactctaggtatgaagtgcagggtatatcagttgtggtaatgtccatggccacctttgcaagctccagatccaacttcgagaagctcagaggcgtacttgggagtcggccat

SEQ ID NO: 8006 - DNA, 140 bp, Artificial Sequence
  Synthetic
atggccgactcccaagtacgcctctgagcttctcgaagttggatctggagcttgcaaaggtggccatggacattaccacaactgatataccctgcacttcatacctagagtataccgcttggagacccagcatggcgtat

SEQ ID NO: 8007 - DNA, 140 bp, Artificial Sequence
  Synthetic
atacgccatgctgggtctccacccgtcataactttgtacggcggtcctaaataggtacgcactacagctacctattttgcagaagccgacagtaagtacctaaacactaatcagctacaacgtacttgggagtcggccat

SEQ ID NO: 8008 - DNA, 140 bp, Artificial Sequence
  Synthetic
atggccgactcccaagtacgttgtagctgattagtgtttaggtacttactgtcggcttctgcaaaataggtagctgtagtgcgtacctatttaggaccgccgtacaaagttatgacgggtggagacccagcatggcgtat

SEQ ID NO: 8009 - DNA, 140 bp, Artificial Sequence
  Synthetic
aggccctggctgctgatatgtggagttcatcccaacccaaactttttacaacaggaggtaccagcctcgaccctggactccgcgccctactatccaagtcatcaggcccagaccgcgcccgaccttttgggacagcggtg

SEQ ID NO: 8010 - DNA, 140 bp, Artificial Sequence
  Synthetic
caccgctgtcccaaaaggtcgggcgcggtctgggcctgatgacttggatagtagggcgcggagtccagggtcgaggctggtacctcctgttgtaaaaagtttgggttgggatgaactccacatatcagcagccagggcct

SEQ ID NO: 8011 - DNA, 140 bp, Artificial Sequence
  Synthetic
aggccctggctgctgatatggcagagagaggatgtgcatgaaaatcgaaaatgactgtattttcgaagtcaagcacgaaggtaaggtaacaggttacgcgtgcttggtgggggacaaagtgaccttttgggacagcggtg

SEQ ID NO: 8012 - DNA, 140 bp, Artificial Sequence
  Synthetic
caccgctgtcccaaaaggtcactttgtcccccaccaagcacgcgtaacctgttaccttaccttcgtgcttgacttcgaaaatacagtcattttcgattttcatgcacatcctctctctgccatatcagcagccagggcct

SEQ ID NO: 8013 - DNA, 140 bp, Artificial Sequence
  Synthetic
aggccctggctgctgatatgtataccaccaggcgattaaaggggtccgagtggcgtactgggttgggtttgacacaaccccgttcatgtacaatgccatggcgggtgcctacccctcatagaccttttgggacagcggtg

SEQ ID NO: 8014 - DNA, 140 bp, Artificial Sequence
  Synthetic
caccgctgtcccaaaaggtctatgaggggtaggcacccgccatggcattgtacatgaacggggttgtgtcaaacccaacccagtacgccactcggacccctttaatcgcctggtggtatacatatcagcagccagggcct

SEQ ID NO: 8015 - DNA, 140 bp, Artificial Sequence
  Synthetic
aggccctggctgctgatatgtatgttcaacagacctgacggaaggtagacgaggcaagttgtctattatgagagggaaaaagctaaaaccgtgcgaccgtgtgctgttctcagtagggtcgaccttttgggacagcggtg

SEQ ID NO: 8016 - DNA, 140 bp, Artificial Sequence
  Synthetic
caccgctgtcccaaaaggtcgaccctactgagaacagcacacggtcgcacggttttagctttttccctctcataatagacaacttgcctcgtctaccttccgtcaggtctgttgaacatacatatcagcagccagggcct

SEQ ID NO: 8017 - DNA, 140 bp, Artificial Sequence
  Synthetic
atacgccatgctgggtctccagagggaaaaagctaaaaccgtgcgaccgtgtgctgttctcagtagggtcaacgctttacccggaaagccgcaagctacttaagagctggcacctgccatcgtacttgggagtcggccat

SEQ ID NO: 8018 - DNA, 140 bp, Artificial Sequence
  Synthetic
atggccgactcccaagtacgatggcaggtgccagctcttaagtagcttgcggctttccgggtaaagcgttgaccctactgagaacagcacacggtcgcacggttttagctttttccctctggagacccagcatggcgtat

SEQ ID NO: 8019 - DNA, 140 bp, Artificial Sequence
  Synthetic
atacgccatgctgggtctccttcgacaacaagggacgcgtggtggccatagtcttaggaggagctaatgaaggagcccgtacagccctctcagtggtgacctggaataaagacattgtcacgtacttgggagtcggccat

SEQ ID NO: 8020 - DNA, 140 bp, Artificial Sequence
  Synthetic
atggccgactcccaagtacgtgacaatgtctttattccaggtcaccactgagagggctgtacgggctccttcattagctcctcctaagactatggccaccacgcgtcccttgttgtcgaaggagacccagcatggcgtat

SEQ ID NO: 8021 - DNA, 140 bp, Artificial Sequence
  Synthetic
atacgccatgctgggtctccatgtgcctgttggcaaataccacgttcccctgctcccagcccccttgcacaccctgctgctacgaaaaggaaccggaggaaaccctacgcatgcttgaggcgtacttgggagtcggccat

SEQ ID NO: 8022 - DNA, 140 bp, Artificial Sequence
  Synthetic
atggccgactcccaagtacgcctcaagcatgcgtagggtttcctccggttccttttcgtagcagcagggtgtgcaagggggctgggagcaggggaacgtggtatttgccaacaggcacatggagacccagcatggcgtat

SEQ ID NO: 8023 - DNA, 140 bp, Artificial Sequence
  Synthetic
aggccctggctgctgatatggacgggacgctgaaaatccaggtctccttgcaaattggaataaagacggatggtagccatgattggaccaagctgcgttacatggacaatcacatgccaggaccttttgggacagcggtg

SEQ ID NO: 8024 - DNA, 140 bp, Artificial Sequence
  Synthetic
caccgctgtcccaaaaggtcctggcatgtgattgtccatgtaacgcagcttggtccaatcatggctaccatccgtctttattccaatttgcaaggagacctggattttcagcgtcccgtccatatcagcagccagggcct

SEQ ID NO: 8025 - DNA, 140 bp, Artificial Sequence
  Synthetic
atacgccatgctgggtctcccagacgcagagagggccgggctatttgtaagaacatcagcaccatgcacgattactggaacaatgggacacttcatcctggcccgatgtccgaaaggagacgtacttgggagtcggccat

SEQ ID NO: 8026 - DNA, 140 bp, Artificial Sequence
  Synthetic
atggccgactcccaagtacgtctcctttcggacatcgggccaggatgaagtgtcccattgttccagtaatcgtgcatggtgctgatgttcttacaaatagcccggccctctctgcgtctgggagacccagcatggcgtat

SEQ ID NO: 8027 - DNA, 140 bp, Artificial Sequence
  Synthetic
aggccctggctgctgatatgattactggaacaatgggacacttcatcctggcccgatgtccgaaaggagaaactctgacggtgggattcactgacagtaggaagattagtcactcatgtagaccttttgggacagcggtg

SEQ ID NO: 8028 - DNA, 140 bp, Artificial Sequence
  Synthetic
caccgctgtcccaaaaggtctacatgagtgactaatcttcctactgtcagtgaatcccaccgtcagagtttctcctttcggacatcgggccaggatgaagtgtcccattgttccagtaatcatatcagcagccagggcct

SEQ ID NO: 8029 - DNA, 140 bp, Artificial Sequence
  Synthetic
aggccctggctgctgatatgctctacaggcagcacaggaagatgttcaggtcgaaatcgacgtggaacagcttgaggacagagcgggcgcaggaataatagagactccgagaggagctatgaccttttgggacagcggtg

SEQ ID NO: 8030 - DNA, 140 bp, Artificial Sequence
  Synthetic
caccgctgtcccaaaaggtcatagctcctctcggagtctctattattcctgcgcccgctctgtcctcaagctgttccacgtcgatttcgacctgaacatcttcctgtgctgcctgtagagcatatcagcagccagggcct

SEQ ID NO: 8031 - DNA, 140 bp, Artificial Sequence
  Synthetic
atacgccatgctgggtctcccgcacccatttcaccacgaccctcctgtgataggccgggaaaaatttcattcccgaccgcagcacggtaaagagctaccttgcagcacgtacgtgcagagcgtacttgggagtcggccat

SEQ ID NO: 8032 - DNA, 140 bp, Artificial Sequence
  Synthetic
atggccgactcccaagtacgctctgcacgtacgtgctgcaaggtagctctttaccgtgctgcggtcgggaatgaaatttttcccggcctatcacaggagggtcgtggtgaaatgggtgcgggagacccagcatggcgtat

SEQ ID NO: 8033 - DNA, 140 bp, Artificial Sequence
  Synthetic
aggccctggctgctgatatgaacggccagacggtgcggtataagtgtaattgcggtggctcaaatgaaggactaataactacagacaaagtgattaataactgcagggttgatcaatgtcgaccttttgggacagcggtg

SEQ ID NO: 8034 - DNA, 140 bp, Artificial Sequence
  Synthetic
caccgctgtcccaaaaggtcgacattgatcaaccctgcagttattaatcactttgtctgtagttattagtccttcatttgagccaccgcaattacacttataccgcaccgtctggccgttcatatcagcagccagggcct

SEQ ID NO: 8035 - DNA, 140 bp, Artificial Sequence
  Synthetic
aggccctggctgctgatatgttggcggagcaagtgaagacgtgcacgcacaacggacgagcagggaggtatgcggtcgaagcgtacgacggtcgagtcctagtgccctcaggctacgcaagaccttttgggacagcggtg

SEQ ID NO: 8036 - DNA, 140 bp, Artificial Sequence
  Synthetic
caccgctgtcccaaaaggtcttgcgtagcctgagggcactaggactcgaccgtcgtacgcttcgaccgcatacctccctgctcgtccgttgtgcgtgcacgtcttcacttgctccgccaacatatcagcagccagggcct

SEQ ID NO: 8037 - DNA, 140 bp, Artificial Sequence
  Synthetic
aggccctggctgctgatatgatgccgcggtcaccaatcacaaaaagtggcagtataactcccctctggtcccgcgtaacgctgaactcggggaccgaaaaggaaaaattcacatcccgttgaccttttgggacagcggtg

SEQ ID NO: 8038 - DNA, 140 bp, Artificial Sequence
  Synthetic
caccgctgtcccaaaaggtcaacgggatgtgaatttttccttttcggtccccgagttcagcgttacgcgggaccagaggggagttatactgccactttttgtgattggtgaccgcggcatcatatcagcagccagggcct

SEQ ID NO: 8039 - DNA, 140 bp, Artificial Sequence
  Synthetic
aggccctggctgctgatatgtccgctggcaaatgtaacatgcagggtgcctaaagcaaggaaccccaccgtgacgtacgggaaaaaccaagtcatcatgctactgtatcctgaccacccagaccttttgggacagcggtg

SEQ ID NO: 8040 - DNA, 140 bp, Artificial Sequence
  Synthetic
caccgctgtcccaaaaggtctgggtggtcaggatacagtagcatgatgacttggtttttcccgtacgtcacggtggggttccttgctttaggcaccctgcatgttacatttgccagcggacatatcagcagccagggcct

SEQ ID NO: 8041 - DNA, 140 bp, Artificial Sequence
  Synthetic
aggccctggctgctgatatgggacagaacacgagtacgtctacgacgtggatcagagaagatgctgtaagaaggaagaagccgcaggactggtactggtgggcgacttgactaatccgccgaccttttgggacagcggtg

SEQ ID NO: 8042 - DNA, 140 bp, Artificial Sequence
  Synthetic
caccgctgtcccaaaaggtcggcggattagtcaagtcgcccaccagtaccagtcctgcggcttcttccttcttacagcatcttctctgatccacgtcgtagacgtactcgtgttctgtcccatatcagcagccagggcct

SEQ ID NO: 8043 - DNA, 140 bp, Artificial Sequence
  Synthetic
atacgccatgctgggtctccacagaagtcacgccggaggatgcacagaagctgttggtggggctgaaccagagaatagtggttaacggcagaacgcaacggaacacaaacaccatgaagacgtacttgggagtcggccat

SEQ ID NO: 8044 - DNA, 140 bp, Artificial Sequence
  Synthetic
atggccgactcccaagtacgtcttcatggtgtttgtgttccgttgcgttctgccgttaaccactattctctggttcagccccaccaacagcttctgtgcatcctccggcgtgacttctgtggagacccagcatggcgtat

SEQ ID NO: 8045 - DNA, 140 bp, Artificial Sequence
  Synthetic
atacgccatgctgggtctcctcgaggttacgtggggcaacaacgagccgtataagtattggccgcagttatctgcaaacggtacagcccacggccacccgcatgagataatcttgtactacgtacttgggagtcggccat

SEQ ID NO: 8046 - DNA, 140 bp, Artificial Sequence
  Synthetic
atggccgactcccaagtacgtagtacaagattatctcatgcgggtggccgtgggctgtaccgtttgcagataactgcggccaatacttatacggctcgttgttgccccacgtaacctcgaggagacccagcatggcgtat

SEQ ID NO: 8047 - DNA, 140 bp, Artificial Sequence
  Synthetic
aggccctggctgctgatatgtctgcaaacggtacagcccacggccacccgcatgagataatcttgtactattatgagctgtaccctactatgactgtagtagttgtgtcagtggcctcgtgaccttttgggacagcggtg

SEQ ID NO: 8048 - DNA, 140 bp, Artificial Sequence
  Synthetic
caccgctgtcccaaaaggtcacgaggccactgacacaactactacagtcatagtagggtacagctcataatagtacaagattatctcatgcgggtggccgtgggctgtaccgtttgcagacatatcagcagccagggcct

SEQ ID NO: 8049 - DNA, 140 bp, Artificial Sequence
  Synthetic
aggccctggctgctgatatgacaaaattgcagtcataggagtcttcggagtaccgggatctggcaagtcagctattatcaagaacctagttaccaggcaggacctggtgactagtggaaagaccttttgggacagcggtg

SEQ ID NO: 8050 - DNA, 140 bp, Artificial Sequence
  Synthetic
caccgctgtcccaaaaggtctttccactagtcaccaggtcctgcctggtaactaggttcttgataatagctgacttgccagatcccggtactccgaagactcctatgactgcaattttgtcatatcagcagccagggcct

SEQ ID NO: 8051 - DNA, 140 bp, Artificial Sequence
  Synthetic
aggccctggctgctgatatgcgacgcagatgcatcacaccgtacgaactgacaccaggagctaccgtccctttcctgcttagcctaatatgctgcatcagaacagctaaagcggccacatgaccttttgggacagcggtg

SEQ ID NO: 8052 - DNA, 140 bp, Artificial Sequence
  Synthetic
caccgctgtcccaaaaggtcatgtggccgctttagctgttctgatgcagcatattaggctaagcaggaaagggacggtagctcctggtgtcagttcgtacggtgtgatgcatctgcgtcgcatatcagcagccagggcct

SEQ ID NO: 8053 - DNA, 140 bp, Artificial Sequence
  Synthetic
aggccctggctgctgatatgtttgtggtgacccgaagcagtgcggcttcttcaatatgatgcagatgaaagtcaactacaatcacaacatctgcacccaagtgtaccacaaaagtatctcgaccttttgggacagcggtg

SEQ ID NO: 8054 - DNA, 140 bp, Artificial Sequence
  Synthetic
caccgctgtcccaaaaggtcgagatacttttgtggtacacttgggtgcagatgttgtgattgtagttgactttcatctgcatcatattgaagaagccgcactgcttcgggtcaccacaaacatatcagcagccagggcct

SEQ ID NO: 8055 - DNA, 140 bp, Artificial Sequence
  Synthetic
atacgccatgctgggtctccctacaagcccttattccgctggcagccctgattgtcctatgcaactgtctgagactcttaccatgctgttgtaaaacgttggcttttttagccgtaatgacgtacttgggagtcggccat

SEQ ID NO: 8056 - DNA, 140 bp, Artificial Sequence
  Synthetic
atggccgactcccaagtacgtcattacggctaaaaaagccaacgttttacaacagcatggtaagagtctcagacagttgcataggacaatcagggctgccagcggaataagggcttgtagggagacccagcatggcgtat

SEQ ID NO: 8057 - DNA, 140 bp, Artificial Sequence
  Synthetic
aggccctggctgctgatatggagactcttaccatgctgttgtaaaacgttggcttttttagccgtaatgagcatcggtgcccacactgtgagcgcgtacgaacacgtaacagtgatcccggaccttttgggacagcggtg

SEQ ID NO: 8058 - DNA, 140 bp, Artificial Sequence
  Synthetic
caccgctgtcccaaaaggtccgggatcactgttacgtgttcgtacgcgctcacagtgtgggcaccgatgctcattacggctaaaaaagccaacgttttacaacagcatggtaagagtctccatatcagcagccagggcct

SEQ ID NO: 8059 - DNA, 140 bp, Artificial Sequence
  Synthetic
aggccctggctgctgatatgactacaggctcaacaaaacctgaccctggagacctcgtgttaacgtgcttcagagggtgggttaaacaactgcaaattgactatcgtggatacgaggtcagaccttttgggacagcggtg

SEQ ID NO: 8060 - DNA, 140 bp, Artificial Sequence
  Synthetic
caccgctgtcccaaaaggtctgacctcgtatccacgatagtcaatttgcagttgtttaacccaccctctgaagcacgttaacacgaggtctccagggtcaggttttgttgagcctgtagtcatatcagcagccagggcct

SEQ ID NO: 8061 - DNA, 140 bp, Artificial Sequence
  Synthetic
aggccctggctgctgatatgaacacggtgggagtaccgtataagactctagtcaacagaccgggctacagccccatggtactggagatggagctactgtcagtcactttggagccaacgcgaccttttgggacagcggtg

SEQ ID NO: 8062 - DNA, 140 bp, Artificial Sequence
  Synthetic
caccgctgtcccaaaaggtcgcgttggctccaaagtgactgacagtagctccatctccagtaccatggggctgtagcccggtctgttgactagagtcttatacggtactcccaccgtgttcatatcagcagccagggcct

SEQ ID NO: 8063 - DNA, 140 bp, Artificial Sequence
  Synthetic
aggccctggctgctgatatgcatctgcagtcaccaaatgaccttcgatacattccaaaataaagccaacgtttgttgggctaagagcttggtccctatcctcgaaacagcggggataaaagaccttttgggacagcggtg

SEQ ID NO: 8064 - DNA, 140 bp, Artificial Sequence
  Synthetic
caccgctgtcccaaaaggtcttttatccccgctgtttcgaggatagggaccaagctcttagcccaacaaacgttggctttattttggaatgtatcgaaggtcatttggtgactgcagatgcatatcagcagccagggcct

SEQ ID NO: 8065 - DNA, 140 bp, Artificial Sequence
  Synthetic
atacgccatgctgggtctcctcactgtaactgcctatgcaaacggcgaccatgccgtcacagttaaggacgccaaattcattgtggggccaatgtcttcagcctggacacctttcgacaacgtacttgggagtcggccat

SEQ ID NO: 8066 - DNA, 140 bp, Artificial Sequence
  Synthetic
atggccgactcccaagtacgttgtcgaaaggtgtccaggctgaagacattggccccacaatgaatttggcgtccttaactgtgacggcatggtcgccgtttgcataggcagttacagtgaggagacccagcatggcgtat

SEQ ID NO: 8067 - DNA, 140 bp, Artificial Sequence
  Synthetic
atacgccatgctgggtctcctttgttgggctaagagcttggtccctatcctcgaaacagcggggataaaactaaatgacaggcagtggtcccagataattcaagccttcaaagaagacaacgtacttgggagtcggccat

SEQ ID NO: 8068 - DNA, 140 bp, Artificial Sequence
  Synthetic
atggccgactcccaagtacgttgtcttctttgaaggcttgaattatctgggaccactgcctgtcatttagttttatccccgctgtttcgaggatagggaccaagctcttagcccaacaaaggagacccagcatggcgtat

SEQ ID NO: 8069 - DNA, 140 bp, Artificial Sequence
  Synthetic
aggccctggctgctgatatgagcatactcacctgaagtagccctgaatgaaatatgtacgcgcatgtatggggtggatctagacagcgggctattttctaaaccgttggtgtctgtgtatgaccttttgggacagcggtg

SEQ ID NO: 8070 - DNA, 140 bp, Artificial Sequence
  Synthetic
caccgctgtcccaaaaggtcatacacagacaccaacggtttagaaaatagcccgctgtctagatccaccccatacatgcgcgtacatatttcattcagggctacttcaggtgagtatgctcatatcagcagccagggcct

SEQ ID NO: 8071 - DNA, 140 bp, Artificial Sequence
  Synthetic
atacgccatgctgggtctccttggcgcaggaagaccaggacaatttggcgatatccaaagtcgcacgcctgagagcaaagacgtctatgctaacacacaactggtactgcagagaccggccgtacttgggagtcggccat

SEQ ID NO: 8072 - DNA, 140 bp, Artificial Sequence
  Synthetic
atggccgactcccaagtacggccggtctctgcagtaccagttgtgtgttagcatagacgtctttgctctcaggcgtgcgactttggatatcgccaaattgtcctggtcttcctgcgccaaggagacccagcatggcgtat

SEQ ID NO: 8073 - DNA, 140 bp, Artificial Sequence
  Synthetic
aggccctggctgctgatatgtacgcggataaccactgggataataggcctggagggaaaatgttcggatttaaccccgaggcagcatccattctagaaagaaagtatccattcacaaaaggaccttttgggacagcggtg

SEQ ID NO: 8074 - DNA, 140 bp, Artificial Sequence
  Synthetic
caccgctgtcccaaaaggtccttttgtgaatggatactttctttctagaatggatgctgcctcggggttaaatccgaacattttccctccaggcctattatcccagtggttatccgcgtacatatcagcagccagggcct

SEQ ID NO: 8075 - DNA, 140 bp, Artificial Sequence
  Synthetic
aggccctggctgctgatatgtaaccccgaggcagcatccattctagaaagaaagtatccattcacaaaagggaagtggaacatcaacaagcagatctgcgtgactaccaggaggatagaagaccttttgggacagcggtg

SEQ ID NO: 8076 - DNA, 140 bp, Artificial Sequence
  Synthetic
caccgctgtcccaaaaggtcttctatcctcctggtagtcacgcagatctgcttgttgatgttccacttcccttttgtgaatggatactttctttctagaatggatgctgcctcggggttacatatcagcagccagggcct

SEQ ID NO: 8077 - DNA, 140 bp, Artificial Sequence
  Synthetic
aggccctggctgctgatatgtgccaaatagcaacaaacccggtaagagcgatgaactgcgccgtagggaacatgcccatctccatcgacataccggatgcggccttcactagggtcgtcggaccttttgggacagcggtg

SEQ ID NO: 8078 - DNA, 140 bp, Artificial Sequence
  Synthetic
caccgctgtcccaaaaggtccgacgaccctagtgaaggccgcatccggtatgtcgatggagatgggcatgttccctacggcgcagttcatcgctcttaccgggtttgttgctatttggcacatatcagcagccagggcct

SEQ ID NO: 8079 - DNA, 140 bp, Artificial Sequence
  Synthetic
atacgccatgctgggtctcccatgcccatctccatcgacataccggatgcggccttcactagggtcgtcgacgcgccctctttaacggacatgtcatgcgaggtaccagcctgcacccatcgtacttgggagtcggccat

SEQ ID NO: 8080 - DNA, 140 bp, Artificial Sequence
  Synthetic
atggccgactcccaagtacgatgggtgcaggctggtacctcgcatgacatgtccgttaaagagggcgcgtcgacgaccctagtgaaggccgcatccggtatgtcgatggagatgggcatgggagacccagcatggcgtat

SEQ ID NO: 8081 - DNA, 140 bp, Artificial Sequence
  Synthetic
aggccctggctgctgatatgacgcgccctctttaacggacatgtcatgcgaggtaccagcctgcacccattcctcagactttgggggcgtcgccattattaagtatgcagccagcaagaagaccttttgggacagcggtg

SEQ ID NO: 8082 - DNA, 140 bp, Artificial Sequence
  Synthetic
caccgctgtcccaaaaggtcttcttgctggctgcatacttaataatggcgacgcccccaaagtctgaggaatgggtgcaggctggtacctcgcatgacatgtccgttaaagagggcgcgtcatatcagcagccagggcct

SEQ ID NO: 8083 - DNA, 140 bp, Artificial Sequence
  Synthetic
aggccctggctgctgatatggtaggtatgaccttgtggtcataaacatccacacaccttttcgcatacaccattaccaacagtgcgtcgaccacgcaatgaaactgcaaatgctcggggggaccttttgggacagcggtg

SEQ ID NO: 8084 - DNA, 140 bp, Artificial Sequence
  Synthetic
caccgctgtcccaaaaggtccccccgagcatttgcagtttcattgcgtggtcgacgcactgttggtaatggtgtatgcgaaaaggtgtgtggatgtttatgaccacaaggtcatacctaccatatcagcagccagggcct

SEQ ID NO: 8085 - DNA, 140 bp, Artificial Sequence
  Synthetic
aggccctggctgctgatatgtgggtgcagaagatcacgggaggtgtgggactggttgtcgctgttgcagcactgattctaatcgtggtgctatgcgtgtcgttcagcaggcactaacttggaccttttgggacagcggtg

SEQ ID NO: 8086 - DNA, 140 bp, Artificial Sequence
  Synthetic
caccgctgtcccaaaaggtccaagttagtgcctgctgaacgacacgcatagcaccacgattagaatcagtgctgcaacagcgacaaccagtcccacacctcccgtgatcttctgcacccacatatcagcagccagggcct

SEQ ID NO: 8087 - DNA, 140 bp, Artificial Sequence
  Synthetic
aggccctggctgctgatatgactgattctaatcgtggtgctatgcgtgtcgttcagcaggcactaacttgacgactaagcatgaaggtatatgtgtcccctaagagacacaccgtatatagaccttttgggacagcggtg

SEQ ID NO: 8088 - DNA, 140 bp, Artificial Sequence
  Synthetic
caccgctgtcccaaaaggtctatatacggtgtgtctcttaggggacacatataccttcatgcttagtcgtcaagttagtgcctgctgaacgacacgcatagcaccacgattagaatcagtcatatcagcagccagggcct

SEQ ID NO: 8089 - DNA, 140 bp, Artificial Sequence
  Synthetic
atacgccatgctgggtctccacgactaagcatgaaggtatatgtgtcccctaagagacacaccgtatatagctaataatctgtagatcaaagggctacataacccctgaatagtaacaaacgtacttgggagtcggccat

SEQ ID NO: 8090 - DNA, 140 bp, Artificial Sequence
  Synthetic
atggccgactcccaagtacgtttgttactattcaggggttatgtagccctttgatctacagattattagctatatacggtgtgtctcttaggggacacatataccttcatgcttagtcgtggagacccagcatggcgtat

SEQ ID NO: 8091 - DNA, 140 bp, Artificial Sequence
  Synthetic
aggccctggctgctgatatgaagtttagatcgtctagagcgttgaaaccaccatgtgtcaccagcaacactgagatgtttttcctattcagcaactttgacaatggcagaaggaatttcagaccttttgggacagcggtg

SEQ ID NO: 8092 - DNA, 140 bp, Artificial Sequence
  Synthetic
caccgctgtcccaaaaggtctgaaattccttctgccattgtcaaagttgctgaataggaaaaacatctcagtgttgctggtgacacatggtggtttcaacgctctagacgatctaaacttcatatcagcagccagggcct

SEQ ID NO: 8093 - DNA, 140 bp, Artificial Sequence
  Synthetic
aggccctggctgctgatatgatacaaaatcactaaaaattataaaaacagaaaaatacataaataggtatacgtgtcccctaagagacacattgtatgtaggtgataagtatagatcaaagaccttttgggacagcggtg

SEQ ID NO: 8094 - DNA, 140 bp, Artificial Sequence
  Synthetic
caccgctgtcccaaaaggtctttgatctatacttatcacctacatacaatgtgtctcttaggggacacgtatacctatttatgtatttttctgtttttataatttttagtgattttgtatcatatcagcagccagggcct

SEQ ID NO: 8095 - DNA, 140 bp, Artificial Sequence
  Synthetic
atacgccatgctgggtctccacgtgtcccctaagagacacattgtatgtaggtgataagtatagatcaaagggccgaacaacccctgaatagtaacaaaatatgaaaattaataaaaatccgtacttgggagtcggccat

SEQ ID NO: 8096 - DNA, 140 bp, Artificial Sequence
  Synthetic
atggccgactcccaagtacggatttttattaattttcatattttgttactattcaggggttgttcggccctttgatctatacttatcacctacatacaatgtgtctcttaggggacacgtggagacccagcatggcgtat

SEQ ID NO: 8097 - DNA, 140 bp, Artificial Sequence
  Synthetic
aggccctggctgctgatatgcgggtgacggtgtttgcaaggcagtatacaaaaaatggccggagtcctttaagaacagtgcaacaccagtgggaaccgcaaaaacagttatgtgcggtacgaccttttgggacagcggtg

SEQ ID NO: 8098 - DNA, 140 bp, Artificial Sequence
  Synthetic
caccgctgtcccaaaaggtcgtaccgcacataactgtttttgcggttcccactggtgttgcactgttcttaaaggactccggccattttttgtatactgccttgcaaacaccgtcacccgcatatcagcagccagggcct

SEQ ID NO: 8099 - DNA, 140 bp, Artificial Sequence
  Synthetic
atacgccatgctgggtctccgtatccagtaatccacgctgttggaccaaacttctctaattattcggagtctgaaggggaccgggaattggcagctgcctatcgagaagtcgcaaaggaacgtacttgggagtcggccat

SEQ ID NO: 8100 - DNA, 140 bp, Artificial Sequence
  Synthetic
atggccgactcccaagtacgttcctttgcgacttctcgataggcagctgccaattcccggtccccttcagactccgaataattagagaagtttggtccaacagcgtggattactggatacggagacccagcatggcgtat

SEQ ID NO: 8101 - DNA, 140 bp, Artificial Sequence
  Synthetic
atacgccatgctgggtctccataaaatagaaaaaccataaacagaagtagttcaaagggctataaaaacccctgaatagtaacaaaacataaaactaataaaaatcaaatgaataccatacgtacttgggagtcggccat

SEQ ID NO: 8102 - DNA, 140 bp, Artificial Sequence
  Synthetic
atggccgactcccaagtacgtatggtattcatttgatttttattagttttatgttttgttactattcaggggtttttatagccctttgaactacttctgtttatggtttttctattttatggagacccagcatggcgtat

SEQ ID NO: 8103 - DNA, 140 bp, Artificial Sequence
  Synthetic
aggccctggctgctgatatgattggcaaacggaagagatgtaggtacttaagcttcctaaaagcagccgaactcactttgagatgtaggcatagcataccgaactcttccacgattctccgaccttttgggacagcggtg

SEQ ID NO: 8104 - DNA, 140 bp, Artificial Sequence
  Synthetic
caccgctgtcccaaaaggtcggagaatcgtggaagagttcggtatgctatgcctacatctcaaagtgagttcggctgcttttaggaagcttaagtacctacatctcttccgtttgccaatcatatcagcagccagggcct

SEQ ID NO: 8105 - DNA, 140 bp, Artificial Sequence
  Synthetic
aggccctggctgctgatatgacttaagcttcctaaaagcagccgaactcactttgagatgtaggcatagcataccgaactcttccacgattctccgaacccacagggacgtaggagatgtgaccttttgggacagcggtg

SEQ ID NO: 8106 - DNA, 140 bp, Artificial Sequence
  Synthetic
caccgctgtcccaaaaggtcacatctcctacgtccctgtgggttcggagaatcgtggaagagttcggtatgctatgcctacatctcaaagtgagttcggctgcttttaggaagcttaagtcatatcagcagccagggcct

SEQ ID NO: 8107 - DNA, 140 bp, Artificial Sequence
  Synthetic
aggccctggctgctgatatgttacagccatggactcgacggatgcagacgtggtcatctactgccgcgacaaagaatgggagaagaaaatatctgaggccatacagatgcggacccaagtgaccttttgggacagcggtg

SEQ ID NO: 8108 - DNA, 140 bp, Artificial Sequence
  Synthetic
caccgctgtcccaaaaggtcacttgggtccgcatctgtatggcctcagatattttcttctcccattctttgtcgcggcagtagatgaccacgtctgcatccgtcgagtccatggctgtaacatatcagcagccagggcct

SEQ ID NO: 8109 - DNA, 140 bp, Artificial Sequence; identical to SEQ ID NO: 6817
  Synthetic

SEQ ID NO: 8110 - DNA, 140 bp, Artificial Sequence; identical to SEQ ID NO: 6818
  Synthetic

SEQ ID NO: 8111 - DNA, 140 bp, Artificial Sequence
  Synthetic
aggccctggctgctgatatggacgctgacagcgcctttttgaaggccctgcaacgtgcgtaccccatgtttgaggtggaacctaggcaggtcacatcgaatgaccatgctaatgctagaggaccttttgggacagcggtg

SEQ ID NO: 8112 - DNA, 140 bp, Artificial Sequence
  Synthetic
caccgctgtcccaaaaggtcctctagcattagcatggtcattcgatgtgacctgcctaggttccacctcaaacatggggtacgcacgttgcagggccttcaaaaaggcgctgtcagcgtccatatcagcagccagggcct

SEQ ID NO: 8113 - DNA, 140 bp, Artificial Sequence
  Synthetic
atacgccatgctgggtctccactgcccaactaacagaccacgtcgtgggggagtacctggtactttccccgcagaccgtactacgcagccagaagctcagcctgatccacgccttggcggcgtacttgggagtcggccat

SEQ ID NO: 8114 - DNA, 140 bp, Artificial Sequence
  Synthetic
atggccgactcccaagtacgccgccaaggcgtggatcaggctgagcttctggctgcgtagtacggtctgcggggaaagtaccaggtactcccccacgacgtggtctgttagttgggcagtggagacccagcatggcgtat

SEQ ID NO: 8115 - DNA, 140 bp, Artificial Sequence
  Synthetic
atacgccatgctgggtctccgactcgctaattatgcgagaaagctcgcatctgccgcaggaatagtcctggacagaaacatttctggaaagatcggggacttacaagcggtgatggccgtcgtacttgggagtcggccat

SEQ ID NO: 8116 - DNA, 140 bp, Artificial Sequence
  Synthetic
atggccgactcccaagtacgacggccatcaccgcttgtaagtccccgatctttccagaaatgtttctgtccaggactattcctgcggcagatgcgagctttctcgcataattagcgagtcggagacccagcatggcgtat

SEQ ID NO: 8117 - DNA, 140 bp, Artificial Sequence
  Synthetic
atacgccatgctgggtctccactggtatggaagacactttccggcgacccgtggataaagacgctgcagaacccaccgaaaggaaacttcaaagcaactattaaggagtgggaggtggagcgtacttgggagtcggccat

SEQ ID NO: 8118 - DNA, 140 bp, Artificial Sequence
  Synthetic
atggccgactcccaagtacgctccacctcccactccttaatagttgctttgaagtttcctttcggtgggttctgcagcgtctttatccacgggtcgccggaaagtgtcttccataccagtggagacccagcatggcgtat

SEQ ID NO: 8119 - DNA, 140 bp, Artificial Sequence
  Synthetic
aggccctggctgctgatatgaaaatagaaggagtgcaaaaagtcaaatgctccaaggtaatgctatttgaccacaacgtgccatcgcgcgtaagtccaagggaatacagaccttcccagggaccttttgggacagcggtg

SEQ ID NO: 8120 - DNA, 140 bp, Artificial Sequence
  Synthetic
caccgctgtcccaaaaggtccctgggaaggtctgtattcccttggacttacgcgcgatggcacgttgtggtcaaatagcattaccttggagcatttgactttttgcactccttctattttcatatcagcagccagggcct

SEQ ID NO: 8121 - DNA, 140 bp, Artificial Sequence
  Synthetic
aggccctggctgctgatatgccacaacgtgccatcgcgcgtaagtccaagggaatacagaccttcccaggagtctgtacaggaagcgagtacgaccacgtcactgacgcatagccaattcgaccttttgggacagcggtg

SEQ ID NO: 8122 - DNA, 140 bp, Artificial Sequence
  Synthetic
caccgctgtcccaaaaggtcgaattggctatgcgtcagtgacgtggtcgtactcgcttcctgtacagactcctgggaaggtctgtattcccttggacttacgcgcgatggcacgttgtggcatatcagcagccagggcct

SEQ ID NO: 8123 - DNA, 140 bp, Artificial Sequence
  Synthetic
aggccctggctgctgatatgtgacgccccagccctagaaccagcccttgacgacggggcgatacacacgttgccatctgcaaccggaaaccttgcggccgtgtctgactgggtaatgagcgaccttttgggacagcggtg

SEQ ID NO: 8124 - DNA, 140 bp, Artificial Sequence
  Synthetic
caccgctgtcccaaaaggtcgctcattacccagtcagacacggccgcaaggtttccggttgcagatggcaacgtgtgtatcgccccgtcgtcaagggctggttctagggctggggcgtcacatatcagcagccagggcct

SEQ ID NO: 8125 - DNA, 140 bp, Artificial Sequence
  Synthetic
aggccctggctgctgatatgaccgtacctgtcgcgccgcccagaagaaggcgagggagaaacctgactgtgacatgtgacgagagagaagggaatataacacccatggctagcgtccgatgaccttttgggacagcggtg

SEQ ID NO: 8126 - DNA, 140 bp, Artificial Sequence
  Synthetic
caccgctgtcccaaaaggtcatcggacgctagccatgggtgttatattcccttctctctcgtcacatgtcacagtcaggtttctccctcgccttcttctgggcggcgcgacaggtacggtcatatcagcagccagggcct

SEQ ID NO: 8127 - DNA, 140 bp, Artificial Sequence
  Synthetic
aggccctggctgctgatatggacacagcaatgtctcttcaggcaccaccgagtaccgccacggaaccgaatcatccgccgatctccttcggagcatcaagcgagacgttccccattacatgaccttttgggacagcggtg

SEQ ID NO: 8128 - DNA, 140 bp, Artificial Sequence
  Synthetic
caccgctgtcccaaaaggtcatgtaatggggaacgtctcgcttgatgctccgaaggagatcggcggatgattcggttccgtggcggtactcggtggtgcctgaagagacattgctgtgtccatatcagcagccagggcct

SEQ ID NO: 8129 - DNA, 140 bp, Artificial Sequence
  Synthetic
aggccctggctgctgatatgactttcggagacttcttaccaggagaagtggatgacttgacagacagcgactggtccacgtgctcagacacggacgacgagttatgactagacagggcaggaccttttgggacagcggtg

SEQ ID NO: 8130 - DNA, 140 bp, Artificial Sequence
  Synthetic
caccgctgtcccaaaaggtcctgccctgtctagtcataactcgtcgtccgtgtctgagcacgtggaccagtcgctgtctgtcaagtcatccacttctcctggtaagaagtctccgaaagtcatatcagcagccagggcct

SEQ ID NO: 8131 - DNA, 140 bp, Artificial Sequence
  Synthetic
atacgccatgctgggtctccttggtggggctgaaccagaggatagtggttaacggcagaacgcaacggaacacgaacaccatgaagaactacctacttcccgtggtcgcccaggccttcacgtacttgggagtcggccat

SEQ ID NO: 8132 - DNA, 140 bp, Artificial Sequence
  Synthetic
atggccgactcccaagtacgtgaaggcctgggcgaccacgggaagtaggtagttcttcatggtgttcgtgttccgttgcgttctgccgttaaccactatcctctggttcagccccaccaaggagacccagcatggcgtat

SEQ ID NO: 8133 - DNA, 140 bp, Artificial Sequence
  Synthetic
atacgccatgctgggtctccgtaagtgggcaaaggagtgccggaaggacatggaagatgagaagcttctgggggtcagagaaagaacactaacctgctgctgtctatgggcatttaagaacgtacttgggagtcggccat

SEQ ID NO: 8134 - DNA, 140 bp, Artificial Sequence
  Synthetic
atggccgactcccaagtacgttcttaaatgcccatagacagcagcaggttagtgttctttctctgacccccagaagcttctcatcttccatgtccttccggcactcctttgcccacttacggagacccagcatggcgtat

SEQ ID NO: 8135 - DNA, 140 bp, Artificial Sequence
  Synthetic
atacgccatgctgggtctccgcagaaaacacacacggtctacaagaggcctgatacccagtcaatccagaaggttcaggccgaatttgacagctttgtagtaccgggcctgtggtcgtcccgtacttgggagtcggccat

SEQ ID NO: 8136 - DNA, 140 bp, Artificial Sequence
  Synthetic
atggccgactcccaagtacgggacgaccacaggcccggtactacaaagctgtcaaattcggcctgaaccttctggattgactgggtatcaggcctcttgtagaccgtgtgtgttttctgcggagacccagcatggcgtat

SEQ ID NO: 8137 - DNA, 140 bp, Artificial Sequence
  Synthetic
aggccctggctgctgatatgaggttcaggccgaatttgacagctttgtagtaccgggcctgtggtcgtccgggttgtcaatcccgttgaggactagaatcaagtggttgttacgcaaggtgaccttttgggacagcggtg

SEQ ID NO: 8138 - DNA, 140 bp, Artificial Sequence
  Synthetic
caccgctgtcccaaaaggtcaccttgcgtaacaaccacttgattctagtcctcaacgggattgacaacccggacgaccacaggcccggtactacaaagctgtcaaattcggcctgaacctcatatcagcagccagggcct

SEQ ID NO: 8139 - DNA, 140 bp, Artificial Sequence
  Synthetic
atacgccatgctgggtctcctcgcgcaaagtagaaaacatgaaagcagcaatcatccagagactaaagagaggctgtagactatacttaatgtcagagaccccaaaagtccctacttacccgtacttgggagtcggccat

SEQ ID NO: 8140 - DNA, 140 bp, Artificial Sequence
  Synthetic
atggccgactcccaagtacgggtaagtagggacttttggggtctctgacattaagtatagtctacagcctctctttagtctctggatgattgctgctttcatgttttctactttgcgcgaggagacccagcatggcgtat

SEQ ID NO: 8141 - DNA, 140 bp, Artificial Sequence
  Synthetic
atacgccatgctgggtctccgccgaaaacagacctgatcccatacagcgggaatgcccaagaagcccaggatgcagaaaaagaagcagaggaagaacgagaagcagaactgactcatgagcgtacttgggagtcggccat

SEQ ID NO: 8142 - DNA, 140 bp, Artificial Sequence
  Synthetic
atggccgactcccaagtacgctcatgagtcagttctgcttctcgttcttcctctgcttctttttctgcatcctgggcttcttgggcattcccgctgtatgggatcaggtctgttttcggcggagacccagcatggcgtat

SEQ ID NO: 8143 - DNA, 140 bp, Artificial Sequence
  Synthetic
atacgccatgctgggtctccatgcagaaaaagaagcagaggaagaacgagaagcagaactgactcatgaggctctaccacccctacaggcagcacaggaagatgtccaggtcgaaatcgacgtacttgggagtcggccat

SEQ ID NO: 8144 - DNA, 140 bp, Artificial Sequence
  Synthetic
atggccgactcccaagtacgtcgatttcgacctggacatcttcctgtgctgcctgtaggggtggtagagcctcatgagtcagttctgcttctcgttcttcctctgcttctttttctgcatggagacccagcatggcgtat

SEQ ID NO: 8145 - DNA, 140 bp, Artificial Sequence
  Synthetic
aggccctggctgctgatatgttaagaaactccaggagagtgcatccatggccaacagaagcaggtatcagtcgcgcaaagtagaaaacatgaaagcagcaatcatccagagactaaagaggaccttttgggacagcggtg

SEQ ID NO: 8146 - DNA, 140 bp, Artificial Sequence
  Synthetic
caccgctgtcccaaaaggtcctctttagtctctggatgattgctgctttcatgttttctactttgcgcgactgatacctgcttctgttggccatggatgcactctcctggagtttcttaacatatcagcagccagggcct

SEQ ID NO: 8147 - DNA, 140 bp, Artificial Sequence; identical to SEQ ID NO: 6825
  Synthetic

SEQ ID NO: 8148 - DNA, 140 bp, Artificial Sequence; identical to SEQ ID NO: 6826
  Synthetic

SEQ ID NO: 8149 - DNA, 140 bp, Artificial Sequence
  Synthetic
atacgccatgctgggtctccgaggcgctatcaaagttactgcccaactaacagaccacgtcgtgggggagtacctggtactttccccgcagaccgtactacgcagccagaagctcagcctcgtacttgggagtcggccat

SEQ ID NO: 8150 - DNA, 140 bp, Artificial Sequence
  Synthetic
atggccgactcccaagtacgaggctgagcttctggctgcgtagtacggtctgcggggaaagtaccaggtactcccccacgacgtggtctgttagttgggcagtaactttgatagcgcctcggagacccagcatggcgtat

SEQ ID NO: 8151 - DNA, 140 bp, Artificial Sequence
  Synthetic
aggccctggctgctgatatgtacctggtactttccccgcagaccgtactacgcagccagaagctcagcctgatccacgctttagcggagcaagtgaagacgtgtacgcacagcggacgaggaccttttgggacagcggtg

SEQ ID NO: 8152 - DNA, 140 bp, Artificial Sequence
  Synthetic
caccgctgtcccaaaaggtcctcgtccgctgtgcgtacacgtcttcacttgctccgctaaagcgtggatcaggctgagcttctggctgcgtagtacggtctgcggggaaagtaccaggtacatatcagcagccagggcct

SEQ ID NO: 8153 - DNA, 140 bp, Artificial Sequence
  Synthetic
aggccctggctgctgatatgaggctgtagactatacttaatgtcagagaccccaaaagtccctacttaccggactacatatccggcgcctgtgtactcgcctccgatcaacgtccgattggaccttttgggacagcggtg

SEQ ID NO: 8154 - DNA, 140 bp, Artificial Sequence
  Synthetic
caccgctgtcccaaaaggtccaatcggacgttgatcggaggcgagtacacaggcgccggatatgtagtccggtaagtagggacttttggggtctctgacattaagtatagtctacagcctcatatcagcagccagggcct

SEQ ID NO: 8155 - DNA, 140 bp, Artificial Sequence
  Synthetic
aggccctggctgctgatatgcagggaggtatgcggtcgaagcgtacgatggccgagtcctagtgccctcaggctatgcaatttcgcctgaagacttccagagtctaagcgaaagcgcaacgaccttttgggacagcggtg

SEQ ID NO: 8156 - DNA, 140 bp, Artificial Sequence
  Synthetic
caccgctgtcccaaaaggtcgttgcgctttcgcttagactctggaagtcttcaggcgaaattgcatagcctgagggcactaggactcggccatcgtacgcttcgaccgcatacctccctgcatatcagcagccagggcct

SEQ ID NO: 8157 - DNA, 140 bp, Artificial Sequence
  Synthetic
aggccctggctgctgatatgatgcaaccaagaatactgggaagaatttgctgccagccctattaggataacaactgagaatttagcaacctatgttactaaactaaaagggccaaaagcagaccttttgggacagcggtg

SEQ ID NO: 8158 - DNA, 140 bp, Artificial Sequence
  Synthetic
caccgctgtcccaaaaggtctgcttttggcccttttagtttagtaacataggttgctaaattctcagttgttatcctaatagggctggcagcaaattcttcccagtattcttggttgcatcatatcagcagccagggcct

SEQ ID NO: 8159 - DNA, 140 bp, Artificial Sequence
  Synthetic
aggccctggctgctgatatgtagacatggtggacgggtcggagagttgcctggaccgagcgacattcaatccgtcaaaactcaggagctacccgaaacagcacgcttaccacgcgccctcgaccttttgggacagcggtg

SEQ ID NO: 8160 - DNA, 140 bp, Artificial Sequence
  Synthetic
caccgctgtcccaaaaggtcgagggcgcgtggtaagcgtgctgtttcgggtagctcctgagttttgacggattgaatgtcgctcggtccaggcaactctccgacccgtccaccatgtctacatatcagcagccagggcct

SEQ ID NO: 8161 - DNA, 140 bp, Artificial Sequence
  Synthetic
atacgccatgctgggtctccctaatccgccctaccacgaattcgcatacgaagggctaaaaattcgccccgcctgcccatacaaaattgcagtcataggagtcttcggggtaccaggatccgtacttgggagtcggccat

SEQ ID NO: 8162 - DNA, 140 bp, Artificial Sequence
  Synthetic
atggccgactcccaagtacggatcctggtaccccgaagactcctatgactgcaattttgtatgggcaggcggggcgaatttttagcccttcgtatgcgaattcgtggtagggcggattagggagacccagcatggcgtat

SEQ ID NO: 8163 - DNA, 140 bp, Artificial Sequence
  Synthetic
aggccctggctgctgatatgcagagaggtctagagatatctgcacgtacggtagattcgctgctcttgaatggatgcaacagaccagtcgacgtgttgtacgtagacgaggcgtttgcgtgaccttttgggacagcggtg

SEQ ID NO: 8164 - DNA, 140 bp, Artificial Sequence
  Synthetic
caccgctgtcccaaaaggtcacgcaaacgcctcgtctacgtacaacacgtcgactggtctgttgcatccattcaagagcagcgaatctaccgtacgtgcagatatctctagacctctctgcatatcagcagccagggcct

SEQ ID NO: 8165 - DNA, 140 bp, Artificial Sequence
  Synthetic
atacgccatgctgggtctccacttgcgcttactgctttgatgctgttagaggatttaggggtggatcactccctgctggacttgatagaggctgctttcggagagatttccagctgtcaccgtacttgggagtcggccat

SEQ ID NO: 8166 - DNA, 140 bp, Artificial Sequence
  Synthetic
atggccgactcccaagtacggtgacagctggaaatctctccgaaagcagcctctatcaagtccagcagggagtgatccacccctaaatcctctaacagcatcaaagcagtaagcgcaagtggagacccagcatggcgtat

SEQ ID NO: 8167 - DNA, 140 bp, Artificial Sequence
  Synthetic
aggccctggctgctgatatgtaacgtgcttcagagggtgggttaaacaactgcaaattgactatcgtggacacgaggtcatgacagcagccgcatcccaagggttaactagaaaaggagtgaccttttgggacagcggtg

SEQ ID NO: 8168 - DNA, 140 bp, Artificial Sequence
  Synthetic
caccgctgtcccaaaaggtcactccttttctagttaacccttgggatgcggctgctgtcatgacctcgtgtccacgatagtcaatttgcagttgtttaacccaccctctgaagcacgttacatatcagcagccagggcct

SEQ ID NO: 8169 - DNA, 140 bp, Artificial Sequence
  Synthetic
aggccctggctgctgatatgacaggaacagcttgcagagtggcagacccgctaaaaaggctttttaaactgggcaaaccgctagcggcaggtgacgaacaagatgaagatagaagacgaggaccttttgggacagcggtg

SEQ ID NO: 8170 - DNA, 140 bp, Artificial Sequence
  Synthetic
caccgctgtcccaaaaggtcctcgtcttctatcttcatcttgttcgtcacctgccgctagcggtttgcccagtttaaaaagcctttttagcgggtctgccactctgcaagctgttcctgtcatatcagcagccagggcct

SEQ ID NO: 8171 - DNA, 140 bp, Artificial Sequence
  Synthetic
atacgccatgctgggtctccctggagaaagcggtatactctaggtacgaagtgcagggtatatcagttgtggtaatgtccatggccacctttgcaagctccagatccaacttcgagaagccgtacttgggagtcggccat

SEQ ID NO: 8172 - DNA, 140 bp, Artificial Sequence
  Synthetic
atggccgactcccaagtacggcttctcgaagttggatctggagcttgcaaaggtggccatggacattaccacaactgatataccctgcacttcgtacctagagtataccgctttctccagggagacccagcatggcgtat

SEQ ID NO: 8173 - DNA, 140 bp, Artificial Sequence
  Synthetic
aggccctggctgctgatatgtaatggcgggcatctgcagtcaccaagtgacctttgacacattccaaaacaaagccaacgtttgctgggctaagagcttggtccctatcctcgaaacagcgaccttttgggacagcggtg

SEQ ID NO: 8174 - DNA, 140 bp, Artificial Sequence
  Synthetic
caccgctgtcccaaaaggtcgctgtttcgaggatagggaccaagctcttagcccagcaaacgttggctttgttttggaatgtgtcaaaggtcacttggtgactgcagatgcccgccattacatatcagcagccagggcct

SEQ ID NO: 8175 - DNA, 140 bp, Artificial Sequence
  Synthetic
aggccctggctgctgatatgaagaagacaaagcatactcacccgaagtagccctgaatgaaatatgcacgcgcatgtatggggtggatctagacagtgggctattctctaaaccgttggtgaccttttgggacagcggtg

SEQ ID NO: 8176 - DNA, 140 bp, Artificial Sequence
  Synthetic
caccgctgtcccaaaaggtcaccaacggtttagagaatagcccactgtctagatccaccccatacatgcgcgtgcatatttcattcagggctacttcgggtgagtatgctttgtcttcttcatatcagcagccagggcct

SEQ ID NO: 8177 - DNA, 140 bp, Artificial Sequence
  Synthetic
aggccctggctgctgatatgatcaaaagaagcagccacctaaaaagaaaccggctcaaaagaaaaagaagccgggccgcagagagaggatgtgcatgaaaatcgaaaatgattgtattttgaccttttgggacagcggtg

SEQ ID NO: 8178 - DNA, 140 bp, Artificial Sequence
  Synthetic
caccgctgtcccaaaaggtcaaaatacaatcattttcgattttcatgcacatcctctctctgcggcccggcttctttttcttttgagccggtttctttttaggtggctgcttcttttgatcatatcagcagccagggcct

SEQ ID NO: 8179 - DNA, 140 bp, Artificial Sequence
  Synthetic
atacgccatgctgggtctccatctgtgtattacgcggataaccattgggataataggccgggaggaaagatgttcggattcaaccctgaggcagcgtccattctagaaagaaagtacccacgtacttgggagtcggccat

SEQ ID NO: 8180 - DNA, 140 bp, Artificial Sequence
  Synthetic
atggccgactcccaagtacgtgggtactttctttctagaatggacgctgcctcagggttgaatccgaacatctttcctcccggcctattatcccaatggttatccgcgtaatacacagatggagacccagcatggcgtat

SEQ ID NO: 8181 - DNA, 140 bp, Artificial Sequence
  Synthetic
aggccctggctgctgatatgacaaagtaatgaaaccagcacacgtaaaggggaccatcgataacgcggacctggccaaactggcctttaagcggtcatccaagtatgaccttgaatgcgcgaccttttgggacagcggtg

SEQ ID NO: 8182 - DNA, 140 bp, Artificial Sequence
  Synthetic
caccgctgtcccaaaaggtcgcgcattcaaggtcatacttggatgaccgcttaaaggccagtttggccaggtccgcgttatcgatggtcccctttacgtgtgctggtttcattactttgtcatatcagcagccagggcct

SEQ ID NO: 8183 - DNA, 140 bp, Artificial Sequence
  Synthetic
aggccctggctgctgatatggactaccacactcattagtggccgaacaccgcccagtaaaaggggaaagaatggaatggctggttaacaagataaacggacaccacgtactcctggttaggaccttttgggacagcggtg

SEQ ID NO: 8184 - DNA, 140 bp, Artificial Sequence
  Synthetic
caccgctgtcccaaaaggtcctaaccaggagtacgtggtgtccgtttatcttgttaaccagccattccattctttccccttttactgggcggtgttcggccactaatgagtgtggtagtccatatcagcagccagggcct

SEQ ID NO: 8185 - DNA, 140 bp, Artificial Sequence
  Synthetic
atacgccatgctgggtctcccccagttatgtgcctgctggcaaacaccacgttcccctgctcccagcccccttgcacgccctgctgctacgaaaaggaaccggaggaaaccctacgcatgcgtacttgggagtcggccat

SEQ ID NO: 8186 - DNA, 140 bp, Artificial Sequence
  Synthetic
atggccgactcccaagtacgcatgcgtagggtttcctccggttccttttcgtagcagcagggcgtgcaagggggctgggagcaggggaacgtggtgtttgccagcaggcacataactgggggagacccagcatggcgtat

SEQ ID NO: 8187 - DNA, 140 bp, Artificial Sequence
  Synthetic
atacgccatgctgggtctcccttgaggacaacatcatgagacctgggtactatcagctgctacaggcatccttaacatgttcttcccaccgccagcgacgcagcaccaaggacaatttcacgtacttgggagtcggccat

SEQ ID NO: 8188 - DNA, 140 bp, Artificial Sequence
  Synthetic
atggccgactcccaagtacgtgaaattgtccttggtgctgcgtcgctggcggtgggaagaacatgttaaggatgcctgtagcagctgatagtacccaggtctcatgatgttgtcctcaagggagacccagcatggcgtat

SEQ ID NO: 8189 - DNA, 140 bp, Artificial Sequence
  Synthetic
atacgccatgctgggtctcccgcgggttaccaggtgacggtgtttgcaaggcagtatataaaaagtggccggagtcctttaaaaacagtgcaacaccagtaggaaccgcaaaaacagttacgtacttgggagtcggccat

SEQ ID NO: 8190 - DNA, 140 bp, Artificial Sequence
  Synthetic
atggccgactcccaagtacgtaactgtttttgcggttcctactggtgttgcactgtttttaaaggactccggccactttttatatactgccttgcaaacaccgtcacctggtaacccgcgggagacccagcatggcgtat

SEQ ID NO: 8191 - DNA, 140 bp, Artificial Sequence
  Synthetic
aggccctggctgctgatatgatgccagcagacgcagagagggcggggctatttgtaagaacatcagcaccgtgtacgattactggaacaatgggacacttcatcctggcccgatgtccaagaccttttgggacagcggtg

SEQ ID NO: 8192 - DNA, 140 bp, Artificial Sequence
  Synthetic
caccgctgtcccaaaaggtcttggacatcgggccaggatgaagtgtcccattgttccagtaatcgtacacggtgctgatgttcttacaaatagccccgccctctctgcgtctgctggcatcatatcagcagccagggcct

SEQ ID NO: 8193 - DNA, 140 bp, Artificial Sequence
  Synthetic
aggccctggctgctgatatgtctccacaggtgtatactcaggagggaaagacaggctaacccagtcactgaaccacctctttacagccatggactcgacggatgcagacgtggtcatctagaccttttgggacagcggtg

SEQ ID NO: 8194 - DNA, 140 bp, Artificial Sequence
  Synthetic
caccgctgtcccaaaaggtctagatgaccacgtctgcatccgtcgagtccatggctgtaaagaggtggttcagtgactgggttagcctgtctttccctcctgagtatacacctgtggagacatatcagcagccagggcct

SEQ ID NO: 8195 - DNA, 140 bp, Artificial Sequence
  Synthetic
aggccctggctgctgatatgcacggaaggcgcactgtattcatatctagaagggacacgttttcaccagacggcagtggatatggcagagatatacactatgtggccaaagcaaacagaggaccttttgggacagcggtg

SEQ ID NO: 8196 - DNA, 140 bp, Artificial Sequence
  Synthetic
caccgctgtcccaaaaggtcctctgtttgctttggccacatagtgtatatctctgccatatccactgccgtctggtgaaaacgtgtcccttctagatatgaatacagtgcgccttccgtgcatatcagcagccagggcct

SEQ ID NO: 8197 - DNA, 140 bp, Artificial Sequence
  Synthetic
atacgccatgctgggtctccgccaatgagcaagtctgcctatatgccctgggggaaagtattgaatcaatcaggcagaaatgcccggtggatgatgcagacgcatcatctcccccgaaaacgtacttgggagtcggccat

SEQ ID NO: 8198 - DNA, 140 bp, Artificial Sequence
  Synthetic
atggccgactcccaagtacgttttcgggggagatgatgcgtctgcatcatccaccgggcatttctgcctgattgattcaatactttcccccagggcatataggcagacttgctcattggcggagacccagcatggcgtat

SEQ ID NO: 8199 - DNA, 140 bp, Artificial Sequence
  Synthetic
aggccctggctgctgatatgcccaccgtgacgtacgggaaaaaccaagtcatcatgctactgtatcctgaccacccaacactcctgtcctaccggaatatgggagaagaaccaaactatcgaccttttgggacagcggtg

SEQ ID NO: 8200 - DNA, 140 bp, Artificial Sequence
  Synthetic
caccgctgtcccaaaaggtcgatagtttggttcttctcccatattccggtaggacaggagtgttgggtggtcaggatacagtagcatgatgacttggtttttcccgtacgtcacggtgggcatatcagcagccagggcct

SEQ ID NO: 8201 - DNA, 140 bp, Artificial Sequence
  Synthetic
aggccctggctgctgatatgcaggcagaaatgcccggtggatgatgcagacgcatcatctcccccgaaaactgtcccgtgtctttgccggtatgccatgactcctgaacgcgtcacccgagaccttttgggacagcggtg

SEQ ID NO: 8202 - DNA, 140 bp, Artificial Sequence
  Synthetic
caccgctgtcccaaaaggtctcgggtgacgcgttcaggagtcatggcataccggcaaagacacgggacagttttcgggggagatgatgcgtctgcatcatccaccgggcatttctgcctgcatatcagcagccagggcct

SEQ ID NO: 8203 - DNA, 140 bp, Artificial Sequence
  Synthetic
atacgccatgctgggtctcctgttattcgatcacaatgtgccatcgcgcgtaagtccaagggaatacagatcttcccaggagtctgtacaggaagtgagtacgacaacgtcattgacgcacgtacttgggagtcggccat

SEQ ID NO: 8204 - DNA, 140 bp, Artificial Sequence
  Synthetic
atggccgactcccaagtacgtgcgtcaatgacgttgtcgtactcacttcctgtacagactcctgggaagatctgtattcccttggacttacgcgcgatggcacattgtgatcgaataacaggagacccagcatggcgtat

SEQ ID NO: 8205 - DNA, 140 bp, Artificial Sequence
  Synthetic
atacgccatgctgggtctcctagccagtttgatctaagcgccgatggcgagacactgcctgtcccgtcagacctggatgctgacgccccagccctagaaccggccctagacgacggggcgcgtacttgggagtcggccat

SEQ ID NO: 8206 - DNA, 140 bp, Artificial Sequence
  Synthetic
atggccgactcccaagtacgcgccccgtcgtctagggccggttctagggctggggcgtcagcatccaggtctgacgggacaggcagtgtctcgccatcggcgcttagatcaaactggctaggagacccagcatggcgtat

SEQ ID NO: 8207 - DNA, 140 bp, Artificial Sequence
  Synthetic
atacgccatgctgggtctccgtacatacattaccaaccataatcggaaaccttgcggccgtgtctgactgggtaatgagcaccgtacctgtcgcgccgcctagaagaaggagagggagaacgtacttgggagtcggccat

SEQ ID NO: 8208 - DNA, 140 bp, Artificial Sequence
  Synthetic
atggccgactcccaagtacgttctccctctccttcttctaggcggcgcgacaggtacggtgctcattacccagtcagacacggccgcaaggtttccgattatggttggtaatgtatgtacggagacccagcatggcgtat

SEQ ID NO: 8209 - DNA, 140 bp, Artificial Sequence
  Synthetic
aggccctggctgctgatatgcccatcacatttggggacttcgacgaaggagaaatcgaaagcttgtcttctgagctactaactttcggagacttcctacccggtgaagtggatgatctgagaccttttgggacagcggtg

SEQ ID NO: 8210 - DNA, 140 bp, Artificial Sequence
  Synthetic
caccgctgtcccaaaaggtctcagatcatccacttcaccgggtaggaagtctccgaaagttagtagctcagaagacaagctttcgatttctccttcgtcgaagtccccaaatgtgatgggcatatcagcagccagggcct

SEQ ID NO: 8211 - DNA, 140 bp, Artificial Sequence
  Synthetic
atacgccatgctgggtctcccagatagcgactggtccacgtgcccagacacggacgacgagttatgactagacagggcaggtgggtatatattctcgtcggacactggtccaggccatttcgtacttgggagtcggccat

SEQ ID NO: 8212 - DNA, 140 bp, Artificial Sequence
  Synthetic
atggccgactcccaagtacgaaatggcctggaccagtgtccgacgagaatatatacccacctgccctgtctagtcataactcgtcgtccgtgtctgggcacgtggaccagtcgctatctgggagacccagcatggcgtat

SEQ ID NO: 8213 - DNA, 140 bp, Artificial Sequence
  Synthetic
atacgccatgctgggtctccgacagggcaggtgggtatatattctcgtcggacactggtccaggccatttacaacagaagtcggtacgccagtcagtgctgccggtaaacaccctggaggcgtacttgggagtcggccat

SEQ ID NO: 8214 - DNA, 140 bp, Artificial Sequence
  Synthetic
atggccgactcccaagtacgcctccagggtgtttaccggcagcactgactggcgtaccgacttctgttgtaaatggcctggaccagtgtccgacgagaatatatacccacctgccctgtcggagacccagcatggcgtat

SEQ ID NO: 8215 - DNA, 140 bp, Artificial Sequence
  Synthetic
atacgccatgctgggtctccacaacagaagtcggtacgccagtcagtgctgccggtaaacaccctggaggaagtccacgaggagaagtgttacccacctaagctggatgaattaaaggagcgtacttgggagtcggccat

SEQ ID NO: 8216 - DNA, 140 bp, Artificial Sequence
  Synthetic
atggccgactcccaagtacgctcctttaattcatccagcttaggtgggtaacacttctcctcgtggacttcctccagggtgtttaccggcagcactgactggcgtaccgacttctgttgtggagacccagcatggcgtat

SEQ ID NO: 8217 - DNA, 140 bp, Artificial Sequence
  Synthetic
aggccctggctgctgatatggggctcataccgcatctgcatcagctaagctccgcgtcctttaccaaggaaataacatcactgtaactgcctatgcaaacggcgaccatgccgtcacagtgaccttttgggacagcggtg

SEQ ID NO: 8218 - DNA, 140 bp, Artificial Sequence
  Synthetic
caccgctgtcccaaaaggtcactgtgacggcatggtcgccgtttgcataggcagttacagtgatgttatttccttggtaaaggacgcggagcttagctgatgcagatgcggtatgagccccatatcagcagccagggcct

SEQ ID NO: 8219 - DNA, 140 bp, Artificial Sequence
  Synthetic
aggccctggctgctgatatgaataacatcactgtaactgcctatgcaaacggcgaccatgccgtcacagttaaggacgccaaattcattgtggggccaatgtcttcagcctggacaccttgaccttttgggacagcggtg

SEQ ID NO: 8220 - DNA, 140 bp, Artificial Sequence
  Synthetic
caccgctgtcccaaaaggtcaaggtgtccaggctgaagacattggccccacaatgaatttggcgtccttaactgtgacggcatggtcgccgtttgcataggcagttacagtgatgttattcatatcagcagccagggcct

SEQ ID NO: 8221 - DNA, 140 bp, Artificial Sequence
  Synthetic
aggccctggctgctgatatggactaaagagaggctgtaaactgtatttaatggcagagaccccgaaagtcccgacttatcggaccatatacccggcgcctgtgtactcgcctccgatcaagaccttttgggacagcggtg

SEQ ID NO: 8222 - DNA, 140 bp, Artificial Sequence
  Synthetic
caccgctgtcccaaaaggtcttgatcggaggcgagtacacaggcgccgggtatatggtccgataagtcgggactttcggggtctctgccattaaatacagtttacagcctctctttagtccatatcagcagccagggcct

SEQ ID NO: 8223 - DNA, 140 bp, Artificial Sequence
  Synthetic
atacgccatgctgggtctcctgtccgattgtccaaccccgagtccgcagtggcagcatgtaacgagttcttagctagaaactacccaactgtttcatcataccaaatcaccgacgagtatcgtacttgggagtcggccat

SEQ ID NO: 8224 - DNA, 140 bp, Artificial Sequence
  Synthetic
atggccgactcccaagtacgatactcgtcggtgatttggtatgatgaaacagttgggtagtttctagctaagaactcgttacatgctgccactgcggactcggggttggacaatcggacaggagacccagcatggcgtat

SEQ ID NO: 8225 - DNA, 140 bp, Artificial Sequence
  Synthetic
aggccctggctgctgatatgtagctagaaactacccaactgtttcatcataccaaatcaccgacgagtatgatgcatatctagacatggtggacgggtcggagagttgcttggaccgagcgaccttttgggacagcggtg

SEQ ID NO: 8226 - DNA, 140 bp, Artificial Sequence
  Synthetic
caccgctgtcccaaaaggtcgctcggtccaagcaactctccgacccgtccaccatgtctagatatgcatcatactcgtcggtgatttggtatgatgaaacagttgggtagtttctagctacatatcagcagccagggcct

SEQ ID NO: 8227 - DNA, 140 bp, Artificial Sequence
  Synthetic
aggccctggctgctgatatggatgcatatctagacatggtggacgggtcggagagttgcttggaccgagcgacattcaatccgtcaaaacttaggagctacccgaaacaacatgcttatcgaccttttgggacagcggtg

SEQ ID NO: 8228 - DNA, 140 bp, Artificial Sequence
  Synthetic
caccgctgtcccaaaaggtcgataagcatgttgtttcgggtagctcctaagttttgacggattgaatgtcgctcggtccaagcaactctccgacccgtccaccatgtctagatatgcatccatatcagcagccagggcct

SEQ ID NO: 8229 - DNA, 140 bp, Artificial Sequence
  Synthetic
atacgccatgctgggtctccccgccctttggcgcaggaagaccaggacaatttggcgatattcaaagtcgcacacctgagagtgaagacgtctatgctaatacacaactggtactgcagacgtacttgggagtcggccat

SEQ ID NO: 8230 - DNA, 140 bp, Artificial Sequence
  Synthetic
atggccgactcccaagtacgtctgcagtaccagttgtgtattagcatagacgtcttcactctcaggtgtgcgactttgaatatcgccaaattgtcctggtcttcctgcgccaaagggcggggagacccagcatggcgtat

SEQ ID NO: 8231 - DNA, 140 bp, Artificial Sequence
  Synthetic
aggccctggctgctgatatgtttaagtattggctaaaagaacgcggggcgtcactgcagcacacagcaccatttggctgccaaatagcaacaaacccggtaagagcggtgaactgcgccggaccttttgggacagcggtg

SEQ ID NO: 8232 - DNA, 140 bp, Artificial Sequence
  Synthetic
caccgctgtcccaaaaggtccggcgcagttcaccgctcttaccgggtttgttgctatttggcagccaaatggtgctgtgtgctgcagtgacgccccgcgttcttttagccaatacttaaacatatcagcagccagggcct

SEQ ID NO: 8233 - DNA, 140 bp, Artificial Sequence
  Synthetic
aggccctggctgctgatatgcagaatgtactggcagcagccacgaaaaggaactgcaacgtcacacagatgagggaattacccactttggactcagcagtattcaacgtggagtgttttagaccttttgggacagcggtg

SEQ ID NO: 8234 - DNA, 140 bp, Artificial Sequence
  Synthetic
caccgctgtcccaaaaggtctaaaacactccacgttgaatactgctgagtccaaagtgggtaattccctcatctgtgtgacgttgcagttccttttcgtggctgctgccagtacattctgcatatcagcagccagggcct

SEQ ID NO: 8235 - DNA, 140 bp, Artificial Sequence
  Synthetic
aggccctggctgctgatatggtcgtcgacgcgccctctttaacggacatgtcgtgcgaggtaccagcctgcacccattcctcagactttgggggcgttgccattattaaatatgcagccagaccttttgggacagcggtg

SEQ ID NO: 8236 - DNA, 140 bp, Artificial Sequence
  Synthetic
caccgctgtcccaaaaggtctggctgcatatttaataatggcaacgcccccaaagtctgaggaatgggtgcaggctggtacctcgcacgacatgtccgttaaagagggcgcgtcgacgaccatatcagcagccagggcct

SEQ ID NO: 8237 - DNA, 140 bp, Artificial Sequence
  Synthetic
atacgccatgctgggtctccaaaaattcgcatgtaaccgagaatactgggaagaatttgcagccagccctatcaggataacaactgagaatctaacaacctatgtcactaaactaaagggcgtacttgggagtcggccat

SEQ ID NO: 8238 - DNA, 140 bp, Artificial Sequence
  Synthetic
atggccgactcccaagtacgccctttagtttagtgacataggttgttagattctcagttgttatcctgatagggctggctgcaaattcttcccagtattctcggttacatgcgaatttttggagacccagcatggcgtat

SEQ ID NO: 8239 - DNA, 140 bp, Artificial Sequence
  Synthetic
atacgccatgctgggtctccgcaagaaaggcaagtgtgcggtgcattcgatgactaacgccgtcactattcgggaagctgagatagaagttgaaggaaattctcagctgcaaatctctttcgtacttgggagtcggccat

SEQ ID NO: 8240 - DNA, 140 bp, Artificial Sequence
  Synthetic
atggccgactcccaagtacgaaagagatttgcagctgagaatttccttcaacttctatctcagcttcccgaatagtgacggcgttagtcatcgaatgcaccgcacacttgcctttcttgcggagacccagcatggcgtat

SEQ ID NO: 8241 - DNA, 140 bp, Artificial Sequence
  Synthetic
aggccctggctgctgatatgatcaggataacaactgagaatctaacaacctatgtcactaaactaaaggggccaaaagcagcagcgctgtttgcaaaaacccataatctgctgccactgcgaccttttgggacagcggtg

SEQ ID NO: 8242 - DNA, 140 bp, Artificial Sequence
  Synthetic
caccgctgtcccaaaaggtcgcagtggcagcagattatgggtttttgcaaacagcgctgctgcttttggcccctttagtttagtgacataggttgttagattctcagttgttatcctgatcatatcagcagccagggcct

SEQ ID NO: 8243 - DNA, 140 bp, Artificial Sequence
  Synthetic
aggccctggctgctgatatgcgggaagctgagatagaagttgaaggaaattctcagctgcaaatctctttctcgacggccttagccagcgccgaattccgcgtacaagtctgttccacacgaccttttgggacagcggtg

SEQ ID NO: 8244 - DNA, 140 bp, Artificial Sequence
  Synthetic
caccgctgtcccaaaaggtcgtgtggaacagacttgtacgcggaattcggcgctggctaaggccgtcgagaaagagatttgcagctgagaatttccttcaacttctatctcagcttcccgcatatcagcagccagggcct

SEQ ID NO: 8245 - DNA, 140 bp, Artificial Sequence
  Synthetic
aggccctggctgctgatatggtaactcctggtacaaagcatacagaggaaagacctaaggtgcaggttatacaggcggctgaacccttggcaacagcgtacctatgtggaattcacagaggaccttttgggacagcggtg

SEQ ID NO: 8246 - DNA, 140 bp, Artificial Sequence
  Synthetic
caccgctgtcccaaaaggtcctctgtgaattccacataggtacgctgttgccaagggttcagccgcctgtataacctgcaccttaggtctttcctctgtatgctttgtaccaggagttaccatatcagcagccagggcct

SEQ ID NO: 8247 - DNA, 140 bp, Artificial Sequence
  Synthetic
atacgccatgctgggtctccacaggcggctgaacccttggcaacagcgtacctatgtggaattcacagagaactggttaggagattgaacgccgtcctcctacccaatgtgcatacactacgtacttgggagtcggccat

SEQ ID NO: 8248 - DNA, 140 bp, Artificial Sequence
  Synthetic
atggccgactcccaagtacgtagtgtatgcacattgggtaggaggacggcgttcaatctcctaaccagttctctgtgaattccacataggtacgctgttgccaagggttcagccgcctgtggagacccagcatggcgtat

SEQ ID NO: 8249 - DNA, 140 bp, Artificial Sequence
  Synthetic
atacgccatgctgggtctccaagtacactgtgcagctgagtgccaccccccgaaggaccacatagtcaactacccggcgtcacataccaccctcggggtccaggacatctccgctacggccgtacttgggagtcggccat

SEQ ID NO: 8250 - DNA, 140 bp, Artificial Sequence
  Synthetic
atggccgactcccaagtacggccgtagcggagatgtcctggaccccgagggtggtatgtgacgccgggtagttgactatgtggtccttcggggggtggcactcagctgcacagtgtacttggagacccagcatggcgtat

SEQ ID NO: 8251 - DNA, 140 bp, Artificial Sequence
  Synthetic
atacgccatgctgggtctcctttgacatgtctgccgaggacttcgatgccattatagccgcacacttcaagccaggagacgctgttttagaaacggacatagcctcctttgataagagcccgtacttgggagtcggccat

SEQ ID NO: 8252 - DNA, 140 bp, Artificial Sequence
  Synthetic
atggccgactcccaagtacgggctcttatcaaaggaggctatgtccgtttctaaaacagcgtctcctggcttgaagtgtgcggctataatggcatcgaagtcctcggcagacatgtcaaaggagacccagcatggcgtat

SEQ ID NO: 8253 - DNA, 140 bp, Artificial Sequence
  Synthetic
aggccctggctgctgatatggccaggagacgctgttttagaaacggacatagcctcctttgataagagccaagatgattcacttgcgcttaccgccttaatgctgttagaagatttgggagaccttttgggacagcggtg

SEQ ID NO: 8254 - DNA, 140 bp, Artificial Sequence
  Synthetic
caccgctgtcccaaaaggtctcccaaatcttctaacagcattaaggcggtaagcgcaagtgaatcatcttggctcttatcaaaggaggctatgtccgtttctaaaacagcgtctcctggccatatcagcagccagggcct

SEQ ID NO: 8255 - DNA, 140 bp, Artificial Sequence
  Synthetic
atacgccatgctgggtctccgtatatagctaataatctgtagatcaaagggctataaaaacccctgaatagtaacaaaacataaaactaataaaaatcaaatgaataccataattggcaacgtacttgggagtcggccat

SEQ ID NO: 8256 - DNA, 140 bp, Artificial Sequence
  Synthetic
atggccgactcccaagtacgttgccaattatggtattcatttgatttttattagttttatgttttgttactattcaggggtttttatagccctttgatctacagattattagctatatacggagacccagcatggcgtat

SEQ ID NO: 8257 - DNA, 140 bp, Artificial Sequence
  Synthetic
aggccctggctgctgatatggtggatcactccctgttggacttgatagaggctgctttcggagagatttccagctgtcatctgccgacaggtacgcgcttcaagttcggcgctatgatgagaccttttgggacagcggtg

SEQ ID NO: 8258 - DNA, 140 bp, Artificial Sequence
  Synthetic
caccgctgtcccaaaaggtctcatcatagcgccgaacttgaagcgcgtacctgtcggcagatgacagctggaaatctctccgaaagcagcctctatcaagtccaacagggagtgatccaccatatcagcagccagggcct

SEQ ID NO: 8259 - DNA, 140 bp, Artificial Sequence; identical to SEQ ID NO: 6831
  Synthetic

SEQ ID NO: 8260 - DNA, 140 bp, Artificial Sequence; identical to SEQ ID NO: 6832
  Synthetic

SEQ ID NO: 8261 - DNA, 140 bp, Artificial Sequence
  Synthetic
atacgccatgctgggtctccacttaagcttcctaaaagcagccgaactcactttgagatgtaggcatagcataccgaactcttccacgattctccgaacccatagggacgtaggagatgtcgtacttgggagtcggccat

SEQ ID NO: 8262 - DNA, 140 bp, Artificial Sequence
  Synthetic
atggccgactcccaagtacgacatctcctacgtccctatgggttcggagaatcgtggaagagttcggtatgctatgcctacatctcaaagtgagttcggctgcttttaggaagcttaagtggagacccagcatggcgtat

SEQ ID NO: 8263 - DNA, 140 bp, Artificial Sequence
  Synthetic
atacgccatgctgggtctccatcgctagccgggtgttggaagatcgtctgacaaaatccgcatgcgcggccttcatcggcgacgacaacataatacatggtgtcgtctccgatgaattgacgtacttgggagtcggccat

SEQ ID NO: 8264 - DNA, 140 bp, Artificial Sequence
  Synthetic
atggccgactcccaagtacgtcaattcatcggagacgacaccatgtattatgttgtcgtcgccgatgaaggccgcgcatgcggattttgtcagacgatcttccaacacccggctagcgatggagacccagcatggcgtat

SEQ ID NO: 8265 - DNA, 140 bp, Artificial Sequence
  Synthetic
aggccctggctgctgatatgcttcatcggcgacgacaacataatacatggtgtcgtctccgatgaattgatggcagccagatgcgctacttggatgaacatggaagtgaagatcatagatgaccttttgggacagcggtg

SEQ ID NO: 8266 - DNA, 140 bp, Artificial Sequence
  Synthetic
caccgctgtcccaaaaggtcatctatgatcttcacttccatgttcatccaagtagcgcatctggctgccatcaattcatcggagacgacaccatgtattatgttgtcgtcgccgatgaagcatatcagcagccagggcct

SEQ ID NO: 8267 - DNA, 140 bp, Artificial Sequence
  Synthetic
atacgccatgctgggtctcctggcagccagatgcgctacttggatgaacatggaagtgaagatcatagatgcagttgtatcccagaaagctccttacttttgtggagggtttatactgcacgtacttgggagtcggccat

SEQ ID NO: 8268 - DNA, 140 bp, Artificial Sequence
  Synthetic
atggccgactcccaagtacgtgcagtataaaccctccacaaaagtaaggagctttctgggatacaactgcatctatgatcttcacttccatgttcatccaagtagcgcatctggctgccaggagacccagcatggcgtat

SEQ ID NO: 8269 - DNA, 140 bp, Artificial Sequence
  Synthetic
aggccctggctgctgatatggcagttgtatcccagaaagctccttacttttgtggagggtttatactgcatgatactgtgacaggaacagcttgcagagtggcggacccgctaaaaaggtgaccttttgggacagcggtg

SEQ ID NO: 8270 - DNA, 140 bp, Artificial Sequence
  Synthetic
caccgctgtcccaaaaggtcacctttttagcgggtccgccactctgcaagctgttcctgtcacagtatcatgcagtataaaccctccacaaaagtaaggagctttctgggatacaactgccatatcagcagccagggcct

SEQ ID NO: 8271 - DNA, 140 bp, Artificial Sequence
  Synthetic
atacgccatgctgggtctccgaaaaatcggagatctacaagcagtaatggctgtaccagacgcagaaacgcccacattctgcttgcacactgacgtctcatgtagacagagggcggacgtcgtacttgggagtcggccat

SEQ ID NO: 8272 - DNA, 140 bp, Artificial Sequence
  Synthetic
atggccgactcccaagtacgacgtccgccctctgtctacatgagacgtcagtgtgcaagcagaatgtgggcgtttctgcgtctggtacagccattactgcttgtagatctccgatttttcggagacccagcatggcgtat

SEQ ID NO: 8273 - DNA, 140 bp, Artificial Sequence
  Synthetic
atacgccatgctgggtctcccgctatataccaggacgtctacgccgtgcatgcaccaacgtcgctataccaccaggcgattaaaggagtcggtgtagcatactggatagggtttgatacgcgtacttgggagtcggccat

SEQ ID NO: 8274 - DNA, 140 bp, Artificial Sequence
  Synthetic
atggccgactcccaagtacgcgtatcaaaccctatccagtatgctacaccgactcctttaatcgcctggtggtatagcgacgttggtgcatgcacggcgtagacgtcctggtatatagcgggagacccagcatggcgtat

SEQ ID NO: 8275 - DNA, 140 bp, Artificial Sequence
  Synthetic
aggccctggctgctgatatggtttgcccaatgcgcagcgcagaagaccctgagagactcgccaactacgcgagaaaactagcatctgccgcaggaaaagtcctggacagaaacatctccggaccttttgggacagcggtg

SEQ ID NO: 8276 - DNA, 140 bp, Artificial Sequence
  Synthetic
caccgctgtcccaaaaggtccggagatgtttctgtccaggacttttcctgcggcagatgctagttttctcgcgtagttggcgagtctctcagggtcttctgcgctgcgcattgggcaaaccatatcagcagccagggcct

SEQ ID NO: 8277 - DNA, 140 bp, Artificial Sequence
  Synthetic
atacgccatgctgggtctcctgatactgtgacaggaacagcttgcagagtggcggacccgctaaaaaggttatttaaattgggcaaaccgttagcggcaggtgacgaacaagatgaagaccgtacttgggagtcggccat

SEQ ID NO: 8278 - DNA, 140 bp, Artificial Sequence
  Synthetic
atggccgactcccaagtacggtcttcatcttgttcgtcacctgccgctaacggtttgcccaatttaaataacctttttagcgggtccgccactctgcaagctgttcctgtcacagtatcaggagacccagcatggcgtat

SEQ ID NO: 8279 - DNA, 140 bp, Artificial Sequence
  Synthetic
atacgccatgctgggtctccaaaaagatgaagccatgtgaccgcgtactgttctcagtcgggtcaacactttacccggagagccgtaagcttcttaagagttggcacttaccttcagtgtcgtacttgggagtcggccat

SEQ ID NO: 8280 - DNA, 140 bp, Artificial Sequence
  Synthetic
atggccgactcccaagtacgacactgaaggtaagtgccaactcttaagaagcttacggctctccgggtaaagtgttgacccgactgagaacagtacgcggtcacatggcttcatctttttggagacccagcatggcgtat

SEQ ID NO: 8281 - DNA, 140 bp, Artificial Sequence
  Synthetic
aggccctggctgctgatatgtatcagttgcggtaatgtccatggccacctttgcaagctccagatccaacttcgagaagctcagaggacccgtcataactttgtacggcggtcctaaatagaccttttgggacagcggtg

SEQ ID NO: 8282 - DNA, 140 bp, Artificial Sequence
  Synthetic
caccgctgtcccaaaaggtctatttaggaccgccgtacaaagttatgacgggtcctctgagcttctcgaagttggatctggagcttgcaaaggtggccatggacattaccgcaactgatacatatcagcagccagggcct

SEQ ID NO: 8283 - DNA, 140 bp, Artificial Sequence
  Synthetic
aggccctggctgctgatatgtcgtgtgaaggctatgtcgttaagagaataacgattagcccgggcctctacggtaaaaccacagggtatgcagtaacccaccatgcagacggattcctaagaccttttgggacagcggtg

SEQ ID NO: 8284 - DNA, 140 bp, Artificial Sequence
  Synthetic
caccgctgtcccaaaaggtcttaggaatccgtctgcatggtgggttactgcataccctgtggttttaccgtagaggcccgggctaatcgttattctcttaacgacatagccttcacacgacatatcagcagccagggcct

SEQ ID NO: 8285 - DNA, 140 bp, Artificial Sequence
  Synthetic
aggccctggctgctgatatgataccaatcagccataatggagtttatcccaacccaaactttctacaataggaggtaccagcctcgaccttggactccgcgccctactatccaagttatcgaccttttgggacagcggtg

SEQ ID NO: 8286 - DNA, 140 bp, Artificial Sequence
  Synthetic
caccgctgtcccaaaaggtcgataacttggatagtagggcgcggagtccaaggtcgaggctggtacctcctattgtagaaagtttgggttgggataaactccattatggctgattggtatcatatcagcagccagggcct

SEQ ID NO: 8287 - DNA, 140 bp, Artificial Sequence
  Synthetic
aggccctggctgctgatatgggaggtaccagcctcgaccttggactccgcgccctactatccaagttatcagacccagaccgcgtccgcaaaggaaagccgggcaacttgcccagctgatgaccttttgggacagcggtg

SEQ ID NO: 8288 - DNA, 140 bp, Artificial Sequence
  Synthetic
caccgctgtcccaaaaggtcatcagctgggcaagttgcccggctttcctttgcggacgcggtctgggtctgataacttggatagtagggcgcggagtccaaggtcgaggctggtacctcccatatcagcagccagggcct

SEQ ID NO: 8289 - DNA, 140 bp, Artificial Sequence
  Synthetic
atacgccatgctgggtctcccactgacatgctgctgcctttgggcgttcaagaagcagaagacacacacggtctacaagaggcctgacactcagtcgattcagaaagtcccagccgaattcgtacttgggagtcggccat

SEQ ID NO: 8290 - DNA, 140 bp, Artificial Sequence
  Synthetic
atggccgactcccaagtacgaattcggctgggactttctgaatcgactgagtgtcaggcctcttgtagaccgtgtgtgtcttctgcttcttgaacgcccaaaggcagcagcatgtcagtgggagacccagcatggcgtat

SEQ ID NO: 8291 - DNA, 140 bp, Artificial Sequence
  Synthetic
atacgccatgctgggtctccctcagcagttaataaactgacaatgcgcgcggtacctcaacagaagccgcgcaagaatcggaagaataagaagcaaaagcaaaagcagcaggcgccacgacgtacttgggagtcggccat

SEQ ID NO: 8292 - DNA, 140 bp, Artificial Sequence
  Synthetic
atggccgactcccaagtacgtcgtggcgcctgctgcttttgcttttgcttcttattcttccgattcttgcgcggcttctgttgaggtaccgcgcgcattgtcagtttattaactgctgagggagacccagcatggcgtat

SEQ ID NO: 8293 - DNA, 140 bp, Artificial Sequence
  Synthetic
atacgccatgctgggtctcctgacagctttgcggtaccaagtctgtggtcatctggactgtcgatcccgctacggaccagaatcaagtggctgctaagcaaaatgccaaagactgatttgcgtacttgggagtcggccat

SEQ ID NO: 8294 - DNA, 140 bp, Artificial Sequence
  Synthetic
atggccgactcccaagtacgcaaatcagtctttggcattttgcttagcagccacttgattctggtccgtagcgggatcgacagtccagatgaccacagacttggtaccgcaaagctgtcaggagacccagcatggcgtat

SEQ ID NO: 8295 - DNA, 140 bp, Artificial Sequence
  Synthetic
aggccctggctgctgatatgtacggaccagaatcaagtggctgctaagcaaaatgccaaagactgatttgatcccctacagcggtgacgccaaagaagcccgcgacgctgaaaaagaagcgaccttttgggacagcggtg

SEQ ID NO: 8296 - DNA, 140 bp, Artificial Sequence
  Synthetic
caccgctgtcccaaaaggtcgcttctttttcagcgtcgcgggcttctttggcgtcaccgctgtaggggatcaaatcagtctttggcattttgcttagcagccacttgattctggtccgtacatatcagcagccagggcct

SEQ ID NO: 8297 - DNA, 140 bp, Artificial Sequence
  Synthetic
atacgccatgctgggtctcccgaagcatatgacggcagaatccttgtgccctcaggctatgcaatatcacctgaagacttccagagcctgagcgaaagtgcgacgatggtgtacaacgaacgtacttgggagtcggccat

SEQ ID NO: 8298 - DNA, 140 bp, Artificial Sequence
  Synthetic
atggccgactcccaagtacgttcgttgtacaccatcgtcgcactttcgctcaggctctggaagtcttcaggtgatattgcatagcctgagggcacaaggattctgccgtcatatgcttcgggagacccagcatggcgtat

SEQ ID NO: 8299 - DNA, 140 bp, Artificial Sequence
  Synthetic
atacgccatgctgggtctcccctgaacactgacgaggagtcgtacgagctggtaagggcagaaaggacagagcatgagtacgtctatgatgtggatcaaagaaggtgctgcaagaaagagcgtacttgggagtcggccat

SEQ ID NO: 8300 - DNA, 140 bp, Artificial Sequence
  Synthetic
atggccgactcccaagtacgctctttcttgcagcaccttctttgatccacatcatagacgtactcatgctctgtcctttctgcccttaccagctcgtacgactcctcgtcagtgttcaggggagacccagcatggcgtat

SEQ ID NO: 8301 - DNA, 140 bp, Artificial Sequence
  Synthetic
aggccctggctgctgatatgccgcagtaataggggtctttggagtgccaggatccggcaaatcagcaatcattaagaacctggttaccaggcaagacctagtgaccagtggaaagaaagagaccttttgggacagcggtg

SEQ ID NO: 8302 - DNA, 140 bp, Artificial Sequence
  Synthetic
caccgctgtcccaaaaggtctctttctttccactggtcactaggtcttgcctggtaaccaggttcttaatgattgctgatttgccggatcctggcactccaaagacccctattactgcggcatatcagcagccagggcct

SEQ ID NO: 8303 - DNA, 140 bp, Artificial Sequence
  Synthetic
atacgccatgctgggtctccaaactgccaagaaatctccaccgatgtgatgcgacagaggaacctggagatatctgcacgcacggtcgactcactgctcttgaacggatgcaatagaccacgtacttgggagtcggccat

SEQ ID NO: 8304 - DNA, 140 bp, Artificial Sequence
  Synthetic
atggccgactcccaagtacgtggtctattgcatccgttcaagagcagtgagtcgaccgtgcgtgcagatatctccaggttcctctgtcgcatcacatcggtggagatttcttggcagtttggagacccagcatggcgtat

SEQ ID NO: 8305 - DNA, 140 bp, Artificial Sequence
  Synthetic
aggccctggctgctgatatgtatctgcacgcacggtcgactcactgctcttgaacggatgcaatagaccagtcgacgtgttgtacgtcgacgaagcgtttgcgtgccactctggcacgctgaccttttgggacagcggtg

SEQ ID NO: 8306 - DNA, 140 bp, Artificial Sequence
  Synthetic
caccgctgtcccaaaaggtcagcgtgccagagtggcacgcaaacgcttcgtcgacgtacaacacgtcgactggtctattgcatccgttcaagagcagtgagtcgaccgtgcgtgcagatacatatcagcagccagggcct

SEQ ID NO: 8307 - DNA, 140 bp, Artificial Sequence
  Synthetic
aggccctggctgctgatatggtcttgccattccagttatgtgcctgctggcaaataccacgttcccctgctcccagcccccttgcacaccctgctgctacgaaaaagagccggagaaaacgaccttttgggacagcggtg

SEQ ID NO: 8308 - DNA, 140 bp, Artificial Sequence
  Synthetic
caccgctgtcccaaaaggtcgttttctccggctctttttcgtagcagcagggtgtgcaagggggctgggagcaggggaacgtggtatttgccagcaggcacataactggaatggcaagaccatatcagcagccagggcct

SEQ ID NO: 8309 - DNA, 140 bp, Artificial Sequence
  Synthetic
aggccctggctgctgatatgaaatgcgcacaacaaatgagtacaacaagccaattgtagtggatactacaggctcgacaaaacccgaccccggagaccttgtgttaacatgtttcagagggaccttttgggacagcggtg

SEQ ID NO: 8310 - DNA, 140 bp, Artificial Sequence
  Synthetic
caccgctgtcccaaaaggtccctctgaaacatgttaacacaaggtctccggggtcgggttttgtcgagcctgtagtatccactacaattggcttgttgtactcatttgttgtgcgcatttcatatcagcagccagggcct

SEQ ID NO: 8311 - DNA, 140 bp, Artificial Sequence
  Synthetic
atacgccatgctgggtctccgtgggttaagcaactgcaaattgactatcgtggacacgaggtcatgacagcagctgcatctcaggggctaaccagaaaaggggtctatgccgtcaggcaacgtacttgggagtcggccat

SEQ ID NO: 8312 - DNA, 140 bp, Artificial Sequence
  Synthetic
atggccgactcccaagtacgttgcctgacggcatagaccccttttctggttagcccctgagatgcagctgctgtcatgacctcgtgtccacgatagtcaatttgcagttgcttaacccacggagacccagcatggcgtat

SEQ ID NO: 8313 - DNA, 140 bp, Artificial Sequence
  Synthetic
aggccctggctgctgatatgacccatggataaagacactgcagaacccgccgaaaggaaattttaaagcaactattaaggaatgggaagtggaacatgcttcaataatggcgggtatctggaccttttgggacagcggtg

SEQ ID NO: 8314 - DNA, 140 bp, Artificial Sequence
  Synthetic
caccgctgtcccaaaaggtccagatacccgccattattgaagcatgttccacttcccattccttaatagttgctttaaaatttcctttcggcgggttctgcagtgtctttatccatgggtcatatcagcagccagggcct

SEQ ID NO: 8315 - DNA, 140 bp, Artificial Sequence
  Synthetic
aggccctggctgctgatatggacaacttcaatgtctataaagccataagaccgtacctagctcactgtcccgactgtggagaagggcactcgtgccatagtcccgtagcgctagaacgcagaccttttgggacagcggtg

SEQ ID NO: 8316 - DNA, 140 bp, Artificial Sequence
  Synthetic
caccgctgtcccaaaaggtctgcgttctagcgctacgggactatggcacgagtgcccttctccacagtcgggacagtgagctaggtacggtcttatggctttatagacattgaagttgtccatatcagcagccagggcct

SEQ ID NO: 8317 - DNA, 140 bp, Artificial Sequence
  Synthetic
aggccctggctgctgatatggggcgaagagcttagtccccatcctagaaacagcagggataaaactaaacgacaggcagtggtcccagataatccaggctttcaaagaagacagagcatagaccttttgggacagcggtg

SEQ ID NO: 8318 - DNA, 140 bp, Artificial Sequence
  Synthetic
caccgctgtcccaaaaggtctatgctctgtcttctttgaaagcctggattatctgggaccactgcctgtcgtttagttttatccctgctgtttctaggatggggactaagctcttcgccccatatcagcagccagggcct

SEQ ID NO: 8319 - DNA, 140 bp, Artificial Sequence
  Synthetic
aggccctggctgctgatatgtcagaaacgaagcgacagacgggacgctgaaaatccaggtttccttgcaaatcggaataaagacggatgatagccatgattggaccaagctgcgttacatgaccttttgggacagcggtg

SEQ ID NO: 8320 - DNA, 140 bp, Artificial Sequence
  Synthetic
caccgctgtcccaaaaggtcatgtaacgcagcttggtccaatcatggctatcatccgtctttattccgatttgcaaggaaacctggattttcagcgtcccgtctgtcgcttcgtttctgacatatcagcagccagggcct

SEQ ID NO: 8321 - DNA, 140 bp, Artificial Sequence
  Synthetic
aggccctggctgctgatatgcgaagcggcgtccatactggagaggaaatacccgtttacaaaagggaagtggaataccaacaagcaaatctgtgtgactactaggaggattgaagactttgaccttttgggacagcggtg

SEQ ID NO: 8322 - DNA, 140 bp, Artificial Sequence
  Synthetic
caccgctgtcccaaaaggtcaaagtcttcaatcctcctagtagtcacacagatttgcttgttggtattccacttcccttttgtaaacgggtatttcctctccagtatggacgccgcttcgcatatcagcagccagggcct

SEQ ID NO: 8323 - DNA, 140 bp, Artificial Sequence
  Synthetic
aggccctggctgctgatatgtcccagcccccttgcacaccctgctgctacgaaaaagagccggagaaaaccctgcgcatgctagaagacaacgtcatgagccccgggtactatcagctgcgaccttttgggacagcggtg

SEQ ID NO: 8324 - DNA, 140 bp, Artificial Sequence
  Synthetic
caccgctgtcccaaaaggtcgcagctgatagtacccggggctcatgacgttgtcttctagcatgcgcagggttttctccggctctttttcgtagcagcagggtgtgcaagggggctgggacatatcagcagccagggcct

SEQ ID NO: 8325 - DNA, 140 bp, Artificial Sequence
  Synthetic
aggccctggctgctgatatgtcccagcccccttgcacaccctgctgctacgaaaaagagccggagaaaaccctgcgcatgcttgaagacaacgtcatgagccccgggtactatcagctgcgaccttttgggacagcggtg

SEQ ID NO: 8326 - DNA, 140 bp, Artificial Sequence
  Synthetic
caccgctgtcccaaaaggtcgcagctgatagtacccggggctcatgacgttgtcttcaagcatgcgcagggttttctccggctctttttcgtagcagcagggtgtgcaagggggctgggacatatcagcagccagggcct

SEQ ID NO: 8327 - DNA, 140 bp, Artificial Sequence
  Synthetic
aggccctggctgctgatatgtcccagcccccttgcacaccctgctgctacgaaaaagagccggagaaaaccctgcgcatgctcgaagacaacgtcatgagccccgggtactatcagctgcgaccttttgggacagcggtg

SEQ ID NO: 8328 - DNA, 140 bp, Artificial Sequence
  Synthetic
caccgctgtcccaaaaggtcgcagctgatagtacccggggctcatgacgttgtcttcgagcatgcgcagggttttctccggctctttttcgtagcagcagggtgtgcaagggggctgggacatatcagcagccagggcct

SEQ ID NO: 8329 - DNA, 140 bp, Artificial Sequence
  Synthetic
aggccctggctgctgatatgtcccagcccccttgcacaccctgctgctacgaaaaagagccggagaaaaccctgcgcatgctggaagacaacgtcatgagccccgggtactatcagctgcgaccttttgggacagcggtg

SEQ ID NO: 8330 - DNA, 140 bp, Artificial Sequence
  Synthetic
caccgctgtcccaaaaggtcgcagctgatagtacccggggctcatgacgttgtcttccagcatgcgcagggttttctccggctctttttcgtagcagcagggtgtgcaagggggctgggacatatcagcagccagggcct

SEQ ID NO: 8331 - DNA, 140 bp, Artificial Sequence
  Synthetic
aggccctggctgctgatatgatcggaataaagacggatgatagccatgattggaccaagctgcgttacatggacaatcatatgccagcagacgcagagagggccgggctatttgtaagaagaccttttgggacagcggtg

SEQ ID NO: 8332 - DNA, 140 bp, Artificial Sequence
  Synthetic
caccgctgtcccaaaaggtcttcttacaaatagcccggccctctctgcgtctgctggcatatgattgtccatgtaacgcagcttggtccaatcatggctatcatccgtctttattccgatcatatcagcagccagggcct

SEQ ID NO: 8333 - DNA, 140 bp, Artificial Sequence
  Synthetic
aggccctggctgctgatatgcctgagactgctcaagccgggtggttcattactgatcagggcatacggctacgcagacagaacaagcgaacgagtagtctgcgtactaggacgcaagtttgaccttttgggacagcggtg

SEQ ID NO: 8334 - DNA, 140 bp, Artificial Sequence
  Synthetic
caccgctgtcccaaaaggtcaaacttgcgtcctagtacgcagactactcgttcgcttgttctgtctgcgtagccgtatgccctgatcagtaatgaaccacccggcttgagcagtctcaggcatatcagcagccagggcct

SEQ ID NO: 8335 - DNA, 140 bp, Artificial Sequence
  Synthetic
aggccctggctgctgatatggatcagtcactcatgtacgcacccatttcaccacgaccctcctgtgataggccgggaaaaatttcattcccgaccgcagcacggtagagaactaccttgcgaccttttgggacagcggtg

SEQ ID NO: 8336 - DNA, 140 bp, Artificial Sequence
  Synthetic
caccgctgtcccaaaaggtcgcaaggtagttctctaccgtgctgcggtcgggaatgaaatttttcccggcctatcacaggagggtcgtggtgaaatgggtgcgtacatgagtgactgatccatatcagcagccagggcct

SEQ ID NO: 8337 - DNA, 140 bp, Artificial Sequence
  Synthetic
atacgccatgctgggtctcccgatcatccagagcgttgaaaccgccgtgcgtcactagcaacaccgagatgtttttcttgttcagcaactttgataacggcagaaggaactttacgacgccgtacttgggagtcggccat

SEQ ID NO: 8338 - DNA, 140 bp, Artificial Sequence
  Synthetic
atggccgactcccaagtacggcgtcgtaaagttccttctgccgttatcaaagttgctgaacaagaaaaacatctcggtgttgctagtgacgcacggcggtttcaacgctctggatgatcgggagacccagcatggcgtat

SEQ ID NO: 8339 - DNA, 140 bp, Artificial Sequence
  Synthetic
aggccctggctgctgatatggccgggaaaaatttcattcccgaccgcagcacggtagagaactaccttgcagcacgtacgcgcagagcaccgctgcaactgccgaggagatagaggtacagaccttttgggacagcggtg

SEQ ID NO: 8340 - DNA, 140 bp, Artificial Sequence
  Synthetic
caccgctgtcccaaaaggtctgtacctctatctcctcggcagttgcagcggtgctctgcgcgtacgtgctgcaaggtagttctctaccgtgctgcggtcgggaatgaaatttttcccggccatatcagcagccagggcct

SEQ ID NO: 8341 - DNA, 140 bp, Artificial Sequence
  Synthetic
atacgccatgctgggtctcctatgcccccagacaccccagatcgcacattgatgtcacaacagtccggtaatgtaaagatcacagtcaatagtcagacggtgcggtacaagtgtaattgccgtacttgggagtcggccat

SEQ ID NO: 8342 - DNA, 140 bp, Artificial Sequence
  Synthetic
atggccgactcccaagtacggcaattacacttgtaccgcaccgtctgactattgactgtgatctttacattaccggactgttgtgacatcaatgtgcgatctggggtgtctgggggcataggagacccagcatggcgtat

SEQ ID NO: 8343 - DNA, 140 bp, Artificial Sequence
  Synthetic
atacgccatgctgggtctccatgtaaagatcacagtcaatagtcagacggtgcggtacaagtgtaattgcggtgactcaaatgaaggactaaccactacagacaaagtgattaataactgcgtacttgggagtcggccat

SEQ ID NO: 8344 - DNA, 140 bp, Artificial Sequence
  Synthetic
atggccgactcccaagtacgcagttattaatcactttgtctgtagtggttagtccttcatttgagtcaccgcaattacacttgtaccgcaccgtctgactattgactgtgatctttacatggagacccagcatggcgtat

SEQ ID NO: 8345 - DNA, 140 bp, Artificial Sequence
  Synthetic
atacgccatgctgggtctccagactaggagtaaacagcgtagctataccgctcctttccaccggtgtgtactctggagggaaagacaggctgactcagtcattaaaccacctttttacagcgtacttgggagtcggccat

SEQ ID NO: 8346 - DNA, 140 bp, Artificial Sequence
  Synthetic
atggccgactcccaagtacgctgtaaaaaggtggtttaatgactgagtcagcctgtctttccctccagagtacacaccggtggaaaggagcggtatagctacgctgtttactcctagtctggagacccagcatggcgtat

SEQ ID NO: 8347 - DNA, 140 bp, Artificial Sequence
  Synthetic
atacgccatgctgggtctccacgtaatgaacaaccagctgaatgctgcttttgttggtcaggccacccgagcagggtgtgcaccgtcgtaccgggttagacgcatggacatcgcaaagaacgtacttgggagtcggccat

SEQ ID NO: 8348 - DNA, 140 bp, Artificial Sequence
  Synthetic
atggccgactcccaagtacgttctttgcgatgtccatgcgtctaacccggtacgacggtgcacaccctgctcgggtggcctgaccaacaaaagcagcattcagctggttgttcattacgtggagacccagcatggcgtat

SEQ ID NO: 8349 - DNA, 140 bp, Artificial Sequence
  Synthetic
aggccctggctgctgatatgataattcccctctggtcccgcgtaatgctgaactcggggaccgaaaaggaaaagttcacattccgtttcctctggcaaatgtgacatgcagggtgcctaagaccttttgggacagcggtg

SEQ ID NO: 8350 - DNA, 140 bp, Artificial Sequence
  Synthetic
caccgctgtcccaaaaggtcttaggcaccctgcatgtcacatttgccagaggaaacggaatgtgaacttttccttttcggtccccgagttcagcattacgcgggaccagaggggaattatcatatcagcagccagggcct

SEQ ID NO: 8351 - DNA, 140 bp, Artificial Sequence
  Synthetic
atacgccatgctgggtctcccattagattcaactgatgcagatgtggttatctactgccgcgacaaggagtgggagaagaaaatagccgaggccatacaaatgaggacccaagtggaactcgtacttgggagtcggccat

SEQ ID NO: 8352 - DNA, 140 bp, Artificial Sequence
  Synthetic
atggccgactcccaagtacgagttccacttgggtcctcatttgtatggcctcggctattttcttctcccactccttgtcgcggcagtagataaccacatctgcatcagttgaatctaatgggagacccagcatggcgtat

SEQ ID NO: 8353 - DNA, 140 bp, Artificial Sequence
  Synthetic
atacgccatgctgggtctccaaagttcacattccgtttcctctggcaaatgtgacatgcagggtgcctaaggcaaggaaccccaccgtgacgtacggaaaaaaccaagtcatcatgctgccgtacttgggagtcggccat

SEQ ID NO: 8354 - DNA, 140 bp, Artificial Sequence
  Synthetic
atggccgactcccaagtacggcagcatgatgacttggttttttccgtacgtcacggtggggttccttgccttaggcaccctgcatgtcacatttgccagaggaaacggaatgtgaactttggagacccagcatggcgtat

SEQ ID NO: 8355 - DNA, 140 bp, Artificial Sequence
  Synthetic
atacgccatgctgggtctccagaagtatacaccatgtggccaaagcagacggaggctaatgaacaagtttgcttgtacgcattgggggaaagcatagaatcaatcaggcaaaagtgcccacgtacttgggagtcggccat

SEQ ID NO: 8356 - DNA, 140 bp, Artificial Sequence
  Synthetic
atggccgactcccaagtacgtgggcacttttgcctgattgattctatgctttcccccaatgcgtacaagcaaacttgttcattagcctccgtctgctttggccacatggtgtatacttctggagacccagcatggcgtat

SEQ ID NO: 8357 - DNA, 140 bp, Artificial Sequence
  Synthetic
aggccctggctgctgatatgccaaactatcaagaagagtgggtgacgcataagaaggagatcaggttaaccgtgccgactgaagggctcgaggtcacgtggggcaacaacgagccgtacagaccttttgggacagcggtg

SEQ ID NO: 8358 - DNA, 140 bp, Artificial Sequence
  Synthetic
caccgctgtcccaaaaggtctgtacggctcgttgttgccccacgtgacctcgagcccttcagtcggcacggttaacctgatctccttcttatgcgtcacccactcttcttgatagtttggcatatcagcagccagggcct

SEQ ID NO: 8359 - DNA, 140 bp, Artificial Sequence
  Synthetic
aggccctggctgctgatatgtgggagaagaaaatagccgaggccatacaaatgaggacccaagtggaactactagacgaacacatctctgtagactgcgacatcatccgagtgcaccctggaccttttgggacagcggtg

SEQ ID NO: 8360 - DNA, 140 bp, Artificial Sequence
  Synthetic
caccgctgtcccaaaaggtccagggtgcactcggatgatgtcgcagtctacagagatgtgttcgtctagtagttccacttgggtcctcatttgtatggcctcggctattttcttctcccacatatcagcagccagggcct

SEQ ID NO: 8361 - DNA, 140 bp, Artificial Sequence
  Synthetic
atacgccatgctgggtctccagtattggccgcagttatccacaaacggtacagcccacggccacccgcatgagataattttgtattattatgagctgtaccctactatgactgtggtagtcgtacttgggagtcggccat

SEQ ID NO: 8362 - DNA, 140 bp, Artificial Sequence
  Synthetic
atggccgactcccaagtacgactaccacagtcatagtagggtacagctcataataatacaaaattatctcatgcgggtggccgtgggctgtaccgtttgtggataactgcggccaatactggagacccagcatggcgtat

SEQ ID NO: 8363 - DNA, 140 bp, Artificial Sequence
  Synthetic
aggccctggctgctgatatgcgtgccatcacgcgttagtccaagggaatataaatcgcctcaggagactgtacaagaagtaagttcgaccacgtcactgacgcacagccaattcgaccttgaccttttgggacagcggtg

SEQ ID NO: 8364 - DNA, 140 bp, Artificial Sequence
  Synthetic
caccgctgtcccaaaaggtcaaggtcgaattggctgtgcgtcagtgacgtggtcgaacttacttcttgtacagtctcctgaggcgatttatattcccttggactaacgcgtgatggcacgcatatcagcagccagggcct

SEQ ID NO: 8365 - DNA, 140 bp, Artificial Sequence
  Synthetic
aggccctggctgctgatatggaaggagtgcagaaagtcaagtgttctaaagtgatgctgttcgaccataacgtgccatcacgcgttagtccaagggaatataaatcgcctcaggagactggaccttttgggacagcggtg

SEQ ID NO: 8366 - DNA, 140 bp, Artificial Sequence
  Synthetic
caccgctgtcccaaaaggtccagtctcctgaggcgatttatattcccttggactaacgcgtgatggcacgttatggtcgaacagcatcactttagaacacttgactttctgcactccttccatatcagcagccagggcct

SEQ ID NO: 8367 - DNA, 140 bp, Artificial Sequence
  Synthetic
aggccctggctgctgatatgagcgttgacggtgaggaactgcccgctccgtctgacttggaagctgatgctccgattccggaaccaacaccagacgacagagcggtacttactttgcctcgaccttttgggacagcggtg

SEQ ID NO: 8368 - DNA, 140 bp, Artificial Sequence
  Synthetic
caccgctgtcccaaaaggtcgaggcaaagtaagtaccgctctgtcgtctggtgttggttccggaatcggagcatcagcttccaagtcagacggagcgggcagttcctcaccgtcaacgctcatatcagcagccagggcct

SEQ ID NO: 8369 - DNA, 140 bp, Artificial Sequence
  Synthetic
atacgccatgctgggtctccagctaaagcggccacataccaagaggctgcggtatacctgtggaacgagcagcagcctttgttttggctgcaagcccttattccgctggcagccctgattcgtacttgggagtcggccat

SEQ ID NO: 8370 - DNA, 140 bp, Artificial Sequence
  Synthetic
atggccgactcccaagtacgaatcagggctgccagcggaataagggcttgcagccaaaacaaaggctgctgctcgttccacaggtataccgcagcctcttggtatgtggccgctttagctggagacccagcatggcgtat

SEQ ID NO: 8371 - DNA, 140 bp, Artificial Sequence
  Synthetic
atacgccatgctgggtctccccacgattgaaaatttttcggctgtgtcagactgggtaatgaataccgcgccagtcgcaccacccagaagaagacgtgggaaaaacttgaatgtcacctgcgtacttgggagtcggccat

SEQ ID NO: 8372 - DNA, 140 bp, Artificial Sequence
  Synthetic
atggccgactcccaagtacgcaggtgacattcaagtttttcccacgtcttcttctgggtggtgcgactggcgcggtattcattacccagtctgacacagccgaaaaattttcaatcgtggggagacccagcatggcgtat

SEQ ID NO: 8373 - DNA, 140 bp, Artificial Sequence
  Synthetic
aggccctggctgctgatatgagcagcctttgttttggctgcaagcccttattccgctggcagccctgattgtcctatgcaactgtctgagactcttaccatgcttttgtaaaacgttgacgaccttttgggacagcggtg

SEQ ID NO: 8374 - DNA, 140 bp, Artificial Sequence
  Synthetic
caccgctgtcccaaaaggtcgtcaacgttttacaaaagcatggtaagagtctcagacagttgcataggacaatcagggctgccagcggaataagggcttgcagccaaaacaaaggctgctcatatcagcagccagggcct

SEQ ID NO: 8375 - DNA, 140 bp, Artificial Sequence
  Synthetic
atacgccatgctgggtctccgagcgaatctgcactccatcgtacaggaaacggcagagatacgcgatacggccgcgtccctccaggcgcccctgagtgtcgctacagaaccaaatcaactcgtacttgggagtcggccat

SEQ ID NO: 8376 - DNA, 140 bp, Artificial Sequence
  Synthetic
atggccgactcccaagtacgagttgatttggttctgtagcgacactcaggggcgcctggagggacgcggccgtatcgcgtatctctgccgtttcctgtacgatggagtgcagattcgctcggagacccagcatggcgtat

SEQ ID NO: 8377 - DNA, 140 bp, Artificial Sequence
  Synthetic
atacgccatgctgggtctccgccgatctcattcggagcaccaaacgagactttccccataacgttcggggattttgatgaaggggagattgaaagcttgtcctctgagttactgacctttcgtacttgggagtcggccat

SEQ ID NO: 8378 - DNA, 140 bp, Artificial Sequence
  Synthetic
atggccgactcccaagtacgaaaggtcagtaactcagaggacaagctttcaatctccccttcatcaaaatccccgaacgttatggggaaagtctcgtttggtgctccgaatgagatcggcggagacccagcatggcgtat

SEQ ID NO: 8379 - DNA, 140 bp, Artificial Sequence
  Synthetic
atacgccatgctgggtctccggggacttctcgccgggcgaagtggatgacctgacagacagcgactggtccacgtgttcagacacggacgacgaattatgactagatagggcaggtgggtcgtacttgggagtcggccat

SEQ ID NO: 8380 - DNA, 140 bp, Artificial Sequence
  Synthetic
atggccgactcccaagtacgacccacctgccctatctagtcataattcgtcgtccgtgtctgaacacgtggaccagtcgctgtctgtcaggtcatccacttcgcccggcgagaagtccccggagacccagcatggcgtat

SEQ ID NO: 8381 - DNA, 140 bp, Artificial Sequence
  Synthetic
aggccctggctgctgatatgcacgtgttcagacacggacgacgaattatgactagatagggcaggtgggtacatattctcatctgacaccggccccggccacctgcaacagaggtctgtcgaccttttgggacagcggtg

SEQ ID NO: 8382 - DNA, 140 bp, Artificial Sequence
  Synthetic
caccgctgtcccaaaaggtcgacagacctctgttgcaggtggccggggccggtgtcagatgagaatatgtacccacctgccctatctagtcataattcgtcgtccgtgtctgaacacgtgcatatcagcagccagggcct

SEQ ID NO: 8383 - DNA, 140 bp, Artificial Sequence
  Synthetic
atacgccatgctgggtctccattcatgtggggcggcgcctactgcttctgcgacactgaaaatacgcaattgagcgaagcacatgtggagaagtccgaatcatgcaaaacagaatttgcacgtacttgggagtcggccat

SEQ ID NO: 8384 - DNA, 140 bp, Artificial Sequence
  Synthetic
atggccgactcccaagtacgtgcaaattctgttttgcatgattcggacttctccacatgtgcttcgctcaattgcgtattttcagtgtcgcagaagcagtaggcgccgccccacatgaatggagacccagcatggcgtat

SEQ ID NO: 8385 - DNA, 140 bp, Artificial Sequence
  Synthetic
aggccctggctgctgatatgtgagcgaagcacatgtggagaagtccgaatcatgcaaaacagaatttgcatcagcatatagggctcataccgcatccgcatcagctaagctccgcgtcctgaccttttgggacagcggtg

SEQ ID NO: 8386 - DNA, 140 bp, Artificial Sequence
  Synthetic
caccgctgtcccaaaaggtcaggacgcggagcttagctgatgcggatgcggtatgagccctatatgctgatgcaaattctgttttgcatgattcggacttctccacatgtgcttcgctcacatatcagcagccagggcct

SEQ ID NO: 8387 - DNA, 140 bp, Artificial Sequence
  Synthetic
aggccctggctgctgatatgatgttacccacctaagttggatgaagtgaaagagcagttgttacttaagaaactccaggaaagtgcgtccatggctaacagaagcaggtaccaatcccgcgaccttttgggacagcggtg

SEQ ID NO: 8388 - DNA, 140 bp, Artificial Sequence
  Synthetic
caccgctgtcccaaaaggtcgcgggattggtacctgcttctgttagccatggacgcactttcctggagtttcttaagtaacaactgctctttcacttcatccaacttaggtgggtaacatcatatcagcagccagggcct

SEQ ID NO: 8389 - DNA, 140 bp, Artificial Sequence
  Synthetic
atacgccatgctgggtctcctcagcatatagggctcataccgcatccgcatcagctaagctccgcgtcctttaccaaggaaataatgttactgtatctgcttatgcaaacggcgatcatgcgtacttgggagtcggccat

SEQ ID NO: 8390 - DNA, 140 bp, Artificial Sequence
  Synthetic
atggccgactcccaagtacgcatgatcgccgtttgcataagcagatacagtaacattatttccttggtaaaggacgcggagcttagctgatgcggatgcggtatgagccctatatgctgaggagacccagcatggcgtat

SEQ ID NO: 8391 - DNA, 140 bp, Artificial Sequence
  Synthetic
atacgccatgctgggtctccccgtcacagttaaggacgctaaattcattgtggggccaatgtcttcagcctggacaccttttgacaataaaatcgtggtgtacaaaggcgacgtctacaacgtacttgggagtcggccat

SEQ ID NO: 8392 - DNA, 140 bp, Artificial Sequence
  Synthetic
atggccgactcccaagtacgttgtagacgtcgcctttgtacaccacgattttattgtcaaaaggtgtccaggctgaagacattggccccacaatgaatttagcgtccttaactgtgacggggagacccagcatggcgtat

SEQ ID NO: 8393 - DNA, 140 bp, Artificial Sequence
  Synthetic
aggccctggctgctgatatgaaagtagagaacatgaaagcaacaatagtccaaaggctgaagggtggttgcaaactttatttaatgtcggagaccccgaaagttcctacctaccgaactagaccttttgggacagcggtg

SEQ ID NO: 8394 - DNA, 140 bp, Artificial Sequence
  Synthetic
caccgctgtcccaaaaggtctagttcggtaggtaggaactttcggggtctccgacattaaataaagtttgcaaccacccttcagcctttggactattgttgctttcatgttctctactttcatatcagcagccagggcct

SEQ ID NO: 8395 - DNA, 140 bp, Artificial Sequence
  Synthetic
atacgccatgctgggtctccacatattctcatctgacaccggccccggccacctgcaacagaggtctgtccgccagacagtactgccggtaaataccttggaggaagttcaggaggagaacgtacttgggagtcggccat

SEQ ID NO: 8396 - DNA, 140 bp, Artificial Sequence
  Synthetic
atggccgactcccaagtacgttctcctcctgaacttcctccaaggtatttaccggcagtactgtctggcggacagacctctgttgcaggtggccggggccggtgtcagatgagaatatgtggagacccagcatggcgtat

SEQ ID NO: 8397 - DNA, 140 bp, Artificial Sequence
  Synthetic
aggccctggctgctgatatgaagtgccgtaccttccccgttccagaacacgctgcagaacgtactggctgctgccacgaaaagaaattgcaacgtcacacagatgagagagctgcctactgaccttttgggacagcggtg

SEQ ID NO: 8398 - DNA, 140 bp, Artificial Sequence
  Synthetic
caccgctgtcccaaaaggtcagtaggcagctctctcatctgtgtgacgttgcaatttcttttcgtggcagcagccagtacgttctgcagcgtgttctggaacggggaaggtacggcacttcatatcagcagccagggcct

SEQ ID NO: 8399 - DNA, 140 bp, Artificial Sequence
  Synthetic
aggccctggctgctgatatggtactgcagagaccgtccgcgggtacggtgcacgtgccgtactctcaggcaccatctggcttcaagtattggctaaaagaacgaggggcgtcgctgcagcgaccttttgggacagcggtg

SEQ ID NO: 8400 - DNA, 140 bp, Artificial Sequence
  Synthetic
caccgctgtcccaaaaggtcgctgcagcgacgcccctcgttcttttagccaatacttgaagccagatggtgcctgagagtacggcacgtgcaccgtacccgcggacggtctctgcagtaccatatcagcagccagggcct

SEQ ID NO: 8401 - DNA, 140 bp, Artificial Sequence
  Synthetic
atacgccatgctgggtctccttggattcagcggtatttaatgttgagtgctttaaaaaatttgcgtgcaatcaagaatactggaaagaatttgccgccagtcctattaggataacgactgcgtacttgggagtcggccat

SEQ ID NO: 8402 - DNA, 140 bp, Artificial Sequence
  Synthetic
atggccgactcccaagtacgcagtcgttatcctaataggactggcggcaaattctttccagtattcttgattgcacgcaaattttttaaagcactcaacattaaataccgctgaatccaaggagacccagcatggcgtat

SEQ ID NO: 8403 - DNA, 140 bp, Artificial Sequence
  Synthetic
aggccctggctgctgatatgacacagcaccatttggctgtcaaatagcaacaaacccggtaagagcgatgaactgcgccgtagggaacatgcctatctccatcgacataccggacgcggcgaccttttgggacagcggtg

SEQ ID NO: 8404 - DNA, 140 bp, Artificial Sequence
  Synthetic
caccgctgtcccaaaaggtcgccgcgtccggtatgtcgatggagataggcatgttccctacggcgcagttcatcgctcttaccgggtttgttgctatttgacagccaaatggtgctgtgtcatatcagcagccagggcct

SEQ ID NO: 8405 - DNA, 140 bp, Artificial Sequence
  Synthetic
atacgccatgctgggtctccagaacttgacaacttatgtcacaaaactaaaaggaccaaaagcagcagcattgtttgccaagacacataacctgctatcactgcaggaggtgccgatggacgtacttgggagtcggccat

SEQ ID NO: 8406 - DNA, 140 bp, Artificial Sequence
  Synthetic
atggccgactcccaagtacgtccatcggcacctcctgcagtgatagcaggttatgtgtcttggcaaacaatgctgctgcttttggtccttttagttttgtgacataagttgtcaagttctggagacccagcatggcgtat

SEQ ID NO: 8407 - DNA, 140 bp, Artificial Sequence
  Synthetic
atacgccatgctgggtctccaaccctgttcgtcaacacactgctaaacatcaccatagccagccgagtgctggaggaccgcttgacaaagtctgcgtgcgcggccttcatcggcgacgaccgtacttgggagtcggccat

SEQ ID NO: 8408 - DNA, 140 bp, Artificial Sequence
  Synthetic
atggccgactcccaagtacggtcgtcgccgatgaaggccgcgcacgcagactttgtcaagcggtcctccagcactcggctggctatggtgatgtttagcagtgtgttgacgaacagggttggagacccagcatggcgtat

SEQ ID NO: 8409 - DNA, 140 bp, Artificial Sequence
  Synthetic
aggccctggctgctgatatgaaatctctttttcgacggccctagccagcgccgaattccgcgtacaagtctgttctacacaagtacactgtgcagccgagtgccatccaccgaaagaccagaccttttgggacagcggtg

SEQ ID NO: 8410 - DNA, 140 bp, Artificial Sequence
  Synthetic
caccgctgtcccaaaaggtctggtctttcggtggatggcactcggctgcacagtgtacttgtgtagaacagacttgtacgcggaattcggcgctggctagggccgtcgaaaaagagatttcatatcagcagccagggcct

SEQ ID NO: 8411 - DNA, 140 bp, Artificial Sequence
  Synthetic
aggccctggctgctgatatgtggaggaccgcttgacaaagtctgcgtgcgcggccttcatcggcgacgacaacataatacatggggttgtctctgacgaactgatggcagcaagatgtgcgaccttttgggacagcggtg

SEQ ID NO: 8412 - DNA, 140 bp, Artificial Sequence
  Synthetic
caccgctgtcccaaaaggtcgcacatcttgctgccatcagttcgtcagagacaaccccatgtattatgttgtcgtcgccgatgaaggccgcgcacgcagactttgtcaagcggtcctccacatatcagcagccagggcct

SEQ ID NO: 8413 - DNA, 140 bp, Artificial Sequence
  Synthetic
atacgccatgctgggtctcctatagtcaattacccggcgtcacacaccaccctcggggtccaagacatttccgttacggcgatgtcatgggtgcagaagatcacgggaggtgtgggactgcgtacttgggagtcggccat

SEQ ID NO: 8414 - DNA, 140 bp, Artificial Sequence
  Synthetic
atggccgactcccaagtacgcagtcccacacctcccgtgatcttctgcacccatgacatcgccgtaacggaaatgtcttggaccccgagggtggtgtgtgacgccgggtaattgactataggagacccagcatggcgtat

SEQ ID NO: 8415 - DNA, 140 bp, Artificial Sequence
  Synthetic
atacgccatgctgggtctcctacatggatgaacatggaagtgaaaatcatagatgcggtcgtgtctcagaaagccccgtacttctgcggagggtttatactgtatgacacagtagtaggccgtacttgggagtcggccat

SEQ ID NO: 8416 - DNA, 140 bp, Artificial Sequence
  Synthetic
atggccgactcccaagtacggcctactactgtgtcatacagtataaaccctccgcagaagtacggggctttctgagacacgaccgcatctatgattttcacttccatgttcatccatgtaggagacccagcatggcgtat

SEQ ID NO: 8417 - DNA, 140 bp, Artificial Sequence
  Synthetic
atacgccatgctgggtctccgttgtcgctgttgcagcactgatcctaatcgtggtgctatgcgtgtcgtttagcaggcactaacttgacaactaggtacgaaggtatatgtgtcccctaacgtacttgggagtcggccat

SEQ ID NO: 8418 - DNA, 140 bp, Artificial Sequence
  Synthetic
atggccgactcccaagtacgttaggggacacatataccttcgtacctagttgtcaagttagtgcctgctaaacgacacgcatagcaccacgattaggatcagtgctgcaacagcgacaacggagacccagcatggcgtat

SEQ ID NO: 8419 - DNA, 140 bp, Artificial Sequence
  Synthetic
aggccctggctgctgatatgaccgctggcggcgggagatgaacaagacgacgacagaagacgtgcactggctgacgaagtggttagatggcaacgaacagggctgactgatgagctagaagaccttttgggacagcggtg

SEQ ID NO: 8420 - DNA, 140 bp, Artificial Sequence
  Synthetic
caccgctgtcccaaaaggtcttctagctcatcagtcagccctgttcgttgccatctaaccacttcgtcagccagtgcacgtcttctgtcgtcgtcttgttcatctcccgccgccagcggtcatatcagcagccagggcct

SEQ ID NO: 8421 - DNA, 140 bp, Artificial Sequence
  Synthetic
atacgccatgctgggtctccgagacacaccacatatagctaagaatcaatagataagtatagatcaaagggctgaacaacccctgaatagtaacaaaatataaaaatcaacaaaaatcatcgtacttgggagtcggccat

SEQ ID NO: 8422 - DNA, 140 bp, Artificial Sequence
  Synthetic
atggccgactcccaagtacgatgatttttgttgatttttatattttgttactattcaggggttgttcagccctttgatctatacttatctattgattcttagctatatgtggtgtgtctcggagacccagcatggcgtat

SEQ ID NO: 8423 - DNA, 140 bp, Artificial Sequence
  Synthetic
atacgccatgctgggtctccgacccatcgtaaccctgtacggtggtcctaaataggtacgcactacagctacctatttcgtcagaaaccaatcgcagctacccgcatacctaccagctaccgtacttgggagtcggccat

SEQ ID NO: 8424 - DNA, 140 bp, Artificial Sequence
  Synthetic
atggccgactcccaagtacggtagctggtaggtatgcgggtagctgcgattggtttctgacgaaataggtagctgtagtgcgtacctatttaggaccaccgtacagggttacgatgggtcggagacccagcatggcgtat

SEQ ID NO: 8425 - DNA, 140 bp, Artificial Sequence
  Synthetic
atacgccatgctgggtctccaaaatagaaaaccagaaacagaagtaggtaagaaggtatatgtgtcccctaagagacacaccatatatagctaagaatcaatagataagtatagatcaaacgtacttgggagtcggccat

SEQ ID NO: 8426 - DNA, 140 bp, Artificial Sequence
  Synthetic
atggccgactcccaagtacgtttgatctatacttatctattgattcttagctatatatggtgtgtctcttaggggacacatataccttcttacctacttctgtttctggttttctattttggagacccagcatggcgtat

SEQ ID NO: 8427 - DNA, 140 bp, Artificial Sequence
  Synthetic
aggccctggctgctgatatggtctatggccacctttgcaagctctagatctaactttgagaagctcagaggacccatcgtaaccctgtacggtggtcctaaataggtacgcactacagctgaccttttgggacagcggtg

SEQ ID NO: 8428 - DNA, 140 bp, Artificial Sequence
  Synthetic
caccgctgtcccaaaaggtcagctgtagtgcgtacctatttaggaccaccgtacagggttacgatgggtcctctgagcttctcaaagttagatctagagcttgcaaaggtggccatagaccatatcagcagccagggcct

SEQ ID NO: 8429 - DNA, 140 bp, Artificial Sequence
  Synthetic
atacgccatgctgggtctccccacagaggcaggcagggcaactcgcccagctgatctctgcagtcaacaaattgaccatgcgcgcggtacctcaacagaagcctcgcagaaatcggaaaacgtacttgggagtcggccat

SEQ ID NO: 8430 - DNA, 140 bp, Artificial Sequence
  Synthetic
atggccgactcccaagtacgttttccgatttctgcgaggcttctgttgaggtaccgcgcgcatggtcaatttgttgactgcagagatcagctgggcgagttgccctgcctgcctctgtggggagacccagcatggcgtat

SEQ ID NO: 8431 - DNA, 140 bp, Artificial Sequence
  Synthetic
atacgccatgctgggtctccattgaccatgcgcgcggtacctcaacagaagcctcgcagaaatcggaaaaacaagaagcaaaggcagaagaagcaggcgccgcaaaacgacccaaagcaacgtacttgggagtcggccat

SEQ ID NO: 8432 - DNA, 140 bp, Artificial Sequence
  Synthetic
atggccgactcccaagtacgttgctttgggtcgttttgcggcgcctgcttcttctgcctttgcttcttgtttttccgatttctgcgaggcttctgttgaggtaccgcgcgcatggtcaatggagacccagcatggcgtat

SEQ ID NO: 8433 - DNA, 140 bp, Artificial Sequence
  Synthetic
aggccctggctgctgatatgtggcaatcggaagagatgtaggtacttaagcttcctaaaagcagccgaactcgctttgagatgtaggcgtagcacaccgaactcttccataattctccgagaccttttgggacagcggtg

SEQ ID NO: 8434 - DNA, 140 bp, Artificial Sequence
  Synthetic
caccgctgtcccaaaaggtctcggagaattatggaagagttcggtgtgctacgcctacatctcaaagcgagttcggctgcttttaggaagcttaagtacctacatctcttccgattgccacatatcagcagccagggcct

SEQ ID NO: 8435 - DNA, 140 bp, Artificial Sequence
  Synthetic
atacgccatgctgggtctcctcaagcatgaaggcaaagtgatgggctacgcatgcctggtgggggacaaagtaatgaaaccagcacatgtgaagggaactattgacaatgccgatctggccgtacttgggagtcggccat

SEQ ID NO: 8436 - DNA, 140 bp, Artificial Sequence
  Synthetic
atggccgactcccaagtacggccagatcggcattgtcaatagttcccttcacatgtgctggtttcattactttgtcccccaccaggcatgcgtagcccatcactttgccttcatgcttgaggagacccagcatggcgtat

SEQ ID NO: 8437 - DNA, 140 bp, Artificial Sequence
  Synthetic
atacgccatgctgggtctccacccacagggacgtaggagatgttcaaagtggctataaaaccctgaacagtaataaaacataaaattaataaggatcaaatgagtaccataattggcaaacgtacttgggagtcggccat

SEQ ID NO: 8438 - DNA, 140 bp, Artificial Sequence
  Synthetic
atggccgactcccaagtacgtttgccaattatggtactcatttgatccttattaattttatgttttattactgttcagggttttatagccactttgaacatctcctacgtccctgtgggtggagacccagcatggcgtat

SEQ ID NO: 8439 - DNA, 140 bp, Artificial Sequence
  Synthetic
aggccctggctgctgatatgtaataaaacataaaattaataaggatcaaatgagtaccataattggcaaacggaagagatgtaggtacttaagcttcctaaaagcagccgaactcactttgaccttttgggacagcggtg

SEQ ID NO: 8440 - DNA, 140 bp, Artificial Sequence
  Synthetic
caccgctgtcccaaaaggtcaaagtgagttcggctgcttttaggaagcttaagtacctacatctcttccgtttgccaattatggtactcatttgatccttattaattttatgttttattacatatcagcagccagggcct

SEQ ID NO: 8441 - DNA, 140 bp, Artificial Sequence
  Synthetic
atacgccatgctgggtctcctaaactggccttcaagcggtcatctaaatacgaccttgaatgtgcacagataccagtgcacatgaagtctgatgcctcgaagttcacccacgagaaaccccgtacttgggagtcggccat

SEQ ID NO: 8442 - DNA, 140 bp, Artificial Sequence
  Synthetic
atggccgactcccaagtacggggtttctcgtgggtgaacttcgaggcatcagacttcatgtgcactggtatctgtgcacattcaaggtcgtatttagatgaccgcttgaaggccagtttaggagacccagcatggcgtat

SEQ ID NO: 8443 - DNA, 140 bp, Artificial Sequence
  Synthetic
atacgccatgctgggtctcctcttgtgcctgttggcaaacactacattcccctgctctcagccgccttgcacaccatgctgctacgaaaaggaaccggaaagcaccttgcgcatgcttgacgtacttgggagtcggccat

SEQ ID NO: 8444 - DNA, 140 bp, Artificial Sequence
  Synthetic
atggccgactcccaagtacgtcaagcatgcgcaaggtgctttccggttccttttcgtagcagcatggtgtgcaaggcggctgagagcaggggaatgtagtgtttgccaacaggcacaagaggagacccagcatggcgtat

SEQ ID NO: 8445 - DNA, 140 bp, Artificial Sequence
  Synthetic
aggccctggctgctgatatgctactctgcaaagcaagagattaataacccatcatggatcctgtgtacgtggacatagacgctgacagcgcctttttgaaggccctgcaacgtgcgtaccgaccttttgggacagcggtg

SEQ ID NO: 8446 - DNA, 140 bp, Artificial Sequence
  Synthetic
caccgctgtcccaaaaggtcggtacgcacgttgcagggccttcaaaaaggcgctgtcagcgtctatgtccacgtacacaggatccatgatgggttattaatctcttgctttgcagagtagcatatcagcagccagggcct

SEQ ID NO: 8447 - DNA, 140 bp, Artificial Sequence
  Synthetic
atacgccatgctgggtctccggataacgtgatgagacccggatactaccagctgctaaaagcatcgctgacttgctctccccaccgccaaagacgcagtactaaggacaattttaatgtccgtacttgggagtcggccat

SEQ ID NO: 8448 - DNA, 140 bp, Artificial Sequence
  Synthetic
atggccgactcccaagtacggacattaaaattgtccttagtactgcgtctttggcggtggggagagcaagtcagcgatgcttttagcagctggtagtatccgggtctcatcacgttatccggagacccagcatggcgtat

SEQ ID NO: 8449 - DNA, 140 bp, Artificial Sequence
  Synthetic
aggccctggctgctgatatgcacaaaaattacccctgagggagccgaagagtggagcctcgccctcccggtcttgtgcctgttggcaaacactacattcccctgctctcagccgccttgcgaccttttgggacagcggtg

SEQ ID NO: 8450 - DNA, 140 bp, Artificial Sequence
  Synthetic
caccgctgtcccaaaaggtcgcaaggcggctgagagcaggggaatgtagtgtttgccaacaggcacaagaccgggagggcgaggctccactcttcggctccctcaggggtaatttttgtgcatatcagcagccagggcct

SEQ ID NO: 8451 - DNA, 140 bp, Artificial Sequence
  Synthetic
aggccctggctgctgatatgcttgctctccccaccgccaaagacgcagtactaaggacaattttaatgtctataaagccacaagaccatatctagcccattgtcctgattgcggagaagggaccttttgggacagcggtg

SEQ ID NO: 8452 - DNA, 140 bp, Artificial Sequence
  Synthetic
caccgctgtcccaaaaggtcccttctccgcaatcaggacaatgggctagatatggtcttgtggctttatagacattaaaattgtccttagtactgcgtctttggcggtggggagagcaagcatatcagcagccagggcct

SEQ ID NO: 8453 - DNA, 140 bp, Artificial Sequence
  Synthetic
aggccctggctgctgatatgggacatagacgctgacagcgcctttttgaaggccctgcaacgtgcgtaccccatgtttgaggtggaaccaaggcaggtcacaccgaatgaccatgctaatgaccttttgggacagcggtg

SEQ ID NO: 8454 - DNA, 140 bp, Artificial Sequence
  Synthetic
caccgctgtcccaaaaggtcattagcatggtcattcggtgtgacctgccttggttccacctcaaacatggggtacgcacgttgcagggccttcaaaaaggcgctgtcagcgtctatgtcccatatcagcagccagggcct

SEQ ID NO: 8455 - DNA, 140 bp, Artificial Sequence
  Synthetic
atacgccatgctgggtctccgagacgctgacagtgggatttacggacagcagaaagatcagccacacatgcacacacccgttccatcatgaatcacctgtgataggtagggagaggttcccgtacttgggagtcggccat

SEQ ID NO: 8456 - DNA, 140 bp, Artificial Sequence
  Synthetic
atggccgactcccaagtacgggaacctctccctacctatcacaggtgattcatgatggaacgggtgtgtgcatgtgtggctgatctttctgctgtccgtaaatcccactgtcagcgtctcggagacccagcatggcgtat

SEQ ID NO: 8457 - DNA, 140 bp, Artificial Sequence
  Synthetic
aggccctggctgctgatatgtggccgtgccagacaaggagacgccaacattctgcttacacacagacgtctcatgtagacagagagcagacgtcgctatataccaagacgtctatgctgtgaccttttgggacagcggtg

SEQ ID NO: 8458 - DNA, 140 bp, Artificial Sequence
  Synthetic
caccgctgtcccaaaaggtcacagcatagacgtcttggtatatagcgacgtctgctctctgtctacatgagacgtctgtgtgtaagcagaatgttggcgtctccttgtctggcacggccacatatcagcagccagggcct

SEQ ID NO: 8459 - DNA, 140 bp, Artificial Sequence
  Synthetic
aggccctggctgctgatatgagcaccgctgccactgccgaggagatagaggtgcatatgcccccagatactcctgaccgcacgctgatgacgcagcagtctggcagcgtgaagatcacaggaccttttgggacagcggtg

SEQ ID NO: 8460 - DNA, 140 bp, Artificial Sequence
  Synthetic
caccgctgtcccaaaaggtcctgtgatcttcacgctgccagactgctgcgtcatcagcgtgcggtcaggagtatctgggggcatatgcacctctatctcctcggcagtggcagcggtgctcatatcagcagccagggcct

SEQ ID NO: 8461 - DNA, 140 bp, Artificial Sequence
  Synthetic
aggccctggctgctgatatgtcctgaccgcacgctgatgacgcagcagtctggcagcgtgaagatcacagttaatgggcagacggtgcggtacaagtgcaactgcggcggctcaaacgaggaccttttgggacagcggtg

SEQ ID NO: 8462 - DNA, 140 bp, Artificial Sequence
  Synthetic
caccgctgtcccaaaaggtcctcgtttgagccgccgcagttgcacttgtaccgcaccgtctgcccattaactgtgatcttcacgctgccagactgctgcgtcatcagcgtgcggtcaggacatatcagcagccagggcct

SEQ ID NO: 8463 - DNA, 140 bp, Artificial Sequence
  Synthetic
aggccctggctgctgatatgttaatgggcagacggtgcggtacaagtgcaactgcggcggctcaaacgagggactgacaaccacagacaaagtgatcaataactgcaaaattgatcagtggaccttttgggacagcggtg

SEQ ID NO: 8464 - DNA, 140 bp, Artificial Sequence
  Synthetic
caccgctgtcccaaaaggtccactgatcaattttgcagttattgatcactttgtctgtggttgtcagtccctcgtttgagccgccgcagttgcacttgtaccgcaccgtctgcccattaacatatcagcagccagggcct

SEQ ID NO: 8465 - DNA, 140 bp, Artificial Sequence
  Synthetic
aggccctggctgctgatatggttcgtgcttctgtcgatggtgggcacagcagtgggaatgtgtgtgtgcgcacggcgcagatgcattacaccatatgaattaacaccaggagccactgttgaccttttgggacagcggtg

SEQ ID NO: 8466 - DNA, 140 bp, Artificial Sequence
  Synthetic
caccgctgtcccaaaaggtcaacagtggctcctggtgttaattcatatggtgtaatgcatctgcgccgtgcgcacacacacattcccactgctgtgcccaccatcgacagaagcacgaaccatatcagcagccagggcct

SEQ ID NO: 8467 - DNA, 140 bp, Artificial Sequence
  Synthetic
aggccctggctgctgatatgccctttctgctcagcctgctatgctgcgtcagaacgaccaaggcggccacatactacgaggctgcggcatatctatggaacgaacagcagcccctgttctgaccttttgggacagcggtg

SEQ ID NO: 8468 - DNA, 140 bp, Artificial Sequence
  Synthetic
caccgctgtcccaaaaggtcagaacaggggctgctgttcgttccatagatatgccgcagcctcgtagtatgtggccgccttggtcgttctgacgcagcatagcaggctgagcagaaagggcatatcagcagccagggcct

SEQ ID NO: 8469 - DNA, 140 bp, Artificial Sequence
  Synthetic
atacgccatgctgggtctccggttgcaggctcttatcccgctggccgccttgatcgtcctgtgcaactgtctgaagctcttgccatgctgctgtaagaccctggcttttttagccgtaatcgtacttgggagtcggccat

SEQ ID NO: 8470 - DNA, 140 bp, Artificial Sequence
  Synthetic
atggccgactcccaagtacgattacggctaaaaaagccagggtcttacagcagcatggcaagagcttcagacagttgcacaggacgatcaaggcggccagcgggataagagcctgcaaccggagacccagcatggcgtat

SEQ ID NO: 8471 - DNA, 140 bp, Artificial Sequence
  Synthetic
atacgccatgctgggtctcccagccctggcaagcgccgagtttcgcgtgcaagtgtgctccacacaagtacactgcgcagccgcatgccatcctccaaaggaccacatagtcaattaccccgtacttgggagtcggccat

SEQ ID NO: 8472 - DNA, 140 bp, Artificial Sequence
  Synthetic
atggccgactcccaagtacggggtaattgactatgtggtcctttggaggatggcatgcggctgcgcagtgtacttgtgtggagcacacttgcacgcgaaactcggcgcttgccagggctgggagacccagcatggcgtat

SEQ ID NO: 8473 - DNA, 140 bp, Artificial Sequence
  Synthetic
aggccctggctgctgatatggatcaaatgaccggcatccttgctacagaagtcacgccggaggatgcacagaagctgttggtggggctgaaccagagaatagtggttaacggcagaacgcgaccttttgggacagcggtg

SEQ ID NO: 8474 - DNA, 140 bp, Artificial Sequence
  Synthetic
caccgctgtcccaaaaggtcgcgttctgccgttaaccactattctctggttcagccccaccaacagcttctgtgcatcctccggcgtgacttctgtagcaaggatgccggtcatttgatccatatcagcagccagggcct

SEQ ID NO: 8475 - DNA, 140 bp, Artificial Sequence
  Synthetic
atacgccatgctgggtctccgccttaatcttaattgtggtgctatgcgtgtcgtttagcaggcactaaaccgatgataaggcacgaaataactaaatagcaaaagtagaaagtacataaccgtacttgggagtcggccat

SEQ ID NO: 8476 - DNA, 140 bp, Artificial Sequence
  Synthetic
atggccgactcccaagtacggttatgtactttctacttttgctatttagttatttcgtgccttatcatcggtttagtgcctgctaaacgacacgcatagcaccacaattaagattaaggcggagacccagcatggcgtat

SEQ ID NO: 8477 - DNA, 140 bp, Artificial Sequence
  Synthetic
atacgccatgctgggtctccaacggaatatgaacaccatgaaaaattatctgcttcccgtggtcgcccaagccttcagtaagtgggcaaaggagtgccggaaagacatggaagatgaaaacgtacttgggagtcggccat

SEQ ID NO: 8478 - DNA, 140 bp, Artificial Sequence
  Synthetic
atggccgactcccaagtacgttttcatcttccatgtctttccggcactcctttgcccacttactgaaggcttgggcgaccacgggaagcagataatttttcatggtgttcatattccgttggagacccagcatggcgtat

SEQ ID NO: 8479 - DNA, 140 bp, Artificial Sequence
  Synthetic
aggccctggctgctgatatgcgatgataaggcacgaaataactaaatagcaaaagtagaaagtacataaccaggtatatgtgccccctaagaggcacaatatatatagctaagcactattgaccttttgggacagcggtg

SEQ ID NO: 8480 - DNA, 140 bp, Artificial Sequence
  Synthetic
caccgctgtcccaaaaggtcaatagtgcttagctatatatattgtgcctcttagggggcacatatacctggttatgtactttctacttttgctatttagttatttcgtgccttatcatcgcatatcagcagccagggcct

SEQ ID NO: 8481 - DNA, 140 bp, Artificial Sequence
  Synthetic
aggccctggctgctgatatgagatcaaagggctatacaacccctgaatagtaacaaaacacaaaaatcaataaaaatcataaaaaggaaaatctcataaacaggtataagtgtcccctaagaccttttgggacagcggtg

SEQ ID NO: 8482 - DNA, 140 bp, Artificial Sequence
  Synthetic
caccgctgtcccaaaaggtcttaggggacacttatacctgtttatgagattttcctttttatgatttttattgatttttgtgttttgttactattcaggggttgtatagccctttgatctcatatcagcagccagggcct

SEQ ID NO: 8483 - DNA, 140 bp, Artificial Sequence
  Synthetic
aggccctggctgctgatatgattcagaaggttcaggccgagtttgacagctttgtggtaccgagtctgtggtcgtccgggttgtcaatccctttgaggactagaatcaaatggttgttaagaccttttgggacagcggtg

SEQ ID NO: 8484 - DNA, 140 bp, Artificial Sequence
  Synthetic
caccgctgtcccaaaaggtcttaacaaccatttgattctagtcctcaaagggattgacaacccggacgaccacagactcggtaccacaaagctgtcaaactcggcctgaaccttctgaatcatatcagcagccagggcct

SEQ ID NO: 8485 - DNA, 140 bp, Artificial Sequence
  Synthetic
aggccctggctgctgatatgccctgaatagtaacaaaacacaaaaacaataaaaactacaaaatagaaaatctataaacaaaagtagttcaaagggctataaaaacccctgaatagtaacgaccttttgggacagcggtg

SEQ ID NO: 8486 - DNA, 140 bp, Artificial Sequence
  Synthetic
caccgctgtcccaaaaggtcgttactattcaggggtttttatagccctttgaactacttttgtttatagattttctattttgtagtttttattgtttttgtgttttgttactattcagggcatatcagcagccagggcct

SEQ ID NO: 8487 - DNA, 140 bp, Artificial Sequence
  Synthetic
atacgccatgctgggtctccaaaacataaaatgtaataaaaattaagtgtgtacccaaaagaggtacagtaagaatcagtgaataccacaattggcaacgagaagagacgtaggtatttacgtacttgggagtcggccat

SEQ ID NO: 8488 - DNA, 140 bp, Artificial Sequence
  Synthetic
atggccgactcccaagtacgtaaatacctacgtctcttctcgttgccaattgtggtattcactgattcttactgtacctcttttgggtacacacttaatttttattacattttatgttttggagacccagcatggcgtat

SEQ ID NO: 8489 - DNA, 140 bp, Artificial Sequence
  Synthetic
aggccctggctgctgatatgaagaatcagtgaataccacaattggcaacgagaagagacgtaggtatttatgtgcaactgtctgaagctcttgccatgctgctgtaagcttcctaaaagcgaccttttgggacagcggtg

SEQ ID NO: 8490 - DNA, 140 bp, Artificial Sequence
  Synthetic
caccgctgtcccaaaaggtcgcttttaggaagcttacagcagcatggcaagagcttcagacagttgcacataaatacctacgtctcttctcgttgccaattgtggtattcactgattcttcatatcagcagccagggcct

SEQ ID NO: 8491 - DNA, 140 bp, Artificial Sequence
  Synthetic
atacgccatgctgggtctcctctgaagctcttgccatgctgctgtaagcttcctaaaagcagccgaactcactttgagacgtaggcatagtataccgaactcttccactattctccgaaccgtacttgggagtcggccat

SEQ ID NO: 8492 - DNA, 140 bp, Artificial Sequence
  Synthetic
atggccgactcccaagtacggttcggagaatagtggaagagttcggtatactatgcctacgtctcaaagtgagttcggctgcttttaggaagcttacagcagcatggcaagagcttcagaggagacccagcatggcgtat

SEQ ID NO: 8493 - DNA, 140 bp, Artificial Sequence
  Synthetic
aggccctggctgctgatatgcgcgggttaccgggtgacggtgtttgcaaggcagtatataaaaaatggccggagtcctttaaaaattgtgcaacaccagtaggaaccgcaaaaacagttagaccttttgggacagcggtg

SEQ ID NO: 8494 - DNA, 140 bp, Artificial Sequence
  Synthetic
caccgctgtcccaaaaggtctaactgtttttgcggttcctactggtgttgcacaatttttaaaggactccggccattttttatatactgccttgcaaacaccgtcacccggtaacccgcgcatatcagcagccagggcct

SEQ ID NO: 8495 - DNA, 140 bp, Artificial Sequence
  Synthetic
atacgccatgctgggtctccagatacccgtgcacatgaagtccgacgcttcgaagttcacccatgagaaaccggaggggtactacaactggcaccacggagccgtacagtactcaggaggcgtacttgggagtcggccat

SEQ ID NO: 8496 - DNA, 140 bp, Artificial Sequence
  Synthetic
atggccgactcccaagtacgcctcctgagtactgtacggctccgtggtgccagttgtagtacccctccggtttctcatgggtgaacttcgaagcgtcggacttcatgtgcacgggtatctggagacccagcatggcgtat

SEQ ID NO: 8497 - DNA, 140 bp, Artificial Sequence
  Synthetic
aggccctggctgctgatatggggaacatgcctatctccatcgacataccggacgcggcctttaccagggtcgtcgacgcgccatctttaacggacatgtcatgtgaggtatcagcctgcagaccttttgggacagcggtg

SEQ ID NO: 8498 - DNA, 140 bp, Artificial Sequence
  Synthetic
caccgctgtcccaaaaggtctgcaggctgatacctcacatgacatgtccgttaaagatggcgcgtcgacgaccctggtaaaggccgcgtccggtatgtcgatggagataggcatgttccccatatcagcagccagggcct

SEQ ID NO: 8499 - DNA, 140 bp, Artificial Sequence
  Synthetic
atacgccatgctgggtctccatatagctaggaatcaacagataagtatagatctaagggctgaacaacccctgaataataacaaaatataaaaatcaacaaaaatcataaaatagaaaaccgtacttgggagtcggccat

SEQ ID NO: 8500 - DNA, 140 bp, Artificial Sequence
  Synthetic
atggccgactcccaagtacggttttctattttatgatttttgttgatttttatattttgttattattcaggggttgttcagcccttagatctatacttatctgttgattcctagctatatggagacccagcatggcgtat

SEQ ID NO: 8501 - DNA, 140 bp, Artificial Sequence
  Synthetic
aggccctggctgctgatatgatatatagctaagaatcaatagataagcatagatcaaagggctgaacaacccctgaataataacaaaatataaaaaccaataaaaatcataaaatagaaagaccttttgggacagcggtg

SEQ ID NO: 8502 - DNA, 140 bp, Artificial Sequence
  Synthetic
caccgctgtcccaaaaggtctttctattttatgatttttattggtttttatattttgttattattcaggggttgttcagccctttgatctatgcttatctattgattcttagctatatatcatatcagcagccagggcct

SEQ ID NO: 8503 - DNA, 140 bp, Artificial Sequence
  Synthetic
atacgccatgctgggtctccatggctgcgtgagacacacgtagcctatcagtttcttactgctctactctgcaaagcaagagattaataacccatcatggattctgtgtacgtggatatacgtacttgggagtcggccat

SEQ ID NO: 8504 - DNA, 140 bp, Artificial Sequence
  Synthetic
atggccgactcccaagtacgtatatccacgtacacagaatccatgatgggttattaatctcttgctttgcagagtagagcagtaagaaactgataggctacgtgtgtctcacgcagccatggagacccagcatggcgtat

SEQ ID NO: 8505 - DNA, 140 bp, Artificial Sequence
  Synthetic
aggccctggctgctgatatgtcgtggatacgaggtcatgacagcagccgcatcccaagggttaaccagaaaaggagtttacgcagttagacaaaaagttaatgaaaacccgctctatgcagaccttttgggacagcggtg

SEQ ID NO: 8506 - DNA, 140 bp, Artificial Sequence
  Synthetic
caccgctgtcccaaaaggtctgcatagagcgggttttcattaactttttgtctaactgcgtaaactccttttctggttaacccttgggatgcggctgctgtcatgacctcgtatccacgacatatcagcagccagggcct

SEQ ID NO: 8507 - DNA, 140 bp, Artificial Sequence
  Synthetic
aggccctggctgctgatatgcacgaacaccatgaagaactacctgcttcccgtggtcgcccaggccttcagtaagtgggcgaaggagtgccggaaggacatggaagatgagaagcttctggaccttttgggacagcggtg

SEQ ID NO: 8508 - DNA, 140 bp, Artificial Sequence
  Synthetic
caccgctgtcccaaaaggtccagaagcttctcatcttccatgtccttccggcactccttcgcccacttactgaaggcctgggcgaccacgggaagcaggtagttcttcatggtgttcgtgcatatcagcagccagggcct

SEQ ID NO: 8509 - DNA, 140 bp, Artificial Sequence
  Synthetic
aggccctggctgctgatatggcagatgaaagtcaactacaatcataacatctgcactcaagtgtaccacaaaagtatctccaggcggtgcacactgcctgtgactgccattgtgtcgtcggaccttttgggacagcggtg

SEQ ID NO: 8510 - DNA, 140 bp, Artificial Sequence
  Synthetic
caccgctgtcccaaaaggtccgacgacacaatggcagtcacaggcagtgtgcaccgcctggagatacttttgtggtacacttgagtgcagatgttatgattgtagttgactttcatctgccatatcagcagccagggcct

SEQ ID NO: 8511 - DNA, 140 bp, Artificial Sequence
  Synthetic
aggccctggctgctgatatgcggctataaccttgcactgcctactaagagagtcacctgggtagcgccactaggtgtccgcggagcggactatacatacaacctagagatgggtctaccggaccttttgggacagcggtg

SEQ ID NO: 8512 - DNA, 140 bp, Artificial Sequence
  Synthetic
caccgctgtcccaaaaggtccggtagacccatctctaggttgtatgtatagtccgctccgcggacacctagtggcgctacccaggtgactctcttagtaggcagtgcaaggttatagccgcatatcagcagccagggcct

SEQ ID NO: 8513 - DNA, 140 bp, Artificial Sequence
  Synthetic
atacgccatgctgggtctcccacggaaggcgcactgtactcatatctagaagggacacgttttcaccagacggcagtggatgtggcagagatacatactatgtggccaaagcaaatagagcgtacttgggagtcggccat

SEQ ID NO: 8514 - DNA, 140 bp, Artificial Sequence
  Synthetic
atggccgactcccaagtacgctctatttgctttggccacatagtatgtatctctgccacatccactgccgtctggtgaaaacgtgtcccttctagatatgagtacagtgcgccttccgtgggagacccagcatggcgtat

SEQ ID NO: 8515 - DNA, 140 bp, Artificial Sequence
  Synthetic
aggccctggctgctgatatgaccgtatacccggcgcctgtgtactcgcctccgatcaacgtccgattgtccaatcccgagtccgcagtggcagcatgtaacgagttcttagctagaaactgaccttttgggacagcggtg

SEQ ID NO: 8516 - DNA, 140 bp, Artificial Sequence
  Synthetic
caccgctgtcccaaaaggtcagtttctagctaagaactcgttacatgctgccactgcggactcgggattggacaatcggacgttgatcggaggcgagtacacaggcgccgggtatacggtcatatcagcagccagggcct

SEQ ID NO: 8517 - DNA, 140 bp, Artificial Sequence
  Synthetic
aggccctggctgctgatatggggccgcagagagagaatgtgcatgaaaatcgaaaatgattgtatcttcgaagtcaagcatgaaggtaaggtaacaggttacgcgtgcttggtaggggacgaccttttgggacagcggtg

SEQ ID NO: 8518 - DNA, 140 bp, Artificial Sequence
  Synthetic
caccgctgtcccaaaaggtcgtcccctaccaagcacgcgtaacctgttaccttaccttcatgcttgacttcgaagatacaatcattttcgattttcatgcacattctctctctgcggccccatatcagcagccagggcct

SEQ ID NO: 8519 - DNA, 140 bp, Artificial Sequence
  Synthetic
aggccctggctgctgatatggcacgattactggaacaatgggacacttcattctggcccgatgtccgaaaggagaaactctgacggtagggttcactgacggtaggaagatcagtcactcgaccttttgggacagcggtg

SEQ ID NO: 8520 - DNA, 140 bp, Artificial Sequence
  Synthetic
caccgctgtcccaaaaggtcgagtgactgatcttcctaccgtcagtgaaccctaccgtcagagtttctcctttcggacatcgggccagaatgaagtgtcccattgttccagtaatcgtgccatatcagcagccagggcct

SEQ ID NO: 8521 - DNA, 140 bp, Artificial Sequence
  Synthetic
aggccctggctgctgatatgtgtctgagactcttaccatgctgttgtaaaatgttgacttttttagccgtactgagcgtcggtgcccacactgtgagtgcgtacgaacacgtaacagtgagaccttttgggacagcggtg

SEQ ID NO: 8522 - DNA, 140 bp, Artificial Sequence
  Synthetic
caccgctgtcccaaaaggtctcactgttacgtgttcgtacgcactcacagtgtgggcaccgacgctcagtacggctaaaaaagtcaacattttacaacagcatggtaagagtctcagacacatatcagcagccagggcct

SEQ ID NO: 8523 - DNA, 140 bp, Artificial Sequence
  Synthetic
aggccctggctgctgatatgcaccttttcgcatacaccattaccaacagtgcgtcgaccacgcaatgaaactgcaaatgctcgggggtgactcattgagactgctcaaaccgggcggctcgaccttttgggacagcggtg

SEQ ID NO: 8524 - DNA, 140 bp, Artificial Sequence
  Synthetic
caccgctgtcccaaaaggtcgagccgcccggtttgagcagtctcaatgagtcacccccgagcatttgcagtttcattgcgtggtcgacgcactgttggtaatggtgtatgcgaaaaggtgcatatcagcagccagggcct

SEQ ID NO: 8525 - DNA, 140 bp, Artificial Sequence
  Synthetic
aggccctggctgctgatatgatgtggagaagtccgaatcatgcaaaacagaatttgcatcagcatacagggctcataccgcatccgcgtcagctaagctccgcgtcctttaccaaggaaagaccttttgggacagcggtg

SEQ ID NO: 8526 - DNA, 140 bp, Artificial Sequence
  Synthetic
caccgctgtcccaaaaggtctttccttggtaaaggacgcggagcttagctgacgcggatgcggtatgagccctgtatgctgatgcaaattctgttttgcatgattcggacttctccacatcatatcagcagccagggcct

SEQ ID NO: 8527 - DNA, 140 bp, Artificial Sequence
  Synthetic
atacgccatgctgggtctcctaatatcactgtagctgcttatgcaaacggcgaccatgccgtcacagttaaggacgctaaattcatagtggggccaatgtcttcagcctggacacctttccgtacttgggagtcggccat

SEQ ID NO: 8528 - DNA, 140 bp, Artificial Sequence
  Synthetic
atggccgactcccaagtacggaaaggtgtccaggctgaagacattggccccactatgaatttagcgtccttaactgtgacggcatggtcgccgtttgcataagcagctacagtgatattaggagacccagcatggcgtat

SEQ ID NO: 8529 - DNA, 140 bp, Artificial Sequence
  Synthetic
aggccctggctgctgatatgacccctcatactcgacaaattgggcggatgagcaggtactgaaggctaagaacataggattatgttcaacagacctgacggaaggtggacgaggcaaattgaccttttgggacagcggtg

SEQ ID NO: 8530 - DNA, 140 bp, Artificial Sequence
  Synthetic
caccgctgtcccaaaaggtcaatttgcctcgtccaccttccgtcaggtctgttgaacataatcctatgttcttagccttcagtacctgctcatccgcccaatttgtcgagtatgaggggtcatatcagcagccagggcct

SEQ ID NO: 8531 - DNA, 140 bp, Artificial Sequence
  Synthetic
atacgccatgctgggtctccctgtgacacagtggtttcgtgtgagggctacgtcgtcaagagaataacgatgagcccaggcctttatggaaaaaccacagggtatgcggtaacccaccaccgtacttgggagtcggccat

SEQ ID NO: 8532 - DNA, 140 bp, Artificial Sequence
  Synthetic
atggccgactcccaagtacggtggtgggttaccgcataccctgtggtttttccataaaggcctgggctcatcgttattctcttgacgacgtagccctcacacgaaaccactgtgtcacagggagacccagcatggcgtat

SEQ ID NO: 8533 - DNA, 140 bp, Artificial Sequence
  Synthetic
aggccctggctgctgatatgcgtcagcaccgtgcacgattactggaacaatgggacacttcattctggcccgatgtccgaaaggagaaactctgacggtggggttcactgatggcagaaagaccttttgggacagcggtg

SEQ ID NO: 8534 - DNA, 140 bp, Artificial Sequence
  Synthetic
caccgctgtcccaaaaggtctttctgccatcagtgaaccccaccgtcagagtttctcctttcggacatcgggccagaatgaagtgtcccattgttccagtaatcgtgcacggtgctgacgcatatcagcagccagggcct

SEQ ID NO: 8535 - DNA, 140 bp, Artificial Sequence
  Synthetic
aggccctggctgctgatatgcagatgcggacccaagtagagctgctggatgagcacatctccatagactgcgatattgttcgcgtgcaccctgacagcagcttggcaggcagaaaaggatgaccttttgggacagcggtg

SEQ ID NO: 8536 - DNA, 140 bp, Artificial Sequence
  Synthetic
caccgctgtcccaaaaggtcatccttttctgcctgccaagctgctgtcagggtgcacgcgaacaatatcgcagtctatggagatgtgctcatccagcagctctacttgggtccgcatctgcatatcagcagccagggcct

SEQ ID NO: 8537 - DNA, 140 bp, Artificial Sequence
  Synthetic
aggccctggctgctgatatgaaagcagccgaactcgctttgagatgtaggcgtagcacaccgaactcttccacgattccccgaacccacagggacgtaggagatgttcaaagtgactatagaccttttgggacagcggtg

SEQ ID NO: 8538 - DNA, 140 bp, Artificial Sequence
  Synthetic
caccgctgtcccaaaaggtctatagtcactttgaacatctcctacgtccctgtgggttcggggaatcgtggaagagttcggtgtgctacgcctacatctcaaagcgagttcggctgctttcatatcagcagccagggcct

SEQ ID NO: 8539 - DNA, 140 bp, Artificial Sequence
  Synthetic
atacgccatgctgggtctccttggaccaaactgcgttatatggacaaccacatgccagcagacgcagagagggcggggctatttgtaagaacattagcaccgtgtacgattactggaacacgtacttgggagtcggccat

SEQ ID NO: 8540 - DNA, 140 bp, Artificial Sequence
  Synthetic
atggccgactcccaagtacgtgttccagtaatcgtacacggtgctaatgttcttacaaatagccccgccctctctgcgtctgctggcatgtggttgtccatataacgcagtttggtccaaggagacccagcatggcgtat

SEQ ID NO: 8541 - DNA, 140 bp, Artificial Sequence
  Synthetic
aggccctggctgctgatatgctgactgggtaatgagcaccgtacctgtcgcgccgcccagaagaaggcgagggagaaacctgactgtgacatgtgacgagagagaagggaatataacaccgaccttttgggacagcggtg

SEQ ID NO: 8542 - DNA, 140 bp, Artificial Sequence
  Synthetic
caccgctgtcccaaaaggtcggtgttatattcccttctctctcgtcacatgtcacagtcaggtttctccctcgccttcttctgggcggcgcgacaggtacggtgctcattacccagtcagcatatcagcagccagggcct

SEQ ID NO: 8543 - DNA, 140 bp, Artificial Sequence
  Synthetic
aggccctggctgctgatatggacgttccccattacatttggggacttcaacgaaggagaaatcgaaagcttgtcttctgagctactaactttcggagacttcttaccaggagaagtggatgaccttttgggacagcggtg

SEQ ID NO: 8544 - DNA, 140 bp, Artificial Sequence
  Synthetic
caccgctgtcccaaaaggtcatccacttctcctggtaagaagtctccgaaagttagtagctcagaagacaagctttcgatttctccttcgttgaagtccccaaatgtaatggggaacgtccatatcagcagccagggcct

SEQ ID NO: 8545 - DNA, 140 bp, Artificial Sequence
  Synthetic
atacgccatgctgggtctccgtggggcctatgtcttcagcctggacacctttcgacaacaaaattgtggtgtacaaaggtgtcgtctataacatggactacccgccctttggcgcaggaacgtacttgggagtcggccat

SEQ ID NO: 8546 - DNA, 140 bp, Artificial Sequence
  Synthetic
atggccgactcccaagtacgttcctgcgccaaagggcgggtagtccatgttatagacgacacctttgtacaccacaattttgttgtcgaaaggtgtccaggctgaagacataggccccacggagacccagcatggcgtat

SEQ ID NO: 8547 - DNA, 140 bp, Artificial Sequence
  Synthetic
aggccctggctgctgatatggacttgacagacagcgactggtccacgtgctcagacacggacgacgagttatgactagacagggcaggtgggtatatattctcgtcggacaccggtccaggaccttttgggacagcggtg

SEQ ID NO: 8548 - DNA, 140 bp, Artificial Sequence
  Synthetic
caccgctgtcccaaaaggtcctggaccggtgtccgacgagaatatatacccacctgccctgtctagtcataactcgtcgtccgtgtctgagcacgtggaccagtcgctgtctgtcaagtccatatcagcagccagggcct

SEQ ID NO: 8549 - DNA, 140 bp, Artificial Sequence
  Synthetic
aggccctggctgctgatatgtgtcttctgagctactaactttcggagacttcttaccaggagaagtggatgacttgacagacagcgactggtccacgtgctcagacacggacgacgagttgaccttttgggacagcggtg

SEQ ID NO: 8550 - DNA, 140 bp, Artificial Sequence
  Synthetic
caccgctgtcccaaaaggtcaactcgtcgtccgtgtctgagcacgtggaccagtcgctgtctgtcaagtcatccacttctcctggtaagaagtctccgaaagttagtagctcagaagacacatatcagcagccagggcct

SEQ ID NO: 8551 - DNA, 140 bp, Artificial Sequence
  Synthetic
atacgccatgctgggtctccggcagtgcgccagcaaggaggatgatgtcggataggaagtaccactgcgtttgcccaatgcgcagcgcagaagaccctgagagactcgccaactacgcgacgtacttgggagtcggccat

SEQ ID NO: 8552 - DNA, 140 bp, Artificial Sequence
  Synthetic
atggccgactcccaagtacgtcgcgtagttggcgagtctctcagggtcttctgcgctgcgcattgggcaaacgcagtggtacttcctatccgacatcatcctccttgctggcgcactgccggagacccagcatggcgtat

SEQ ID NO: 8553 - DNA, 140 bp, Artificial Sequence
  Synthetic
aggccctggctgctgatatgaccgagcgacatttaatccgtcaaaactcaggagctacccgaaacagcacgcttaccacgcgccctccatcagaagcgctgtaccgtccccattccagaagaccttttgggacagcggtg

SEQ ID NO: 8554 - DNA, 140 bp, Artificial Sequence
  Synthetic
caccgctgtcccaaaaggtcttctggaatggggacggtacagcgcttctgatggagggcgcgtggtaagcgtgctgtttcgggtagctcctgagttttgacggattaaatgtcgctcggtcatatcagcagccagggcct

SEQ ID NO: 8555 - DNA, 140 bp, Artificial Sequence
  Synthetic
aggccctggctgctgatatgttgcccaatgcgcagcgcagaagaccctgagagactcgccaactacgcgagaaaactagcatctgctgcaggaaaagtcttggacagaaacatctccggagaccttttgggacagcggtg

SEQ ID NO: 8556 - DNA, 140 bp, Artificial Sequence
  Synthetic
caccgctgtcccaaaaggtctccggagatgtttctgtccaagacttttcctgcagcagatgctagttttctcgcgtagttggcgagtctctcagggtcttctgcgctgcgcattgggcaacatatcagcagccagggcct

SEQ ID NO: 8557 - DNA, 140 bp, Artificial Sequence
  Synthetic
aggccctggctgctgatatggcttaccacgcgccctccatcagaagcgctgtaccgtccccattccagaacacactacagaatgtactggcagcagccacgaaaagaaactgcaacgtcagaccttttgggacagcggtg

SEQ ID NO: 8558 - DNA, 140 bp, Artificial Sequence
  Synthetic
caccgctgtcccaaaaggtctgacgttgcagtttcttttcgtggctgctgccagtacattctgtagtgtgttctggaatggggacggtacagcgcttctgatggagggcgcgtggtaagccatatcagcagccagggcct

SEQ ID NO: 8559 - DNA, 140 bp, Artificial Sequence
  Synthetic
atacgccatgctgggtctcccaggcgattaaaggagtccgtgtagcatactggatagggtttgatacaaccccgttcatgtataatgccatggcaggtgcatacccctcatactcgacaacgtacttgggagtcggccat

SEQ ID NO: 8560 - DNA, 140 bp, Artificial Sequence
  Synthetic
atggccgactcccaagtacgttgtcgagtatgaggggtatgcacctgccatggcattatacatgaacggggttgtatcaaaccctatccagtatgctacacggactcctttaatcgcctgggagacccagcatggcgtat

SEQ ID NO: 8561 - DNA, 140 bp, Artificial Sequence
  Synthetic
aggccctggctgctgatatgactgggcagatgagcaggtgctgaaggcaaagaacataggattatgttcaacagacctgacggaaggtagacgaggtaaattgtctatcatgagagggaagaccttttgggacagcggtg

SEQ ID NO: 8562 - DNA, 140 bp, Artificial Sequence
  Synthetic
caccgctgtcccaaaaggtcttccctctcatgatagacaatttacctcgtctaccttccgtcaggtctgttgaacataatcctatgttctttgccttcagcacctgctcatctgcccagtcatatcagcagccagggcct

SEQ ID NO: 8563 - DNA, 140 bp, Artificial Sequence
  Synthetic
atacgccatgctgggtctcctgcaaaacaaccgatacggtagacggcgagagagtgtcattttcggtatgcacgtatgtacctgcaaccatttgtgatcaaatgacaggtattcttgccacgtacttgggagtcggccat

SEQ ID NO: 8564 - DNA, 140 bp, Artificial Sequence
  Synthetic
atggccgactcccaagtacgtggcaagaatacctgtcatttgatcacaaatggttgcaggtacatacgtgcataccgaaaatgacactctctcgccgtctaccgtatcggttgttttgcaggagacccagcatggcgtat

SEQ ID NO: 8565 - DNA, 140 bp, Artificial Sequence
  Synthetic
atacgccatgctgggtctcccggaggttacaccggaggatgcacagaagctgctggtgggattgaaccagaggatagtggtcaatggcagaacacagaggaacacgaacacaatgaagaacgtacttgggagtcggccat

SEQ ID NO: 8566 - DNA, 140 bp, Artificial Sequence
  Synthetic
atggccgactcccaagtacgttcttcattgtgttcgtgttcctctgtgttctgccattgaccactatcctctggttcaatcccaccagcagcttctgtgcatcctccggtgtaacctccgggagacccagcatggcgtat

SEQ ID NO: 8567 - DNA, 140 bp, Artificial Sequence
  Synthetic
aggccctggctgctgatatgaggatagtggtcaatggcagaacacagaggaacacgaacacaatgaagaattacttgcttcctgtggttgcccaagccctcagtaagtgggcaaaggaatgaccttttgggacagcggtg

SEQ ID NO: 8568 - DNA, 140 bp, Artificial Sequence
  Synthetic
caccgctgtcccaaaaggtcattcctttgcccacttactgagggcttgggcaaccacaggaagcaagtaattcttcattgtgttcgtgttcctctgtgttctgccattgaccactatcctcatatcagcagccagggcct

SEQ ID NO: 8569 - DNA, 140 bp, Artificial Sequence
  Synthetic
atacgccatgctgggtctcctgaacactgacgaggagtcgtacgagctggtaagggcagaaaggacagagcatgagtacgtctatgatgtggaccaaagaaggtgctgcaagaaagaggacgtacttgggagtcggccat

SEQ ID NO: 8570 - DNA, 140 bp, Artificial Sequence
  Synthetic
atggccgactcccaagtacgtcctctttcttgcagcaccttctttggtccacatcatagacgtactcatgctctgtcctttctgcccttaccagctcgtacgactcctcgtcagtgttcaggagacccagcatggcgtat

SEQ ID NO: 8571 - DNA, 140 bp, Artificial Sequence
  Synthetic
aggccctggctgctgatatgcatgagtacgtctatgatgtggaccaaagaaggtgctgcaagaaagaggaggcagccgggctggtactggtcggcgacctgaccaacccgccctaccatggaccttttgggacagcggtg

SEQ ID NO: 8572 - DNA, 140 bp, Artificial Sequence
  Synthetic
caccgctgtcccaaaaggtccatggtagggcgggttggtcaggtcgccgaccagtaccagcccggctgcctcctctttcttgcagcaccttctttggtccacatcatagacgtactcatgcatatcagcagccagggcct

SEQ ID NO: 8573 - DNA, 140 bp, Artificial Sequence
  Synthetic
atacgccatgctgggtctcctctgcacgcacggtcgactcactgctcttgaacggatgcaacagaccagtcgacgtgttgtacgtcgacgaagcgtttgcgtgccattctggcacgttaccgtacttgggagtcggccat

SEQ ID NO: 8574 - DNA, 140 bp, Artificial Sequence
  Synthetic
atggccgactcccaagtacggtaacgtgccagaatggcacgcaaacgcttcgtcgacgtacaacacgtcgactggtctgttgcatccgttcaagagcagtgagtcgaccgtgcgtgcagaggagacccagcatggcgtat

SEQ ID NO: 8575 - DNA, 140 bp, Artificial Sequence
  Synthetic
aggccctggctgctgatatgcaaccataacatctgcacccaagtgtaccataaaagtatctccaggcggtgtacactgcctgtgactgccattgtgtcctcgttgcattacgaaggcaaagaccttttgggacagcggtg

SEQ ID NO: 8576 - DNA, 140 bp, Artificial Sequence
  Synthetic
caccgctgtcccaaaaggtctttgccttcgtaatgcaacgaggacacaatggcagtcacaggcagtgtacaccgcctggagatacttttatggtacacttgggtgcagatgttatggttgcatatcagcagccagggcct

SEQ ID NO: 8577 - DNA, 140 bp, Artificial Sequence
  Synthetic
atacgccatgctgggtctccactgtcccgactgtggagaagggcactcgtgccatagtcccgtagcactagaacgcatcagaaatgaagcgacagacgggacgctgaaaatccaggtctccgtacttgggagtcggccat

SEQ ID NO: 8578 - DNA, 140 bp, Artificial Sequence
  Synthetic
atggccgactcccaagtacggagacctggattttcagcgtcccgtctgtcgcttcatttctgatgcgttctagtgctacgggactatggcacgagtgcccttctccacagtcgggacagtggagacccagcatggcgtat

SEQ ID NO: 8579 - DNA, 140 bp, Artificial Sequence
  Synthetic
atacgccatgctgggtctcctactgacgcgtacggaaggcaaactagtatggaagacactttctggagacccatgggtaaagacactgcagaacccgccgaaaggaaattttaaagcaaccgtacttgggagtcggccat

SEQ ID NO: 8580 - DNA, 140 bp, Artificial Sequence
  Synthetic
atggccgactcccaagtacggttgctttaaaatttcctttcggcgggttctgcagtgtctttacccatgggtctccagaaagtgtcttccatactagtttgccttccgtacgcgtcagtaggagacccagcatggcgtat

SEQ ID NO: 8581 - DNA, 140 bp, Artificial Sequence
  Synthetic
aggccctggctgctgatatgaccaccaagtgaccttcgacacgttccagaataaagccaatgtctgctgggcgaagagcttagtccccatcctagaaacagcagggataaaattaaacgagaccttttgggacagcggtg

SEQ ID NO: 8582 - DNA, 140 bp, Artificial Sequence
  Synthetic
caccgctgtcccaaaaggtctcgtttaattttatccctgctgtttctaggatggggactaagctcttcgcccagcagacattggctttattctggaacgtgtcgaaggtcacttggtggtcatatcagcagccagggcct

SEQ ID NO: 8583 - DNA, 140 bp, Artificial Sequence
  Synthetic
aggccctggctgctgatatggtgataggtcgggaaaaattccattcccgaccgcagcacggtaaagagctaccttgcagcacgtacgtgcagagcaccgccgcaactaccgaggagataggaccttttgggacagcggtg

SEQ ID NO: 8584 - DNA, 140 bp, Artificial Sequence
  Synthetic
caccgctgtcccaaaaggtcctatctcctcggtagttgcggcggtgctctgcacgtacgtgctgcaaggtagctctttaccgtgctgcggtcgggaatggaatttttcccgacctatcaccatatcagcagccagggcct

SEQ ID NO: 8585 - DNA, 140 bp, Artificial Sequence
  Synthetic
aggccctggctgctgatatggcgaagagcttagtccccatcctagaaacagcagggataaaattaaacgacaggcagtggtcccagataatccaggcttttaaagaagacagagcatactgaccttttgggacagcggtg

SEQ ID NO: 8586 - DNA, 140 bp, Artificial Sequence
  Synthetic
caccgctgtcccaaaaggtcagtatgctctgtcttctttaaaagcctggattatctgggaccactgcctgtcgtttaattttatccctgctgtttctaggatggggactaagctcttcgccatatcagcagccagggcct

SEQ ID NO: 8587 - DNA, 140 bp, Artificial Sequence
  Synthetic
atacgccatgctgggtctcccacctgaggtggccctgaatgagatatgcacgcgcatgtacggggtagacctggacagcgggctgttctctaagccactggtgtccgtgcattatgcggacgtacttgggagtcggccat

SEQ ID NO: 8588 - DNA, 140 bp, Artificial Sequence
  Synthetic
atggccgactcccaagtacgtccgcataatgcacggacaccagtggcttagagaacagcccgctgtccaggtctaccccgtacatgcgcgtgcatatctcattcagggccacctcaggtgggagacccagcatggcgtat

SEQ ID NO: 8589 - DNA, 140 bp, Artificial Sequence
  Synthetic
atacgccatgctgggtctccaacaccaacaagcaaatctgtgtgactactaggaggattgaagattttaacccgaacaccaacatcatacctgccaacaggagactaccgcattcattggcgtacttgggagtcggccat

SEQ ID NO: 8590 - DNA, 140 bp, Artificial Sequence
  Synthetic
atggccgactcccaagtacgccaatgaatgcggtagtctcctgttggcaggtatgatgttggtgttcgggttaaaatcttcaatcctcctagtagtcacacagatttgcttgttggtgttggagacccagcatggcgtat

SEQ ID NO: 8591 - DNA, 140 bp, Artificial Sequence
  Synthetic
atacgccatgctgggtctccatcatccagagcgttgaaaccgccgtgcgtcactagcaacaccgagatgtttttcttgttcagcaactttgataacggcagaaggaactttacaacgcaccgtacttgggagtcggccat

SEQ ID NO: 8592 - DNA, 140 bp, Artificial Sequence
  Synthetic
atggccgactcccaagtacggtgcgttgtaaagttccttctgccgttatcaaagttgctgaacaagaaaaacatctcggtgttgctagtgacgcacggcggtttcaacgctctggatgatggagacccagcatggcgtat

SEQ ID NO: 8593 - DNA, 140 bp, Artificial Sequence
  Synthetic
aggccctggctgctgatatgttttcttgttcagcaactttgataacggcagaaggaactttacaacgcacgtaatgaacaaccagctgaatgctgcttttgttggccaggccacccgagcgaccttttgggacagcggtg

SEQ ID NO: 8594 - DNA, 140 bp, Artificial Sequence
  Synthetic
caccgctgtcccaaaaggtcgctcgggtggcctggccaacaaaagcagcattcagctggttgttcattacgtgcgttgtaaagttccttctgccgttatcaaagttgctgaacaagaaaacatatcagcagccagggcct

SEQ ID NO: 8595 - DNA, 140 bp, Artificial Sequence
  Synthetic
aggccctggctgctgatatggtaatgaacaaccagctgaatgctgcttttgttggccaggccacccgagcagggtgtgcaccgtcgtaccgggttaaacgcatggacatcgcaaagaacggaccttttgggacagcggtg

SEQ ID NO: 8596 - DNA, 140 bp, Artificial Sequence
  Synthetic
caccgctgtcccaaaaggtccgttctttgcgatgtccatgcgtttaacccggtacgacggtgcacaccctgctcgggtggcctggccaacaaaagcagcattcagctggttgttcattaccatatcagcagccagggcct

SEQ ID NO: 8597 - DNA, 140 bp, Artificial Sequence
  Synthetic
aggccctggctgctgatatgaacgagcagcaacctttgttttggctacaagcccttattccgctggcagccctgattgttctatgcaactgtctgagactcttaccatgctgctgtaaaagaccttttgggacagcggtg

SEQ ID NO: 8598 - DNA, 140 bp, Artificial Sequence
  Synthetic
caccgctgtcccaaaaggtcttttacagcagcatggtaagagtctcagacagttgcatagaacaatcagggctgccagcggaataagggcttgtagccaaaacaaaggttgctgctcgttcatatcagcagccagggcct

SEQ ID NO: 8599 - DNA, 140 bp, Artificial Sequence
  Synthetic
atacgccatgctgggtctcctgcaacaccagtgggaaccgcaaagacagtcatgtgcggtacatacccggtaatccatgcagtaggacctaatttctcaaattactctgagtccgaaggacgtacttgggagtcggccat

SEQ ID NO: 8600 - DNA, 140 bp, Artificial Sequence
  Synthetic
atggccgactcccaagtacgtccttcggactcagagtaatttgagaaattaggtcctactgcatggattaccgggtatgtaccgcacatgactgtctttgcggttcccactggtgttgcaggagacccagcatggcgtat

SEQ ID NO: 8601 - DNA, 140 bp, Artificial Sequence
  Synthetic
aggccctggctgctgatatgtaatccatgcagtaggacctaatttctcaaattactctgagtccgaaggagaccgggaattggcggctgcttaccgcgaagtcgctaaggaggtgactaggaccttttgggacagcggtg

SEQ ID NO: 8602 - DNA, 140 bp, Artificial Sequence
  Synthetic
caccgctgtcccaaaaggtcctagtcacctccttagcgacttcgcggtaagcagccgccaattcccggtctccttcggactcagagtaatttgagaaattaggtcctactgcatggattacatatcagcagccagggcct

SEQ ID NO: 8603 - DNA, 140 bp, Artificial Sequence
  Synthetic
aggccctggctgctgatatgctcctacttggaagggacacggttccatcagacggcagtagacatggcagaagtatacaccatgtggccaaagcagacggaggctaatgaacaagtttgcgaccttttgggacagcggtg

SEQ ID NO: 8604 - DNA, 140 bp, Artificial Sequence
  Synthetic
caccgctgtcccaaaaggtcgcaaacttgttcattagcctccgtctgctttggccacatggtgtatacttctgccatgtctactgccgtctgatggaaccgtgtcccttccaagtaggagcatatcagcagccagggcct

SEQ ID NO: 8605 - DNA, 140 bp, Artificial Sequence
  Synthetic
atacgccatgctgggtctccctgcagcacacagcaccatttggctgccaaatagcaacaaacccggtaagagcggtgaactgcgccgtagggaacatgcccatctccatcgacataccggcgtacttgggagtcggccat

SEQ ID NO: 8606 - DNA, 140 bp, Artificial Sequence
  Synthetic
atggccgactcccaagtacgccggtatgtcgatggagatgggcatgttccctacggcgcagttcaccgctcttaccgggtttgttgctatttggcagccaaatggtgctgtgtgctgcagggagacccagcatggcgtat

SEQ ID NO: 8607 - DNA, 140 bp, Artificial Sequence
  Synthetic
aggccctggctgctgatatgtgcgaggtaccagcctgcacccattcctcagactttgggggcgtcgccattattaaatatgcagccagcaagaaaggcaagtgtgcggtgcattcgatgagaccttttgggacagcggtg

SEQ ID NO: 8608 - DNA, 140 bp, Artificial Sequence
  Synthetic
caccgctgtcccaaaaggtctcatcgaatgcaccgcacacttgcctttcttgctggctgcatatttaataatggcgacgcccccaaagtctgaggaatgggtgcaggctggtacctcgcacatatcagcagccagggcct

SEQ ID NO: 8609 - DNA, 140 bp, Artificial Sequence
  Synthetic
aggccctggctgctgatatgtgccatcacgcgttagtccaagggaatataaatcgcctcaggagaccgcacaagaaataagttcgaccacgtcactgacgcacagccaattcgaccttaggaccttttgggacagcggtg

SEQ ID NO: 8610 - DNA, 140 bp, Artificial Sequence
  Synthetic
caccgctgtcccaaaaggtcctaaggtcgaattggctgtgcgtcagtgacgtggtcgaacttatttcttgtgcggtctcctgaggcgatttatattcccttggactaacgcgtgatggcacatatcagcagccagggcct

SEQ ID NO: 8611 - DNA, 140 bp, Artificial Sequence
  Synthetic
atacgccatgctgggtctccacgagagagaagggaacgtacttcccatggctagcgttcggtttttcagagcggatctgcactccatcgtacaggaaacggcagagatacgcgatacggccgtacttgggagtcggccat

SEQ ID NO: 8612 - DNA, 140 bp, Artificial Sequence
  Synthetic
atggccgactcccaagtacggccgtatcgcgtatctctgccgtttcctgtacgatggagtgcagatccgctctgaaaaaccgaacgctagccatgggaagtacgttcccttctctctcgtggagacccagcatggcgtat

SEQ ID NO: 8613 - DNA, 140 bp, Artificial Sequence
  Synthetic
atacgccatgctgggtctcctttgacgaaggggagattgaaagcttgtcctctgagttactgacctttggagacttctcgccaggcgaagtggaagacctgacagacagcgattggtccacgtacttgggagtcggccat

SEQ ID NO: 8614 - DNA, 140 bp, Artificial Sequence
  Synthetic
atggccgactcccaagtacgtggaccaatcgctgtctgtcaggtcttccacttcgcctggcgagaagtctccaaaggtcagtaactcagaggacaagctttcaatctccccttcgtcaaaggagacccagcatggcgtat

SEQ ID NO: 8615 - DNA, 140 bp, Artificial Sequence
  Synthetic
atacgccatgctgggtctccgtagtttaaagggctataaaacccctgaatagtaataaaacataaagttaataaaaatcaaatgaataccataattggcaaacggaagagatgtaggtatcgtacttgggagtcggccat

SEQ ID NO: 8616 - DNA, 140 bp, Artificial Sequence
  Synthetic
atggccgactcccaagtacgatacctacatctcttccgtttgccaattatggtattcatttgatttttattaactttatgttttattactattcaggggttttatagccctttaaactacggagacccagcatggcgtat

SEQ ID NO: 8617 - DNA, 140 bp, Artificial Sequence
  Synthetic
aggccctggctgctgatatgttaagcttcctaaaagcagccgaactcactttgagaagtaggcatagcataccgaactcttccacgattctccgaacccacagggacgtaggagatgttagaccttttgggacagcggtg

SEQ ID NO: 8618 - DNA, 140 bp, Artificial Sequence
  Synthetic
caccgctgtcccaaaaggtctaacatctcctacgtccctgtgggttcggagaatcgtggaagagttcggtatgctatgcctacttctcaaagtgagttcggctgcttttaggaagcttaacatatcagcagccagggcct

SEQ ID NO: 8619 - DNA, 140 bp, Artificial Sequence
  Synthetic
atacgccatgctgggtctccaagacacacgtagcctaccagtttcttactgctctactctgcaaagcaagagattaataacccatcatggattctgtgtacgtggacatagacgctgacacgtacttgggagtcggccat

SEQ ID NO: 8620 - DNA, 140 bp, Artificial Sequence
  Synthetic
atggccgactcccaagtacgtgtcagcgtctatgtccacgtacacagaatccatgatgggttattaatctcttgctttgcagagtagagcagtaagaaactggtaggctacgtgtgtcttggagacccagcatggcgtat

SEQ ID NO: 8621 - DNA, 140 bp, Artificial Sequence
  Synthetic
atacgccatgctgggtctccgtggacgggtcggaaagctgccttgaccgggcgacattcaatccatcaaagcttagaagttatccaaaacagcactcctaccatgcacccacaatcagaacgtacttgggagtcggccat

SEQ ID NO: 8622 - DNA, 140 bp, Artificial Sequence
  Synthetic
atggccgactcccaagtacgttctgattgtgggtgcatggtaggagtgctgttttggataacttctaagctttgatggattgaatgtcgcccggtcaaggcagctttccgacccgtccacggagacccagcatggcgtat

SEQ ID NO: 8623 - DNA, 140 bp, Artificial Sequence
  Synthetic
aggccctggctgctgatatggcttagaagttatccaaaacagcactcctaccatgcacccacaatcagaagtgccgtaccttccccgttccagaacacgttgcagaatgtactggctgctgaccttttgggacagcggtg

SEQ ID NO: 8624 - DNA, 140 bp, Artificial Sequence
  Synthetic
caccgctgtcccaaaaggtcagcagccagtacattctgcaacgtgttctggaacggggaaggtacggcacttctgattgtgggtgcatggtaggagtgctgttttggataacttctaagccatatcagcagccagggcct

SEQ ID NO: 8625 - DNA, 140 bp, Artificial Sequence
  Synthetic
aggccctggctgctgatatgcactgcgtttgcccgatgcgcagcgcagaagatcccgagagactcgctaattatgcgagaaagctcgcatctgccgcaggaaaagtcctggacagaaacagaccttttgggacagcggtg

SEQ ID NO: 8626 - DNA, 140 bp, Artificial Sequence
  Synthetic
caccgctgtcccaaaaggtctgtttctgtccaggacttttcctgcggcagatgcgagctttctcgcataattagcgagtctctcgggatcttctgcgctgcgcatcgggcaaacgcagtgcatatcagcagccagggcct

SEQ ID NO: 8627 - DNA, 140 bp, Artificial Sequence
  Synthetic
aggccctggctgctgatatgggattcagcggtatttaatgttgagtgctttaaaaaatttgcgtgcaatcaagaatactggaaggaatttgccgccagtcctattaggataacgactgaggaccttttgggacagcggtg

SEQ ID NO: 8628 - DNA, 140 bp, Artificial Sequence
  Synthetic
caccgctgtcccaaaaggtcctcagtcgttatcctaataggactggcggcaaattccttccagtattcttgattgcacgcaaattttttaaagcactcaacattaaataccgctgaatcccatatcagcagccagggcct

SEQ ID NO: 8629 - DNA, 140 bp, Artificial Sequence
  Synthetic
atacgccatgctgggtctccgacacaaccccgttcatgtacaacgctatggcgggtgcctacccctcatactcgacaaattgggcggatgagcaggtactgaaggctaagaacataggatcgtacttgggagtcggccat

SEQ ID NO: 8630 - DNA, 140 bp, Artificial Sequence
  Synthetic
atggccgactcccaagtacgatcctatgttcttagccttcagtacctgctcatccgcccaatttgtcgagtatgaggggtaggcacccgccatagcgttgtacatgaacggggttgtgtcggagacccagcatggcgtat

SEQ ID NO: 8631 - DNA, 140 bp, Artificial Sequence
  Synthetic
aggccctggctgctgatatgcacactgaggaaagacctaaagtgcaggtcatacaggcagccgaacctttggcaacagcatatctgtgtgggattcacagagagttggtcagaaggctgagaccttttgggacagcggtg

SEQ ID NO: 8632 - DNA, 140 bp, Artificial Sequence
  Synthetic
caccgctgtcccaaaaggtctcagccttctgaccaactctctgtgaatcccacacagatatgctgttgccaaaggttcggctgcctgtatgacctgcactttaggtctttcctcagtgtgcatatcagcagccagggcct

SEQ ID NO: 8633 - DNA, 140 bp, Artificial Sequence
  Synthetic
aggccctggctgctgatatggtggtttcgtgtgagggctacgtcgttaagagaataacgatgagcccaggcctttatggaaaaaccacagggtatgcggtaacccaccacgcagacggatgaccttttgggacagcggtg

SEQ ID NO: 8634 - DNA, 140 bp, Artificial Sequence
  Synthetic
caccgctgtcccaaaaggtcatccgtctgcgtggtgggttaccgcataccctgtggtttttccataaaggcctgggctcatcgttattctcttaacgacgtagccctcacacgaaaccaccatatcagcagccagggcct

SEQ ID NO: 8635 - DNA, 140 bp, Artificial Sequence
  Synthetic
aggccctggctgctgatatgcctttatggaaaaaccacagggtatgcggtaacccaccacgcagacggattcctgatgtgcaagactaccgacacggttgacggcgaaagagtgtcattcgaccttttgggacagcggtg

SEQ ID NO: 8636 - DNA, 140 bp, Artificial Sequence
  Synthetic
caccgctgtcccaaaaggtcgaatgacactctttcgccgtcaaccgtgtcggtagtcttgcacatcaggaatccgtctgcgtggtgggttaccgcataccctgtggtttttccataaaggcatatcagcagccagggcct

SEQ ID NO: 8637 - DNA, 140 bp, Artificial Sequence
  Synthetic
aggccctggctgctgatatggggcacccgttttaagttcggcgccatgatgaagtctggtatgtttctaaccctgttcgtcaatacactgctgaacatcaccatagccagccgagtgctggaccttttgggacagcggtg

SEQ ID NO: 8638 - DNA, 140 bp, Artificial Sequence
  Synthetic
caccgctgtcccaaaaggtccagcactcggctggctatggtgatgttcagcagtgtattgacgaacagggttagaaacataccagacttcatcatggcgccgaacttaaaacgggtgccccatatcagcagccagggcct

SEQ ID NO: 8639 - DNA, 140 bp, Artificial Sequence
  Synthetic
aggccctggctgctgatatgtgaaccagagaatagtggttaacggcagaacgcaacggaacacgaacaccatgaagaactacctgattcccgtggtcgcccaggccttcagtaagtgggcgaccttttgggacagcggtg

SEQ ID NO: 8640 - DNA, 140 bp, Artificial Sequence
  Synthetic
caccgctgtcccaaaaggtcgcccacttactgaaggcctgggcgaccacgggaatcaggtagttcttcatggtgttcgtgttccgttgcgttctgccgttaaccactattctctggttcacatatcagcagccagggcct

SEQ ID NO: 8641 - DNA, 140 bp, Artificial Sequence
  Synthetic
atacgccatgctgggtctcccacacggtctacaagaggcctgatacccagtcaatccagaaggttcaggccgaatttgacagctttatggtaccgggcctgtggtcgtccgggttgtcaacgtacttgggagtcggccat

SEQ ID NO: 8642 - DNA, 140 bp, Artificial Sequence
  Synthetic
atggccgactcccaagtacgttgacaacccggacgaccacaggcccggtaccataaagctgtcaaattcggcctgaaccttctggattgactgggtatcaggcctcttgtagaccgtgtgggagacccagcatggcgtat

SEQ ID NO: 8643 - DNA, 140 bp, Artificial Sequence
  Synthetic
atacgccatgctgggtctcccgctggcggcgggagatgaacaagacgacgacagaagacgtgaactggctgacgaagtggtcagatggcaacgaacagggctaattgacgagctagaaaacgtacttgggagtcggccat

SEQ ID NO: 8644 - DNA, 140 bp, Artificial Sequence
  Synthetic
atggccgactcccaagtacgttttctagctcgtcaattagccctgttcgttgccatctgaccacttcgtcagccagttcacgtcttctgtcgtcgtcttgttcatctcccgccgccagcgggagacccagcatggcgtat

SEQ ID NO: 8645 - DNA, 140 bp, Artificial Sequence
  Synthetic
atacgccatgctgggtctcccgctggcggcgggagatgaacaagacgacgacagaagacgtgtactggctgacgaagtggtcagatggcaacgaacagggctaattgacgagctagaaaacgtacttgggagtcggccat

SEQ ID NO: 8646 - DNA, 140 bp, Artificial Sequence
  Synthetic
atggccgactcccaagtacgttttctagctcgtcaattagccctgttcgttgccatctgaccacttcgtcagccagtacacgtcttctgtcgtcgtcttgttcatctcccgccgccagcgggagacccagcatggcgtat

SEQ ID NO: 8647 - DNA, 140 bp, Artificial Sequence
  Synthetic
atacgccatgctgggtctcccgctggcggcgggagatgaacaagacgacgacagaagacgtgcactggctgacgaagtggtcagatggcaacgaacagggctaattgacgagctagaaaacgtacttgggagtcggccat

SEQ ID NO: 8648 - DNA, 140 bp, Artificial Sequence
  Synthetic
atggccgactcccaagtacgttttctagctcgtcaattagccctgttcgttgccatctgaccacttcgtcagccagtgcacgtcttctgtcgtcgtcttgttcatctcccgccgccagcgggagacccagcatggcgtat

SEQ ID NO: 8649 - DNA, 140 bp, Artificial Sequence
  Synthetic
atacgccatgctgggtctcccgctggcggcgggagatgaacaagacgacgacagaagacgtggactggctgacgaagtggtcagatggcaacgaacagggctaattgacgagctagaaaacgtacttgggagtcggccat

SEQ ID NO: 8650 - DNA, 140 bp, Artificial Sequence
  Synthetic
atggccgactcccaagtacgttttctagctcgtcaattagccctgttcgttgccatctgaccacttcgtcagccagtccacgtcttctgtcgtcgtcttgttcatctcccgccgccagcgggagacccagcatggcgtat

SEQ ID NO: 8651 - DNA, 140 bp, Artificial Sequence
  Synthetic
aggccctggctgctgatatggacgaagtggtcagatggcaacgaacagggctaattgacgagctagaaaaagcggtacactccaggtatgaagtgcaaggcatatctgtcgtggtaatgtgaccttttgggacagcggtg

SEQ ID NO: 8652 - DNA, 140 bp, Artificial Sequence
  Synthetic
caccgctgtcccaaaaggtcacattaccacgacagatatgccttgcacttcatacctggagtgtaccgctttttctagctcgtcaattagccctgttcgttgccatctgaccacttcgtccatatcagcagccagggcct

SEQ ID NO: 8653 - DNA, 140 bp, Artificial Sequence
  Synthetic
atacgccatgctgggtctcccccatcgtaactctgtacggtggtcctaaataggtacgcactacagctacctatttcgtcagaaaccaatcgcagctacttgcatacctaccagctacaacgtacttgggagtcggccat

SEQ ID NO: 8654 - DNA, 140 bp, Artificial Sequence
  Synthetic
atggccgactcccaagtacgttgtagctggtaggtatgcaagtagctgcgattggtttctgacgaaataggtagctgtagtgcgtacctatttaggaccaccgtacagagttacgatgggggagacccagcatggcgtat

SEQ ID NO: 8655 - DNA, 140 bp, Artificial Sequence
  Synthetic
aggccctggctgctgatatgccctacaggcagcacaggaagatgtccaggtcgaaatcgacgtggaacagcttgaggacagagctggtgcaggaataatagagactccgagaggcgctatgaccttttgggacagcggtg

SEQ ID NO: 8656 - DNA, 140 bp, Artificial Sequence
  Synthetic
caccgctgtcccaaaaggtcatagcgcctctcggagtctctattattcctgcaccagctctgtcctcaagctgttccacgtcgatttcgacctggacatcttcctgtgctgcctgtagggcatatcagcagccagggcct

SEQ ID NO: 8657 - DNA, 140 bp, Artificial Sequence
  Synthetic
atacgccatgctgggtctcctggagttcatcccgacgcaaactttctacaatagaaggtaccaaccccgaccctgggccccacgccctacaattcaagtaattagacctagaccacgtcccgtacttgggagtcggccat

SEQ ID NO: 8658 - DNA, 140 bp, Artificial Sequence
  Synthetic
atggccgactcccaagtacgggacgtggtctaggtctaattacttgaattgtagggcgtggggcccagggtcggggttggtaccttctattgtagaaagtttgcgtcgggatgaactccaggagacccagcatggcgtat

SEQ ID NO: 8659 - DNA, 140 bp, Artificial Sequence
  Synthetic
atacgccatgctgggtctccttggcggagcaagtgaagacgtgtacgcacagcggacgagcagggaggtatgcggtcgaagcgtacgatggccgagtcctagtgccctcaggctatgcaacgtacttgggagtcggccat

SEQ ID NO: 8660 - DNA, 140 bp, Artificial Sequence
  Synthetic
atggccgactcccaagtacgttgcatagcctgagggcactaggactcggccatcgtacgcttcgaccgcatacctccctgctcgtccgctgtgcgtacacgtcttcacttgctccgccaaggagacccagcatggcgtat

SEQ ID NO: 8661 - DNA, 140 bp, Artificial Sequence
  Synthetic
aggccctggctgctgatatggaagcaaccaccacaaaagaagccggctcaaaagaagaagaaaccaggccgtagagagagaatgtgcatgaagattgaaaatgattgcatcttcgaagtcgaccttttgggacagcggtg

SEQ ID NO: 8662 - DNA, 140 bp, Artificial Sequence
  Synthetic
caccgctgtcccaaaaggtcgacttcgaagatgcaatcattttcaatcttcatgcacattctctctctacggcctggtttcttcttcttttgagccggcttcttttgtggtggttgcttccatatcagcagccagggcct

SEQ ID NO: 8663 - DNA, 140 bp, Artificial Sequence
  Synthetic
aggccctggctgctgatatgacaaaactgcagtcataggagtcttcggggtaccaggatctggcaagtcagccattatcaagaacctagttaccaggcaagacctggtgactagcggaaagaccttttgggacagcggtg

SEQ ID NO: 8664 - DNA, 140 bp, Artificial Sequence
  Synthetic
caccgctgtcccaaaaggtctttccgctagtcaccaggtcttgcctggtaactaggttcttgataatggctgacttgccagatcctggtaccccgaagactcctatgactgcagttttgtcatatcagcagccagggcct

SEQ ID NO: 8665 - DNA, 140 bp, Artificial Sequence
  Synthetic
aggccctggctgctgatatggccattatcaagaacctagttaccaggcaagacctggtgactagcggaaagaaagaaaactgccaagaaatcagcaccgacgtgatgagacagagaggtcgaccttttgggacagcggtg

SEQ ID NO: 8666 - DNA, 140 bp, Artificial Sequence
  Synthetic
caccgctgtcccaaaaggtcgacctctctgtctcatcacgtcggtgctgatttcttggcagttttctttctttccgctagtcaccaggtcttgcctggtaactaggttcttgataatggccatatcagcagccagggcct

SEQ ID NO: 8667 - DNA, 140 bp, Artificial Sequence
  Synthetic
atacgccatgctgggtctcctcactatcccgacgggtgcaggcaagccgggagacagcggcagaccgatcttcgacaacaaaggacgagtggtggccatcgtcctaggaggggccaacgacgtacttgggagtcggccat

SEQ ID NO: 8668 - DNA, 140 bp, Artificial Sequence
  Synthetic
atggccgactcccaagtacgtcgttggcccctcctaggacgatggccaccactcgtcctttgttgtcgaagatcggtctgccgctgtctcccggcttgcctgcacccgtcgggatagtgaggagacccagcatggcgtat

SEQ ID NO: 8669 - DNA, 140 bp, Artificial Sequence
  Synthetic
aggccctggctgctgatatgaacgttacttgctttgatcgccttggtgagaccaagacagaaagttgtactttgtggtgacccgaagcagtgcggcttcttcaatatgatgcagatgaaagaccttttgggacagcggtg

SEQ ID NO: 8670 - DNA, 140 bp, Artificial Sequence
  Synthetic
caccgctgtcccaaaaggtctttcatctgcatcatattgaagaagccgcactgcttcgggtcaccacaaagtacaactttctgtcttggtctcaccaaggcgatcaaagcaagtaacgttcatatcagcagccagggcct

SEQ ID NO: 8671 - DNA, 140 bp, Artificial Sequence
  Synthetic
atacgccatgctgggtctcccacacccgttccatcatgaaccacctgtgataggtagggagaggttccactctcgaccacaacatggtaaagagttaccttgcagcacgtacgtgcagagcgtacttgggagtcggccat

SEQ ID NO: 8672 - DNA, 140 bp, Artificial Sequence
  Synthetic
atggccgactcccaagtacgctctgcacgtacgtgctgcaaggtaactctttaccatgttgtggtcgagagtggaacctctccctacctatcacaggtggttcatgatggaacgggtgtgggagacccagcatggcgtat

SEQ ID NO: 8673 - DNA, 140 bp, Artificial Sequence
  Synthetic
aggccctggctgctgatatgactgacaaccacagacaaagtgatcaataactgcaaaattgatcagtgccatgttgcagtcactaatcacaagaagtggcaatacaactcccctctagtcgaccttttgggacagcggtg

SEQ ID NO: 8674 - DNA, 140 bp, Artificial Sequence
  Synthetic
caccgctgtcccaaaaggtcgactagaggggagttgtattgccacttcttgtgattagtgactgcaacatggcactgatcaattttgcagttattgatcactttgtctgtggttgtcagtcatatcagcagccagggcct

SEQ ID NO: 8675 - DNA, 140 bp, Artificial Sequence
  Synthetic
atacgccatgctgggtctcccaaccctgaggcagcgtccattctagaaagaaagtacccatttacaaaaggaaagtggaacatcaacaagcagatctgcgtgaccaccaggaggatagaacgtacttgggagtcggccat

SEQ ID NO: 8676 - DNA, 140 bp, Artificial Sequence
  Synthetic
atggccgactcccaagtacgttctatcctcctggtggtcacgcagatctgcttgttgatgttccactttccttttgtaaatgggtactttctttctagaatggacgctgcctcagggttgggagacccagcatggcgtat

SEQ ID NO: 8677 - DNA, 140 bp, Artificial Sequence
  Synthetic
aggccctggctgctgatatgcccattggcaaacgtgacttgcagagtaccaaaagcaagaaaccccacagtaacgtacgggaaaaaccaagtcaccatgctgctgtatcctgaccatccggaccttttgggacagcggtg

SEQ ID NO: 8678 - DNA, 140 bp, Artificial Sequence
  Synthetic
caccgctgtcccaaaaggtccggatggtcaggatacagcagcatggtgacttggtttttcccgtacgttactgtggggtttcttgcttttggtactctgcaagtcacgtttgccaatgggcatatcagcagccagggcct

SEQ ID NO: 8679 - DNA, 140 bp, Artificial Sequence
  Synthetic
atacgccatgctgggtctcccggagcggactatacatacaacttagagctgggtctaccagcaacacttggtaggtatgacctagtggtcataaacatccacacaccttttcgcatacaccgtacttgggagtcggccat

SEQ ID NO: 8680 - DNA, 140 bp, Artificial Sequence
  Synthetic
atggccgactcccaagtacggtgtatgcgaaaaggtgtgtggatgtttatgaccactaggtcatacctaccaagtgttgctggtagacccagctctaagttgtatgtatagtccgctccgggagacccagcatggcgtat

SEQ ID NO: 8681 - DNA, 140 bp, Artificial Sequence
  Synthetic
atacgccatgctgggtctccttatgagctgtaccccactatgactgtaatcattgtgtcggtggcctcgttcgtgcttctgtcgatggtgggcacggcagtgggaatgtgtgtgtgcgcacgtacttgggagtcggccat

SEQ ID NO: 8682 - DNA, 140 bp, Artificial Sequence
  Synthetic
atggccgactcccaagtacgtgcgcacacacacattcccactgccgtgcccaccatcgacagaagcacgaacgaggccaccgacacaatgattacagtcatagtggggtacagctcataaggagacccagcatggcgtat

SEQ ID NO: 8683 - DNA, 140 bp, Artificial Sequence
  Synthetic
aggccctggctgctgatatgacccgagcaggatgtgcaccatcgtaccgggtaaaacgcatggacatcgcgaagaacgatgaagagtgcgtggttaacgccgctaaccctcgcgggttacgaccttttgggacagcggtg

SEQ ID NO: 8684 - DNA, 140 bp, Artificial Sequence
  Synthetic
caccgctgtcccaaaaggtcgtaacccgcgagggttagcggcgttaaccacgcactcttcatcgttcttcgcgatgtccatgcgttttacccggtacgatggtgcacatcctgctcgggtcatatcagcagccagggcct

SEQ ID NO: 8685 - DNA, 140 bp, Artificial Sequence
  Synthetic
atacgccatgctgggtctccccccatggtattggagatggagctacaatcagtcaccttggaaccaacactatcacttgactacatcacgtgcgagtacaaaactgtcatcccctccccgcgtacttgggagtcggccat

SEQ ID NO: 8686 - DNA, 140 bp, Artificial Sequence
  Synthetic
atggccgactcccaagtacgcggggaggggatgacagttttgtactcgcacgtgatgtagtcaagtgatagtgttggttccaaggtgactgattgtagctccatctccaataccatggggggagacccagcatggcgtat

SEQ ID NO: 8687 - DNA, 140 bp, Artificial Sequence
  Synthetic
atacgccatgctgggtctccgtatccagtaatccacgctgcaggaccaaacttctcaaattattcggagtctgaaggggaccgggaattggcggctgcctatcgagaagtcgcaaaggaacgtacttgggagtcggccat

SEQ ID NO: 8688 - DNA, 140 bp, Artificial Sequence
  Synthetic
atggccgactcccaagtacgttcctttgcgacttctcgataggcagccgccaattcccggtccccttcagactccgaataatttgagaagtttggtcctgcagcgtggattactggatacggagacccagcatggcgtat

SEQ ID NO: 8689 - DNA, 140 bp, Artificial Sequence
  Synthetic
atacgccatgctgggtctcctacgtgaagtgctgcggtacagcagagtgcaaggacaagagcttaccagactacagttgcaaggtctttactggagtctacccatttatgtggggcggcgcgtacttgggagtcggccat

SEQ ID NO: 8690 - DNA, 140 bp, Artificial Sequence
  Synthetic
atggccgactcccaagtacgcgccgccccacataaatgggtagactccagtaaagaccttgcaactgtagtctggtaagctcttgtccttgcactctgctgtaccgcagcacttcacgtaggagacccagcatggcgtat

SEQ ID NO: 8691 - DNA, 140 bp, Artificial Sequence
  Synthetic
aggccctggctgctgatatgctacagttgcaaggtctttactggagtctacccatttatgtggggcggcgcctactgcttttgcgacgccgaaaatacgcaattgagcgaggcacatgtagaccttttgggacagcggtg

SEQ ID NO: 8692 - DNA, 140 bp, Artificial Sequence
  Synthetic
caccgctgtcccaaaaggtctacatgtgcctcgctcaattgcgtattttcggcgtcgcaaaagcagtaggcgccgccccacataaatgggtagactccagtaaagaccttgcaactgtagcatatcagcagccagggcct

SEQ ID NO: 8693 - DNA, 140 bp, Artificial Sequence
  Synthetic
atacgccatgctgggtctccgagaaatccgaatcttgcaaaacagagtttgcatcggcctacagagctcacaccgcatcggcgtcggcgaagctccgcgtcctttaccaaggaaacaacacgtacttgggagtcggccat

SEQ ID NO: 8694 - DNA, 140 bp, Artificial Sequence
  Synthetic
atggccgactcccaagtacgtgttgtttccttggtaaaggacgcggagcttcgccgacgccgatgcggtgtgagctctgtaggccgatgcaaactctgttttgcaagattcggatttctcggagacccagcatggcgtat

SEQ ID NO: 8695 - DNA, 140 bp, Artificial Sequence
  Synthetic
aggccctggctgctgatatgtgtatactcaggagggaaagacaggctaacccagtcactgaaccacctctttacagccatggactcgacggatgcagacgtggtcatctactgccgcgacgaccttttgggacagcggtg

SEQ ID NO: 8696 - DNA, 140 bp, Artificial Sequence
  Synthetic
caccgctgtcccaaaaggtcgtcgcggcagtagatgaccacgtctgcatccgtcgagtccatggctgtaaagaggtggttcagtgactgggttagcctgtctttccctcctgagtatacacatatcagcagccagggcct

SEQ ID NO: 8697 - DNA, 140 bp, Artificial Sequence
  Synthetic
aggccctggctgctgatatgaaggaatgggagaagaaaatatctgaggccatacagatgcggacccaagtggagctgctggatgagcacatctccatagattgcgatgtcattcgcgtgcgaccttttgggacagcggtg

SEQ ID NO: 8698 - DNA, 140 bp, Artificial Sequence
  Synthetic
caccgctgtcccaaaaggtcgcacgcgaatgacatcgcaatctatggagatgtgctcatccagcagctccacttgggtccgcatctgtatggcctcagatattttcttctcccattccttcatatcagcagccagggcct

SEQ ID NO: 8699 - DNA, 140 bp, Artificial Sequence
  Synthetic
atacgccatgctgggtctccttaccgtagctgcctacgccaacggcgatcatgccgtcacagtaaaggacgctaagtttgtcgtgggaccaatgtcctccgcctggacaccttttgacaacgtacttgggagtcggccat

SEQ ID NO: 8700 - DNA, 140 bp, Artificial Sequence
  Synthetic
atggccgactcccaagtacgttgtcaaaaggtgtccaggcggaggacattggtcccacgacaaacttagcgtcctttactgtgacggcatgatcgccgttggcgtaggcagctacggtaaggagacccagcatggcgtat

SEQ ID NO: 8701 - DNA, 140 bp, Artificial Sequence
  Synthetic
atacgccatgctgggtctcccataccaatttccatcgacataccggatgcggcctttactagggttgtcgatgcaccctctgtgacggacatgtcatgcgaagtaccagcctgcactcaccgtacttgggagtcggccat

SEQ ID NO: 8702 - DNA, 140 bp, Artificial Sequence
  Synthetic
atggccgactcccaagtacggtgagtgcaggctggtacttcgcatgacatgtccgtcacagagggtgcatcgacaaccctagtaaaggccgcatccggtatgtcgatggaaattggtatgggagacccagcatggcgtat

SEQ ID NO: 8703 - DNA, 140 bp, Artificial Sequence
  Synthetic
aggccctggctgctgatatgcagcaccaaggacaacttcaatgtctataaagccacaagaccatacttagctcactgtcccgactgtggagaagggcactcgtgccatagtcccgtagcagaccttttgggacagcggtg

SEQ ID NO: 8704 - DNA, 140 bp, Artificial Sequence
  Synthetic
caccgctgtcccaaaaggtctgctacgggactatggcacgagtgcccttctccacagtcgggacagtgagctaagtatggtcttgtggctttatagacattgaagttgtccttggtgctgcatatcagcagccagggcct

SEQ ID NO: 8705 - DNA, 140 bp, Artificial Sequence
  Synthetic
aggccctggctgctgatatgccgacgtagaagtagaggggaactcccagctgcaaatatccttctcaacagccttggcaagcgccgagtttcgtgtgcaagtgtgctccacacaagtacagaccttttgggacagcggtg

SEQ ID NO: 8706 - DNA, 140 bp, Artificial Sequence
  Synthetic
caccgctgtcccaaaaggtctgtacttgtgtggagcacacttgcacacgaaactcggcgcttgccaaggctgttgagaaggatatttgcagctgggagttcccctctacttctacgtcggcatatcagcagccagggcct

SEQ ID NO: 8707 - DNA, 140 bp, Artificial Sequence
  Synthetic
atacgccatgctgggtctcctaccaaccacaatcggaaaccttgcggccgtgtctgactgggtaatgagcaccgtacctgtcgcgccgcctagaagaaggagagggagaaacctgactgtcgtacttgggagtcggccat

SEQ ID NO: 8708 - DNA, 140 bp, Artificial Sequence
  Synthetic
atggccgactcccaagtacgacagtcaggtttctccctctccttcttctaggcggcgcgacaggtacggtgctcattacccagtcagacacggccgcaaggtttccgattgtggttggtaggagacccagcatggcgtat

SEQ ID NO: 8709 - DNA, 140 bp, Artificial Sequence
  Synthetic
atacgccatgctgggtctccctgcgcagccgcatgccaccctccaaaggaccacatagtcaactacccagcatcacacaccacccttggggtccaggatatatccacaacggcaatgtctcgtacttgggagtcggccat

SEQ ID NO: 8710 - DNA, 140 bp, Artificial Sequence
  Synthetic
atggccgactcccaagtacgagacattgccgttgtggatatatcctggaccccaagggtggtgtgtgatgctgggtagttgactatgtggtcctttggagggtggcatgcggctgcgcagggagacccagcatggcgtat

SEQ ID NO: 8711 - DNA, 140 bp, Artificial Sequence
  Synthetic
atacgccatgctgggtctcctgggtgcagaggattacgggaggagtagggttaattgttgctgttgctgccttaattttaattgtggtgctatgcgtgtcgtttagcagacactaaaccgcgtacttgggagtcggccat

SEQ ID NO: 8712 - DNA, 140 bp, Artificial Sequence
  Synthetic
atggccgactcccaagtacgcggtttagtgtctgctaaacgacacgcatagcaccacaattaaaattaaggcagcaacagcaacaattaaccctactcctcccgtaatcctctgcacccaggagacccagcatggcgtat

SEQ ID NO: 8713 - DNA, 140 bp, Artificial Sequence
  Synthetic
atacgccatgctgggtctcctctttagagcagagctgtgtccagccgtacaagaaacagcggagacgcgtgacacagctatttcccttcaggcaccgccaagtaccactatggaactgagcgtacttgggagtcggccat

SEQ ID NO: 8714 - DNA, 140 bp, Artificial Sequence
  Synthetic
atggccgactcccaagtacgctcagttccatagtggtacttggcggtgcctgaagggaaatagctgtgtcacgcgtctccgctgtttcttgtacggctggacacagctctgctctaaagaggagacccagcatggcgtat

SEQ ID NO: 8715 - DNA, 140 bp, Artificial Sequence
  Synthetic
aggccctggctgctgatatgcttaattttaattgtggtgctatgcgtgtcgtttagcagacactaaaccgatgacaaggcacgaaataactaaatagtaaaaatagaaagtacataaccagaccttttgggacagcggtg

SEQ ID NO: 8716 - DNA, 140 bp, Artificial Sequence
  Synthetic
caccgctgtcccaaaaggtctggttatgtactttctatttttactatttagttatttcgtgccttgtcatcggtttagtgtctgctaaacgacacgcatagcaccacaattaaaattaagcatatcagcagccagggcct

SEQ ID NO: 8717 - DNA, 140 bp, Artificial Sequence
  Synthetic
atacgccatgctgggtctccgacacattgtatgtaggtagtaagtatagatcaaagggctatattaacccctgaatagtaacaaaacataaaaataataaaaactacaaaatagaaaatccgtacttgggagtcggccat

SEQ ID NO: 8718 - DNA, 140 bp, Artificial Sequence
  Synthetic
atggccgactcccaagtacggattttctattttgtagtttttattatttttatgttttgttactattcaggggttaatatagccctttgatctatacttactacctacatacaatgtgtcggagacccagcatggcgtat

SEQ ID NO: 8719 - DNA, 140 bp, Artificial Sequence
  Synthetic
aggccctggctgctgatatgctgaatagtaacaaaacataaaaataataaaaactacaaaatagaaaatctataaacaaaaagtagttcaaagggctacaaaacccctgaatagtaacaagaccttttgggacagcggtg

SEQ ID NO: 8720 - DNA, 140 bp, Artificial Sequence
  Synthetic
caccgctgtcccaaaaggtcttgttactattcaggggttttgtagccctttgaactactttttgtttatagattttctattttgtagtttttattatttttatgttttgttactattcagcatatcagcagccagggcct

SEQ ID NO: 8721 - DNA, 140 bp, Artificial Sequence
  Synthetic
aggccctggctgctgatatgggagaagtgttacccacctaagctggatgaattaaaggagcaactactacttaagaaactccaggagagtgcgtccatggccaatagaagcaggtatcaggaccttttgggacagcggtg

SEQ ID NO: 8722 - DNA, 140 bp, Artificial Sequence
  Synthetic
caccgctgtcccaaaaggtcctgatacctgcttctattggccatggacgcactctcctggagtttcttaagtagtagttgctcctttaattcatccagcttaggtgggtaacacttctcccatatcagcagccagggcct

SEQ ID NO: 8723 - DNA, 140 bp, Artificial Sequence
  Synthetic
aggccctggctgctgatatggcacgattactggaacaatgggacacttcattctggcccgatgtccgaaaggagaaactctgacggcggggttcactgacggtaggaagatcagtcactcgaccttttgggacagcggtg

SEQ ID NO: 8724 - DNA, 140 bp, Artificial Sequence
  Synthetic
caccgctgtcccaaaaggtcgagtgactgatcttcctaccgtcagtgaaccccgccgtcagagtttctcctttcggacatcgggccagaatgaagtgtcccattgttccagtaatcgtgccatatcagcagccagggcct

SEQ ID NO: 8725 - DNA, 140 bp, Artificial Sequence
  Synthetic
aggccctggctgctgatatgtatcagaagcgctgtaccttccccattccagaacacactacagaatgtactggcagcagccacgaaaaggaactgcaacgtcacacagatgagggaattagaccttttgggacagcggtg

SEQ ID NO: 8726 - DNA, 140 bp, Artificial Sequence
  Synthetic
caccgctgtcccaaaaggtctaattccctcatctgtgtgacgttgcagttccttttcgtggctgctgccagtacattctgtagtgtgttctggaatggggaaggtacagcgcttctgatacatatcagcagccagggcct

SEQ ID NO: 8727 - DNA, 140 bp, Artificial Sequence
  Synthetic
atacgccatgctgggtctccgacagagagcagacgtcgctatataccaagacgtctatgctgtatacgcacccacgtcgctataccaccaggcgattaaaggggtccgagtggcgtactgcgtacttgggagtcggccat

SEQ ID NO: 8728 - DNA, 140 bp, Artificial Sequence
  Synthetic
atggccgactcccaagtacgcagtacgccactcggacccctttaatcgcctggtggtatagcgacgtgggtgcgtatacagcatagacgtcttggtatatagcgacgtctgctctctgtcggagacccagcatggcgtat

SEQ ID NO: 8729 - DNA, 140 bp, Artificial Sequence
  Synthetic
aggccctggctgctgatatggaacccttggcaacagcgtacctatgtggaattcacagagagctggttaggagattgaacgccgttctcctacccaatgtacatacactatttgacatgtgaccttttgggacagcggtg

SEQ ID NO: 8730 - DNA, 140 bp, Artificial Sequence
  Synthetic
caccgctgtcccaaaaggtcacatgtcaaatagtgtatgtacattgggtaggagaacggcgttcaatctcctaaccagctctctgtgaattccacataggtacgctgttgccaagggttccatatcagcagccagggcct

SEQ ID NO: 8731 - DNA, 140 bp, Artificial Sequence
  Synthetic
aggccctggctgctgatatgaggacaggtcacccgagcaggatgtgcaccgtcgtaccgggtaaaacgcatggacatcgcgaaaaacgatgaaaagtgcgtagtcaacgccgctaaccctgaccttttgggacagcggtg

SEQ ID NO: 8732 - DNA, 140 bp, Artificial Sequence
  Synthetic
caccgctgtcccaaaaggtcagggttagcggcgttgactacgcacttttcatcgtttttcgcgatgtccatgcgttttacccggtacgacggtgcacatcctgctcgggtgacctgtcctcatatcagcagccagggcct

SEQ ID NO: 8733 - DNA, 140 bp, Artificial Sequence
  Synthetic
atacgccatgctgggtctccacttgcgcttaccgccttaatgctgttagaagatttgggagtggatcactccctgttggacttgatagaggctgctttcggagagatttccagctgtcatcgtacttgggagtcggccat

SEQ ID NO: 8734 - DNA, 140 bp, Artificial Sequence
  Synthetic
atggccgactcccaagtacgatgacagctggaaatctctccgaaagcagcctctatcaagtccaacagggagtgatccactcccaaatcttctaacagcattaaggcggtaagcgcaagtggagacccagcatggcgtat

SEQ ID NO: 8735 - DNA, 140 bp, Artificial Sequence
  Synthetic
atacgccatgctgggtctccctgccgacaggtacgcgcttcaagttcggcgctatgatgaaatccggtatgttcctaactctgttcgtcaacacattgttaaacatcaccatcgctagcccgtacttgggagtcggccat

SEQ ID NO: 8736 - DNA, 140 bp, Artificial Sequence
  Synthetic
atggccgactcccaagtacgggctagcgatggtgatgtttaacaatgtgttgacgaacagagttaggaacataccggatttcatcatagcgccgaacttgaagcgcgtacctgtcggcagggagacccagcatggcgtat

SEQ ID NO: 8737 - DNA, 140 bp, Artificial Sequence
  Synthetic
aggccctggctgctgatatggacgacaacataatacatggtgtcgtctccgatgaattgatggcagccagatgcgctacttggatgaacatggaagtgaagatcatagatgcagttgtatgaccttttgggacagcggtg

SEQ ID NO: 8738 - DNA, 140 bp, Artificial Sequence
  Synthetic
caccgctgtcccaaaaggtcatacaactgcatctatgatcttcacttccatgttcatccaagtagcgcatctggctgccatcaattcatcggagacgacaccatgtattatgttgtcgtccatatcagcagccagggcct

SEQ ID NO: 8739 - DNA, 140 bp, Artificial Sequence
  Synthetic
aggccctggctgctgatatgacaggaacagcttgcagagtggcggacccgctaaaaaggttatttaaactgggcaaaccgttagcggcaggtgacgaacaagatgaagatagaagacggggaccttttgggacagcggtg

SEQ ID NO: 8740 - DNA, 140 bp, Artificial Sequence
  Synthetic
caccgctgtcccaaaaggtccccgtcttctatcttcatcttgttcgtcacctgccgctaacggtttgcccagtttaaataacctttttagcgggtccgccactctgcaagctgttcctgtcatatcagcagccagggcct

SEQ ID NO: 8741 - DNA, 140 bp, Artificial Sequence
  Synthetic
aggccctggctgctgatatggtcttgccatcccagttatgtgcctgttggcaaacaccacgttcccctgctcccagcccccttgcacgccctgctgctacgagaaggaaccggaggaaacgaccttttgggacagcggtg

SEQ ID NO: 8742 - DNA, 140 bp, Artificial Sequence
  Synthetic
caccgctgtcccaaaaggtcgtttcctccggttccttctcgtagcagcagggcgtgcaagggggctgggagcaggggaacgtggtgtttgccaacaggcacataactgggatggcaagaccatatcagcagccagggcct

SEQ ID NO: 8743 - DNA, 140 bp, Artificial Sequence
  Synthetic
aggccctggctgctgatatgcgctggctgatgaagtaatcagatggcaacgaacagggctaatagatgagctggagaaagcggtgtactctaggtacgaagtgcagggtatatcagttgcgaccttttgggacagcggtg

SEQ ID NO: 8744 - DNA, 140 bp, Artificial Sequence
  Synthetic
caccgctgtcccaaaaggtcgcaactgatataccctgcacttcgtacctagagtacaccgctttctccagctcatctattagccctgttcgttgccatctgattacttcatcagccagcgcatatcagcagccagggcct

SEQ ID NO: 8745 - DNA, 140 bp, Artificial Sequence
  Synthetic
atacgccatgctgggtctcccctacgcatgcttgaggacaacgtcatgagacctgggtactatcagctgctacaagcatctttaacatgttctccccaccgccagcgacgcagcaccaagcgtacttgggagtcggccat

SEQ ID NO: 8746 - DNA, 140 bp, Artificial Sequence
  Synthetic
atggccgactcccaagtacgcttggtgctgcgtcgctggcggtggggagaacatgttaaagatgcttgtagcagctgatagtacccaggtctcatgacgttgtcctcaagcatgcgtaggggagacccagcatggcgtat

SEQ ID NO: 8747 - DNA, 140 bp, Artificial Sequence
  Synthetic
aggccctggctgctgatatggcagatacccgtgcacatgaagtccgacgcttcgaagttcacccatgagaaaccggaggggtactacaactggcaccacggagcagtacagtactcaggagaccttttgggacagcggtg

SEQ ID NO: 8748 - DNA, 140 bp, Artificial Sequence
  Synthetic
caccgctgtcccaaaaggtctcctgagtactgtactgctccgtggtgccagttgtagtacccctccggtttctcatgggtgaacttcgaagcgtcggacttcatgtgcacgggtatctgccatatcagcagccagggcct

SEQ ID NO: 8749 - DNA, 140 bp, Artificial Sequence
  Synthetic
atacgccatgctgggtctcccccgcgtaatgctgaacttggggatcgacaaggaaaaattcacatcccgtttccgctggcaaatgtaacatgcagggtgcctaaagcaaggatccccacccgtacttgggagtcggccat

SEQ ID NO: 8750 - DNA, 140 bp, Artificial Sequence
  Synthetic
atggccgactcccaagtacgggtggggatccttgctttaggcaccctgcatgttacatttgccagcggaaacgggatgtgaatttttccttgtcgatccccaagttcagcattacgcgggggagacccagcatggcgtat

SEQ ID NO: 8751 - DNA, 140 bp, Artificial Sequence
  Synthetic
aggccctggctgctgatatgaccgatcttcgacaacaaggggcgcgtggtggccatagttttaggaggagctaatgaaggagcccgtacagccctctcggtggtgacctggaacaaagacgaccttttgggacagcggtg

SEQ ID NO: 8752 - DNA, 140 bp, Artificial Sequence
  Synthetic
caccgctgtcccaaaaggtcgtctttgttccaggtcaccaccgagagggctgtacgggctccttcattagctcctcctaaaactatggccaccacgcgccccttgttgtcgaagatcggtcatatcagcagccagggcct

SEQ ID NO: 8753 - DNA, 140 bp, Artificial Sequence
  Synthetic
atacgccatgctgggtctcctagcctaccagtttcttactgctctactctgcttagcaagagacttgagaacccatcatggatcccgtgtacgtggacatagacgccgacagcgccttttcgtacttgggagtcggccat

SEQ ID NO: 8754 - DNA, 140 bp, Artificial Sequence
  Synthetic
atggccgactcccaagtacgaaaaggcgctgtcggcgtctatgtccacgtacacgggatccatgatgggttctcaagtctcttgctaagcagagtagagcagtaagaaactggtaggctaggagacccagcatggcgtat

SEQ ID NO: 8755 - DNA, 140 bp, Artificial Sequence
  Synthetic
atacgccatgctgggtctccgcagcgcgccagcaaggaggatgatgtcggataggaagtaccactgcgtttgcccaatgcgcagcgcagaagaccctgagagactcgccaactacgcgagcgtacttgggagtcggccat

SEQ ID NO: 8756 - DNA, 140 bp, Artificial Sequence
  Synthetic
atggccgactcccaagtacgctcgcgtagttggcgagtctctcagggtcttctgcgctgcgcattgggcaaacgcagtggtacttcctatccgacatcatcctccttgctggcgcgctgcggagacccagcatggcgtat

SEQ ID NO: 8757 - DNA, 140 bp, Artificial Sequence
  Synthetic
atacgccatgctgggtctccaaatcggagatctacaagcagtaatggctgtaccagacgcagaaacgcccacattctgcttgcacactgacgtctcatgtagacaaagggcggacgtcgccgtacttgggagtcggccat

SEQ ID NO: 8758 - DNA, 140 bp, Artificial Sequence
  Synthetic
atggccgactcccaagtacggcgacgtccgccctttgtctacatgagacgtcagtgtgcaagcagaatgtgggcgtttctgcgtctggtacagccattactgcttgtagatctccgatttggagacccagcatggcgtat

SEQ ID NO: 8759 - DNA, 140 bp, Artificial Sequence
  Synthetic
aggccctggctgctgatatgacattctgcttgcacactgacgtctcatgtagacaaagggcggacgtcgctatataccaggacgtctacgccgtgcatgcaccaacatcgctataccaccgaccttttgggacagcggtg

SEQ ID NO: 8760 - DNA, 140 bp, Artificial Sequence
  Synthetic
caccgctgtcccaaaaggtcggtggtatagcgatgttggtgcatgcacggcgtagacgtcctggtatatagcgacgtccgccctttgtctacatgagacgtcagtgtgcaagcagaatgtcatatcagcagccagggcct

SEQ ID NO: 8761 - DNA, 140 bp, Artificial Sequence
  Synthetic
atacgccatgctgggtctccatgccagcagacgcagagagggctgggctacttgtaagaacgtcagcaccgtgcacgattactggaacaatgggacacttcatcctggcccgttgtccgacgtacttgggagtcggccat

SEQ ID NO: 8762 - DNA, 140 bp, Artificial Sequence
  Synthetic
atggccgactcccaagtacgtcggacaacgggccaggatgaagtgtcccattgttccagtaatcgtgcacggtgctgacgttcttacaagtagcccagccctctctgcgtctgctggcatggagacccagcatggcgtat

SEQ ID NO: 8763 - DNA, 140 bp, Artificial Sequence
  Synthetic
aggccctggctgctgatatgagcgacagacgggacgctgaaaatccaggtttccttgcaaatcggaataaagacggatgatagccatgattggaccaagctgcgttacatggacaatcacgaccttttgggacagcggtg

SEQ ID NO: 8764 - DNA, 140 bp, Artificial Sequence
  Synthetic
caccgctgtcccaaaaggtcgtgattgtccatgtaacgcagcttggtccaatcatggctatcatccgtctttattccgatttgcaaggaaacctggattttcagcgtcccgtctgtcgctcatatcagcagccagggcct

SEQ ID NO: 8765 - DNA, 140 bp, Artificial Sequence
  Synthetic
atacgccatgctgggtctccaaggagaaactctgacggtgggattcactgacggtaggaagatcagtcactcatgtacgcacccatttcaccacgaccctcctgtgataggccgggaaaacgtacttgggagtcggccat

SEQ ID NO: 8766 - DNA, 140 bp, Artificial Sequence
  Synthetic
atggccgactcccaagtacgttttcccggcctatcacaggagggtcgtggtgaaatgggtgcgtacatgagtgactgatcttcctaccgtcagtgaatcccaccgtcagagtttctccttggagacccagcatggcgtat

SEQ ID NO: 8767 - DNA, 140 bp, Artificial Sequence
  Synthetic
atacgccatgctgggtctcccagacctgacggaaggtagacgaggtaaattgtctatcatgagaggaaaaaagatggagccatgtgaccgcgtactgttctcagtcgggtcaacgctttacgtacttgggagtcggccat

SEQ ID NO: 8768 - DNA, 140 bp, Artificial Sequence
  Synthetic
atggccgactcccaagtacgtaaagcgttgacccgactgagaacagtacgcggtcacatggctccatcttttttcctctcatgatagacaatttacctcgtctaccttccgtcaggtctgggagacccagcatggcgtat

SEQ ID NO: 8769 - DNA, 140 bp, Artificial Sequence
  Synthetic
aggccctggctgctgatatggacacccctgatcgcacattaatgtcacaacagtccggcaatgtaaagatcacagtcaatggccagacggtgcggtacaagtgtaattgcggtgactcaagaccttttgggacagcggtg

SEQ ID NO: 8770 - DNA, 140 bp, Artificial Sequence
  Synthetic
caccgctgtcccaaaaggtcttgagtcaccgcaattacacttgtaccgcaccgtctggccattgactgtgatctttacattgccggactgttgtgacattaatgtgcgatcaggggtgtccatatcagcagccagggcct

SEQ ID NO: 8771 - DNA, 140 bp, Artificial Sequence
  Synthetic
atacgccatgctgggtctcccccggagagccgtaagcttcttaagagttggcacttaccctcagtgttccatctaaaagggaagctcagcttcacgtgccgctgtgatacagtggtttcgcgtacttgggagtcggccat

SEQ ID NO: 8772 - DNA, 140 bp, Artificial Sequence
  Synthetic
atggccgactcccaagtacgcgaaaccactgtatcacagcggcacgtgaagctgagcttcccttttagatggaacactgagggtaagtgccaactcttaagaagcttacggctctccgggggagacccagcatggcgtat

SEQ ID NO: 8773 - DNA, 140 bp, Artificial Sequence
  Synthetic
atacgccatgctgggtctcctaaaaccacagggtacgcagtaacccaccatgcagacggattcctaatgtgcaaaacaaccgatacggtagacggcgagagagtgtcattttcggtatgccgtacttgggagtcggccat

SEQ ID NO: 8774 - DNA, 140 bp, Artificial Sequence
  Synthetic
atggccgactcccaagtacggcataccgaaaatgacactctctcgccgtctaccgtatcggttgttttgcacattaggaatccgtctgcatggtgggttactgcgtaccctgtggttttaggagacccagcatggcgtat

SEQ ID NO: 8775 - DNA, 140 bp, Artificial Sequence
  Synthetic
aggccctggctgctgatatggcaaaacaaccgatacggtagacggcgagagagtgtcattttcggtatgcacgtacgtacctgcaaccatttgtgatcaaatgacaggtattcttgccacgaccttttgggacagcggtg

SEQ ID NO: 8776 - DNA, 140 bp, Artificial Sequence
  Synthetic
caccgctgtcccaaaaggtcgtggcaagaatacctgtcatttgatcacaaatggttgcaggtacgtacgtgcataccgaaaatgacactctctcgccgtctaccgtatcggttgttttgccatatcagcagccagggcct

SEQ ID NO: 8777 - DNA, 140 bp, Artificial Sequence
  Synthetic
aggccctggctgctgatatgccacccaacgctcctgtcctaccggaatatgggagaagaaccaaactatcaagaagagtgggtgacgcataagaaggaagtcaggttaaccgtgccgactgaccttttgggacagcggtg

SEQ ID NO: 8778 - DNA, 140 bp, Artificial Sequence
  Synthetic
caccgctgtcccaaaaggtcagtcggcacggttaacctgacttccttcttatgcgtcacccactcttcttgatagtttggttcttctcccatattccggtaggacaggagcgttgggtggcatatcagcagccagggcct

SEQ ID NO: 8779 - DNA, 140 bp, Artificial Sequence
  Synthetic
atacgccatgctgggtctcctgacatgctgctgcctttgggcgttcaagaagcagaagacacacacggtctacaagaggcctgacactcagtcaattcagaaagtcccagccgaatttgacgtacttgggagtcggccat

SEQ ID NO: 8780 - DNA, 140 bp, Artificial Sequence
  Synthetic
atggccgactcccaagtacgtcaaattcggctgggactttctgaattgactgagtgtcaggcctcttgtagaccgtgtgtgtcttctgcttcttgaacgcccaaaggcagcagcatgtcaggagacccagcatggcgtat

SEQ ID NO: 8781 - DNA, 140 bp, Artificial Sequence
  Synthetic
aggccctggctgctgatatgtgtattattatgagctgtaccctactatgactgtggtagttgtgtcagtggcctcgttcgtactcctgtcgatggtgggtgtggcagtggggatgtgcatgaccttttgggacagcggtg

SEQ ID NO: 8782 - DNA, 140 bp, Artificial Sequence
  Synthetic
caccgctgtcccaaaaggtcatgcacatccccactgccacacccaccatcgacaggagtacgaacgaggccactgacacaactaccacagtcatagtagggtacagctcataataatacacatatcagcagccagggcct

SEQ ID NO: 8783 - DNA, 140 bp, Artificial Sequence
  Synthetic
aggccctggctgctgatatgagaccgtgttacgaagccagaagctcagcctgatccacgcattggcggaacaagtgaagacatgcacacacagcggacgagcaggaaggtacgcggtcgagaccttttgggacagcggtg

SEQ ID NO: 8784 - DNA, 140 bp, Artificial Sequence
  Synthetic
caccgctgtcccaaaaggtctcgaccgcgtaccttcctgctcgtccgctgtgtgtgcatgtcttcacttgttccgccaatgcgtggatcaggctgagcttctggcttcgtaacacggtctcatatcagcagccagggcct

SEQ ID NO: 8785 - DNA, 140 bp, Artificial Sequence
  Synthetic
aggccctggctgctgatatggatcccgaacacggtgggagtaccgtataagactctagtcaatagaccgggctacagccccatggtactggagatggagcttctgtcagtcactttggaggaccttttgggacagcggtg

SEQ ID NO: 8786 - DNA, 140 bp, Artificial Sequence
  Synthetic
caccgctgtcccaaaaggtcctccaaagtgactgacagaagctccatctccagtaccatggggctgtagcccggtctattgactagagtcttatacggtactcccaccgtgttcgggatccatatcagcagccagggcct

SEQ ID NO: 8787 - DNA, 140 bp, Artificial Sequence
  Synthetic
aggccctggctgctgatatgaagacttccagagcctgagcgaaagtgcgacgatggtgtacaacgaaagggagtttgtaaataggaaattacaccatatcgcgttgcacggaccagccctgaccttttgggacagcggtg

SEQ ID NO: 8788 - DNA, 140 bp, Artificial Sequence
  Synthetic
caccgctgtcccaaaaggtcagggctggtccgtgcaacgcgatatggtgtaatttcctatttacaaactccctttcgttgtacaccatcgtcgcactttcgctcaggctctggaagtcttcatatcagcagccagggcct

SEQ ID NO: 8789 - DNA, 140 bp, Artificial Sequence
  Synthetic
atacgccatgctgggtctccaataatgttactgtatctgcctatgcaaacggcgaccatgccgtcacagttaaggacgctaaattcattgtggggccaatgtcttcagcctggacaccttcgtacttgggagtcggccat

SEQ ID NO: 8790 - DNA, 140 bp, Artificial Sequence
  Synthetic
atggccgactcccaagtacgaaggtgtccaggctgaagacattggccccacaatgaatttagcgtccttaactgtgacggcatggtcgccgtttgcataggcagatacagtaacattattggagacccagcatggcgtat

SEQ ID NO: 8791 - DNA, 140 bp, Artificial Sequence
  Synthetic
aggccctggctgctgatatgctgccaagaaatctccaccgacgtgatgcgacagaggaatctggagatatctgcacgcacggtcgactcactgctcttgaacggatgcaacagaccagtcgaccttttgggacagcggtg

SEQ ID NO: 8792 - DNA, 140 bp, Artificial Sequence
  Synthetic
caccgctgtcccaaaaggtcgactggtctgttgcatccgttcaagagcagtgagtcgaccgtgcgtgcagatatctccagattcctctgtcgcatcacgtcggtggagatttcttggcagcatatcagcagccagggcct

SEQ ID NO: 8793 - DNA, 140 bp, Artificial Sequence
  Synthetic
atacgccatgctgggtctccaaccataacatctgcacccaagtgtaccataaaagtatttccaggcggtgtacactgcctgtgactgccattgtgtcttcgttgcattacgaaggcaaaacgtacttgggagtcggccat

SEQ ID NO: 8794 - DNA, 140 bp, Artificial Sequence
  Synthetic
atggccgactcccaagtacgttttgccttcgtaatgcaacgaagacacaatggcagtcacaggcagtgtacaccgcctggaaatacttttatggtacacttgggtgcagatgttatggttggagacccagcatggcgtat

SEQ ID NO: 8795 - DNA, 140 bp, Artificial Sequence
  Synthetic
aggccctggctgctgatatgttcgacggccctagccagcgccgaattccgcgtacaagtctgttctacacaagtacactgtgcagccgagtgccatccaccgaaagaccatatagtcaatgaccttttgggacagcggtg

SEQ ID NO: 8796 - DNA, 140 bp, Artificial Sequence
  Synthetic
caccgctgtcccaaaaggtcattgactatatggtctttcggtggatggcactcggctgcacagtgtacttgtgtagaacagacttgtacgcggaattcggcgctggctagggccgtcgaacatatcagcagccagggcct

SEQ ID NO: 8797 - DNA, 140 bp, Artificial Sequence
  Synthetic
aggccctggctgctgatatgaagtacactgtgcagccgagtgccatccaccgaaagaccatatagtcaattacccggcgtcacacaccaccctcggggtccaagacatttccgctacggcgaccttttgggacagcggtg

SEQ ID NO: 8798 - DNA, 140 bp, Artificial Sequence
  Synthetic
caccgctgtcccaaaaggtcgccgtagcggaaatgtcttggaccccgagggtggtgtgtgacgccgggtaattgactatatggtctttcggtggatggcactcggctgcacagtgtacttcatatcagcagccagggcct

SEQ ID NO: 8799 - DNA, 140 bp, Artificial Sequence
  Synthetic
aggccctggctgctgatatgccaccaagtgaccttcgacacgttccagaataaagccaatgtctgctgggcgaagagcttagtccccatcctagaaacggcagggataaaattaaacgacgaccttttgggacagcggtg

SEQ ID NO: 8800 - DNA, 140 bp, Artificial Sequence
  Synthetic
caccgctgtcccaaaaggtcgtcgtttaattttatccctgccgtttctaggatggggactaagctcttcgcccagcagacattggctttattctggaacgtgtcgaaggtcacttggtggcatatcagcagccagggcct

SEQ ID NO: 8801 - DNA, 140 bp, Artificial Sequence
  Synthetic
aggccctggctgctgatatgacatatagctaagaatcaatagataagtatagatcaaagggctgaacaacccctgaatagtaacaaaatataaaaatcaataaaaaatcataaaatagaagaccttttgggacagcggtg

SEQ ID NO: 8802 - DNA, 140 bp, Artificial Sequence
  Synthetic
caccgctgtcccaaaaggtcttctattttatgattttttattgatttttatattttgttactattcaggggttgttcagccctttgatctatacttatctattgattcttagctatatgtcatatcagcagccagggcct

SEQ ID NO: 8803 - DNA, 140 bp, Artificial Sequence
  Synthetic
atacgccatgctgggtctccaacccctgaataataacaaaatataaaaatcaataaaaatcataaaatagaaaaccataaacagaagtagttcaaagggctataaaacccctgaatagtacgtacttgggagtcggccat

SEQ ID NO: 8804 - DNA, 140 bp, Artificial Sequence
  Synthetic
atggccgactcccaagtacgtactattcaggggttttatagccctttgaactacttctgtttatggttttctattttatgatttttattgatttttatattttgttattattcaggggttggagacccagcatggcgtat

SEQ ID NO: 8805 - DNA, 140 bp, Artificial Sequence
  Synthetic
atacgccatgctgggtctccacaaaacataaaactaataaaaattaaatgaataccataattggcaatcggaagagatgtaggtacttaagcttcctaaaagcagccgaactcgctttgacgtacttgggagtcggccat

SEQ ID NO: 8806 - DNA, 140 bp, Artificial Sequence
  Synthetic
atggccgactcccaagtacgtcaaagcgagttcggctgcttttaggaagcttaagtacctacatctcttccgattgccaattatggtattcatttaatttttattagttttatgttttgtggagacccagcatggcgtat

SEQ ID NO: 8807 - DNA, 140 bp, Artificial Sequence
  Synthetic
aggccctggctgctgatatgataccaacaagcaaatctgtgtgactactaggaggattgaagattttaacccgaacaccaacattatacctgccaacaggagactaccgcattcattggtgaccttttgggacagcggtg

SEQ ID NO: 8808 - DNA, 140 bp, Artificial Sequence
  Synthetic
caccgctgtcccaaaaggtcaccaatgaatgcggtagtctcctgttggcaggtataatgttggtgttcgggttaaaatcttcaatcctcctagtagtcacacagatttgcttgttggtatcatatcagcagccagggcct

SEQ ID NO: 8809 - DNA, 140 bp, Artificial Sequence
  Synthetic
aggccctggctgctgatatgccataattggcaatcggaagagatgtaggtacttaagcttcctaaaagcagccgaactcgctttgagatgtaggcatagcacaccgaactcttccacgatgaccttttgggacagcggtg

SEQ ID NO: 8810 - DNA, 140 bp, Artificial Sequence
  Synthetic
caccgctgtcccaaaaggtcatcgtggaagagttcggtgtgctatgcctacatctcaaagcgagttcggctgcttttaggaagcttaagtacctacatctcttccgattgccaattatggcatatcagcagccagggcct

SEQ ID NO: 8811 - DNA, 140 bp, Artificial Sequence
  Synthetic
aggccctggctgctgatatgaattgggcggatgagcaggtactgaaggctaagaacataggattatgttcaacagacctgacggaaggtagacgaggcaaattgtctatcatgagagggagaccttttgggacagcggtg

SEQ ID NO: 8812 - DNA, 140 bp, Artificial Sequence
  Synthetic
caccgctgtcccaaaaggtctccctctcatgatagacaatttgcctcgtctaccttccgtcaggtctgttgaacataatcctatgttcttagccttcagtacctgctcatccgcccaattcatatcagcagccagggcct

SEQ ID NO: 8813 - DNA, 140 bp, Artificial Sequence
  Synthetic
aggccctggctgctgatatgaaaagctaaaaccgtgcgaccgtgtgctgttctcagtagggtcaacgctttacccggaaagccgcatgctacttaagagctggcacctaccatcggtgttgaccttttgggacagcggtg

SEQ ID NO: 8814 - DNA, 140 bp, Artificial Sequence
  Synthetic
caccgctgtcccaaaaggtcaacaccgatggtaggtgccagctcttaagtagcatgcggctttccgggtaaagcgttgaccctactgagaacagcacacggtcgcacggttttagcttttcatatcagcagccagggcct

SEQ ID NO: 8815 - DNA, 140 bp, Artificial Sequence
  Synthetic
aggccctggctgctgatatggagactgctcaagccgggtggttcattactgatcagggcatacggctacgcagacagaacaagcgaacgagtagtctgcgtactgggacgcaagtttcgagaccttttgggacagcggtg

SEQ ID NO: 8816 - DNA, 140 bp, Artificial Sequence
  Synthetic
caccgctgtcccaaaaggtctcgaaacttgcgtcccagtacgcagactactcgttcgcttgttctgtctgcgtagccgtatgccctgatcagtaatgaaccacccggcttgagcagtctccatatcagcagccagggcct

SEQ ID NO: 8817 - DNA, 140 bp, Artificial Sequence
  Synthetic
atacgccatgctgggtctccgagaatagtggttaacggcagaacgcaacggaacacgaacaccatgaagaactatctacttcccgtggtcgcccaggcctttagtaagtgggcgaaggagcgtacttgggagtcggccat

SEQ ID NO: 8818 - DNA, 140 bp, Artificial Sequence
  Synthetic
atggccgactcccaagtacgctccttcgcccacttactaaaggcctgggcgaccacgggaagtagatagttcttcatggtgttcgtgttccgttgcgttctgccgttaaccactattctcggagacccagcatggcgtat

SEQ ID NO: 8819 - DNA, 140 bp, Artificial Sequence
  Synthetic
atacgccatgctgggtctccgaggactagaatcaagtggctgttacgcaaggtgccgaaaacagacctgatcccatacagcgggaatgcccaagaagcccaggatgcagaaaaagaagcacgtacttgggagtcggccat

SEQ ID NO: 8820 - DNA, 140 bp, Artificial Sequence
  Synthetic
atggccgactcccaagtacgtgcttctttttctgcatcctgggcttcttgggcattcccgctgtatgggatcaggtctgttttcggcaccttgcgtaacagccacttgattctagtcctcggagacccagcatggcgtat

SEQ ID NO: 8821 - DNA, 140 bp, Artificial Sequence
  Synthetic
atacgccatgctgggtctccacacgagtacgtctacgacgtggaccagagaagatgctgtaagaaggaagaagctgcaggattggtactggtgggcgacttgactaatccgccctaccaccgtacttgggagtcggccat

SEQ ID NO: 8822 - DNA, 140 bp, Artificial Sequence
  Synthetic
atggccgactcccaagtacggtggtagggcggattagtcaagtcgcccaccagtaccaatcctgcagcttcttccttcttacagcatcttctctggtccacgtcgtagacgtactcgtgtggagacccagcatggcgtat

SEQ ID NO: 8823 - DNA, 140 bp, Artificial Sequence
  Synthetic
atacgccatgctgggtctcccaacaccagtgggaaccgcaaagacaatcatgtgcggtacatacccggtaatccatgcagtaggacctaatttctcaaattactctgagtccgaaggagacgtacttgggagtcggccat

SEQ ID NO: 8824 - DNA, 140 bp, Artificial Sequence
  Synthetic
atggccgactcccaagtacgtctccttcggactcagagtaatttgagaaattaggtcctactgcatggattaccgggtatgtaccgcacatgattgtctttgcggttcccactggtgttgggagacccagcatggcgtat

SEQ ID NO: 8825 - DNA, 140 bp, Artificial Sequence
  Synthetic
aggccctggctgctgatatgatccatgcagtaggacctaatttctcaaattactctgagtccgaaggagaccgggaattggcggctgcttaccgagaagtcgctaaggaggtgactagacgaccttttgggacagcggtg

SEQ ID NO: 8826 - DNA, 140 bp, Artificial Sequence
  Synthetic
caccgctgtcccaaaaggtcgtctagtcacctccttagcgacttctcggtaagcagccgccaattcccggtctccttcggactcagagtaatttgagaaattaggtcctactgcatggatcatatcagcagccagggcct

SEQ ID NO: 8827 - DNA, 140 bp, Artificial Sequence
  Synthetic
atacgccatgctgggtctccacaatcataacatctgcacccaagtgtaccacaaaagtatctccaggcggtgtacactgcctgtgactgccattgtgtcgtcgttgcattacgaaggcaacgtacttgggagtcggccat

SEQ ID NO: 8828 - DNA, 140 bp, Artificial Sequence
  Synthetic
atggccgactcccaagtacgttgccttcgtaatgcaacgacgacacaatggcagtcacaggcagtgtacaccgcctggagatacttttgtggtacacttgggtgcagatgttatgattgtggagacccagcatggcgtat

SEQ ID NO: 8829 - DNA, 140 bp, Artificial Sequence
  Synthetic
atacgccatgctgggtctccagactcaactgatgcagatgtggttatctactgccgcgacaaggagtgggagaagaaaatagccgaggccatacaaatgaggacccaagtggaactactacgtacttgggagtcggccat

SEQ ID NO: 8830 - DNA, 140 bp, Artificial Sequence
  Synthetic
atggccgactcccaagtacgtagtagttccacttgggtcctcatttgtatggcctcggctattttcttctcccactccttgtcgcggcagtagataaccacatctgcatcagttgagtctggagacccagcatggcgtat

SEQ ID NO: 8831 - DNA, 140 bp, Artificial Sequence
  Synthetic
aggccctggctgctgatatgagtcaccaagtgacctttgacacgttccaaaacaaagccaacgtttgctgggctaagagcttggtccctatcctcgaaacagcggggataaaattaaatggaccttttgggacagcggtg

SEQ ID NO: 8832 - DNA, 140 bp, Artificial Sequence
  Synthetic
caccgctgtcccaaaaggtccatttaattttatccccgctgtttcgaggatagggaccaagctcttagcccagcaaacgttggctttgttttggaacgtgtcaaaggtcacttggtgactcatatcagcagccagggcct

SEQ ID NO: 8833 - DNA, 140 bp, Artificial Sequence
  Synthetic
aggccctggctgctgatatgcctacttggaagggacacggttccatcagacggcagtggacatggcagaagtatacaccatgtggccaaagcagacagaggctaatgaacaagtttgcttgaccttttgggacagcggtg

SEQ ID NO: 8834 - DNA, 140 bp, Artificial Sequence
  Synthetic
caccgctgtcccaaaaggtcaagcaaacttgttcattagcctctgtctgctttggccacatggtgtatacttctgccatgtccactgccgtctgatggaaccgtgtcccttccaagtaggcatatcagcagccagggcct

SEQ ID NO: 8835 - DNA, 140 bp, Artificial Sequence
  Synthetic
atacgccatgctgggtctcccgcagatagaaccagcgaacgagtcatctgcgtactgggacgcaagtttagatcgtctagagcattgaaaccaccatgtatcaccagtaatactgagatgcgtacttgggagtcggccat

SEQ ID NO: 8836 - DNA, 140 bp, Artificial Sequence
  Synthetic
atggccgactcccaagtacgcatctcagtattactggtgatacatggtggtttcaatgctctagacgatctaaacttgcgtcccagtacgcagatgactcgttcgctggttctatctgcgggagacccagcatggcgtat

SEQ ID NO: 8837 - DNA, 140 bp, Artificial Sequence
  Synthetic
atacgccatgctgggtctcctatgccatgacacccgaacgagtcaccaggcttcgtatgaaccatgtcacaagcataatagtgtgctcatcattcccccttccaaagtataaaatagaagcgtacttgggagtcggccat

SEQ ID NO: 8838 - DNA, 140 bp, Artificial Sequence
  Synthetic
atggccgactcccaagtacgcttctattttatactttggaagggggaatgatgagcacactattatgcttgtgacatggttcatacgaagcctggtgactcgttcgggtgtcatggcataggagacccagcatggcgtat

SEQ ID NO: 8839 - DNA, 140 bp, Artificial Sequence
  Synthetic
aggccctggctgctgatatgcggtgtttgcaaggcagtatataaaaaatggccggagtcctttaaaaacagtgcaacaccagtaggaaccgcaaaaacagttatgtgcggtacatatccagaccttttgggacagcggtg

SEQ ID NO: 8840 - DNA, 140 bp, Artificial Sequence
  Synthetic
caccgctgtcccaaaaggtctggatatgtaccgcacataactgtttttgcggttcctactggtgttgcactgtttttaaaggactccggccattttttatatactgccttgcaaacaccgcatatcagcagccagggcct

SEQ ID NO: 8841 - DNA, 140 bp, Artificial Sequence
  Synthetic
aggccctggctgctgatatggagatatataccatgtggccaaagcaaacagaggccaatgagcaagtctgcctatatgccctgggggaaagtattgaatcaatcaggcagaaatgcccgggaccttttgggacagcggtg

SEQ ID NO: 8842 - DNA, 140 bp, Artificial Sequence
  Synthetic
caccgctgtcccaaaaggtcccgggcatttctgcctgattgattcaatactttcccccagggcatataggcagacttgctcattggcctctgtttgctttggccacatggtatatatctccatatcagcagccagggcct

SEQ ID NO: 8843 - DNA, 140 bp, Artificial Sequence
  Synthetic
aggccctggctgctgatatggcgccgatggcgagacactgcctgtcccgtcagacctggatgctgacgccccagccctagaaccggccctagacgacggggcgatacatacgttaccaacgaccttttgggacagcggtg

SEQ ID NO: 8844 - DNA, 140 bp, Artificial Sequence
  Synthetic
caccgctgtcccaaaaggtcgttggtaacgtatgtatcgccccgtcgtctagggccggttctagggctggggcgtcagcatccaggtctgacgggacaggcagtgtctcgccatcggcgccatatcagcagccagggcct

SEQ ID NO: 8845 - DNA, 140 bp, Artificial Sequence
  Synthetic
atacgccatgctgggtctccctgtcgcgccgcctagaagaaggagagggagaaacctgactgtgatatgtgacgagagagaagggaatataacacccatggctagcgtccgattctttagcgtacttgggagtcggccat

SEQ ID NO: 8846 - DNA, 140 bp, Artificial Sequence
  Synthetic
atggccgactcccaagtacgctaaagaatcggacgctagccatgggtgttatattcccttctctctcgtcacatatcacagtcaggtttctccctctccttcttctaggcggcgcgacagggagacccagcatggcgtat

SEQ ID NO: 8847 - DNA, 140 bp, Artificial Sequence
  Synthetic
aggccctggctgctgatatgagcagagctgtgtccggccgtacaagaaacagcggagacgcgtgacacagctatttcccttcaggcaccgccaagtaccaccatggaactgagccatccagaccttttgggacagcggtg

SEQ ID NO: 8848 - DNA, 140 bp, Artificial Sequence
  Synthetic
caccgctgtcccaaaaggtctggatggctcagttccatggtggtacttggcggtgcctgaagggaaatagctgtgtcacgcgtctccgctgtttcttgtacggccggacacagctctgctcatatcagcagccagggcct

SEQ ID NO: 8849 - DNA, 140 bp, Artificial Sequence
  Synthetic
aggccctggctgctgatatgaagtggaaaatatgaaagcaacaatcatccagagactaaagagaggctgtaaactgtatttaatggcagagaccccgaaagtcccgacttatcggaccgtgaccttttgggacagcggtg

SEQ ID NO: 8850 - DNA, 140 bp, Artificial Sequence
  Synthetic
caccgctgtcccaaaaggtcacggtccgataagtcgggactttcggggtctctgccattaaatacagtttacagcctctctttagtctctggatgattgttgctttcatattttccacttcatatcagcagccagggcct

SEQ ID NO: 8851 - DNA, 140 bp, Artificial Sequence
  Synthetic
atacgccatgctgggtctccatacccggcgcctgtgtactcgcctccgatcaacgtccgattgtccaaccccgagtccgcagtggcagcatgtaatgagttcttagctagaaactacccacgtacttgggagtcggccat

SEQ ID NO: 8852 - DNA, 140 bp, Artificial Sequence
  Synthetic
atggccgactcccaagtacgtgggtagtttctagctaagaactcattacatgctgccactgcggactcggggttggacaatcggacgttgatcggaggcgagtacacaggcgccgggtatggagacccagcatggcgtat

SEQ ID NO: 8853 - DNA, 140 bp, Artificial Sequence
  Synthetic
atacgccatgctgggtctccagacagtactgccggtaaataccttggaggaagttcaagaggagaaatgttacccacctaagttggatgaagtgaaagagcagttgttacttaagaaactcgtacttgggagtcggccat

SEQ ID NO: 8854 - DNA, 140 bp, Artificial Sequence
  Synthetic
atggccgactcccaagtacgagtttcttaagtaacaactgctctttcacttcatccaacttaggtgggtaacatttctcctcttgaacttcctccaaggtatttaccggcagtactgtctggagacccagcatggcgtat

SEQ ID NO: 8855 - DNA, 140 bp, Artificial Sequence
  Synthetic
atacgccatgctgggtctccccaggaaagtgcgtccatggctaacagaagcaggtaccaatcccgcaaagtagagaacatgaaagcaacaatagtccaaaggctgaagggtggttgcaaacgtacttgggagtcggccat

SEQ ID NO: 8856 - DNA, 140 bp, Artificial Sequence
  Synthetic
atggccgactcccaagtacgtttgcaaccacccttcagcctttggactattgttgctttcatgttctctactttgcgggattggtacctgcttctgttagccatggacgcactttcctggggagacccagcatggcgtat

SEQ ID NO: 8857 - DNA, 140 bp, Artificial Sequence
  Synthetic
atacgccatgctgggtctccggaagatcgtctgacaaaatctgcatgcgcggccttcatcggcgacgacaacataatacatggtgtcgtctccgacgaattgatggcagccagatgcgctcgtacttgggagtcggccat

SEQ ID NO: 8858 - DNA, 140 bp, Artificial Sequence
  Synthetic
atggccgactcccaagtacgagcgcatctggctgccatcaattcgtcggagacgacaccatgtattatgttgtcgtcgccgatgaaggccgcgcatgcagattttgtcagacgatcttccggagacccagcatggcgtat

SEQ ID NO: 8859 - DNA, 140 bp, Artificial Sequence
  Synthetic
aggccctggctgctgatatgagtctgctgtggcagcgtgcaatgagttcctagcaaggaactatccgacagttgcgtcgtaccaaatcaccgatgagtacgatgcatacctggacatggtgaccttttgggacagcggtg

SEQ ID NO: 8860 - DNA, 140 bp, Artificial Sequence
  Synthetic
caccgctgtcccaaaaggtcaccatgtccaggtatgcatcgtactcatcggtgatttggtacgacgcaactgtcggatagttccttgctaggaactcattgcacgctgccacagcagactcatatcagcagccagggcct

SEQ ID NO: 8861 - DNA, 140 bp, Artificial Sequence
  Synthetic
atacgccatgctgggtctcctgacaatgcgcgcggtacctcaacagaagccgcgcaagaatcggaagaataagaagcaaaagcaaaaacagcaggcgccacgaaacaatatgaatcaaaacgtacttgggagtcggccat

SEQ ID NO: 8862 - DNA, 140 bp, Artificial Sequence
  Synthetic
atggccgactcccaagtacgttttgattcatattgtttcgtggcgcctgctgtttttgcttttgcttcttattcttccgattcttgcgcggcttctgttgaggtaccgcgcgcattgtcaggagacccagcatggcgtat

SEQ ID NO: 8863 - DNA, 140 bp, Artificial Sequence
  Synthetic
aggccctggctgctgatatgccgttagcggcaggtgacgaacaagacgaagacagaagacgggcgctggctgatgaagtaatcagatggcaacgaacagggctaatagatgagctggagagaccttttgggacagcggtg

SEQ ID NO: 8864 - DNA, 140 bp, Artificial Sequence
  Synthetic
caccgctgtcccaaaaggtctctccagctcatctattagccctgttcgttgccatctgattacttcatcagccagcgcccgtcttctgtcttcgtcttgttcgtcacctgccgctaacggcatatcagcagccagggcct

SEQ ID NO: 8865 - DNA, 140 bp, Artificial Sequence
  Synthetic
atacgccatgctgggtctcccgaaaatcacccctgagggggccgaagagtggagtcttgccattccagttatgtgcctgctggcaaataccacgttcccctgctcccagcccccttgcaccgtacttgggagtcggccat

SEQ ID NO: 8866 - DNA, 140 bp, Artificial Sequence
  Synthetic
atggccgactcccaagtacggtgcaagggggctgggagcaggggaacgtggtatttgccagcaggcacataactggaatggcaagactccactcttcggccccctcaggggtgattttcgggagacccagcatggcgtat

SEQ ID NO: 8867 - DNA, 140 bp, Artificial Sequence
  Synthetic
aggccctggctgctgatatgattcagcggtatttaatgttgagtgctttaaaaaatttgcgtgcaatcaagaatactggaaggaatttgccgccagtccaattaggataacgactgagaagaccttttgggacagcggtg

SEQ ID NO: 8868 - DNA, 140 bp, Artificial Sequence
  Synthetic
caccgctgtcccaaaaggtcttctcagtcgttatcctaattggactggcggcaaattccttccagtattcttgattgcacgcaaattttttaaagcactcaacattaaataccgctgaatcatatcagcagccagggcct

SEQ ID NO: 8869 - DNA, 140 bp, Artificial Sequence
  Synthetic
atacgccatgctgggtctcccgcacccatttcaccacgaccctcctgtgataggccgggaaaaattccattcccgaccgcagcacggtagagaactaccttgcagcacgtacacgcagagcgtacttgggagtcggccat

SEQ ID NO: 8870 - DNA, 140 bp, Artificial Sequence
  Synthetic
atggccgactcccaagtacgctctgcgtgtacgtgctgcaaggtagttctctaccgtgctgcggtcgggaatggaatttttcccggcctatcacaggagggtcgtggtgaaatgggtgcgggagacccagcatggcgtat

SEQ ID NO: 8871 - DNA, 140 bp, Artificial Sequence
  Synthetic
atacgccatgctgggtctcctcgaggtcacgtggggtaacaatgagccgtacaagtattggccgcagttatccacaaacggtacagcccacggccacccgcatgagataattctgtattacgtacttgggagtcggccat

SEQ ID NO: 8872 - DNA, 140 bp, Artificial Sequence
  Synthetic
atggccgactcccaagtacgtaatacagaattatctcatgcgggtggccgtgggctgtaccgtttgtggataactgcggccaatacttgtacggctcattgttaccccacgtgacctcgaggagacccagcatggcgtat

SEQ ID NO: 8873 - DNA, 140 bp, Artificial Sequence
  Synthetic
aggccctggctgctgatatgaccaggaggctgcggtatacctgtggaacgagcagcagcctttgttttggctgcaagcccttattccgctggcagccctgattgtcctatgtaactgtctgaccttttgggacagcggtg

SEQ ID NO: 8874 - DNA, 140 bp, Artificial Sequence
  Synthetic
caccgctgtcccaaaaggtcagacagttacataggacaatcagggctgccagcggaataagggcttgcagccaaaacaaaggctgctgctcgttccacaggtataccgcagcctcctggtcatatcagcagccagggcct

SEQ ID NO: 8875 - DNA, 140 bp, Artificial Sequence
  Synthetic
atacgccatgctgggtctccctgcaagcccttattccgctggcagccctgattgtcctatgtaactgtctgagactcttaccatgctgttgtaaaacgttgacttttttagccgtactgacgtacttgggagtcggccat

SEQ ID NO: 8876 - DNA, 140 bp, Artificial Sequence
  Synthetic
atggccgactcccaagtacgtcagtacggctaaaaaagtcaacgttttacaacagcatggtaagagtctcagacagttacataggacaatcagggctgccagcggaataagggcttgcagggagacccagcatggcgtat

SEQ ID NO: 8877 - DNA, 140 bp, Artificial Sequence
  Synthetic
aggccctggctgctgatatgaacacggtgggagtaccgtataagactctagtcaacagaccgggctacagccccatggtactggagatggagcttctgtctgtcactttggagccaacgcgaccttttgggacagcggtg

SEQ ID NO: 8878 - DNA, 140 bp, Artificial Sequence
  Synthetic
caccgctgtcccaaaaggtcgcgttggctccaaagtgacagacagaagctccatctccagtaccatggggctgtagcccggtctgttgactagagtcttatacggtactcccaccgtgttcatatcagcagccagggcct

SEQ ID NO: 8879 - DNA, 140 bp, Artificial Sequence
  Synthetic
atacgccatgctgggtctcccttgatagaggctgccttcggggagatctccagctgccacctaccgacgggcacccgttttaagttcggcgccatgatgaagtctggtatgtttttaacccgtacttgggagtcggccat

SEQ ID NO: 8880 - DNA, 140 bp, Artificial Sequence
  Synthetic
atggccgactcccaagtacgggttaaaaacataccagacttcatcatggcgccgaacttaaaacgggtgcccgtcggtaggtggcagctggagatctccccgaaggcagcctctatcaagggagacccagcatggcgtat

SEQ ID NO: 8881 - DNA, 140 bp, Artificial Sequence
  Synthetic
aggccctggctgctgatatgcctactgcttctgcgacactgaaaatacgcaattgagcgaagcacatgtggagaagtccgaatcatgcaaaacagaatttgcatcagcatacagggcccagaccttttgggacagcggtg

SEQ ID NO: 8882 - DNA, 140 bp, Artificial Sequence
  Synthetic
caccgctgtcccaaaaggtctgggccctgtatgctgatgcaaattctgttttgcatgattcggacttctccacatgtgcttcgctcaattgcgtattttcagtgtcgcagaagcagtaggcatatcagcagccagggcct

SEQ ID NO: 8883 - DNA, 140 bp, Artificial Sequence
  Synthetic
atacgccatgctgggtctcctaccgcatccgcatcagctaagctccgcgtcctttaccaaggaaataatgtcactgtatctgcttatgcaaacggcgaccatgccgtcacagttaaggaccgtacttgggagtcggccat

SEQ ID NO: 8884 - DNA, 140 bp, Artificial Sequence
  Synthetic
atggccgactcccaagtacggtccttaactgtgacggcatggtcgccgtttgcataagcagatacagtgacattatttccttggtaaaggacgcggagcttagctgatgcggatgcggtaggagacccagcatggcgtat

SEQ ID NO: 8885 - DNA, 140 bp, Artificial Sequence
  Synthetic
atacgccatgctgggtctcccctgcagagtggcagacccgctaaagcggctgttcaagctgggcaaaccgctggcggcgggagatgaacaagacgacgacagaagacgtgcactggctgacgtacttgggagtcggccat

SEQ ID NO: 8886 - DNA, 140 bp, Artificial Sequence
  Synthetic
atggccgactcccaagtacgtcagccagtgcacgtcttctgtcgtcgtcttgttcatctcccgccgccagcggtttgcccagcttgaacagccgctttagcgggtctgccactctgcaggggagacccagcatggcgtat

SEQ ID NO: 8887 - DNA, 140 bp, Artificial Sequence
  Synthetic
aggccctggctgctgatatgctggcggcgggagatgaacaagacgacgacagaagacgtgcactggctgacgaagtggtcagatggcaacgaacagggctaattgatgagctagaaaaaggaccttttgggacagcggtg

SEQ ID NO: 8888 - DNA, 140 bp, Artificial Sequence
  Synthetic
caccgctgtcccaaaaggtcctttttctagctcatcaattagccctgttcgttgccatctgaccacttcgtcagccagtgcacgtcttctgtcgtcgtcttgttcatctcccgccgccagcatatcagcagccagggcct

SEQ ID NO: 8889 - DNA, 140 bp, Artificial Sequence
  Synthetic
aggccctggctgctgatatgtcactgtatctgcttatgcaaacggcgaccatgccgtcacagttaaggacgctaaattcatagtggggccaatgtcttcagcctggacacctttcgacaagaccttttgggacagcggtg

SEQ ID NO: 8890 - DNA, 140 bp, Artificial Sequence
  Synthetic
caccgctgtcccaaaaggtcttgtcgaaaggtgtccaggctgaagacattggccccactatgaatttagcgtccttaactgtgacggcatggtcgccgtttgcataagcagatacagtgacatatcagcagccagggcct

SEQ ID NO: 8891 - DNA, 140 bp, Artificial Sequence
  Synthetic
aggccctggctgctgatatgtcctcagactttgggggcgtagccatcattaaatatgcagccagcaagaaaggcaagtgtgcagtgcattcgatgactaacgccgtcactattcgggaaggaccttttgggacagcggtg

SEQ ID NO: 8892 - DNA, 140 bp, Artificial Sequence
  Synthetic
caccgctgtcccaaaaggtccttcccgaatagtgacggcgttagtcatcgaatgcactgcacacttgcctttcttgctggctgcatatttaatgatggctacgcccccaaagtctgaggacatatcagcagccagggcct

SEQ ID NO: 8893 - DNA, 140 bp, Artificial Sequence
  Synthetic
aggccctggctgctgatatgatggccacctttgcaagctctagatctaactttgagaagctcagaggacccatcgtaactctgtacggtggtcctaaataggtacgcactacagctacctgaccttttgggacagcggtg

SEQ ID NO: 8894 - DNA, 140 bp, Artificial Sequence
  Synthetic
caccgctgtcccaaaaggtcaggtagctgtagtgcgtacctatttaggaccaccgtacagagttacgatgggtcctctgagcttctcaaagttagatctagagcttgcaaaggtggccatcatatcagcagccagggcct

SEQ ID NO: 8895 - DNA, 140 bp, Artificial Sequence
  Synthetic
aggccctggctgctgatatgatttcgtcagaaaccaatcgcagctacttgcatacctaccagctacaatggagttcatcccgacgcaaactttctacaacagaaggtaccaaccccgaccgaccttttgggacagcggtg

SEQ ID NO: 8896 - DNA, 140 bp, Artificial Sequence
  Synthetic
caccgctgtcccaaaaggtcggtcggggttggtaccttctgttgtagaaagtttgcgtcgggatgaactccattgtagctggtaggtatgcaagtagctgcgattggtttctgacgaaatcatatcagcagccagggcct

SEQ ID NO: 8897 - DNA, 140 bp, Artificial Sequence
  Synthetic
atacgccatgctgggtctccgagttcatcccgacgcaaactttctacaacagaaggtaccaaccccgaccctgggccccacgccccacaattcaagtaattagacctagaccacgtccaccgtacttgggagtcggccat

SEQ ID NO: 8898 - DNA, 140 bp, Artificial Sequence
  Synthetic
atggccgactcccaagtacggtggacgtggtctaggtctaattacttgaattgtggggcgtggggcccagggtcggggttggtaccttctgttgtagaaagtttgcgtcgggatgaactcggagacccagcatggcgtat

SEQ ID NO: 8899 - DNA, 140 bp, Artificial Sequence
  Synthetic
atacgccatgctgggtctcctagtaacaaaatataaaaatcaacaaaaatcataaaatagaaaactagaaatagaagtaggtaagaaggtatatgtgtcccctaagagacacaccatatacgtacttgggagtcggccat

SEQ ID NO: 8900 - DNA, 140 bp, Artificial Sequence
  Synthetic
atggccgactcccaagtacgtatatggtgtgtctcttaggggacacatataccttcttacctacttctatttctagttttctattttatgatttttgttgatttttatattttgttactaggagacccagcatggcgtat

SEQ ID NO: 8901 - DNA, 140 bp, Artificial Sequence
  Synthetic
atacgccatgctgggtctccagaggcaggctgggcaactcgcccagctgatctctgcagtcaacaaattgaccatgcgcgcggtacctcaacagaagcctcgcagaaatcggaaaaacaacgtacttgggagtcggccat

SEQ ID NO: 8902 - DNA, 140 bp, Artificial Sequence
  Synthetic
atggccgactcccaagtacgttgtttttccgatttctgcgaggcttctgttgaggtaccgcgcgcatggtcaatttgttgactgcagagatcagctgggcgagttgcccagcctgcctctggagacccagcatggcgtat

SEQ ID NO: 8903 - DNA, 140 bp, Artificial Sequence
  Synthetic
atacgccatgctgggtctcccgtagcataccgaactcttccataattctccgaacccacagggacgtaggagatgttcaaagtgactataaaaaccctgaacagtaataaaacataaaatcgtacttgggagtcggccat

SEQ ID NO: 8904 - DNA, 140 bp, Artificial Sequence
  Synthetic
atggccgactcccaagtacgattttatgttttattactgttcagggtttttatagtcactttgaacatctcctacgtccctgtgggttcggagaattatggaagagttcggtatgctacgggagacccagcatggcgtat

SEQ ID NO: 8905 - DNA, 140 bp, Artificial Sequence
  Synthetic
atacgccatgctgggtctccgaagcaaaggcagaagaagcaggcgccgcaaaatgacccaaagcaaaagaagcaaccaccacaaaagaagccggctcaaaagaagaagaaaccaggccgtcgtacttgggagtcggccat

SEQ ID NO: 8906 - DNA, 140 bp, Artificial Sequence
  Synthetic
atggccgactcccaagtacgacggcctggtttcttcttcttttgagccggcttcttttgtggtggttgcttcttttgctttgggtcattttgcggcgcctgcttcttctgcctttgcttcggagacccagcatggcgtat

SEQ ID NO: 8907 - DNA, 140 bp, Artificial Sequence
  Synthetic
aggccctggctgctgatatgtaataaggagtaccataattggcaaacggaagagacgtaggtacttaagcttcctaaaagcagccgaactcactttgagatgtaggcatagcataccgaagaccttttgggacagcggtg

SEQ ID NO: 8908 - DNA, 140 bp, Artificial Sequence
  Synthetic
caccgctgtcccaaaaggtcttcggtatgctatgcctacatctcaaagtgagttcggctgcttttaggaagcttaagtacctacgtctcttccgtttgccaattatggtactccttattacatatcagcagccagggcct

SEQ ID NO: 8909 - DNA, 140 bp, Artificial Sequence
  Synthetic
atacgccatgctgggtctccacttaagcttcctaaaagcagccgaactcactttgagatgtaggcatagcataccgaactcttccacaattctccgtacccatagggacgtaggagatgtcgtacttgggagtcggccat

SEQ ID NO: 8910 - DNA, 140 bp, Artificial Sequence
  Synthetic
atggccgactcccaagtacgacatctcctacgtccctatgggtacggagaattgtggaagagttcggtatgctatgcctacatctcaaagtgagttcggctgcttttaggaagcttaagtggagacccagcatggcgtat

SEQ ID NO: 8911 - DNA, 140 bp, Artificial Sequence
  Synthetic
aggccctggctgctgatatgggtactataactggcatcacggagcagtgcagtattcaggaggccggtttactatcccgacgggtgcaggcaagccgggagacagcggcagaccgatcttgaccttttgggacagcggtg

SEQ ID NO: 8912 - DNA, 140 bp, Artificial Sequence
  Synthetic
caccgctgtcccaaaaggtcaagatcggtctgccgctgtctcccggcttgcctgcacccgtcgggatagtaaaccggcctcctgaatactgcactgctccgtgatgccagttatagtacccatatcagcagccagggcct

SEQ ID NO: 8913 - DNA, 140 bp, Artificial Sequence
  Synthetic
atacgccatgctgggtctccaacgtgatgagacccggatactaccagctgctaaaagcatcgctgacttgttctccccaccgccaaagacgcagtactaaggacaattttaatgtctatacgtacttgggagtcggccat

SEQ ID NO: 8914 - DNA, 140 bp, Artificial Sequence
  Synthetic
atggccgactcccaagtacgtatagacattaaaattgtccttagtactgcgtctttggcggtggggagaacaagtcagcgatgcttttagcagctggtagtatccgggtctcatcacgttggagacccagcatggcgtat

SEQ ID NO: 8915 - DNA, 140 bp, Artificial Sequence
  Synthetic
aggccctggctgctgatatgcaacagaagtcagtacgccagtcagtgctgccggtgaacaccctggaggaagtccacgaggagaagtgttacccacctaagctggatgaagcaaaggagcgaccttttgggacagcggtg

SEQ ID NO: 8916 - DNA, 140 bp, Artificial Sequence
  Synthetic
caccgctgtcccaaaaggtcgctcctttgcttcatccagcttaggtgggtaacacttctcctcgtggacttcctccagggtgttcaccggcagcactgactggcgtactgacttctgttgcatatcagcagccagggcct

SEQ ID NO: 8917 - DNA, 140 bp, Artificial Sequence
  Synthetic
atacgccatgctgggtctccacagccacgattggaccaagctgcgctatatggatagccatacgccagcggacgcggagcgagccggattgcttgtaaggacttcagcaccgtgcacgatcgtacttgggagtcggccat

SEQ ID NO: 8918 - DNA, 140 bp, Artificial Sequence
  Synthetic
atggccgactcccaagtacgatcgtgcacggtgctgaagtccttacaagcaatccggctcgctccgcgtccgctggcgtatggctatccatatagcgcagcttggtccaatcgtggctgtggagacccagcatggcgtat

SEQ ID NO: 8919 - DNA, 140 bp, Artificial Sequence
  Synthetic
atacgccatgctgggtctcctaccgggaccatgggacactttattctcgcccgatgcccgaaaggagagacgctgacagtgggatttacggacagcagaaagatcagccacacatgtacacgtacttgggagtcggccat

SEQ ID NO: 8920 - DNA, 140 bp, Artificial Sequence
  Synthetic
atggccgactcccaagtacgtgtacatgtgtggctgatctttctgctgtccgtaaatcccactgtcagcgtctctcctttcgggcatcgggcgagaataaagtgtcccatggtcccggtaggagacccagcatggcgtat

SEQ ID NO: 8921 - DNA, 140 bp, Artificial Sequence
  Synthetic
aggccctggctgctgatatgcgctgacagtgggatttacggacagcagaaagatcagccacacatgtacacacccgttccatcacgaaccacctgtgataggtagggagaggttccactcgaccttttgggacagcggtg

SEQ ID NO: 8922 - DNA, 140 bp, Artificial Sequence
  Synthetic
caccgctgtcccaaaaggtcgagtggaacctctccctacctatcacaggtggttcgtgatggaacgggtgtgtacatgtgtggctgatctttctgctgtccgtaaatcccactgtcagcgcatatcagcagccagggcct

SEQ ID NO: 8923 - DNA, 140 bp, Artificial Sequence
  Synthetic
atacgccatgctgggtctcctgggcagacggtgcggtacaagtgcaactgcggtggctcaaacgagggactgacaaccacagacaaagtgatcaataactgcaaaattgatcagtgccatcgtacttgggagtcggccat

SEQ ID NO: 8924 - DNA, 140 bp, Artificial Sequence
  Synthetic
atggccgactcccaagtacgatggcactgatcaattttgcagttattgatcactttgtctgtggttgtcagtccctcgtttgagccaccgcagttgcacttgtaccgcaccgtctgcccaggagacccagcatggcgtat

SEQ ID NO: 8925 - DNA, 140 bp, Artificial Sequence
  Synthetic
atacgccatgctgggtctccgcgcaacgctgaactcggggaccgtaaaggaaagattcacatcccattcccattggcaaacgtgacttgcagagtaccaaaagcaagaaaccccacagtacgtacttgggagtcggccat

SEQ ID NO: 8926 - DNA, 140 bp, Artificial Sequence
  Synthetic
atggccgactcccaagtacgtactgtggggtttcttgcttttggtactctgcaagtcacgtttgccaatgggaatgggatgtgaatctttcctttacggtccccgagttcagcgttgcgcggagacccagcatggcgtat

SEQ ID NO: 8927 - DNA, 140 bp, Artificial Sequence
  Synthetic
aggccctggctgctgatatgcattggcaaacgtgacttgcagagtaccaaaagcaagaaaccccacagtaacgtacgggaaaaaccaagtcaccctgctgctgtatcctgaccatccgacgaccttttgggacagcggtg

SEQ ID NO: 8928 - DNA, 140 bp, Artificial Sequence
  Synthetic
caccgctgtcccaaaaggtcgtcggatggtcaggatacagcagcagggtgacttggtttttcccgtacgttactgtggggtttcttgcttttggtactctgcaagtcacgtttgccaatgcatatcagcagccagggcct

SEQ ID NO: 8929 - DNA, 140 bp, Artificial Sequence
  Synthetic
aggccctggctgctgatatgtacgaacggtactgctcatggtcacccacatgagataatcttgtactattatgagctgtaccccactatgactgtaatcattgtgtcggtggcctcgttcgaccttttgggacagcggtg

SEQ ID NO: 8930 - DNA, 140 bp, Artificial Sequence
  Synthetic
caccgctgtcccaaaaggtcgaacgaggccaccgacacaatgattacagtcatagtggggtacagctcataatagtacaagattatctcatgtgggtgaccatgagcagtaccgttcgtacatatcagcagccagggcct

SEQ ID NO: 8931 - DNA, 140 bp, Artificial Sequence
  Synthetic
aggccctggctgctgatatgtcacttgactacatcacgtgcgagtacaaaactgtcatcccctccccgtacgtgaagtgctgtggtacagcagagtgcaaggacaagagcttaccagactgaccttttgggacagcggtg

SEQ ID NO: 8932 - DNA, 140 bp, Artificial Sequence
  Synthetic
caccgctgtcccaaaaggtcagtctggtaagctcttgtccttgcactctgctgtaccacagcacttcacgtacggggaggggatgacagttttgtactcgcacgtgatgtagtcaagtgacatatcagcagccagggcct

SEQ ID NO: 8933 - DNA, 140 bp, Artificial Sequence
  Synthetic
atacgccatgctgggtctccgaaatccgaatcttgcaaaacagagtttgcatcggcctacagagcccacaccgcatcggcgtcggcgaagctccgcgtcctttaccaaggaaacaacattcgtacttgggagtcggccat

SEQ ID NO: 8934 - DNA, 140 bp, Artificial Sequence
  Synthetic
atggccgactcccaagtacgaatgttgtttccttggtaaaggacgcggagcttcgccgacgccgatgcggtgtgggctctgtaggccgatgcaaactctgttttgcaagattcggatttcggagacccagcatggcgtat

SEQ ID NO: 8935 - DNA, 140 bp, Artificial Sequence
  Synthetic
aggccctggctgctgatatgaagtaaagacgtttatgccaacactcagttggtactacagaggccagcagcaggcacggtacatgtaccatactctcaggcaccatctggcttcaagtatgaccttttgggacagcggtg

SEQ ID NO: 8936 - DNA, 140 bp, Artificial Sequence
  Synthetic
caccgctgtcccaaaaggtcatacttgaagccagatggtgcctgagagtatggtacatgtaccgtgcctgctgctggcctctgtagtaccaactgagtgttggcataaacgtctttacttcatatcagcagccagggcct

SEQ ID NO: 8937 - DNA, 140 bp, Artificial Sequence
  Synthetic
atacgccatgctgggtctcctaccaatttccatcgacataccggatgcggcctttactagggttgtcgatgcaccctctgtaacggacatgtcatgcgaagtaccagcctgcactcactccgtacttgggagtcggccat

SEQ ID NO: 8938 - DNA, 140 bp, Artificial Sequence
  Synthetic
atggccgactcccaagtacggagtgagtgcaggctggtacttcgcatgacatgtccgttacagagggtgcatcgacaaccctagtaaaggccgcatccggtatgtcgatggaaattggtaggagacccagcatggcgtat

SEQ ID NO: 8939 - DNA, 140 bp, Artificial Sequence
  Synthetic
atacgccatgctgggtctccctccgactttgggggcgtcgccatcatcaaatatacagctagcaagaaaggtaaatgtgcagtacattcgatgaccaacgccgttaccattcgagaagcccgtacttgggagtcggccat

SEQ ID NO: 8940 - DNA, 140 bp, Artificial Sequence
  Synthetic
atggccgactcccaagtacgggcttctcgaatggtaacggcgttggtcatcgaatgtactgcacatttacctttcttgctagctgtatatttgatgatggcgacgcccccaaagtcggagggagacccagcatggcgtat

SEQ ID NO: 8941 - DNA, 140 bp, Artificial Sequence
  Synthetic
atacgccatgctgggtctccgacgtagaagtagaggggaactcccagctgcaaatatccttctcaacagccttggcaagcgctgagtttcgcgtgcaagtgtgctccacacaagtacactcgtacttgggagtcggccat

SEQ ID NO: 8942 - DNA, 140 bp, Artificial Sequence
  Synthetic
atggccgactcccaagtacgagtgtacttgtgtggagcacacttgcacgcgaaactcagcgcttgccaaggctgttgagaaggatatttgcagctgggagttcccctctacttctacgtcggagacccagcatggcgtat

SEQ ID NO: 8943 - DNA, 140 bp, Artificial Sequence
  Synthetic
atacgccatgctgggtctcctaattttaattgtggtgctatgcgtgtcgtttagcaggcactaaaccgatgacaaggcacgaaataactaaatagtaaaagtagaaagtacataaccaggcgtacttgggagtcggccat

SEQ ID NO: 8944 - DNA, 140 bp, Artificial Sequence
  Synthetic
atggccgactcccaagtacgcctggttatgtactttctacttttactatttagttatttcgtgccttgtcatcggtttagtgcctgctaaacgacacgcatagcaccacaattaaaattaggagacccagcatggcgtat

SEQ ID NO: 8945 - DNA, 140 bp, Artificial Sequence
  Synthetic
aggccctggctgctgatatgcaaagggctatacaacccctgaatagtaacaaaacacaaaaatcaataaaaatcataaaaagaaaaatctcataaacaggtatacgtgtcccctaagagagaccttttgggacagcggtg

SEQ ID NO: 8946 - DNA, 140 bp, Artificial Sequence
  Synthetic
caccgctgtcccaaaaggtctctcttaggggacacgtatacctgtttatgagatttttctttttatgatttttattgatttttgtgttttgttactattcaggggttgtatagccctttgcatatcagcagccagggcct

SEQ ID NO: 8947 - DNA, 140 bp, Artificial Sequence
  Synthetic
aggccctggctgctgatatggaatagtaacaaaacacaaaaacaataaaaactacaaaatagaaaatctataaacaaaagtagttcaaagggctacaaaacccctgaatagtaacaaaacgaccttttgggacagcggtg

SEQ ID NO: 8948 - DNA, 140 bp, Artificial Sequence
  Synthetic
caccgctgtcccaaaaggtcgttttgttactattcaggggttttgtagccctttgaactacttttgtttatagattttctattttgtagtttttattgtttttgtgttttgttactattccatatcagcagccagggcct

SEQ ID NO: 8949 - DNA, 140 bp, Artificial Sequence
  Synthetic
atacgccatgctgggtctcctaaacaaaagtagttcaaagggctacaaaacccctgaatagtaacaaaacataaaatgtaataaaaattaagtgtgtacccaaaagaggtacagtaagaacgtacttgggagtcggccat

SEQ ID NO: 8950 - DNA, 140 bp, Artificial Sequence
  Synthetic
atggccgactcccaagtacgttcttactgtacctcttttgggtacacacttaatttttattacattttatgttttgttactattcaggggttttgtagccctttgaactacttttgtttaggagacccagcatggcgtat

SEQ ID NO: 8951 - DNA, 140 bp, Artificial Sequence
  Synthetic
aggccctggctgctgatatgacgtaggtatttaagcttcctaaaagcagccgaactcactttgagacgtaggcatagcataccgaactcttccactattctccgaacccacaggacgtgagaccttttgggacagcggtg

SEQ ID NO: 8952 - DNA, 140 bp, Artificial Sequence
  Synthetic
caccgctgtcccaaaaggtctcacgtcctgtgggttcggagaatagtggaagagttcggtatgctatgcctacgtctcaaagtgagttcggctgcttttaggaagcttaaatacctacgtcatatcagcagccagggcct

SEQ ID NO: 8953 - DNA, 140 bp, Artificial Sequence
  Synthetic
aggccctggctgctgatatgcaaccccgttcatgtacaacgctatggcgggtgcctacccctcatactcgacaaattgggcggatgagcaggtactgaaggctaagaacataggattatggaccttttgggacagcggtg

SEQ ID NO: 8954 - DNA, 140 bp, Artificial Sequence
  Synthetic
caccgctgtcccaaaaggtccataatcctatgttcttagccttcagtacctgctcatccgcccaatttgtcgagtatgaggggtaggcacccgccatagcgttgtacatgaacggggttgcatatcagcagccagggcct

SEQ ID NO: 8955 - DNA, 140 bp, Artificial Sequence
  Synthetic
atacgccatgctgggtctccgatgtgcaagactaccgacacggttgacggcgaaagagtgtcattctcggtgtgcacgtacgtgccggctaccatttgtgatcaaatgaccggcatccttcgtacttgggagtcggccat

SEQ ID NO: 8956 - DNA, 140 bp, Artificial Sequence
  Synthetic
atggccgactcccaagtacgaaggatgccggtcatttgatcacaaatggtagccggcacgtacgtgcacaccgagaatgacactctttcgccgtcaaccgtgtcggtagtcttgcacatcggagacccagcatggcgtat

SEQ ID NO: 8957 - DNA, 140 bp, Artificial Sequence
  Synthetic
aggccctggctgctgatatgggacacctttcgacaacaaaattgtggtgtacaaaggtgacgtctataacatggactacccgccctttggcgcaggaagaccaggacaatttggcgatatgaccttttgggacagcggtg

SEQ ID NO: 8958 - DNA, 140 bp, Artificial Sequence
  Synthetic
caccgctgtcccaaaaggtcatatcgccaaattgtcctggtcttcctgcgccaaagggcgggtagtccatgttatagacgtcacctttgtacaccacaattttgttgtcgaaaggtgtcccatatcagcagccagggcct

SEQ ID NO: 8959 - DNA, 140 bp, Artificial Sequence
  Synthetic
aggccctggctgctgatatgcggagcaagtgaagacgtgtacgcacagcggacgagcagggaggtatgcggtcgaagcgtacgatggccgagtcctagtgccctcaggctatgcaatctcgaccttttgggacagcggtg

SEQ ID NO: 8960 - DNA, 140 bp, Artificial Sequence
  Synthetic
caccgctgtcccaaaaggtcgagattgcatagcctgagggcactaggactcggccatcgtacgcttcgaccgcatacctccctgctcgtccgctgtgcgtacacgtcttcacttgctccgcatatcagcagccagggcct

SEQ ID NO: 8961 - DNA, 140 bp, Artificial Sequence
  Synthetic
aggccctggctgctgatatgagcaggcactaacttgacaattaagtatgaaggtatatgtgtcccctaagagacacactgtacatagcaaataatctatagatcaaagggctacgcaaccgaccttttgggacagcggtg

SEQ ID NO: 8962 - DNA, 140 bp, Artificial Sequence
  Synthetic
caccgctgtcccaaaaggtcggttgcgtagccctttgatctatagattatttgctatgtacagtgtgtctcttaggggacacatataccttcatacttaattgtcaagttagtgcctgctcatatcagcagccagggcct

SEQ ID NO: 8963 - DNA, 140 bp, Artificial Sequence
  Synthetic
aggccctggctgctgatatgtgaaggccctgcaacgtgcgtaccccatgtttgaggtggaaccaaggcaggtcacaccgaatgaccatgctaatgctagagcgttctcgcatctagctatgaccttttgggacagcggtg

SEQ ID NO: 8964 - DNA, 140 bp, Artificial Sequence
  Synthetic
caccgctgtcccaaaaggtcatagctagatgcgagaacgctctagcattagcatggtcattcggtgtgacctgccttggttccacctcaaacatggggtacgcacgttgcagggccttcacatatcagcagccagggcct

SEQ ID NO: 8965 - DNA, 140 bp, Artificial Sequence
  Synthetic
aggccctggctgctgatatgctgggctaagagcttggtccctatcctcgaaacagcggggataacactaaatgataggcagtggtcccagataattcaagccttcaaagaagacaaagcggaccttttgggacagcggtg

SEQ ID NO: 8966 - DNA, 140 bp, Artificial Sequence
  Synthetic
caccgctgtcccaaaaggtccgctttgtcttctttgaaggcttgaattatctgggaccactgcctatcatttagtgttatccccgctgtttcgaggatagggaccaagctcttagcccagcatatcagcagccagggcct

SEQ ID NO: 8967 - DNA, 140 bp, Artificial Sequence
  Synthetic
aggccctggctgctgatatgaggcgattaaaggggtccgagtggcgtactgggttgggttcgacacaaccccgttcatgtacaatgccatggcgggtgcctacccctcatactcgacaaagaccttttgggacagcggtg

SEQ ID NO: 8968 - DNA, 140 bp, Artificial Sequence
  Synthetic
caccgctgtcccaaaaggtctttgtcgagtatgaggggtaggcacccgccatggcattgtacatgaacggggttgtgtcgaacccaacccagtacgccactcggacccctttaatcgcctcatatcagcagccagggcct

SEQ ID NO: 8969 - DNA, 140 bp, Artificial Sequence
  Synthetic
aggccctggctgctgatatgctgggcagatgagcaggtactgaaggctaagaacataggattatgttcaacagacctgacggaaggtagacgaggcaagttgtctattatgagagggaaagaccttttgggacagcggtg

SEQ ID NO: 8970 - DNA, 140 bp, Artificial Sequence
  Synthetic
caccgctgtcccaaaaggtctttccctctcataatagacaacttgcctcgtctaccttccgtcaggtctgttgaacataatcctatgttcttagccttcagtacctgctcatctgcccagcatatcagcagccagggcct

SEQ ID NO: 8971 - DNA, 140 bp, Artificial Sequence
  Synthetic
atacgccatgctgggtctccaagctaaaaccgtgcgaccgtgtgctgttctcagtagggtcaacgctctacccggaaagccgcaagctacttaagagctggcacctgccatcggtgttcccgtacttgggagtcggccat

SEQ ID NO: 8972 - DNA, 140 bp, Artificial Sequence
  Synthetic
atggccgactcccaagtacgggaacaccgatggcaggtgccagctcttaagtagcttgcggctttccgggtagagcgttgaccctactgagaacagcacacggtcgcacggttttagcttggagacccagcatggcgtat

SEQ ID NO: 8973 - DNA, 140 bp, Artificial Sequence
  Synthetic
aggccctggctgctgatatggcaagactaccgacacggttgacggcgaaagagtgtcattctcggtgtgcacatacgtgccggcgaccatttgtgatcaaatgaccggcatccttgctacgaccttttgggacagcggtg

SEQ ID NO: 8974 - DNA, 140 bp, Artificial Sequence
  Synthetic
caccgctgtcccaaaaggtcgtagcaaggatgccggtcatttgatcacaaatggtcgccggcacgtatgtgcacaccgagaatgacactctttcgccgtcaaccgtgtcggtagtcttgccatatcagcagccagggcct

SEQ ID NO: 8975 - DNA, 140 bp, Artificial Sequence
  Synthetic
aggccctggctgctgatatggaatagtggttaacggcagaacgcaacggaatatgaacaccatgaaaaattatctgcttcccgtggtcgcccaagccttcagtaagtgggcaaaggagtggaccttttgggacagcggtg

SEQ ID NO: 8976 - DNA, 140 bp, Artificial Sequence
  Synthetic
caccgctgtcccaaaaggtccactcctttgcccacttactgaaggcttgggcgaccacgggaagcagataatttttcatggtgttcatattccgttgcgttctgccgttaaccactattccatatcagcagccagggcct

SEQ ID NO: 8977 - DNA, 140 bp, Artificial Sequence
  Synthetic
aggccctggctgctgatatgtgacctgctgctgtctatgggcattcaagaagcagaaaacacacacggtctacaagaggccggatacccagtcaattcagaaggttcaggccgagtttgagaccttttgggacagcggtg

SEQ ID NO: 8978 - DNA, 140 bp, Artificial Sequence
  Synthetic
caccgctgtcccaaaaggtctcaaactcggcctgaaccttctgaattgactgggtatccggcctcttgtagaccgtgtgtgttttctgcttcttgaatgcccatagacagcagcaggtcacatatcagcagccagggcct

SEQ ID NO: 8979 - DNA, 140 bp, Artificial Sequence
  Synthetic
atacgccatgctgggtctccccagtaatccacgccgtaggaccaaacttctcaaattattcggagtctgaaggggaccgggaattggcggctgcctatcgagaagtcgcaaaggaagtaacgtacttgggagtcggccat

SEQ ID NO: 8980 - DNA, 140 bp, Artificial Sequence
  Synthetic
atggccgactcccaagtacgttacttcctttgcgacttctcgataggcagccgccaattcccggtccccttcagactccgaataatttgagaagtttggtcctacggcgtggattactggggagacccagcatggcgtat

SEQ ID NO: 8981 - DNA, 140 bp, Artificial Sequence
  Synthetic
aggccctggctgctgatatgagagcgggcgcaggaataatagagactccgagaggagctatcaaagttactgcccaaccaacagaccacgtcgtgggagagtacctggtactctccccgcgaccttttgggacagcggtg

SEQ ID NO: 8982 - DNA, 140 bp, Artificial Sequence
  Synthetic
caccgctgtcccaaaaggtcgcggggagagtaccaggtactctcccacgacgtggtctgttggttgggcagtaactttgatagctcctctcggagtctctattattcctgcgcccgctctcatatcagcagccagggcct

SEQ ID NO: 8983 - DNA, 140 bp, Artificial Sequence
  Synthetic
aggccctggctgctgatatgtgcgcactacgaatgagtacaacaagccgattgtagtggacactacaggctcaacaaaacctgaccctggagacctcgtgttaacgtgcttcagagggtggaccttttgggacagcggtg

SEQ ID NO: 8984 - DNA, 140 bp, Artificial Sequence
  Synthetic
caccgctgtcccaaaaggtccaccctctgaagcacgttaacacgaggtctccagggtcaggttttgttgagcctgtagtgtccactacaatcggcttgttgtactcattcgtagtgcgcacatatcagcagccagggcct

SEQ ID NO: 8985 - DNA, 140 bp, Artificial Sequence
  Synthetic
atacgccatgctgggtctcctagagctgagctgtgtccagccgtacaagaaacagcggagacgcgtgacacagctatttcccttcaggcaccgccaagtaccactatggaactgagccatcgtacttgggagtcggccat

SEQ ID NO: 8986 - DNA, 140 bp, Artificial Sequence
  Synthetic
atggccgactcccaagtacgatggctcagttccatagtggtacttggcggtgcctgaagggaaatagctgtgtcacgcgtctccgctgtttcttgtacggctggacacagctcagctctaggagacccagcatggcgtat

SEQ ID NO: 8987 - DNA, 140 bp, Artificial Sequence
  Synthetic
aggccctggctgctgatatgtccacgtgcccagacacggacgacgagttatgactagacagggcaggtgggtatatattctcgtcagacactggtccaggtcatttacaacagaagtcgggaccttttgggacagcggtg

SEQ ID NO: 8988 - DNA, 140 bp, Artificial Sequence
  Synthetic
caccgctgtcccaaaaggtcccgacttctgttgtaaatgacctggaccagtgtctgacgagaatatatacccacctgccctgtctagtcataactcgtcgtccgtgtctgggcacgtggacatatcagcagccagggcct

SEQ ID NO: 8989 - DNA, 140 bp, Artificial Sequence
  Synthetic
aggccctggctgctgatatgaaccactgggataataggcctggagggaaaatgttcggatttaaccccgaggcagcatccattctagaaagaaagtacccattcacaaaagggaagtggagaccttttgggacagcggtg

SEQ ID NO: 8990 - DNA, 140 bp, Artificial Sequence
  Synthetic
caccgctgtcccaaaaggtctccacttcccttttgtgaatgggtactttctttctagaatggatgctgcctcggggttaaatccgaacattttccctccaggcctattatcccagtggttcatatcagcagccagggcct

SEQ ID NO: 8991 - DNA, 140 bp, Artificial Sequence
  Synthetic
aggccctggctgctgatatgggcagcatccattctagaaagaaagtacccattcacaaaagggaagtggaacatcaacaagcagatctgcgtgactaccaggaggatagaagactttaacgaccttttgggacagcggtg

SEQ ID NO: 8992 - DNA, 140 bp, Artificial Sequence
  Synthetic
caccgctgtcccaaaaggtcgttaaagtcttctatcctcctggtagtcacgcagatctgcttgttgatgttccacttcccttttgtgaatgggtactttctttctagaatggatgctgcccatatcagcagccagggcct

SEQ ID NO: 8993 - DNA, 140 bp, Artificial Sequence
  Synthetic
atacgccatgctgggtctccccaactgtttcatcataccaaatcaccgacgagtacgatgcatatctagacatggtggacgggtcggagagttgtctggaccgagcgacattcaatccgtcgtacttgggagtcggccat

SEQ ID NO: 8994 - DNA, 140 bp, Artificial Sequence
  Synthetic
atggccgactcccaagtacgacggattgaatgtcgctcggtccagacaactctccgacccgtccaccatgtctagatatgcatcgtactcgtcggtgatttggtatgatgaaacagttggggagacccagcatggcgtat

SEQ ID NO: 8995 - DNA, 140 bp, Artificial Sequence
  Synthetic
aggccctggctgctgatatgcagtgcgtcgaccacgcaatgaaactgcaaatgctcgggggtgactcattgagactgctcaaaccgggcggctctctattgatcagagcatatggttacggaccttttgggacagcggtg

SEQ ID NO: 8996 - DNA, 140 bp, Artificial Sequence
  Synthetic
caccgctgtcccaaaaggtccgtaaccatatgctctgatcaatagagagccgcccggtttgagcagtctcaatgagtcacccccgagcatttgcagtttcattgcgtggtcgacgcactgcatatcagcagccagggcct

SEQ ID NO: 8997 - DNA, 140 bp, Artificial Sequence
  Synthetic
aggccctggctgctgatatggagactgctcaaaccgggcggctctctattgatcagagcatatggttacgcagatagaaccagtgaacgagtcatctgcgtattgggacgcaagtttagagaccttttgggacagcggtg

SEQ ID NO: 8998 - DNA, 140 bp, Artificial Sequence
  Synthetic
caccgctgtcccaaaaggtctctaaacttgcgtcccaatacgcagatgactcgttcactggttctatctgcgtaaccatatgctctgatcaatagagagccgcccggtttgagcagtctccatatcagcagccagggcct

SEQ ID NO: 8999 - DNA, 140 bp, Artificial Sequence
  Synthetic
aggccctggctgctgatatgtcgtctagagcgttgaaaccaccatgtgtcaccagcaacactgagatgtttttcctattcagcaactttgacaatggcagaaggaatttcacaactcatggaccttttgggacagcggtg

SEQ ID NO: 9000 - DNA, 140 bp, Artificial Sequence
  Synthetic
caccgctgtcccaaaaggtccatgagttgtgaaattccttctgccattgtcaaagttgctgaataggaaaaacatctcagtgttgctggtgacacatggtggtttcaacgctctagacgacatatcagcagccagggcct

SEQ ID NO: 9001 - DNA, 140 bp, Artificial Sequence
  Synthetic
aggccctggctgctgatatggtgtttgcaaggcagtatacaaaaaatggccggagtcctttaagaacagtgcaacaccagtgggaaccgcaaaaacagttatgtgcggtacgtatccagtgaccttttgggacagcggtg

SEQ ID NO: 9002 - DNA, 140 bp, Artificial Sequence
  Synthetic
caccgctgtcccaaaaggtcactggatacgtaccgcacataactgtttttgcggttcccactggtgttgcactgttcttaaaggactccggccattttttgtatactgccttgcaaacaccatatcagcagccagggcct

SEQ ID NO: 9003 - DNA, 140 bp, Artificial Sequence
  Synthetic
aggccctggctgctgatatgaatccacgctgttggaccaaacttctctaattattcggagtctgaaggggaccgggaattggcagctgcctatcgagaagtcgcaaaggaagtaactagggaccttttgggacagcggtg

SEQ ID NO: 9004 - DNA, 140 bp, Artificial Sequence
  Synthetic
caccgctgtcccaaaaggtccctagttacttcctttgcgacttctcgataggcagctgccaattcccggtccccttcagactccgaataattagagaagtttggtccaacagcgtggattcatatcagcagccagggcct

SEQ ID NO: 9005 - DNA, 140 bp, Artificial Sequence
  Synthetic
aggccctggctgctgatatgaccgggaattggcagctgcctatcgagaagtcgcaaaggaagtaactaggctgggagtaaatagtgtagctatacctctcctctccacaggtgtatactcgaccttttgggacagcggtg

SEQ ID NO: 9006 - DNA, 140 bp, Artificial Sequence
  Synthetic
caccgctgtcccaaaaggtcgagtatacacctgtggagaggagaggtatagctacactatttactcccagcctagttacttcctttgcgacttctcgataggcagctgccaattcccggtcatatcagcagccagggcct

SEQ ID NO: 9007 - DNA, 140 bp, Artificial Sequence
  Synthetic
aggccctggctgctgatatggccatcgcgcgtaagtccaagggaatatagatcttcccaggagtctgcacaggaggcgagtacaatcacgtcactgacgcatagtcaattcgacctaagcgaccttttgggacagcggtg

SEQ ID NO: 9008 - DNA, 140 bp, Artificial Sequence
  Synthetic
caccgctgtcccaaaaggtcgcttaggtcgaattgactatgcgtcagtgacgtgattgtactcgcctcctgtgcagactcctgggaagatctatattcccttggacttacgcgcgatggccatatcagcagccagggcct

SEQ ID NO: 9009 - DNA, 140 bp, Artificial Sequence
  Synthetic
aggccctggctgctgatatgaataagaagcaaaagcaaaagcagcaggcgccacgaaacaacatgaatcaaaagaagcagccccctaaaaagaaaccggctcaaaagaaaaagaagccgggaccttttgggacagcggtg

SEQ ID NO: 9010 - DNA, 140 bp, Artificial Sequence
  Synthetic
caccgctgtcccaaaaggtcccggcttctttttcttttgagccggtttctttttagggggctgcttcttttgattcatgttgtttcgtggcgcctgctgcttttgcttttgcttcttattcatatcagcagccagggcct

SEQ ID NO: 9011 - DNA, 140 bp, Artificial Sequence
  Synthetic
aggccctggctgctgatatgcgagagagaagggaatataacacccatggctagcgtccgattctttagggcagagctgtgtccggtcgtacaagaaacagcggagacgcgtgacacagcagaccttttgggacagcggtg

SEQ ID NO: 9012 - DNA, 140 bp, Artificial Sequence
  Synthetic
caccgctgtcccaaaaggtctgctgtgtcacgcgtctccgctgtttcttgtacgaccggacacagctctgccctaaagaatcggacgctagccatgggtgttatattcccttctctctcgcatatcagcagccagggcct

SEQ ID NO: 9013 - DNA, 140 bp, Artificial Sequence
  Synthetic
aggccctggctgctgatatgcagagctgtgtccggtcgtacaagaaacagcggagacgcgtgacacagcaatgtctcttcaggcaccaccgagtaccgccacggaaccgaatcatccgccgaccttttgggacagcggtg

SEQ ID NO: 9014 - DNA, 140 bp, Artificial Sequence
  Synthetic
caccgctgtcccaaaaggtcggcggatgattcggttccgtggcggtactcggtggtgcctgaagagacattgctgtgtcacgcgtctccgctgtttcttgtacgaccggacacagctctgcatatcagcagccagggcct

SEQ ID NO: 9015 - DNA, 140 bp, Artificial Sequence
  Synthetic
aggccctggctgctgatatggtagaaaacatgaaagcagcaatcatccagagactaaagagaggctgtagactatacttaatgtcagagaccccaaaagtccctacttaccggactacatgaccttttgggacagcggtg

SEQ ID NO: 9016 - DNA, 140 bp, Artificial Sequence
  Synthetic
caccgctgtcccaaaaggtcatgtagtccggtaagtagggacttttggggtctctgacattaagtatagtctacagcctctctttagtctctggatgattgctgctttcatgttttctaccatatcagcagccagggcct

SEQ ID NO: 9017 - DNA, 140 bp, Artificial Sequence
  Synthetic
aggccctggctgctgatatgccccagatcgcacattgatgtcacaacagtccggcaatgtaaagatcacagtcaatagtcagacggtgcggtacaagtgtaattgcggtgactcaaatgagaccttttgggacagcggtg

SEQ ID NO: 9018 - DNA, 140 bp, Artificial Sequence
  Synthetic
caccgctgtcccaaaaggtctcatttgagtcaccgcaattacacttgtaccgcaccgtctgactattgactgtgatctttacattgccggactgttgtgacatcaatgtgcgatctggggcatatcagcagccagggcct

SEQ ID NO: 9019 - DNA, 140 bp, Artificial Sequence
  Synthetic
aggccctggctgctgatatgatttagcaacctatgttactaaactaaaagggccaaaagcagcagcgctattcgcaaaaacccataatctactgccactacaggaagtaccaatggataggaccttttgggacagcggtg

SEQ ID NO: 9020 - DNA, 140 bp, Artificial Sequence
  Synthetic
caccgctgtcccaaaaggtcctatccattggtacttcctgtagtggcagtagattatgggtttttgcgaatagcgctgctgcttttggcccttttagtttagtaacataggttgctaaatcatatcagcagccagggcct

SEQ ID NO: 9021 - DNA, 140 bp, Artificial Sequence
  Synthetic
aggccctggctgctgatatgggctcgaggtcacgtggggcaacaacgagccgtacaagtattggccgcagttatctacaaacggtacagcccacggccacccgcatgagataattttgtagaccttttgggacagcggtg

SEQ ID NO: 9022 - DNA, 140 bp, Artificial Sequence
  Synthetic
caccgctgtcccaaaaggtctacaaaattatctcatgcgggtggccgtgggctgtaccgtttgtagataactgcggccaatacttgtacggctcgttgttgccccacgtgacctcgagcccatatcagcagccagggcct

SEQ ID NO: 9023 - DNA, 140 bp, Artificial Sequence
  Synthetic
aggccctggctgctgatatgtactgctttgatgctgttagaggatttaggggtggatcactccctgctggacttgatagaggctgctttcggagagatttccagctgtcacctaccgacagaccttttgggacagcggtg

SEQ ID NO: 9024 - DNA, 140 bp, Artificial Sequence
  Synthetic
caccgctgtcccaaaaggtctgtcggtaggtgacagctggaaatctctccgaaagcagcctctatcaagtccagcagggagtgatccacccctaaatcctctaacagcatcaaagcagtacatatcagcagccagggcct

SEQ ID NO: 9025 - DNA, 140 bp, Artificial Sequence
  Synthetic
atacgccatgctgggtctccggtacgcgcttcaagttcggcgccatgatgaaatcaggtatgttcctaactctgttcgtcaacacattgttaaacatcaccatcgccagccgagtgctggcgtacttgggagtcggccat

SEQ ID NO: 9026 - DNA, 140 bp, Artificial Sequence
  Synthetic
atggccgactcccaagtacgccagcactcggctggcgatggtgatgtttaacaatgtgttgacgaacagagttaggaacatacctgatttcatcatggcgccgaacttgaagcgcgtaccggagacccagcatggcgtat

SEQ ID NO: 9027 - DNA, 140 bp, Artificial Sequence
  Synthetic
aggccctggctgctgatatgtctgttcgtcaacacattgttaaacatcaccatcgccagccgagtgctggaagatcgtctgacaaaatccgcgtgcgcggccttcatcggcgacgacaacgaccttttgggacagcggtg

SEQ ID NO: 9028 - DNA, 140 bp, Artificial Sequence
  Synthetic
caccgctgtcccaaaaggtcgttgtcgtcgccgatgaaggccgcgcacgcggattttgtcagacgatcttccagcactcggctggcgatggtgatgtttaacaatgtgttgacgaacagacatatcagcagccagggcct

SEQ ID NO: 9029 - DNA, 140 bp, Artificial Sequence
  Synthetic
aggccctggctgctgatatgataatacatggagtcgtctccgatgaattgatggcagccagatgtgccacttggatgaacatggaagtgaagatcatagatgcagttgtatccttgaaaggaccttttgggacagcggtg

SEQ ID NO: 9030 - DNA, 140 bp, Artificial Sequence
  Synthetic
caccgctgtcccaaaaggtcctttcaaggatacaactgcatctatgatcttcacttccatgttcatccaagtggcacatctggctgccatcaattcatcggagacgactccatgtattatcatatcagcagccagggcct

SEQ ID NO: 9031 - DNA, 140 bp, Artificial Sequence
  Synthetic
aggccctggctgctgatatgccgaacacggtgggagtaccgtataagactctagtcaacagaccgggctacagccccatggtactggagatggagcttctgtcagtcactttggagccaagaccttttgggacagcggtg

SEQ ID NO: 9032 - DNA, 140 bp, Artificial Sequence
  Synthetic
caccgctgtcccaaaaggtcttggctccaaagtgactgacagaagctccatctccagtaccatggggctgtagcccggtctgttgactagagtcttatacggtactcccaccgtgttcggcatatcagcagccagggcct

SEQ ID NO: 9033 - DNA, 140 bp, Artificial Sequence
  Synthetic
aggccctggctgctgatatgacgaagtgatcagatggcaacgaacagggctaattgatgagctggagaaagcggtatactctaggtacgaagtgcagggtatatcagttgtggtaatgtcgaccttttgggacagcggtg

SEQ ID NO: 9034 - DNA, 140 bp, Artificial Sequence
  Synthetic
caccgctgtcccaaaaggtcgacattaccacaactgatataccctgcacttcgtacctagagtataccgctttctccagctcatcaattagccctgttcgttgccatctgatcacttcgtcatatcagcagccagggcct

SEQ ID NO: 9035 - DNA, 140 bp, Artificial Sequence
  Synthetic
atacgccatgctgggtctcccaataaaatcgtggtgtacaaaggtgacgtctacaacatggactacccgcccttcggcgcaggaagaccaggacaatttggcgacatccaaagtcgcacgcgtacttgggagtcggccat

SEQ ID NO: 9036 - DNA, 140 bp, Artificial Sequence
  Synthetic
atggccgactcccaagtacgcgtgcgactttggatgtcgccaaattgtcctggtcttcctgcgccgaagggcgggtagtccatgttgtagacgtcacctttgtacaccacgattttattgggagacccagcatggcgtat

SEQ ID NO: 9037 - DNA, 140 bp, Artificial Sequence
  Synthetic
atacgccatgctgggtctccgcacgaaggtaaggtaacaggttacgcgtgcctggtgggggacaaagtaatgaaaccagcacatgtaaaggggaccatcgataacgcggacctggccaaacgtacttgggagtcggccat

SEQ ID NO: 9038 - DNA, 140 bp, Artificial Sequence
  Synthetic
atggccgactcccaagtacgtttggccaggtccgcgttatcgatggtcccctttacatgtgctggtttcattactttgtcccccaccaggcacgcgtaacctgttaccttaccttcgtgcggagacccagcatggcgtat

SEQ ID NO: 9039 - DNA, 140 bp, Artificial Sequence
  Synthetic
aggccctggctgctgatatgctggcctttaagcggtcatctaagtatgaccttgaatgcgcgcagatacccgtgcacatgaagtccgacgcttcgaagttcacccatgagaaaccggagggaccttttgggacagcggtg

SEQ ID NO: 9040 - DNA, 140 bp, Artificial Sequence
  Synthetic
caccgctgtcccaaaaggtccctccggtttctcatgggtgaacttcgaagcgtcggacttcatgtgcacgggtatctgcgcgcattcaaggtcatacttagatgaccgcttaaaggccagcatatcagcagccagggcct

SEQ ID NO: 9041 - DNA, 140 bp, Artificial Sequence
  Synthetic
aggccctggctgctgatatggaacatgcctatctccatcgacataccggacgcggccttcactagggtcgtcgacgcgccatctttaacggacatgtcgtgtgaggtaccagcctgcaccgaccttttgggacagcggtg

SEQ ID NO: 9042 - DNA, 140 bp, Artificial Sequence
  Synthetic
caccgctgtcccaaaaggtcggtgcaggctggtacctcacacgacatgtccgttaaagatggcgcgtcgacgaccctagtgaaggccgcgtccggtatgtcgatggagataggcatgttccatatcagcagccagggcct

SEQ ID NO: 9043 - DNA, 140 bp, Artificial Sequence
  Synthetic
aggccctggctgctgatatgaggtacttaagcttcctaaaagcagccgaactcgctttgatgtaggcatagcacaccgaactcttccacgattctccgaacccacagggacgtaggagaagaccttttgggacagcggtg

SEQ ID NO: 9044 - DNA, 140 bp, Artificial Sequence
  Synthetic
caccgctgtcccaaaaggtcttctcctacgtccctgtgggttcggagaatcgtggaagagttcggtgtgctatgcctacatcaaagcgagttcggctgcttttaggaagcttaagtacctcatatcagcagccagggcct

SEQ ID NO: 9045 - DNA, 140 bp, Artificial Sequence
  Synthetic
atacgccatgctgggtctcccggcagtgcaccagcaaggaggatgatgtcggacaggaagtaccactgcgtctgcccgatgcgcagcgcagaagatcccgagagactcgccaattatgcgcgtacttgggagtcggccat

SEQ ID NO: 9046 - DNA, 140 bp, Artificial Sequence
  Synthetic
atggccgactcccaagtacgcgcataattggcgagtctctcgggatcttctgcgctgcgcatcgggcagacgcagtggtacttcctgtccgacatcatcctccttgctggtgcactgccgggagacccagcatggcgtat

SEQ ID NO: 9047 - DNA, 140 bp, Artificial Sequence
  Synthetic
aggccctggctgctgatatgaactgggcagatgagcaggtactgaaggctaagaacataggattatgttcaacagacctgacggaaggtagacgaggcaaattgtctattatgagagggagaccttttgggacagcggtg

SEQ ID NO: 9048 - DNA, 140 bp, Artificial Sequence
  Synthetic
caccgctgtcccaaaaggtctccctctcataatagacaatttgcctcgtctaccttccgtcaggtctgttgaacataatcctatgttcttagccttcagtacctgctcatctgcccagttcatatcagcagccagggcct

SEQ ID NO: 9049 - DNA, 140 bp, Artificial Sequence
  Synthetic
aggccctggctgctgatatgggaaaaaccacagggtatgcggtaacccaccacgcagacggattcttgatgtgtaagactaccgacacggttgacggcgaaagagtgtcattctcggtgtgaccttttgggacagcggtg

SEQ ID NO: 9050 - DNA, 140 bp, Artificial Sequence
  Synthetic
caccgctgtcccaaaaggtcacaccgagaatgacactctttcgccgtcaaccgtgtcggtagtcttacacatcaagaatccgtctgcgtggtgggttaccgcataccctgtggtttttcccatatcagcagccagggcct

SEQ ID NO: 9051 - DNA, 140 bp, Artificial Sequence
  Synthetic
aggccctggctgctgatatggaggtcacgtggggcaacaacgagccgtataagtattggccgcagttatctacaaacggtacagcccatggccacccgcatgagataattctgtattattgaccttttgggacagcggtg

SEQ ID NO: 9052 - DNA, 140 bp, Artificial Sequence
  Synthetic
caccgctgtcccaaaaggtcaataatacagaattatctcatgcgggtggccatgggctgtaccgtttgtagataactgcggccaatacttatacggctcgttgttgccccacgtgacctccatatcagcagccagggcct

SEQ ID NO: 9053 - DNA, 140 bp, Artificial Sequence
  Synthetic
atacgccatgctgggtctccgagaatagtggttaacggcagaacgcaacggaatacgaacaccatgaaaaactatctgcttcccgtggtcgcccaagccctcagtaagtgggcaaaggagcgtacttgggagtcggccat

SEQ ID NO: 9054 - DNA, 140 bp, Artificial Sequence
  Synthetic
atggccgactcccaagtacgctcctttgcccacttactgagggcttgggcgaccacgggaagcagatagtttttcatggtgttcgtattccgttgcgttctgccgttaaccactattctcggagacccagcatggcgtat

SEQ ID NO: 9055 - DNA, 140 bp, Artificial Sequence
  Synthetic
aggccctggctgctgatatgacagctgtaaggtcttcaccggcgtctacccatttatgtggggcggcgcctactgcttctgcgacgctgaaaacacgcagttgagcgaagcacatgtggagaccttttgggacagcggtg

SEQ ID NO: 9056 - DNA, 140 bp, Artificial Sequence
  Synthetic
caccgctgtcccaaaaggtctccacatgtgcttcgctcaactgcgtgttttcagcgtcgcagaagcagtaggcgccgccccacataaatgggtagacgccggtgaagaccttacagctgtcatatcagcagccagggcct

SEQ ID NO: 9057 - DNA, 140 bp, Artificial Sequence
  Synthetic
aggccctggctgctgatatgggcgcaggaagaccaggacaatttggcgatatccaaagtcgcacacctgagagtaaagacgtctatgctaatacacaactggtactgcagagaccggctggaccttttgggacagcggtg

SEQ ID NO: 9058 - DNA, 140 bp, Artificial Sequence
  Synthetic
caccgctgtcccaaaaggtccagccggtctctgcagtaccagttgtgtattagcatagacgtctttactctcaggtgtgcgactttggatatcgccaaattgtcctggtcttcctgcgcccatatcagcagccagggcct

SEQ ID NO: 9059 - DNA, 140 bp, Artificial Sequence
  Synthetic
aggccctggctgctgatatggagtaaagacgtctatgctaatacacaactggtactgcagagaccggctgtgggtacggtacacgtgccatactctcaggcaccatctggctttaagtatgaccttttgggacagcggtg

SEQ ID NO: 9060 - DNA, 140 bp, Artificial Sequence
  Synthetic
caccgctgtcccaaaaggtcatacttaaagccagatggtgcctgagagtatggcacgtgtaccgtacccacagccggtctctgcagtaccagttgtgtattagcatagacgtctttactccatatcagcagccagggcct

SEQ ID NO: 9061 - DNA, 140 bp, Artificial Sequence
  Synthetic
aggccctggctgctgatatgctcagactttgggggcgtcgccattattaaatatgcagccagcaagaaaggcaagtgtgcggtgcattcgatgactaacgccgtcactattcgggaagctgaccttttgggacagcggtg

SEQ ID NO: 9062 - DNA, 140 bp, Artificial Sequence
  Synthetic
caccgctgtcccaaaaggtcagcttcccgaatagtgacggcgttagtcatcgaatgcaccgcacacttgcctttcttgctggctgcatatttaataatggcgacgcccccaaagtctgagcatatcagcagccagggcct

SEQ ID NO: 9063 - DNA, 140 bp, Artificial Sequence
  Synthetic
atacgccatgctgggtctccaaaatagaaaaaccataaacagaagtagtttaaagggctataaaacccctgaatagcaacaaaacataaagttaataaaaatcaaatgaataccataattcgtacttgggagtcggccat

SEQ ID NO: 9064 - DNA, 140 bp, Artificial Sequence
  Synthetic
atggccgactcccaagtacgaattatggtattcatttgatttttattaactttatgttttgttgctattcaggggttttatagccctttaaactacttctgtttatggtttttctattttggagacccagcatggcgtat

SEQ ID NO: 9065 - DNA, 140 bp, Artificial Sequence
  Synthetic
aggccctggctgctgatatgctgtcgcgccgcccagaagaaggcgagggagaaacctgactgtgacatgcgacgagagagaagggaacataacacccatggctagcgtccgattctttaggaccttttgggacagcggtg

SEQ ID NO: 9066 - DNA, 140 bp, Artificial Sequence
  Synthetic
caccgctgtcccaaaaggtcctaaagaatcggacgctagccatgggtgttatgttcccttctctctcgtcgcatgtcacagtcaggtttctccctcgccttcttctgggcggcgcgacagcatatcagcagccagggcct

SEQ ID NO: 9067 - DNA, 140 bp, Artificial Sequence
  Synthetic
aggccctggctgctgatatgggcaaacggaagagatgtaggtacttaagcttcctaaaagcagccgaactcactttgagaagtaggcatagcataccgaactcttccacgattctccgaagaccttttgggacagcggtg

SEQ ID NO: 9068 - DNA, 140 bp, Artificial Sequence
  Synthetic
caccgctgtcccaaaaggtcttcggagaatcgtggaagagttcggtatgctatgcctacttctcaaagtgagttcggctgcttttaggaagcttaagtacctacatctcttccgtttgcccatatcagcagccagggcct

SEQ ID NO: 9069 - DNA, 140 bp, Artificial Sequence
  Synthetic
atacgccatgctgggtctccagcagagctgcgtccggtcgcacaagaaacagcggagacgcgtgacacagcaacgtctcttcaggcaccgccgagtaccgccacggaactgaatcatccgcgtacttgggagtcggccat

SEQ ID NO: 9070 - DNA, 140 bp, Artificial Sequence
  Synthetic
atggccgactcccaagtacgcggatgattcagttccgtggcggtactcggcggtgcctgaagagacgttgctgtgtcacgcgtctccgctgtttcttgtgcgaccggacgcagctctgctggagacccagcatggcgtat

SEQ ID NO: 9071 - DNA, 140 bp, Artificial Sequence
  Synthetic
atacgccatgctgggtctccatggctgcgtgagacacacgtagcctaccagtttcttactgctctactctgcaaagcaagagattaagaacccatcatggatcctgtgtacgtggacatacgtacttgggagtcggccat

SEQ ID NO: 9072 - DNA, 140 bp, Artificial Sequence
  Synthetic
atggccgactcccaagtacgtatgtccacgtacacaggatccatgatgggttcttaatctcttgctttgcagagtagagcagtaagaaactggtaggctacgtgtgtctcacgcagccatggagacccagcatggcgtat

SEQ ID NO: 9073 - DNA, 140 bp, Artificial Sequence
  Synthetic
aggccctggctgctgatatggcaaagcaagagattaagaacccatcatggatcctgtgtacgtggacatagacgctgacagcgcctttttgaaggccctgcaacgtgcgtaccccatgttgaccttttgggacagcggtg

SEQ ID NO: 9074 - DNA, 140 bp, Artificial Sequence
  Synthetic
caccgctgtcccaaaaggtcaacatggggtacgcacgttgcagggccttcaaaaaggcgctgtcagcgtctatgtccacgtacacaggatccatgatgggttcttaatctcttgctttgccatatcagcagccagggcct

SEQ ID NO: 9075 - DNA, 140 bp, Artificial Sequence
  Synthetic
aggccctggctgctgatatggacgctgacagcgcctttttgaaggccctgcaacgtgcgtaccccatgtttgaggtggaacctaggcaggtcacaccgaatgaccatgctaatgctagaggaccttttgggacagcggtg

SEQ ID NO: 9076 - DNA, 140 bp, Artificial Sequence
  Synthetic
caccgctgtcccaaaaggtcctctagcattagcatggtcattcggtgtgacctgcctaggttccacctcaaacatggggtacgcacgttgcagggccttcaaaaaggcgctgtcagcgtccatatcagcagccagggcct

SEQ ID NO: 9077 - DNA, 140 bp, Artificial Sequence
  Synthetic
aggccctggctgctgatatggacagagagcagacgtcgcgatataccaagacgtctatgctgtacacgcacccacgtcgctataccaccaggcgattaaaggggtccgattggcgtactggaccttttgggacagcggtg

SEQ ID NO: 9078 - DNA, 140 bp, Artificial Sequence
  Synthetic
caccgctgtcccaaaaggtccagtacgccaatcggacccctttaatcgcctggtggtatagcgacgtgggtgcgtgtacagcatagacgtcttggtatatcgcgacgtctgctctctgtccatatcagcagccagggcct

SEQ ID NO: 9079 - DNA, 140 bp, Artificial Sequence
  Synthetic
aggccctggctgctgatatgttggtggggctgaaccagagaatagtggttaacggcagaacgcaacggaatacgaacaccatgaaaaactatatgattcccgtggtcgcccaagccttcagaccttttgggacagcggtg

SEQ ID NO: 9080 - DNA, 140 bp, Artificial Sequence
  Synthetic
caccgctgtcccaaaaggtctgaaggcttgggcgaccacgggaatcatatagtttttcatggtgttcgtattccgttgcgttctgccgttaaccactattctctggttcagccccaccaacatatcagcagccagggcct

SEQ ID NO: 9081 - DNA, 140 bp, Artificial Sequence
  Synthetic
aggccctggctgctgatatgtgacgaagtgatcagatggcaacgaacagggctaattgatgagttggagaaagcggtatactctaggtatgaagtgcagggtatatcagttgtggtaatggaccttttgggacagcggtg

SEQ ID NO: 9082 - DNA, 140 bp, Artificial Sequence
  Synthetic
caccgctgtcccaaaaggtccattaccacaactgatataccctgcacttcatacctagagtataccgctttctccaactcatcaattagccctgttcgttgccatctgatcacttcgtcacatatcagcagccagggcct

SEQ ID NO: 9083 - DNA, 140 bp, Artificial Sequence
  Synthetic
aggccctggctgctgatatgggggtactacaactggcaccacggagcagtacagtactcaggaggccggttcaccatccccacaggtgctggcaaaccaggggacagcggcagaccgatcgaccttttgggacagcggtg

SEQ ID NO: 9084 - DNA, 140 bp, Artificial Sequence
  Synthetic
caccgctgtcccaaaaggtcgatcggtctgccgctgtcccctggtttgccagcacctgtggggatggtgaaccggcctcctgagtactgtactgctccgtggtgccagttgtagtacccccatatcagcagccagggcct

SEQ ID NO: 9085 - DNA, 140 bp, Artificial Sequence
  Synthetic
aggccctggctgctgatatgatgtgcctgttggcaaacaccacgttcccctgctcccagcccccttgcacaccctgctgctacgaaaaggaaccagaggaaaccctacgcatgcttgagggaccttttgggacagcggtg

SEQ ID NO: 9086 - DNA, 140 bp, Artificial Sequence
  Synthetic
caccgctgtcccaaaaggtccctcaagcatgcgtagggtttcctctggttccttttcgtagcagcagggtgtgcaagggggctgggagcaggggaacgtggtgtttgccaacaggcacatcatatcagcagccagggcct

SEQ ID NO: 9087 - DNA, 140 bp, Artificial Sequence
  Synthetic
aggccctggctgctgatatggacgggacgctgaaaatccaggtctccttgcaaatcggaataaagacggatggtagccacgattggaccaagctgcgttacatggacaaccacatgccaggaccttttgggacagcggtg

SEQ ID NO: 9088 - DNA, 140 bp, Artificial Sequence
  Synthetic
caccgctgtcccaaaaggtcctggcatgtggttgtccatgtaacgcagcttggtccaatcgtggctaccatccgtctttattccgatttgcaaggagacctggattttcagcgtcccgtccatatcagcagccagggcct

SEQ ID NO: 9089 - DNA, 140 bp, Artificial Sequence
  Synthetic
atacgccatgctgggtctccaaagtatctccaggcggtgtacactgcctgtgactgccattgtgtcatcgttgcattacgaaggcaaaatgcgcactacgaatgagtacaacaagccgatcgtacttgggagtcggccat

SEQ ID NO: 9090 - DNA, 140 bp, Artificial Sequence
  Synthetic
atggccgactcccaagtacgatcggcttgttgtactcattcgtagtgcgcattttgccttcgtaatgcaacgatgacacaatggcagtcacaggcagtgtacaccgcctggagatactttggagacccagcatggcgtat

SEQ ID NO: 9091 - DNA, 140 bp, Artificial Sequence
  Synthetic
aggccctggctgctgatatgcagagcacgtcaacgtactcctaacgcgtacggaaggtaaactggtatggaagacactctccggtgacccgtggataaagacgctgcagaacccaccgaagaccttttgggacagcggtg

SEQ ID NO: 9092 - DNA, 140 bp, Artificial Sequence
  Synthetic
caccgctgtcccaaaaggtcttcggtgggttctgcagcgtctttatccacgggtcaccggagagtgtcttccataccagtttaccttccgtacgcgttaggagtacgttgacgtgctctgcatatcagcagccagggcct

SEQ ID NO: 9093 - DNA, 140 bp, Artificial Sequence
  Synthetic
aggccctggctgctgatatgtaatggcgggcatctgcagtcaccaaatgacctttgatacattccaaaacaaagccaacgtttgttgggctaagagtttggtccctatcctcgaaacagcgaccttttgggacagcggtg

SEQ ID NO: 9094 - DNA, 140 bp, Artificial Sequence
  Synthetic
caccgctgtcccaaaaggtcgctgtttcgaggatagggaccaaactcttagcccaacaaacgttggctttgttttggaatgtatcaaaggtcatttggtgactgcagatgcccgccattacatatcagcagccagggcct

SEQ ID NO: 9095 - DNA, 140 bp, Artificial Sequence
  Synthetic
atacgccatgctgggtctccgtctgtgtattacgcggataaccactgggataataggcctggagggaagatgttcggattcaaccccgaggcagcatccattctagaaagaaagtatccacgtacttgggagtcggccat

SEQ ID NO: 9096 - DNA, 140 bp, Artificial Sequence
  Synthetic
atggccgactcccaagtacgtggatactttctttctagaatggatgctgcctcggggttgaatccgaacatcttccctccaggcctattatcccagtggttatccgcgtaatacacagacggagacccagcatggcgtat

SEQ ID NO: 9097 - DNA, 140 bp, Artificial Sequence
  Synthetic
aggccctggctgctgatatgtaggtgtccgcggagcggactatacatacaacctagagttgggtctgccagcaacgcttggtaggtatgacctagtggtcataaacatccacacacctttgaccttttgggacagcggtg

SEQ ID NO: 9098 - DNA, 140 bp, Artificial Sequence
  Synthetic
caccgctgtcccaaaaggtcaaaggtgtgtggatgtttatgaccactaggtcatacctaccaagcgttgctggcagacccaactctaggttgtatgtatagtccgctccgcggacacctacatatcagcagccagggcct

SEQ ID NO: 9099 - DNA, 140 bp, Artificial Sequence
  Synthetic
atacgccatgctgggtctccacgcgccctctttaacggacatgtcgtgcgaggtaccagcctgcacccattcctcagatttcgggggcgtcgccattattaaatatgcagccagcaagaacgtacttgggagtcggccat

SEQ ID NO: 9100 - DNA, 140 bp, Artificial Sequence
  Synthetic
atggccgactcccaagtacgttcttgctggctgcatatttaataatggcgacgcccccgaaatctgaggaatgggtgcaggctggtacctcgcacgacatgtccgttaaagagggcgcgtggagacccagcatggcgtat

SEQ ID NO: 9101 - DNA, 140 bp, Artificial Sequence
  Synthetic
aggccctggctgctgatatggcaacgcttggtaggtatgacctagtggtcataaacatccacacaccttttcgcatacaccattatcaacagtgcgtagaccacgcaatgaaactgcaaagaccttttgggacagcggtg

SEQ ID NO: 9102 - DNA, 140 bp, Artificial Sequence
  Synthetic
caccgctgtcccaaaaggtctttgcagtttcattgcgtggtctacgcactgttgataatggtgtatgcgaaaaggtgtgtggatgtttatgaccactaggtcatacctaccaagcgttgccatatcagcagccagggcct

SEQ ID NO: 9103 - DNA, 140 bp, Artificial Sequence
  Synthetic
aggccctggctgctgatatgctaccagtttcttactgctctactctgcaaagcaagagattaataacccatcatggatcctgtgtacgtggacatagacgctgacagcgccttcttgaaggaccttttgggacagcggtg

SEQ ID NO: 9104 - DNA, 140 bp, Artificial Sequence
  Synthetic
caccgctgtcccaaaaggtccttcaagaaggcgctgtcagcgtctatgtccacgtacacaggatccatgatgggttattaatctcttgctttgcagagtagagcagtaagaaactggtagcatatcagcagccagggcct

SEQ ID NO: 9105 - DNA, 140 bp, Artificial Sequence
  Synthetic
atacgccatgctgggtctcctggatatcgcgaagaacgatgaagagtgcgtagtcaacgccgccaaccctcgcgggttaccaggtgacggtgtttgcaaggcagtatacaaaaaatggcccgtacttgggagtcggccat

SEQ ID NO: 9106 - DNA, 140 bp, Artificial Sequence
  Synthetic
atggccgactcccaagtacgggccattttttgtatactgccttgcaaacaccgtcacctggtaacccgcgagggttggcggcgttgactacgcactcttcatcgttcttcgcgatatccaggagacccagcatggcgtat

SEQ ID NO: 9107 - DNA, 140 bp, Artificial Sequence
  Synthetic
atacgccatgctgggtctccggagtcctttaagaacagtgcaacaccagtgggaaccgcaaaaacagtcatgtgcggtacgtatccagtaatccacgccgttggaccaaacttctctaatcgtacttgggagtcggccat

SEQ ID NO: 9108 - DNA, 140 bp, Artificial Sequence
  Synthetic
atggccgactcccaagtacgattagagaagtttggtccaacggcgtggattactggatacgtaccgcacatgactgtttttgcggttcccactggtgttgcactgttcttaaaggactccggagacccagcatggcgtat

SEQ ID NO: 9109 - DNA, 140 bp, Artificial Sequence
  Synthetic
atacgccatgctgggtctccgaggcctgatacccagtcaattcagaaggttcaggccgagtttgacagctttgtggtaccgagtctgtgttcgtccgggttgtcaatccctttgaggactcgtacttgggagtcggccat

SEQ ID NO: 9110 - DNA, 140 bp, Artificial Sequence
  Synthetic
atggccgactcccaagtacgagtcctcaaagggattgacaacccggacgaacacagactcggtaccacaaagctgtcaaactcggcctgaaccttctgaattgactgggtatcaggcctcggagacccagcatggcgtat

SEQ ID NO: 9111 - DNA, 140 bp, Artificial Sequence
  Synthetic
aggccctggctgctgatatgagaatcaaatggttgttaagcaaggtgccaaaaaccgacctgatcccatacagcggagacgcccaagaagcccgggacgcagaaaaagaagcagaggaaggaccttttgggacagcggtg

SEQ ID NO: 9112 - DNA, 140 bp, Artificial Sequence
  Synthetic
caccgctgtcccaaaaggtccttcctctgcttctttttctgcgtcccgggcttcttgggcgtctccgctgtatgggatcaggtcggtttttggcaccttgcttaacaaccatttgattctcatatcagcagccagggcct

SEQ ID NO: 9113 - DNA, 140 bp, Artificial Sequence
  Synthetic
atacgccatgctgggtctccgttcgcgtgcaccctgacagcagcttggcaggcagaaaaggatacagcaccacggaaggcgcactgtactcatatctagaagggacccgttttcaccaaacgtacttgggagtcggccat

SEQ ID NO: 9114 - DNA, 140 bp, Artificial Sequence
  Synthetic
atggccgactcccaagtacgtttggtgaaaacgggtcccttctagatatgagtacagtgcgccttccgtggtgctgtatccttttctgcctgccaagctgctgtcagggtgcacgcgaacggagacccagcatggcgtat

SEQ ID NO: 9115 - DNA, 140 bp, Artificial Sequence
  Synthetic
aggccctggctgctgatatgcaggcagaaatgcccggtggatgatgcagatgcatcatctcccccgaaactgtcccgtgcctctgccgttacgccatgacaccagaacgcgttacccgacgaccttttgggacagcggtg

SEQ ID NO: 9116 - DNA, 140 bp, Artificial Sequence
  Synthetic
caccgctgtcccaaaaggtcgtcgggtaacgcgttctggtgtcatggcgtaacggcagaggcacgggacagtttcgggggagatgatgcatctgcatcatccaccgggcatttctgcctgcatatcagcagccagggcct

SEQ ID NO: 9117 - DNA, 140 bp, Artificial Sequence
  Synthetic
atacgccatgctgggtctccccgaatcatgcaaaacagaatttgcatcagcatacagggctcataccgcatctgcatcagctaagctccgcgtcctttaccaaggaaacaacatcactgtcgtacttgggagtcggccat

SEQ ID NO: 9118 - DNA, 140 bp, Artificial Sequence
  Synthetic
atggccgactcccaagtacgacagtgatgttgtttccttggtaaaggacgcggagcttagctgatgcagatgcggtatgagccctgtatgctgatgcaaattctgttttgcatgattcggggagacccagcatggcgtat

SEQ ID NO: 9119 - DNA, 140 bp, Artificial Sequence
  Synthetic
atacgccatgctgggtctcccttcccaggagtctgtacaggaagcgagtacgaccacgtcactgacgcatagccaattcgatctaagcgttgacggcaagatactgcccgtcccgtcagacgtacttgggagtcggccat

SEQ ID NO: 9120 - DNA, 140 bp, Artificial Sequence
  Synthetic
atggccgactcccaagtacgtctgacgggacgggcagtatcttgccgtcaacgcttagatcgaattggctatgcgtcagtgacgtggtcgtactcgcttcctgtacagactcctgggaagggagacccagcatggcgtat

SEQ ID NO: 9121 - DNA, 140 bp, Artificial Sequence
  Synthetic
atacgccatgctgggtctcccctggatgctgacgccccagccctagaaccagcccttgacgacggggcgatacacacgttgccatctgcaaccggaaaccttgcggccgtgtctgactggcgtacttgggagtcggccat

SEQ ID NO: 9122 - DNA, 140 bp, Artificial Sequence
  Synthetic
atggccgactcccaagtacgccagtcagacacggccgcaaggtttccggttgcagatggcaacgtgtgtatcgccccgtcgtcaagggctggttctagggctggggcgtcagcatccaggggagacccagcatggcgtat

SEQ ID NO: 9123 - DNA, 140 bp, Artificial Sequence
  Synthetic
aggccctggctgctgatatgagatagcgactggtccacgtgctcagacacggacgacgagttacgactagacagggcaggtgggtatatattctcgtcggacactggtccaggtcatttagaccttttgggacagcggtg

SEQ ID NO: 9124 - DNA, 140 bp, Artificial Sequence
  Synthetic
caccgctgtcccaaaaggtctaaatgacctggaccagtgtccgacgagaatatatacccacctgccctgtctagtcgtaactcgtcgtccgtgtctgagcacgtggaccagtcgctatctcatatcagcagccagggcct

SEQ ID NO: 9125 - DNA, 140 bp, Artificial Sequence
  Synthetic
aggccctggctgctgatatggtcagacctggatgctgacgccccagccctagaaccagcactagacgacggggcgacacacacgctgccatccacaaccggaaaccttgcggccgtgtctgaccttttgggacagcggtg

SEQ ID NO: 9126 - DNA, 140 bp, Artificial Sequence
  Synthetic
caccgctgtcccaaaaggtcagacacggccgcaaggtttccggttgtggatggcagcgtgtgtgtcgccccgtcgtctagtgctggttctagggctggggcgtcagcatccaggtctgaccatatcagcagccagggcct

SEQ ID NO: 9127 - DNA, 140 bp, Artificial Sequence
  Synthetic
atacgccatgctgggtctccatggctgcgtgagacacacgtagcctaccagtttcttactgctctactctgcaaagcaagagaataataacccatcatggatcctgtgtacgtggacatacgtacttgggagtcggccat

SEQ ID NO: 9128 - DNA, 140 bp, Artificial Sequence
  Synthetic
atggccgactcccaagtacgtatgtccacgtacacaggatccatgatgggttattattctcttgctttgcagagtagagcagtaagaaactggtaggctacgtgtgtctcacgcagccatggagacccagcatggcgtat

SEQ ID NO: 9129 - DNA, 140 bp, Artificial Sequence
  Synthetic
atacgccatgctgggtctccctacctaccggaccacatatccggcgcctgtgtactcgcctccgattaacgtccgactgtccaaccccgagtccgcagtggcagcatgcaatgagttcttcgtacttgggagtcggccat

SEQ ID NO: 9130 - DNA, 140 bp, Artificial Sequence
  Synthetic
atggccgactcccaagtacgaagaactcattgcatgctgccactgcggactcggggttggacagtcggacgttaatcggaggcgagtacacaggcgccggatatgtggtccggtaggtagggagacccagcatggcgtat

SEQ ID NO: 9131 - DNA, 140 bp, Artificial Sequence
  Synthetic
atacgccatgctgggtctcctatcagttgtggtaatgtccatggccacctttgcaagctccagatccaagttcgagaagctcataggacccgtcataagtatgtacggcggtcctaaatacgtacttgggagtcggccat

SEQ ID NO: 9132 - DNA, 140 bp, Artificial Sequence
  Synthetic
atggccgactcccaagtacgtatttaggaccgccgtacatacttatgacgggtcctatgagcttctcgaacttggatctggagcttgcaaaggtggccatggacattaccacaactgataggagacccagcatggcgtat

SEQ ID NO: 9133 - DNA, 140 bp, Artificial Sequence
  Synthetic
aggccctggctgctgatatgtcacgccggaggatgcacagaagctgttggtggggctgaaccagagaatagtggttaacggtagaacgcaacggaatatgaacaccatgaaaaattatctgaccttttgggacagcggtg

SEQ ID NO: 9134 - DNA, 140 bp, Artificial Sequence
  Synthetic
caccgctgtcccaaaaggtcagataatttttcatggtgttcatattccgttgcgttctaccgttaaccactattctctggttcagccccaccaacagcttctgtgcatcctccggcgtgacatatcagcagccagggcct

SEQ ID NO: 9135 - DNA, 140 bp, Artificial Sequence
  Synthetic
aggccctggctgctgatatgttgtggtaccgagtctgtggtcgtccgggttgtcaatccctttgaggactagaatcaaatggttgttaagcaaggtgccaaaaaccgacctaatcccatagaccttttgggacagcggtg

SEQ ID NO: 9136 - DNA, 140 bp, Artificial Sequence
  Synthetic
caccgctgtcccaaaaggtctatgggattaggtcggtttttggcaccttgcttaacaaccatttgattctagtcctcaaagggattgacaacccggacgaccacagactcggtaccacaacatatcagcagccagggcct

SEQ ID NO: 9137 - DNA, 140 bp, Artificial Sequence
  Synthetic
atacgccatgctgggtctcccagcggagacgcccgagaagcccgggacgcagaaaaagaagcagaggaagaacgagaagcagaactgactcgcgaagccctaccacgtctacaggcagcacgtacttgggagtcggccat

SEQ ID NO: 9138 - DNA, 140 bp, Artificial Sequence
  Synthetic
atggccgactcccaagtacgtgctgcctgtagacgtggtagggcttcgcgagtcagttctgcttctcgttcttcctctgcttctttttctgcgtcccgggcttctcgggcgtctccgctgggagacccagcatggcgtat

SEQ ID NO: 9139 - DNA, 140 bp, Artificial Sequence
  Synthetic
aggccctggctgctgatatgtggatcactccctgttggacttgatagaggctgctttcggagagatttccagctgtcatctaccgacaggtacgcgcttcaagttcggcgccatgatgaagaccttttgggacagcggtg

SEQ ID NO: 9140 - DNA, 140 bp, Artificial Sequence
  Synthetic
caccgctgtcccaaaaggtcttcatcatggcgccgaacttgaagcgcgtacctgtcggtagatgacagctggaaatctctccgaaagcagcctctatcaagtccaacagggagtgatccacatatcagcagccagggcct

SEQ ID NO: 9141 - DNA, 140 bp, Artificial Sequence
  Synthetic
atacgccatgctgggtctccggcagccagatgcgccacttggatgaacatggaagtgaagatcatagatgcagttgtatcccagaaagccccttacttttgtggagggtttatactgcaccgtacttgggagtcggccat

SEQ ID NO: 9142 - DNA, 140 bp, Artificial Sequence
  Synthetic
atggccgactcccaagtacggtgcagtataaaccctccacaaaagtaaggggctttctgggatacaactgcatctatgatcttcacttccatgttcatccaagtggcgcatctggctgccggagacccagcatggcgtat

SEQ ID NO: 9143 - DNA, 140 bp, Artificial Sequence
  Synthetic
aggccctggctgctgatatgcagttgtatcccagaaagccccttacttttgtggagggtttatactgcacgatatcgtgacaggaacagcttgcagagtggcagacccgctaaaaaggctgaccttttgggacagcggtg

SEQ ID NO: 9144 - DNA, 140 bp, Artificial Sequence
  Synthetic
caccgctgtcccaaaaggtcagcctttttagcgggtctgccactctgcaagctgttcctgtcacgatatcgtgcagtataaaccctccacaaaagtaaggggctttctgggatacaactgcatatcagcagccagggcct

SEQ ID NO: 9145 - DNA, 140 bp, Artificial Sequence
  Synthetic
atacgccatgctgggtctcccgctgaaaatccaggtctccttgcaaatcggaataaagacggatgacagccacgatcggaccaagctgcgttatatggacaaccacatgccagcagacgccgtacttgggagtcggccat

SEQ ID NO: 9146 - DNA, 140 bp, Artificial Sequence
  Synthetic
atggccgactcccaagtacggcgtctgctggcatgtggttgtccatataacgcagcttggtccgatcgtggctgtcatccgtctttattccgatttgcaaggagacctggattttcagcgggagacccagcatggcgtat

SEQ ID NO: 9147 - DNA, 140 bp, Artificial Sequence
  Synthetic
aggccctggctgctgatatgatcagttgtggtaatgtccatggccacctttgcaagctccagatccaacttcgagaagctcagaggacccgtcgtaactttgtacggcggtcctaaataggaccttttgggacagcggtg

SEQ ID NO: 9148 - DNA, 140 bp, Artificial Sequence
  Synthetic
caccgctgtcccaaaaggtcctatttaggaccgccgtacaaagttacgacgggtcctctgagcttctcgaagttggatctggagcttgcaaaggtggccatggacattaccacaactgatcatatcagcagccagggcct

SEQ ID NO: 9149 - DNA, 140 bp, Artificial Sequence
  Synthetic
atacgccatgctgggtctcctcaaccatcctggatatcggcagtgcgccagcaaggaggaggatgtcggacaggaagtaccactgcgtctccccgatgcgcagtgcggaagatcccgagacgtacttgggagtcggccat

SEQ ID NO: 9150 - DNA, 140 bp, Artificial Sequence
  Synthetic
atggccgactcccaagtacgtctcgggatcttccgcactgcgcatcggggagacgcagtggtacttcctgtccgacatcctcctccttgctggcgcactgccgatatccaggatggttgaggagacccagcatggcgtat

SEQ ID NO: 9151 - DNA, 140 bp, Artificial Sequence
  Synthetic
atacgccatgctgggtctccggcccagaccgcgcccgcagaggcaagctgggcaacttgcccagctgatctcagcagttaataaactgacaatgcgcgcggtaccccaacagaagccacgcgtacttgggagtcggccat

SEQ ID NO: 9152 - DNA, 140 bp, Artificial Sequence
  Synthetic
atggccgactcccaagtacgcgtggcttctgttggggtaccgcgcgcattgtcagtttattaactgctgagatcagctgggcaagttgcccagcttgcctctgcgggcgcggtctgggccggagacccagcatggcgtat

SEQ ID NO: 9153 - DNA, 140 bp, Artificial Sequence
  Synthetic
aggccctggctgctgatatggttctatgcaactgtctgagactcttaccatgctgctgtaaaacgttggcttttttagctgtaatgagcgtcggtgcccacactgtgagcgcgtacgaacgaccttttgggacagcggtg

SEQ ID NO: 9154 - DNA, 140 bp, Artificial Sequence
  Synthetic
caccgctgtcccaaaaggtcgttcgtacgcgctcacagtgtgggcaccgacgctcattacagctaaaaaagccaacgttttacagcagcatggtaagagtctcagacagttgcatagaaccatatcagcagccagggcct

SEQ ID NO: 9155 - DNA, 140 bp, Artificial Sequence
  Synthetic
aggccctggctgctgatatgcccacattctgcttgcacactgacgtctcatgtagacaaagggcggacgtcgctatatatcaggacgtctacgccgtgcatgcaccaacatcgctataccgaccttttgggacagcggtg

SEQ ID NO: 9156 - DNA, 140 bp, Artificial Sequence
  Synthetic
caccgctgtcccaaaaggtcggtatagcgatgttggtgcatgcacggcgtagacgtcctgatatatagcgacgtccgccctttgtctacatgagacgtcagtgtgcaagcagaatgtgggcatatcagcagccagggcct

SEQ ID NO: 9157 - DNA, 140 bp, Artificial Sequence
  Synthetic
aggccctggctgctgatatgcccatgagaaaccggaggggtactacaactggcaccacggagcagtacagtactcaggaggccggttcaccatccctacaggtgcgggcaaaccaggggagaccttttgggacagcggtg

SEQ ID NO: 9158 - DNA, 140 bp, Artificial Sequence
  Synthetic
caccgctgtcccaaaaggtctcccctggtttgcccgcacctgtagggatggtgaaccggcctcctgagtactgtactgctccgtggtgccagttgtagtacccctccggtttctcatgggcatatcagcagccagggcct

SEQ ID NO: 9159 - DNA, 140 bp, Artificial Sequence
  Synthetic
atacgccatgctgggtctccaaactgggcagatgagcaggtgctgaaggcaaagaacataggattatgttcaacagacctgacggaaggtagacgaggtaaactgtctatcatgagaggacgtacttgggagtcggccat

SEQ ID NO: 9160 - DNA, 140 bp, Artificial Sequence
  Synthetic
atggccgactcccaagtacgtcctctcatgatagacagtttacctcgtctaccttccgtcaggtctgttgaacataatcctatgttctttgccttcagcacctgctcatctgcccagtttggagacccagcatggcgtat

SEQ ID NO: 9161 - DNA, 140 bp, Artificial Sequence
  Synthetic
atacgccatgctgggtctccaaaaaaatgaagccatgtgaccgcgtactgttctcagtcgggtcaacgctttacccggagagccgtaagcttcttaagagttggcacttaccttcagtgtcgtacttgggagtcggccat

SEQ ID NO: 9162 - DNA, 140 bp, Artificial Sequence
  Synthetic
atggccgactcccaagtacgacactgaaggtaagtgccaactcttaagaagcttacggctctccgggtaaagcgttgacccgactgagaacagtacgcggtcacatggcttcatttttttggagacccagcatggcgtat

SEQ ID NO: 9163 - DNA, 140 bp, Artificial Sequence
  Synthetic
atacgccatgctgggtctcctcttgccatcccagttatgtgcctgttggcaaataccacgttcccctgctcccagcccccttgcataccctgctgctacgaaaaggaaccggaggaaacccgtacttgggagtcggccat

SEQ ID NO: 9164 - DNA, 140 bp, Artificial Sequence
  Synthetic
atggccgactcccaagtacgggtttcctccggttccttttcgtagcagcagggtatgcaagggggctgggagcaggggaacgtggtatttgccaacaggcacataactgggatggcaagaggagacccagcatggcgtat

SEQ ID NO: 9165 - DNA, 140 bp, Artificial Sequence
  Synthetic
atacgccatgctgggtctcctccacctaaaagggaagctcagcttcacgtgccgctgtgatacagtggtttcgtgtgaaggctatgtcgttaagagaataacgattagcccgggcctctacgtacttgggagtcggccat

SEQ ID NO: 9166 - DNA, 140 bp, Artificial Sequence
  Synthetic
atggccgactcccaagtacgtagaggcccgggctaatcgttattctcttaacgacatagccttcacacgaaaccactgtatcacagcggcacgtgaagctgagcttcccttttaggtggaggagacccagcatggcgtat

SEQ ID NO: 9167 - DNA, 140 bp, Artificial Sequence
  Synthetic
aggccctggctgctgatatgtcgtgtgaaggctatgtcgttaagagaataacgattagcccgggcctctacggtgaaacctcagggtacgcagtaacccaccatgcagacggattcctaagaccttttgggacagcggtg

SEQ ID NO: 9168 - DNA, 140 bp, Artificial Sequence
  Synthetic
caccgctgtcccaaaaggtcttaggaatccgtctgcatggtgggttactgcgtaccctgaggtttcaccgtagaggcccgggctaatcgttattctcttaacgacatagccttcacacgacatatcagcagccagggcct

SEQ ID NO: 9169 - DNA, 140 bp, Artificial Sequence
  Synthetic
aggccctggctgctgatatgtgtgcaaaacaaccgatacggtagatggcgagagagtgtcattttcggtatgcacgtacgtacccgcaaccatttgtgatcaaatgacaggtatccttgcgaccttttgggacagcggtg

SEQ ID NO: 9170 - DNA, 140 bp, Artificial Sequence
  Synthetic
caccgctgtcccaaaaggtcgcaaggatacctgtcatttgatcacaaatggttgcgggtacgtacgtgcataccgaaaatgacactctctcgccatctaccgtatcggttgttttgcacacatatcagcagccagggcct

SEQ ID NO: 9171 - DNA, 140 bp, Artificial Sequence
  Synthetic
aggccctggctgctgatatgcccagcccccttgcataccctgctgctacgaaaaggaaccggaggaaaccctacgcatgcttgaggacaacgtcatgagacctgggtactatcagctgctgaccttttgggacagcggtg

SEQ ID NO: 9172 - DNA, 140 bp, Artificial Sequence
  Synthetic
caccgctgtcccaaaaggtcagcagctgatagtacccaggtctcatgacgttgtcctcaagcatgcgtagggtttcctccggttccttttcgtagcagcagggtatgcaagggggctgggcatatcagcagccagggcct

SEQ ID NO: 9173 - DNA, 140 bp, Artificial Sequence
  Synthetic
atacgccatgctgggtctccttggaatagggacggatgatagccatgattggaccaagctgcgttacatggacaatcacataccagcagacgcagggagggccgggctatttgtaagaaccgtacttgggagtcggccat

SEQ ID NO: 9174 - DNA, 140 bp, Artificial Sequence
  Synthetic
atggccgactcccaagtacggttcttacaaatagcccggccctccctgcgtctgctggtatgtgattgtccatgtaacgcagcttggtccaatcatggctatcatccgtccctattccaaggagacccagcatggcgtat

SEQ ID NO: 9175 - DNA, 140 bp, Artificial Sequence
  Synthetic
atacgccatgctgggtctcccacggaggttacaccggaggatgcacagaagctgctggtgggactgaaccagagaatagtggtcaatggcagaacgcagaggaacacgaacacaatgaagcgtacttgggagtcggccat

SEQ ID NO: 9176 - DNA, 140 bp, Artificial Sequence
  Synthetic
atggccgactcccaagtacgcttcattgtgttcgtgttcctctgcgttctgccattgaccactattctctggttcagtcccaccagcagcttctgtgcatcctccggtgtaacctccgtgggagacccagcatggcgtat

SEQ ID NO: 9177 - DNA, 140 bp, Artificial Sequence
  Synthetic
atacgccatgctgggtctccatcagcaccatgcacgattactggaacaatgggacacttcatcctggcccgatgtccgaaaggagaaactctgacggtgggattcactgacagtaggaagcgtacttgggagtcggccat

SEQ ID NO: 9178 - DNA, 140 bp, Artificial Sequence
  Synthetic
atggccgactcccaagtacgcttcctactgtcagtgaatcccaccgtcagagtttctcctttcggacatcgggccaggatgaagtgtcccattgttccagtaatcgtgcatggtgctgatggagacccagcatggcgtat

SEQ ID NO: 9179 - DNA, 140 bp, Artificial Sequence
  Synthetic
aggccctggctgctgatatggtctacaagaggcctgacactcagtcaattcagaaagtcccagccgaatttgacagctttgtggtaccaggtctgtggtcatctggactgtcgatcccgcgaccttttgggacagcggtg

SEQ ID NO: 9180 - DNA, 140 bp, Artificial Sequence
  Synthetic
caccgctgtcccaaaaggtcgcgggatcgacagtccagatgaccacagacctggtaccacaaagctgtcaaattcggctgggactttctgaattgactgagtgtcaggcctcttgtagaccatatcagcagccagggcct

SEQ ID NO: 9181 - DNA, 140 bp, Artificial Sequence
  Synthetic
atacgccatgctgggtctccgtcgacgtgttgtacgtcgacgaagcgtttgcgtgccattctggcacgctacttgccctgatagccttggtgagaccgaggcagaaagtcgtgctatgcgcgtacttgggagtcggccat

SEQ ID NO: 9182 - DNA, 140 bp, Artificial Sequence
  Synthetic
atggccgactcccaagtacgcgcatagcacgactttctgcctcggtctcaccaaggctatcagggcaagtagcgtgccagaatggcacgcaaacgcttcgtcgacgtacaacacgtcgacggagacccagcatggcgtat

SEQ ID NO: 9183 - DNA, 140 bp, Artificial Sequence
  Synthetic
aggccctggctgctgatatgatgcccccagacacccctgatcgcacattgctgtcacaacagtccggcaacgtaaagatcacagtcaacggccggacggtgcggtataagtgtaattgcggaccttttgggacagcggtg

SEQ ID NO: 9184 - DNA, 140 bp, Artificial Sequence
  Synthetic
caccgctgtcccaaaaggtccgcaattacacttataccgcaccgtccggccgttgactgtgatctttacgttgccggactgttgtgacagcaatgtgcgatcaggggtgtctgggggcatcatatcagcagccagggcct

SEQ ID NO: 9185 - DNA, 140 bp, Artificial Sequence
  Synthetic
aggccctggctgctgatatggataatcactgggacaacaggccgggagggaagatgttcggattcaaccccgaagcggcgtccatactggagaggaaatacccgtttataaaagggaagtgaccttttgggacagcggtg

SEQ ID NO: 9186 - DNA, 140 bp, Artificial Sequence
  Synthetic
caccgctgtcccaaaaggtcacttcccttttataaacgggtatttcctctccagtatggacgccgcttcggggttgaatccgaacatcttccctcccggcctgttgtcccagtgattatccatatcagcagccagggcct

SEQ ID NO: 9187 - DNA, 140 bp, Artificial Sequence
  Synthetic
atacgccatgctgggtctccggaataccaacaagcaaatctgtgtgactactaggaggattgaagattttaacccgaacatcaacattatacctgccaacaggagactaccgcattcattcgtacttgggagtcggccat

SEQ ID NO: 9188 - DNA, 140 bp, Artificial Sequence
  Synthetic
atggccgactcccaagtacgaatgaatgcggtagtctcctgttggcaggtataatgttgatgttcgggttaaaatcttcaatcctcctagtagtcacacagatttgcttgttggtattccggagacccagcatggcgtat

SEQ ID NO: 9189 - DNA, 140 bp, Artificial Sequence
  Synthetic
atacgccatgctgggtctccacgtaatgaacaaccagctgaatgctgcttttgttggtcaggccacccgagcagggtgcgcaccgtcgtaccgggttaaacgcatggacatcgcaaagaacgtacttgggagtcggccat

SEQ ID NO: 9190 - DNA, 140 bp, Artificial Sequence
  Synthetic
atggccgactcccaagtacgttctttgcgatgtccatgcgtttaacccggtacgacggtgcgcaccctgctcgggtggcctgaccaacaaaagcagcattcagctggttgttcattacgtggagacccagcatggcgtat

SEQ ID NO: 9191 - DNA, 140 bp, Artificial Sequence
  Synthetic
atacgccatgctgggtctccgtatcctgaccacccaacactcctgtcctaccggagtatgggagaagaaccaaactatcaagaagagtgggtgacgcacaagaaggaggtcgtgctaacccgtacttgggagtcggccat

SEQ ID NO: 9192 - DNA, 140 bp, Artificial Sequence
  Synthetic
atggccgactcccaagtacgggttagcacgacctccttcttgtgcgtcacccactcttcttgatagtttggttcttctcccatactccggtaggacaggagtgttgggtggtcaggatacggagacccagcatggcgtat

SEQ ID NO: 9193 - DNA, 140 bp, Artificial Sequence
  Synthetic
aggccctggctgctgatatgggtaatccatgcagtaggacctaatttctcaaattactctgagtccgaaggagaccgggagttggcagctgcttaccgagaagtcgccaaggaggtgactgaccttttgggacagcggtg

SEQ ID NO: 9194 - DNA, 140 bp, Artificial Sequence
  Synthetic
caccgctgtcccaaaaggtcagtcacctccttggcgacttctcggtaagcagctgccaactcccggtctccttcggactcagagtaatttgagaaattaggtcctactgcatggattacccatatcagcagccagggcct

SEQ ID NO: 9195 - DNA, 140 bp, Artificial Sequence
  Synthetic
atacgccatgctgggtctccactagacgaacacatctctgtagactgcgatatcatccgagtgcaccctgatagcagtctggcaggtagaaaagggtacagcactacagaaggttcactgcgtacttgggagtcggccat

SEQ ID NO: 9196 - DNA, 140 bp, Artificial Sequence
  Synthetic
atggccgactcccaagtacgcagtgaaccttctgtagtgctgtacccttttctacctgccagactgctatcagggtgcactcggatgatatcgcagtctacagagatgtgttcgtctagtggagacccagcatggcgtat

SEQ ID NO: 9197 - DNA, 140 bp, Artificial Sequence
  Synthetic
atacgccatgctgggtctccgaaggagtgcagaaagtcaagtgttctaaagtgatgctgttcgaccataacgtgccatcacgcgttagtccaagggtatataaatcgcctcaggagaccgcgtacttgggagtcggccat

SEQ ID NO: 9198 - DNA, 140 bp, Artificial Sequence
  Synthetic
atggccgactcccaagtacgcggtctcctgaggcgatttatatacccttggactaacgcgtgatggcacgttatggtcgaacagcatcactttagaacacttgactttctgcactccttcggagacccagcatggcgtat

SEQ ID NO: 9199 - DNA, 140 bp, Artificial Sequence
  Synthetic
atacgccatgctgggtctcccacaagaagtaagttcgaccacgtcgctgacgcacagccaattcgaccttagcgttgacggtgaggaactgcccgctccgtctgacttggaagctgatgccgtacttgggagtcggccat

SEQ ID NO: 9200 - DNA, 140 bp, Artificial Sequence
  Synthetic
atggccgactcccaagtacggcatcagcttccaagtcagacggagcgggcagttcctcaccgtcaacgctaaggtcgaattggctgtgcgtcagcgacgtggtcgaacttacttcttgtgggagacccagcatggcgtat

SEQ ID NO: 9201 - DNA, 140 bp, Artificial Sequence
  Synthetic
atacgccatgctgggtctcccaggagctaccgtccctttcctgcttagcctaatatgctgcatcagaacagctaaagcggccacataccaagaggctgcggtatacctgtggaacgagcacgtacttgggagtcggccat

SEQ ID NO: 9202 - DNA, 140 bp, Artificial Sequence
  Synthetic
atggccgactcccaagtacgtgctcgttccacaggtataccgcagcctcttggtatgtggccgctttagctgttctgatgcagcatattaggctaagcaggaaagggacggtagctcctgggagacccagcatggcgtat

SEQ ID NO: 9203 - DNA, 140 bp, Artificial Sequence
  Synthetic
aggccctggctgctgatatgagcgttgacggtgaggaactgcccgctccgtctgacttggaagctgatgctccgattccggaaccaacacaagacgacagagcggcacttactttgcctcgaccttttgggacagcggtg

SEQ ID NO: 9204 - DNA, 140 bp, Artificial Sequence
  Synthetic
caccgctgtcccaaaaggtcgaggcaaagtaagtgccgctctgtcgtcttgtgttggttccggaatcggagcatcagcttccaagtcagacggagcgggcagttcctcaccgtcaacgctcatatcagcagccagggcct

SEQ ID NO: 9205 - DNA, 140 bp, Artificial Sequence
  Synthetic
atacgccatgctgggtctccgagcggatctgcactccattgtacaggaaacggcagagatacgcgatacggccgcgtccctccaggcgcccctgagtgtcgctacagaaccaaatcaactcgtacttgggagtcggccat

SEQ ID NO: 9206 - DNA, 140 bp, Artificial Sequence
  Synthetic
atggccgactcccaagtacgagttgatttggttctgtagcgacactcaggggcgcctggagggacgcggccgtatcgcgtatctctgccgtttcctgtacaatggagtgcagatccgctcggagacccagcatggcgtat

SEQ ID NO: 9207 - DNA, 140 bp, Artificial Sequence
  Synthetic
atacgccatgctgggtctcccgccagacagtactgccggtaaacaccttggaggaagttcaggaggagaaatgttacccacctaagttggatgaagtgaaagagcagttgttacttaagacgtacttgggagtcggccat

SEQ ID NO: 9208 - DNA, 140 bp, Artificial Sequence
  Synthetic
atggccgactcccaagtacgtcttaagtaacaactgctctttcacttcatccaacttaggtgggtaacatttctcctcctgaacttcctccaaggtgtttaccggcagtactgtctggcgggagacccagcatggcgtat

SEQ ID NO: 9209 - DNA, 140 bp, Artificial Sequence
  Synthetic
aggccctggctgctgatatgatgttacccacctaagttggatgaagtgaaagagcagttgttacttaagaaactccaggaaagcgcgtccatggctaacagaagcaggtaccaatcccgcgaccttttgggacagcggtg

SEQ ID NO: 9210 - DNA, 140 bp, Artificial Sequence
  Synthetic
caccgctgtcccaaaaggtcgcgggattggtacctgcttctgttagccatggacgcgctttcctggagtttcttaagtaacaactgctctttcacttcatccaacttaggtgggtaacatcatatcagcagccagggcct

SEQ ID NO: 9211 - DNA, 140 bp, Artificial Sequence
  Synthetic
atacgccatgctgggtctccgacagttgcgtcgtaccaaatcaccgatgagtacgatgcatacctggatatggtggacgggtcggaaagttgccttgaccgggcgacgttcaatccatcacgtacttgggagtcggccat

SEQ ID NO: 9212 - DNA, 140 bp, Artificial Sequence
  Synthetic
atggccgactcccaagtacgtgatggattgaacgtcgcccggtcaaggcaactttccgacccgtccaccatatccaggtatgcatcgtactcatcggtgatttggtacgacgcaactgtcggagacccagcatggcgtat

SEQ ID NO: 9213 - DNA, 140 bp, Artificial Sequence
  Synthetic
aggccctggctgctgatatgagaacttgacaacttatgtcacaaaactaaaaggaccaaaagcagcagcattgtttgccaagacacataacctgctaccactgcaggaggtgccgatggagaccttttgggacagcggtg

SEQ ID NO: 9214 - DNA, 140 bp, Artificial Sequence
  Synthetic
caccgctgtcccaaaaggtctccatcggcacctcctgcagtggtagcaggttatgtgtcttggcaaacaatgctgctgcttttggtccttttagttttgtgacataagttgtcaagttctcatatcagcagccagggcct

SEQ ID NO: 9215 - DNA, 140 bp, Artificial Sequence
  Synthetic
atacgccatgctgggtctccgaatgcagtccttctacctaatgtacacacgctgtttgatatgtctgccgaggactttgacgccattattgccgcgcacttcaagcccggggacgctgtacgtacttgggagtcggccat

SEQ ID NO: 9216 - DNA, 140 bp, Artificial Sequence
  Synthetic
atggccgactcccaagtacgtacagcgtccccgggcttgaagtgcgcggcaataatggcgtcaaagtcctcggcagacatatcaaacagcgtgtgtacattaggtagaaggactgcattcggagacccagcatggcgtat

SEQ ID NO: 9217 - DNA, 140 bp, Artificial Sequence
  Synthetic
atacgccatgctgggtctcctggacttgatagaggctgccttcggggagatctccagctgccacctaccgacgggcactcgttttaagttcggcgccatgatgaagtctggtatgttcctcgtacttgggagtcggccat

SEQ ID NO: 9218 - DNA, 140 bp, Artificial Sequence
  Synthetic
atggccgactcccaagtacgaggaacataccagacttcatcatggcgccgaacttaaaacgagtgcccgtcggtaggtggcagctggagatctccccgaaggcagcctctatcaagtccaggagacccagcatggcgtat

SEQ ID NO: 9219 - DNA, 140 bp, Artificial Sequence
  Synthetic
aggccctggctgctgatatgattgaccatgcgcgcggtacctcaacagaagcctcgcagaaatcggaaaagtaagaagcaaaggcagaagaagcaggcgccgcaaaacgacccaaagcaagaccttttgggacagcggtg

SEQ ID NO: 9220 - DNA, 140 bp, Artificial Sequence
  Synthetic
caccgctgtcccaaaaggtcttgctttgggtcgttttgcggcgcctgcttcttctgcctttgcttcttacttttccgatttctgcgaggcttctgttgaggtaccgcgcgcatggtcaatcatatcagcagccagggcct

SEQ ID NO: 9221 - DNA, 140 bp, Artificial Sequence
  Synthetic
aggccctggctgctgatatgaccagcctgcacccattcctcagactttgggggcgtcgccattattaaatatgcagtcagcaagaaaggcaagtgtgcggtgcattcgatgaccaacgccgaccttttgggacagcggtg

SEQ ID NO: 9222 - DNA, 140 bp, Artificial Sequence
  Synthetic
caccgctgtcccaaaaggtcggcgttggtcatcgaatgcaccgcacacttgcctttcttgctgactgcatatttaataatggcgacgcccccaaagtctgaggaatgggtgcaggctggtcatatcagcagccagggcct

SEQ ID NO: 9223 - DNA, 140 bp, Artificial Sequence
  Synthetic
atacgccatgctgggtctccttaagcatgaaggcaaagtgatgggctacgcatgcctggtgggggacaaagtaatgaaaccagcacatgtgaagggaactatcgacaacgccgatctggccgtacttgggagtcggccat

SEQ ID NO: 9224 - DNA, 140 bp, Artificial Sequence
  Synthetic
atggccgactcccaagtacggccagatcggcgttgtcgatagttcccttcacatgtgctggtttcattactttgtcccccaccaggcatgcgtagcccatcactttgccttcatgcttaaggagacccagcatggcgtat

SEQ ID NO: 9225 - DNA, 140 bp, Artificial Sequence
  Synthetic
aggccctggctgctgatatgcttgctctccccaccgccaaagacgcagtactaaggacaattttaatgtctataaagccacaaggccatatctagctcattgtcctgactgcggagaagggaccttttgggacagcggtg

SEQ ID NO: 9226 - DNA, 140 bp, Artificial Sequence
  Synthetic
caccgctgtcccaaaaggtcccttctccgcagtcaggacaatgagctagatatggccttgtggctttatagacattaaaattgtccttagtactgcgtctttggcggtggggagagcaagcatatcagcagccagggcct

SEQ ID NO: 9227 - DNA, 140 bp, Artificial Sequence
  Synthetic
atacgccatgctgggtctccgagacgctgacagtgggatttacggacagcagaaagatcagccacacatgcacacacccgttccatcatgaaccacctgtgataggcagggagaggttcccgtacttgggagtcggccat

SEQ ID NO: 9228 - DNA, 140 bp, Artificial Sequence
  Synthetic
atggccgactcccaagtacgggaacctctccctgcctatcacaggtggttcatgatggaacgggtgtgtgcatgtgtggctgatctttctgctgtccgtaaatcccactgtcagcgtctcggagacccagcatggcgtat

SEQ ID NO: 9229 - DNA, 140 bp, Artificial Sequence
  Synthetic
atacgccatgctgggtctccactctcgaccacaacatggtaaagagttaccttgcagcacgtacgtgcagagcaccgctgccactgccgaggagatagaggtgcatatgcccccggataccgtacttgggagtcggccat

SEQ ID NO: 9230 - DNA, 140 bp, Artificial Sequence
  Synthetic
atggccgactcccaagtacggtatccgggggcatatgcacctctatctcctcggcagtggcagcggtgctctgcacgtacgtgctgcaaggtaactctttaccatgttgtggtcgagagtggagacccagcatggcgtat

SEQ ID NO: 9231 - DNA, 140 bp, Artificial Sequence
  Synthetic
atacgccatgctgggtctcctcctgaccgcacgctgatgacgcagcagtctggtaacgtgaagatcacagttaatgggcagacggtgcggtacaggtgcaactgcggtggctcaaacgagcgtacttgggagtcggccat

SEQ ID NO: 9232 - DNA, 140 bp, Artificial Sequence
  Synthetic
atggccgactcccaagtacgctcgtttgagccaccgcagttgcacctgtaccgcaccgtctgcccattaactgtgatcttcacgttaccagactgctgcgtcatcagcgtgcggtcaggaggagacccagcatggcgtat

SEQ ID NO: 9233 - DNA, 140 bp, Artificial Sequence
  Synthetic
aggccctggctgctgatatgagacacaccgtatatagctaataatctgtagatcaaagggctatataacccctgaatagtaacaaaatacaaaatcactaaaaattataaaaaacagaaagaccttttgggacagcggtg

SEQ ID NO: 9234 - DNA, 140 bp, Artificial Sequence
  Synthetic
caccgctgtcccaaaaggtctttctgttttttataatttttagtgattttgtattttgttactattcaggggttatatagccctttgatctacagattattagctatatacggtgtgtctcatatcagcagccagggcct

SEQ ID NO: 9235 - DNA, 140 bp, Artificial Sequence
  Synthetic
atacgccatgctgggtctccaatatataaataggtatacgtgtcccctaagagacacattgtatgtaggtgataagtatagatcaaagggccgaacaacccctgaatagtaacaaaatatcgtacttgggagtcggccat

SEQ ID NO: 9236 - DNA, 140 bp, Artificial Sequence
  Synthetic
atggccgactcccaagtacgatattttgttactattcaggggttgttcggccctttgatctatacttatcacctacatacaatgtgtctcttaggggacacgtatacctatttatatattggagacccagcatggcgtat

SEQ ID NO: 9237 - DNA, 140 bp, Artificial Sequence
  Synthetic
atacgccatgctgggtctccagtaacgtacgggaaaaaccaagtcaccatgctgctgtatcctgaccatccgacactcttgtcttatcgtaacatgggacaggaaccaaattaccacgagcgtacttgggagtcggccat

SEQ ID NO: 9238 - DNA, 140 bp, Artificial Sequence
  Synthetic
atggccgactcccaagtacgctcgtggtaatttggttcctgtcccatgttacgataagacaagagtgtcggatggtcaggatacagcagcatggtgacttggtttttcccgtacgttactggagacccagcatggcgtat

SEQ ID NO: 9239 - DNA, 140 bp, Artificial Sequence
  Synthetic
aggccctggctgctgatatggataagtatagatcaaagggccgaacaacccctgaatagtaacaaaatataaaaattaataaaaatcataaaatagaaaaaccataaacagaagtagttcgaccttttgggacagcggtg

SEQ ID NO: 9240 - DNA, 140 bp, Artificial Sequence
  Synthetic
caccgctgtcccaaaaggtcgaactacttctgtttatggtttttctattttatgatttttattaatttttatattttgttactattcaggggttgttcggccctttgatctatacttatccatatcagcagccagggcct

SEQ ID NO: 9241 - DNA, 140 bp, Artificial Sequence
  Synthetic
aggccctggctgctgatatgtctggaggtcacttggggcaacaacgaaccatacaagtactggccgcagatgtctacgaacggtactgctcatggccacccacatgagataatcttgtacgaccttttgggacagcggtg

SEQ ID NO: 9242 - DNA, 140 bp, Artificial Sequence
  Synthetic
caccgctgtcccaaaaggtcgtacaagattatctcatgtgggtggccatgagcagtaccgttcgtagacatctgcggccagtacttgtatggttcgttgttgccccaagtgacctccagacatatcagcagccagggcct

SEQ ID NO: 9243 - DNA, 140 bp, Artificial Sequence
  Synthetic
atacgccatgctgggtctccatattacgaggctgcggcatatttatggaacgaacagcagcccctgttctggttgcaggctcttatcccgctggccgccttgatcgtcctgtgcaactgtcgtacttgggagtcggccat

SEQ ID NO: 9244 - DNA, 140 bp, Artificial Sequence
  Synthetic
atggccgactcccaagtacgacagttgcacaggacgatcaaggcggccagcgggataagagcctgcaaccagaacaggggctgctgttcgttccataaatatgccgcagcctcgtaatatggagacccagcatggcgtat

SEQ ID NO: 9245 - DNA, 140 bp, Artificial Sequence
  Synthetic
aggccctggctgctgatatggccgaactcactttgagatgtaggcatagcataccgaactcttccacgattctccgaacccacagggacgtaggagatgttattttgtttttaatatttcgaccttttgggacagcggtg

SEQ ID NO: 9246 - DNA, 140 bp, Artificial Sequence
  Synthetic
caccgctgtcccaaaaggtcgaaatattaaaaacaaaataacatctcctacgtccctgtgggttcggagaatcgtggaagagttcggtatgctatgcctacatctcaaagtgagttcggccatatcagcagccagggcct

SEQ ID NO: 9247 - DNA, 140 bp, Artificial Sequence
  Synthetic
aggccctggctgctgatatgggttgcaggctcttatcccgctggccgccttgatcgtcctgtgcaactgtctgaagctcttgccatgctgctgtaagaccctggtttttttagccgtaatgaccttttgggacagcggtg

SEQ ID NO: 9248 - DNA, 140 bp, Artificial Sequence
  Synthetic
caccgctgtcccaaaaggtcattacggctaaaaaaaccagggtcttacagcagcatggcaagagcttcagacagttgcacaggacgatcaaggcggccagcgggataagagcctgcaacccatatcagcagccagggcct

SEQ ID NO: 9249 - DNA, 140 bp, Artificial Sequence
  Synthetic
atacgccatgctgggtctccacgtagcctaccagtttctaactgctctactctgcaaagcaagagattaagaacccatcatggatcctgtgtacgtggacatagacgctgacagcgccttcgtacttgggagtcggccat

SEQ ID NO: 9250 - DNA, 140 bp, Artificial Sequence
  Synthetic
atggccgactcccaagtacgaaggcgctgtcagcgtctatgtccacgtacacaggatccatgatgggttcttaatctcttgctttgcagagtagagcagttagaaactggtaggctacgtggagacccagcatggcgtat

SEQ ID NO: 9251 - DNA, 140 bp, Artificial Sequence
  Synthetic
atacgccatgctgggtctccagccccatggtattggagatggagctacaatcagtcactttggaaccaacattgtcacttgactacatcacgtgcgagtacaaaactgtcatcccttccccgtacttgggagtcggccat

SEQ ID NO: 9252 - DNA, 140 bp, Artificial Sequence
  Synthetic
atggccgactcccaagtacggggaagggatgacagttttgtactcgcacgtgatgtagtcaagtgacaatgttggttccaaagtgactgattgtagctccatctccaataccatggggctggagacccagcatggcgtat

SEQ ID NO: 9253 - DNA, 140 bp, Artificial Sequence
  Synthetic
aggccctggctgctgatatgataaaactaatagagcaggaaattgatcccgactcaaccatcctggatatcggcagtgcgccagcaaggaggatgatgtcggacaggaagtaccactgcggaccttttgggacagcggtg

SEQ ID NO: 9254 - DNA, 140 bp, Artificial Sequence
  Synthetic
caccgctgtcccaaaaggtccgcagtggtacttcctgtccgacatcatcctccttgctggcgcactgccgatatccaggatggttgagtcgggatcaatttcctgctctattagttttatcatatcagcagccagggcct

SEQ ID NO: 9255 - DNA, 140 bp, Artificial Sequence
  Synthetic
aggccctggctgctgatatgcacaccgcatcggcgtcggcgaagctccgcgtcctttaccaaggaaacaacattaccgtagctgcctacgctaacggcgaccatgccgttacagtaaagggaccttttgggacagcggtg

SEQ ID NO: 9256 - DNA, 140 bp, Artificial Sequence
  Synthetic
caccgctgtcccaaaaggtccctttactgtaacggcatggtcgccgttagcgtaggcagctacggtaatgttgtttccttggtaaaggacgcggagcttcgccgacgccgatgcggtgtgcatatcagcagccagggcct

SEQ ID NO: 9257 - DNA, 140 bp, Artificial Sequence
  Synthetic
atacgccatgctgggtctcctttgaaggccctgcaacgtgcgtaccccatgtttgaggtggaacctaggcaggtcacaccgaatgaccatgctaatgctagagcgttctcgcacctagctcgtacttgggagtcggccat

SEQ ID NO: 9258 - DNA, 140 bp, Artificial Sequence
  Synthetic
atggccgactcccaagtacgagctaggtgcgagaacgctctagcattagcatggtcattcggtgtgacctgcctaggttccacctcaaacatggggtacgcacgttgcagggccttcaaaggagacccagcatggcgtat

SEQ ID NO: 9259 - DNA, 140 bp, Artificial Sequence
  Synthetic
atacgccatgctgggtctccacgccaagtttgtcgtgggcccaatgtcctccgcctggacaccttttgacaacaaaatcgtggtgtacaaagacgacgtctacaacatggactacccacccgtacttgggagtcggccat

SEQ ID NO: 9260 - DNA, 140 bp, Artificial Sequence
  Synthetic
atggccgactcccaagtacgggtgggtagtccatgttgtagacgtcgtctttgtacaccacgattttgttgtcaaaaggtgtccaggcggaggacattgggcccacgacaaacttggcgtggagacccagcatggcgtat

SEQ ID NO: 9261 - DNA, 140 bp, Artificial Sequence
  Synthetic
aggccctggctgctgatatgccaggcgattaaaggggtccgagtggcgtactgggtagggttcgacacaaccccgttcatgtacaatgccatggcgggtgcctacccctcatattcgacagaccttttgggacagcggtg

SEQ ID NO: 9262 - DNA, 140 bp, Artificial Sequence
  Synthetic
caccgctgtcccaaaaggtctgtcgaatatgaggggtaggcacccgccatggcattgtacatgaacggggttgtgtcgaaccctacccagtacgccactcggacccctttaatcgcctggcatatcagcagccagggcct

SEQ ID NO: 9263 - DNA, 140 bp, Artificial Sequence
  Synthetic
atacgccatgctgggtctccaaaggtaaatgtgcagtacattcgatgaccaacgccgttaccattcgagaagccgacgtagaagtagaggggagctcccagctgcaaatatccttctcaacgtacttgggagtcggccat

SEQ ID NO: 9264 - DNA, 140 bp, Artificial Sequence
  Synthetic
atggccgactcccaagtacgttgagaaggatatttgcagctgggagctcccctctacttctacgtcggcttctcgaatggtaacggcgttggtcatcgaatgtactgcacatttacctttggagacccagcatggcgtat

SEQ ID NO: 9265 - DNA, 140 bp, Artificial Sequence
  Synthetic
atacgccatgctgggtctccaattgggcagatgagcaggtactgaaggctaagaacataggattatgttcaacagacctgacagaaggtagacgaggcaaactgtctattatgagagggacgtacttgggagtcggccat

SEQ ID NO: 9266 - DNA, 140 bp, Artificial Sequence
  Synthetic
atggccgactcccaagtacgtccctctcataatagacagtttgcctcgtctaccttctgtcaggtctgttgaacataatcctatgttcttagccttcagtacctgctcatctgcccaattggagacccagcatggcgtat

SEQ ID NO: 9267 - DNA, 140 bp, Artificial Sequence
  Synthetic
atacgccatgctgggtctccagcatcacacaccacccttggggtccaggatatatccacaacggcaatgtcttgggtgcagaagattacgggaggagtaggactaattgttgctgttgctcgtacttgggagtcggccat

SEQ ID NO: 9268 - DNA, 140 bp, Artificial Sequence
  Synthetic
atggccgactcccaagtacgagcaacagcaacaattagtcctactcctcccgtaatcttctgcacccaagacattgccgttgtggatatatcctggaccccaagggtggtgtgtgatgctggagacccagcatggcgtat

SEQ ID NO: 9269 - DNA, 140 bp, Artificial Sequence
  Synthetic
aggccctggctgctgatatgaacagacctgacagaaggtagacgaggcaaactgtctattatgagagggaaaaagctagaaccgtgcgaccgtgtgctgttctcagtagggtcaacgctcgaccttttgggacagcggtg

SEQ ID NO: 9270 - DNA, 140 bp, Artificial Sequence
  Synthetic
caccgctgtcccaaaaggtcgagcgttgaccctactgagaacagcacacggtcgcacggttctagctttttccctctcataatagacagtttgcctcgtctaccttctgtcaggtctgttcatatcagcagccagggcct

SEQ ID NO: 9271 - DNA, 140 bp, Artificial Sequence
  Synthetic
aggccctggctgctgatatgtacccggaaagccgcaagctacttaagagctggcacctaccatcggtgttccatttaaagggcaagctcagcttcacatgccgctgtgatacagtggtttgaccttttgggacagcggtg

SEQ ID NO: 9272 - DNA, 140 bp, Artificial Sequence
  Synthetic
caccgctgtcccaaaaggtcaaaccactgtatcacagcggcatgtgaagctgagcttgccctttaaatggaacaccgatggtaggtgccagctcttaagtagcttgcggctttccgggtacatatcagcagccagggcct

SEQ ID NO: 9273 - DNA, 140 bp, Artificial Sequence
  Synthetic
atacgccatgctgggtctccaacataaaatgtaataaaaatcaagcgtgtacccaaaagaggtacagtaagaatcagtgaataccacaattggcaacgagaagagacgtaggtatttaagcgtacttgggagtcggccat

SEQ ID NO: 9274 - DNA, 140 bp, Artificial Sequence
  Synthetic
atggccgactcccaagtacgcttaaatacctacgtctcttctcgttgccaattgtggtattcactgattcttactgtacctcttttgggtacacgcttgatttttattacattttatgttggagacccagcatggcgtat

SEQ ID NO: 9275 - DNA, 140 bp, Artificial Sequence
  Synthetic
atacgccatgctgggtctccaattggcaacgagaagagacgtaggtatttaagcttcctaaaagcagccgaactcactttgagacgtaggcatagcataccgaactcttccactattctccgtacttgggagtcggccat

SEQ ID NO: 9276 - DNA, 140 bp, Artificial Sequence
  Synthetic
atggccgactcccaagtacggagaatagtggaagagttcggtatgctatgcctacgtctcaaagtgagttcggctgcttttaggaagcttaaatacctacgtctcttctcgttgccaattggagacccagcatggcgtat

SEQ ID NO: 9277 - DNA, 140 bp, Artificial Sequence
  Synthetic
atacgccatgctgggtctccggaaaaaccacagggtatgcggtaacccaccacgcagacggattcctgatgtgcaagactaccgacacggttgacggtgaaagagtgtcattttcggtgtcgtacttgggagtcggccat

SEQ ID NO: 9278 - DNA, 140 bp, Artificial Sequence
  Synthetic
atggccgactcccaagtacgacaccgaaaatgacactctttcaccgtcaaccgtgtcggtagtcttgcacatcaggaatccgtctgcgtggtgggttaccgcataccctgtggtttttccggagacccagcatggcgtat

SEQ ID NO: 9279 - DNA, 140 bp, Artificial Sequence
  Synthetic
aggccctggctgctgatatgccatttaaagggcaagctcagcttcacatgccgctgtgatacagtggtttcgtgcgagggctacgtcgttaagagaataacgatgagcccaggcctttacgaccttttgggacagcggtg

SEQ ID NO: 9280 - DNA, 140 bp, Artificial Sequence
  Synthetic
caccgctgtcccaaaaggtcgtaaaggcctgggctcatcgttattctcttaacgacgtagccctcgcacgaaaccactgtatcacagcggcatgtgaagctgagcttgccctttaaatggcatatcagcagccagggcct

SEQ ID NO: 9281 - DNA, 140 bp, Artificial Sequence
  Synthetic
aggccctggctgctgatatggtgcaagactaccgacacggttgacggtgaaagagtgtcattttcggtgtgcacgtacgtgccggcgactatttgtgatcaaatgaccggtatccttgctgaccttttgggacagcggtg

SEQ ID NO: 9282 - DNA, 140 bp, Artificial Sequence
  Synthetic
caccgctgtcccaaaaggtcagcaaggataccggtcatttgatcacaaatagtcgccggcacgtacgtgcacaccgaaaatgacactctttcaccgtcaaccgtgtcggtagtcttgcaccatatcagcagccagggcct

SEQ ID NO: 9283 - DNA, 140 bp, Artificial Sequence
  Synthetic
atacgccatgctgggtctccacagaagtcacgccggaggatgcacagaagctgttggtggggctgaaccagagaatagtggttaacggcagaacacaacggaatacgaacaccatgaaaacgtacttgggagtcggccat

SEQ ID NO: 9284 - DNA, 140 bp, Artificial Sequence
  Synthetic
atggccgactcccaagtacgttttcatggtgttcgtattccgttgtgttctgccgttaaccactattctctggttcagccccaccaacagcttctgtgcatcctccggcgtgacttctgtggagacccagcatggcgtat

SEQ ID NO: 9285 - DNA, 140 bp, Artificial Sequence
  Synthetic
aggccctggctgctgatatggagaatagtggttaacggcagaacacaacggaatacgaacaccatgaaaaactatctgcttcccgtggtcgcccaagccttcagcaagtgggcaaaggaggaccttttgggacagcggtg

SEQ ID NO: 9286 - DNA, 140 bp, Artificial Sequence
  Synthetic
caccgctgtcccaaaaggtcctcctttgcccacttgctgaaggcttgggcgaccacgggaagcagatagtttttcatggtgttcgtattccgttgtgttctgccgttaaccactattctccatatcagcagccagggcct

SEQ ID NO: 9287 - DNA, 140 bp, Artificial Sequence
  Synthetic
aggccctggctgctgatatgactgacctgctgctgtctatgggcatttaagaagcagaaaacacacacggtctacaagaggcctgatacccagtcaattcagaaggttcaggccgagtttgaccttttgggacagcggtg

SEQ ID NO: 9288 - DNA, 140 bp, Artificial Sequence
  Synthetic
caccgctgtcccaaaaggtcaaactcggcctgaaccttctgaattgactgggtatcaggcctcttgtagaccgtgtgtgttttctgcttcttaaatgcccatagacagcagcaggtcagtcatatcagcagccagggcct

SEQ ID NO: 9289 - DNA, 140 bp, Artificial Sequence
  Synthetic
aggccctggctgctgatatggcagaaaacacacacggtctacaagaggcctgatacccagtcaattcagaaggttcaggccgagtttgacagctttgtggtaccgagtctgcggtcgtccgaccttttgggacagcggtg

SEQ ID NO: 9290 - DNA, 140 bp, Artificial Sequence
  Synthetic
caccgctgtcccaaaaggtcggacgaccgcagactcggtaccacaaagctgtcaaactcggcctgaaccttctgaattgactgggtatcaggcctcttgtagaccgtgtgtgttttctgccatatcagcagccagggcct

SEQ ID NO: 9291 - DNA, 140 bp, Artificial Sequence
  Synthetic
aggccctggctgctgatatggggttgtcaatccctttgaggactagaatcaaatggttgttaagcaaggtgccaaaaaccgacctgatcccatacagcggagacgcccaagaagcccggggaccttttgggacagcggtg

SEQ ID NO: 9292 - DNA, 140 bp, Artificial Sequence
  Synthetic
caccgctgtcccaaaaggtccccgggcttcttgggcgtctccgctgtatgggatcaggtcggtttttggcaccttgcttaacaaccatttgattctagtcctcaaagggattgacaaccccatatcagcagccagggcct

SEQ ID NO: 9293 - DNA, 140 bp, Artificial Sequence
  Synthetic
atacgccatgctgggtctccgacagctttgtggtgccgagcctgtggtcgtccgggttgtcaatcccgttgaggactagaatcaaatggttgttaagcaaggtgcaaaaaaccgacctgacgtacttgggagtcggccat

SEQ ID NO: 9294 - DNA, 140 bp, Artificial Sequence
  Synthetic
atggccgactcccaagtacgtcaggtcggttttttgcaccttgcttaacaaccatttgattctagtcctcaacgggattgacaacccggacgaccacaggctcggcaccacaaagctgtcggagacccagcatggcgtat

SEQ ID NO: 9295 - DNA, 140 bp, Artificial Sequence
  Synthetic
aggccctggctgctgatatggaggactagaatcaaatggttgttaagcaaggtgcaaaaaaccgacctgatcccgtacagcggggacgcccaagaagcccgggacgcagaaaaagaagcagaccttttgggacagcggtg

SEQ ID NO: 9296 - DNA, 140 bp, Artificial Sequence
  Synthetic
caccgctgtcccaaaaggtctgcttctttttctgcgtcccgggcttcttgggcgtccccgctgtacgggatcaggtcggttttttgcaccttgcttaacaaccatttgattctagtcctccatatcagcagccagggcct

SEQ ID NO: 9297 - DNA, 140 bp, Artificial Sequence
  Synthetic
atacgccatgctgggtctccgaggaagaacgagaagcagaactgactcgtgaagccctaccacccctacaggcagcacaggaagatgtccaggtcgaaatcgacgtggaacagcttgaggcgtacttgggagtcggccat

SEQ ID NO: 9298 - DNA, 140 bp, Artificial Sequence
  Synthetic
atggccgactcccaagtacgcctcaagctgttccacgtcgatttcgacctggacatcttcctgtgctgcctgtaggggtggtagggcttcacgagtcagttctgcttctcgttcttcctcggagacccagcatggcgtat

SEQ ID NO: 9299 - DNA, 140 bp, Artificial Sequence
  Synthetic
aggccctggctgctgatatgggcagcacaggaagatgtccaggtcgaaatcgacgtggaacagcttgaggacagagcgggtgcaggaataatagagactccgagaggagccatcaaagttgaccttttgggacagcggtg

SEQ ID NO: 9300 - DNA, 140 bp, Artificial Sequence
  Synthetic
caccgctgtcccaaaaggtcaactttgatggctcctctcggagtctctattattcctgcacccgctctgtcctcaagctgttccacgtcgatttcgacctggacatcttcctgtgctgcccatatcagcagccagggcct

SEQ ID NO: 9301 - DNA, 140 bp, Artificial Sequence
  Synthetic
atacgccatgctgggtctccgcaacgcttggtaggtatgaccttgtggtcataaacatccacacaccttttcgcatacaccattaccaacagtgcgtcgaccacgcactgaaactgcaaacgtacttgggagtcggccat

SEQ ID NO: 9302 - DNA, 140 bp, Artificial Sequence
  Synthetic
atggccgactcccaagtacgtttgcagtttcagtgcgtggtcgacgcactgttggtaatggtgtatgcgaaaaggtgtgtggatgtttatgaccacaaggtcatacctaccaagcgttgcggagacccagcatggcgtat

SEQ ID NO: 9303 - DNA, 140 bp, Artificial Sequence
  Synthetic
atacgccatgctgggtctccactgcccaaccaacagaccacgtcgtgggagagtacctggtactttccccgcagaccgtactacgtagccagaagctcagcctgattcacgctttggcggcgtacttgggagtcggccat

SEQ ID NO: 9304 - DNA, 140 bp, Artificial Sequence
  Synthetic
atggccgactcccaagtacgccgccaaagcgtgaatcaggctgagcttctggctacgtagtacggtctgcggggaaagtaccaggtactctcccacgacgtggtctgttggttgggcagtggagacccagcatggcgtat

SEQ ID NO: 9305 - DNA, 140 bp, Artificial Sequence
  Synthetic
atacgccatgctgggtctccagcaagtgaagacgtgcacgcacagcggacgagcagggaggtatgcggtcgaagcgtacgacggccgagtcctagtgccctcaggctacgcaatctcgcccgtacttgggagtcggccat

SEQ ID NO: 9306 - DNA, 140 bp, Artificial Sequence
  Synthetic
atggccgactcccaagtacgggcgagattgcgtagcctgagggcactaggactcggccgtcgtacgcttcgaccgcatacctccctgctcgtccgctgtgcgtgcacgtcttcacttgctggagacccagcatggcgtat

SEQ ID NO: 9307 - DNA, 140 bp, Artificial Sequence
  Synthetic
atacgccatgctgggtctccgagagttcgtaaacagaaagctacaccatattgcgatgcacggaccagccctgaataccgacgaagagtcgtatgagctggtgagggcagagaggacagacgtacttgggagtcggccat

SEQ ID NO: 9308 - DNA, 140 bp, Artificial Sequence
  Synthetic
atggccgactcccaagtacgtctgtcctctctgccctcaccagctcatacgactcttcgtcggtattcagggctggtccgtgcatcgcaatatggtgtagctttctgtttacgaactctcggagacccagcatggcgtat

SEQ ID NO: 9309 - DNA, 140 bp, Artificial Sequence
  Synthetic
atacgccatgctgggtctcctgcagtcataggagtcttcggagtaccaggatctggcaagtcagctattatcaagaacctagttaccaggcaagacctggtaactagcggaaagaaagaacgtacttgggagtcggccat

SEQ ID NO: 9310 - DNA, 140 bp, Artificial Sequence
  Synthetic
atggccgactcccaagtacgttctttctttccgctagttaccaggtcttgcctggtaactaggttcttgataatagctgacttgccagatcctggtactccgaagactcctatgactgcaggagacccagcatggcgtat

SEQ ID NO: 9311 - DNA, 140 bp, Artificial Sequence
  Synthetic
aggccctggctgctgatatgagccgcatcccaagggttaaccagaaaaggagtttacgcagttaggcaaaaagttaacgaaaacccgctttatgcatcaacgtcagagcacgttaacgtagaccttttgggacagcggtg

SEQ ID NO: 9312 - DNA, 140 bp, Artificial Sequence
  Synthetic
caccgctgtcccaaaaggtctacgttaacgtgctctgacgttgatgcataaagcgggttttcgttaactttttgcctaactgcgtaaactccttttctggttaacccttgggatgcggctcatatcagcagccagggcct

SEQ ID NO: 9313 - DNA, 140 bp, Artificial Sequence
  Synthetic
aggccctggctgctgatatgagtaggcatagcataccgaactcttccacgattctccgaacccacagggacgtaggagatgttattttgtttttaatatttcaaaaaaaaaaaaaaaaaagaccttttgggacagcggtg

SEQ ID NO: 9314 - DNA, 140 bp, Artificial Sequence
  Synthetic
caccgctgtcccaaaaggtcttttttttttttttttttgaaatattaaaaacaaaataacatctcctacgtccctgtgggttcggagaatcgtggaagagttcggtatgctatgcctactcatatcagcagccagggcct

SEQ ID NO: 9315 - DNA, 140 bp, Artificial Sequence
  Synthetic
aggccctggctgctgatatgcccgtggataaagacgctgcagaacccaccgaaaggaaacttcaaagcaactattaaggagtgggaggtggagcatgcatcaataatggcaggcatctgcgaccttttgggacagcggtg

SEQ ID NO: 9316 - DNA, 140 bp, Artificial Sequence
  Synthetic
caccgctgtcccaaaaggtcgcagatgcctgccattattgatgcatgctccacctcccactccttaatagttgctttgaagtttcctttcggtgggttctgcagcgtctttatccacgggcatatcagcagccagggcct

SEQ ID NO: 9317 - DNA, 140 bp, Artificial Sequence
  Synthetic
aggccctggctgctgatatgagtcaccaaatgacctttgatacattccaaaacaaagccaacgtttgttgggctaagagcttggtccctatcctcgaaacagcggggataaaactaaatggaccttttgggacagcggtg

SEQ ID NO: 9318 - DNA, 140 bp, Artificial Sequence
  Synthetic
caccgctgtcccaaaaggtccatttagttttatccccgctgtttcgaggatagggaccaagctcttagcccaacaaacgttggctttgttttggaatgtatcaaaggtcatttggtgactcatatcagcagccagggcct

SEQ ID NO: 9319 - DNA, 140 bp, Artificial Sequence
  Synthetic
aggccctggctgctgatatgtcacccgaagtagccctgaatgaaatatgcacgcgcatgtatggggtggatctagacagcgggctattttccaaaccgttggtgtctgtgtattacgcgggaccttttgggacagcggtg

SEQ ID NO: 9320 - DNA, 140 bp, Artificial Sequence
  Synthetic
caccgctgtcccaaaaggtcccgcgtaatacacagacaccaacggtttggaaaatagcccgctgtctagatccaccccatacatgcgcgtgcatatttcattcagggctacttcgggtgacatatcagcagccagggcct

SEQ ID NO: 9321 - DNA, 140 bp, Artificial Sequence
  Synthetic
atacgccatgctgggtctccataaccactgggataataggcctggagggaagatgttcggattcaaccccgaggcagcgtccattctagaaagaaagtatccattcacaaaagggaagtgcgtacttgggagtcggccat

SEQ ID NO: 9322 - DNA, 140 bp, Artificial Sequence
  Synthetic
atggccgactcccaagtacgcacttcccttttgtgaatggatactttctttctagaatggacgctgcctcggggttgaatccgaacatcttccctccaggcctattatcccagtggttatggagacccagcatggcgtat

SEQ ID NO: 9323 - DNA, 140 bp, Artificial Sequence
  Synthetic
atacgccatgctgggtctccgaataccaacaagcagatctgcgtgactaccaggaggatagaagactttaaccctaccatcaacattataccggccaataggagactaccacactcattacgtacttgggagtcggccat

SEQ ID NO: 9324 - DNA, 140 bp, Artificial Sequence
  Synthetic
atggccgactcccaagtacgtaatgagtgtggtagtctcctattggccggtataatgttgatggtagggttaaagtcttctatcctcctggtagtcacgcagatctgcttgttggtattcggagacccagcatggcgtat

SEQ ID NO: 9325 - DNA, 140 bp, Artificial Sequence
  Synthetic
aggccctggctgctgatatgtacacgcacccacgtcgctataccaccaggcgattaaaggggtccgagtggcgtactgggttgggttcgacacaaccccgttcatgtacaatgccatggcgaccttttgggacagcggtg

SEQ ID NO: 9326 - DNA, 140 bp, Artificial Sequence
  Synthetic
caccgctgtcccaaaaggtcgccatggcattgtacatgaacggggttgtgtcgaacccaacccagtacgccactcggacccctttaatcgcctggtggtatagcgacgtgggtgcgtgtacatatcagcagccagggcct

SEQ ID NO: 9327 - DNA, 140 bp, Artificial Sequence
  Synthetic
atacgccatgctgggtctcctgacctagtggtcataaacatccacacacctttccgcatacaccattaccaacagtgcgtagaccacgcaatgaaactgcaaatgctcgggggtgactcacgtacttgggagtcggccat

SEQ ID NO: 9328 - DNA, 140 bp, Artificial Sequence
  Synthetic
atggccgactcccaagtacgtgagtcacccccgagcatttgcagtttcattgcgtggtctacgcactgttggtaatggtgtatgcggaaaggtgtgtggatgtttatgaccactaggtcaggagacccagcatggcgtat

SEQ ID NO: 9329 - DNA, 140 bp, Artificial Sequence
  Synthetic
aggccctggctgctgatatgcgcagatagaaccagtgaacgagtcatctgcgtattgggacgcaagtttagatcgtctagagcgttgaaaccaccatgtgtcaccagtaacactgagatggaccttttgggacagcggtg

SEQ ID NO: 9330 - DNA, 140 bp, Artificial Sequence
  Synthetic
caccgctgtcccaaaaggtccatctcagtgttactggtgacacatggtggtttcaacgctctagacgatctaaacttgcgtcccaatacgcagatgactcgttcactggttctatctgcgcatatcagcagccagggcct

SEQ ID NO: 9331 - DNA, 140 bp, Artificial Sequence
  Synthetic
atacgccatgctgggtctccttttttctattcagcaattttgacaatggtagaaggaatttcacaactcatgtcatgaacaatcaactgaatgcagcctttgtgggacaggccacccgagcgtacttgggagtcggccat

SEQ ID NO: 9332 - DNA, 140 bp, Artificial Sequence
  Synthetic
atggccgactcccaagtacgctcgggtggcctgtcccacaaaggctgcattcagttgattgttcatgacatgagttgtgaaattccttctaccattgtcaaaattgctgaatagaaaaaaggagacccagcatggcgtat

SEQ ID NO: 9333 - DNA, 140 bp, Artificial Sequence
  Synthetic
aggccctggctgctgatatgtgtcatgaacaatcaactgaatgcagcctttgtgggacaggccacccgagcaggatgcgcaccgtcgtaccgggtaaaacgcatggacatcgcgaagaacgaccttttgggacagcggtg

SEQ ID NO: 9334 - DNA, 140 bp, Artificial Sequence
  Synthetic
caccgctgtcccaaaaggtcgttcttcgcgatgtccatgcgttttacccggtacgacggtgcgcatcctgctcgggtggcctgtcccacaaaggctgcattcagttgattgttcatgacacatatcagcagccagggcct

SEQ ID NO: 9335 - DNA, 140 bp, Artificial Sequence
  Synthetic
atacgccatgctgggtctccgatgaagagtgcgtagtcaacgccgccaaccctcgcgggttaccgggtgacggtgtttgcaaggcagtatacaaaaaatggccggagtcctttaagaacacgtacttgggagtcggccat

SEQ ID NO: 9336 - DNA, 140 bp, Artificial Sequence
  Synthetic
atggccgactcccaagtacgtgttcttaaaggactccggccattttttgtatactgccttgcaaacaccgtcacccggtaacccgcgagggttggcggcgttgactacgcactcttcatcggagacccagcatggcgtat

SEQ ID NO: 9337 - DNA, 140 bp, Artificial Sequence
  Synthetic
aggccctggctgctgatatgcggtgtttgcaaggcagtatacaaaaaatggccggagtcctttaagaacagtgcaacaccagtgggaaccgcaaaaacgatcatgtgcggtacgtatccagaccttttgggacagcggtg

SEQ ID NO: 9338 - DNA, 140 bp, Artificial Sequence
  Synthetic
caccgctgtcccaaaaggtctggatacgtaccgcacatgatcgtttttgcggttcccactggtgttgcactgttcttaaaggactccggccattttttgtatactgccttgcaaacaccgcatatcagcagccagggcct

SEQ ID NO: 9339 - DNA, 140 bp, Artificial Sequence
  Synthetic
atacgccatgctgggtctccgtaatccacgccgttggaccaaacttctccaattattcggagtctgaaggggaccgggaattggcggctgcctatcgagaaatcgcaaaggaggtaactacgtacttgggagtcggccat

SEQ ID NO: 9340 - DNA, 140 bp, Artificial Sequence
  Synthetic
atggccgactcccaagtacgtagttacctcctttgcgatttctcgataggcagccgccaattcccggtccccttcagactccgaataattggagaagtttggtccaacggcgtggattacggagacccagcatggcgtat

SEQ ID NO: 9341 - DNA, 140 bp, Artificial Sequence
  Synthetic
aggccctggctgctgatatggggagaagaaaatatctgaggccatacagatgcggacccaagtggagctgctggatgagcacatctccatagactgcgatgtcgttcgcgtgcaccccgagaccttttgggacagcggtg

SEQ ID NO: 9342 - DNA, 140 bp, Artificial Sequence
  Synthetic
caccgctgtcccaaaaggtctcggggtgcacgcgaacgacatcgcagtctatggagatgtgctcatccagcagctccacttgggtccgcatctgtatggcctcagatattttcttctccccatatcagcagccagggcct

SEQ ID NO: 9343 - DNA, 140 bp, Artificial Sequence
  Synthetic
atacgccatgctgggtctcccagcagcttggcaggcagaaaaggatacagcaccacggaaggcgcactgtactcatatctagaagggacccgttttcaccagacggcagtggatatggcacgtacttgggagtcggccat

SEQ ID NO: 9344 - DNA, 140 bp, Artificial Sequence
  Synthetic
atggccgactcccaagtacgtgccatatccactgccgtctggtgaaaacgggtcccttctagatatgagtacagtgcgccttccgtggtgctgtatccttttctgcctgccaagctgctgggagacccagcatggcgtat

SEQ ID NO: 9345 - DNA, 140 bp, Artificial Sequence
  Synthetic
atacgccatgctgggtctcctggatgatgcagatgcatcatctcccccgaaaactgtcccgtgcctctgccgttacgccatgacaccagaacgcgtcacccgacttcgcatgaaccatgtcgtacttgggagtcggccat

SEQ ID NO: 9346 - DNA, 140 bp, Artificial Sequence
  Synthetic
atggccgactcccaagtacgacatggttcatgcgaagtcgggtgacgcgttctggtgtcatggcgtaacggcagaggcacgggacagttttcgggggagatgatgcatctgcatcatccaggagacccagcatggcgtat

SEQ ID NO: 9347 - DNA, 140 bp, Artificial Sequence
  Synthetic
aggccctggctgctgatatgggtcgtccgggttgtcaatccctttgaggactagaatcaaatggttgttaagcaaggtgccaaaaaccgacctgatcccgtatagcggagacgcccgagagaccttttgggacagcggtg

SEQ ID NO: 9348 - DNA, 140 bp, Artificial Sequence
  Synthetic
caccgctgtcccaaaaggtctctcgggcgtctccgctatacgggatcaggtcggtttttggcaccttgcttaacaaccatttgattctagtcctcaaagggattgacaacccggacgacccatatcagcagccagggcct

SEQ ID NO: 9349 - DNA, 140 bp, Artificial Sequence
  Synthetic
atacgccatgctgggtctccacaggaagcgagtacgaccacgtcactgacgcatagccaattcgatctaagcgttgacggagagatactgcccgtcccgtcagacctggatgctgacgcccgtacttgggagtcggccat

SEQ ID NO: 9350 - DNA, 140 bp, Artificial Sequence
  Synthetic
atggccgactcccaagtacgggcgtcagcatccaggtctgacgggacgggcagtatctctccgtcaacgcttagatcgaattggctatgcgtcagtgacgtggtcgtactcgcttcctgtggagacccagcatggcgtat

SEQ ID NO: 9351 - DNA, 140 bp, Artificial Sequence
  Synthetic
aggccctggctgctgatatggcgttgacggagagatactgcccgtcccgtcagacctggatgctgacgccccagccctagaaccagccctagacgacggggcgatacacacgttgccatcgaccttttgggacagcggtg

SEQ ID NO: 9352 - DNA, 140 bp, Artificial Sequence
  Synthetic
caccgctgtcccaaaaggtcgatggcaacgtgtgtatcgccccgtcgtctagggctggttctagggctggggcgtcagcatccaggtctgacgggacgggcagtatctctccgtcaacgccatatcagcagccagggcct

SEQ ID NO: 9353 - DNA, 140 bp, Artificial Sequence
  Synthetic
aggccctggctgctgatatgcacaactggaaaccttgcggccgtgtctgactgggtaatgagcaccgtacctgtcgcgccgcccagaagaaggcgagggagaaacctgactgtgacatgcgaccttttgggacagcggtg

SEQ ID NO: 9354 - DNA, 140 bp, Artificial Sequence
  Synthetic
caccgctgtcccaaaaggtcgcatgtcacagtcaggtttctccctcgccttcttctgggcggcgcgacaggtacggtgctcattacccagtcagacacggccgcaaggtttccagttgtgcatatcagcagccagggcct

SEQ ID NO: 9355 - DNA, 140 bp, Artificial Sequence
  Synthetic
aggccctggctgctgatatgcggacgagcagggaggtatgcggtcgaagcgtacgacggccgagtcctagtgccctcaggctatgcaatctcgcctgaagacttccagagtctaagcgaagaccttttgggacagcggtg

SEQ ID NO: 9356 - DNA, 140 bp, Artificial Sequence
  Synthetic
caccgctgtcccaaaaggtcttcgcttagactctggaagtcttcaggcgagattgcatagcctgagggcactaggactcggccgtcgtacgcttcgaccgcatacctccctgctcgtccgcatatcagcagccagggcct

SEQ ID NO: 9357 - DNA, 140 bp, Artificial Sequence
  Synthetic
atacgccatgctgggtctccgacgagagagaagggaatataacacccatggctagcgtccgattctttagggcagagctgtgtccagtcgtacaagaaacagcggagacgcgtgatacagcgtacttgggagtcggccat

SEQ ID NO: 9358 - DNA, 140 bp, Artificial Sequence
  Synthetic
atggccgactcccaagtacgctgtatcacgcgtctccgctgtttcttgtacgactggacacagctctgccctaaagaatcggacgctagccatgggtgttatattcccttctctctcgtcggagacccagcatggcgtat

SEQ ID NO: 9359 - DNA, 140 bp, Artificial Sequence
  Synthetic
atacgccatgctgggtctccctatgtctcttcaggcaccgccgagtaccgctacggaactgagtcatccgccgatctccttcggagcaccaagcgagacgttccccatcacatttggggacgtacttgggagtcggccat

SEQ ID NO: 9360 - DNA, 140 bp, Artificial Sequence
  Synthetic
atggccgactcccaagtacgtccccaaatgtgatggggaacgtctcgcttggtgctccgaaggagatcggcggatgactcagttccgtagcggtactcggcggtgcctgaagagacatagggagacccagcatggcgtat

SEQ ID NO: 9361 - DNA, 140 bp, Artificial Sequence
  Synthetic
atacgccatgctgggtctcccttcaatgaaggagaaatcgaaagcttgtcttccgagctactaactttcggagacttcctacccggagaagtggatgatttgacagatagcgactggtcccgtacttgggagtcggccat

SEQ ID NO: 9362 - DNA, 140 bp, Artificial Sequence
  Synthetic
atggccgactcccaagtacgggaccagtcgctatctgtcaaatcatccacttctccgggtaggaagtctccgaaagttagtagctcggaagacaagctttcgatttctccttcattgaagggagacccagcatggcgtat

SEQ ID NO: 9363 - DNA, 140 bp, Artificial Sequence
  Synthetic
atacgccatgctgggtctccactccaggagagtgcatccatggccaacagaagcaggtatcagtcgcgcaaagtagaaaacatgaaagcaataatcatccagagacttgatagaggctgccgtacttgggagtcggccat

SEQ ID NO: 9364 - DNA, 140 bp, Artificial Sequence
  Synthetic
atggccgactcccaagtacggcagcctctatcaagtctctggatgattattgctttcatgttttctactttgcgcgactgatacctgcttctgttggccatggatgcactctcctggagtggagacccagcatggcgtat

SEQ ID NO: 9365 - DNA, 140 bp, Artificial Sequence
  Synthetic
atacgccatgctgggtctccactccaggagagtgcatccatggccaacagaagcaggtatcagtcgcgcaaagtagaaaacatgaaagcaataatcatccagtgacttgatagaggctgccgtacttgggagtcggccat

SEQ ID NO: 9366 - DNA, 140 bp, Artificial Sequence
  Synthetic
atggccgactcccaagtacggcagcctctatcaagtcactggatgattattgctttcatgttttctactttgcgcgactgatacctgcttctgttggccatggatgcactctcctggagtggagacccagcatggcgtat

SEQ ID NO: 9367 - DNA, 140 bp, Artificial Sequence
  Synthetic
atacgccatgctgggtctccactccaggagagtgcatccatggccaacagaagcaggtatcagtcgcgcaaagtagaaaacatgaaagcaataatcatccagcgacttgatagaggctgccgtacttgggagtcggccat

SEQ ID NO: 9368 - DNA, 140 bp, Artificial Sequence
  Synthetic
atggccgactcccaagtacggcagcctctatcaagtcgctggatgattattgctttcatgttttctactttgcgcgactgatacctgcttctgttggccatggatgcactctcctggagtggagacccagcatggcgtat

SEQ ID NO: 9369 - DNA, 140 bp, Artificial Sequence
  Synthetic
atacgccatgctgggtctccactccaggagagtgcatccatggccaacagaagcaggtatcagtcgcgcaaagtagaaaacatgaaagcaataatcatccagggacttgatagaggctgccgtacttgggagtcggccat

SEQ ID NO: 9370 - DNA, 140 bp, Artificial Sequence
  Synthetic
atggccgactcccaagtacggcagcctctatcaagtccctggatgattattgctttcatgttttctactttgcgcgactgatacctgcttctgttggccatggatgcactctcctggagtggagacccagcatggcgtat

SEQ ID NO: 9371 - DNA, 140 bp, Artificial Sequence
  Synthetic
atacgccatgctgggtctccagactatacttaatgtcagagaccccaaaagtccctacttaccggaccacatatccggcgcctgtgtactcgcctccggtcaacgtccgactgtccaacccgtacttgggagtcggccat

SEQ ID NO: 9372 - DNA, 140 bp, Artificial Sequence
  Synthetic
atggccgactcccaagtacgggttggacagtcggacgttgaccggaggcgagtacacaggcgccggatatgtggtccggtaagtagggacttttggggtctctgacattaagtatagtctggagacccagcatggcgtat

SEQ ID NO: 9373 - DNA, 140 bp, Artificial Sequence
  Synthetic
aggccctggctgctgatatgatatccggcgcctgtgtactcgcctccggtcaacgtccgactgtccaaccccgagtccgcagtggcagcatgcaatgagttcttggctcgaaactatccagaccttttgggacagcggtg

SEQ ID NO: 9374 - DNA, 140 bp, Artificial Sequence
  Synthetic
caccgctgtcccaaaaggtctggatagtttcgagccaagaactcattgcatgctgccactgcggactcggggttggacagtcggacgttgaccggaggcgagtacacaggcgccggatatcatatcagcagccagggcct

SEQ ID NO: 9375 - DNA, 140 bp, Artificial Sequence
  Synthetic
aggccctggctgctgatatgcaagaatactgggaagaatttgctgccagccctattaggataacaactgagaatttaacaacctatgttactaaactaaaggggccaaaagcagcagcgcgaccttttgggacagcggtg

SEQ ID NO: 9376 - DNA, 140 bp, Artificial Sequence
  Synthetic
caccgctgtcccaaaaggtcgcgctgctgcttttggcccctttagtttagtaacataggttgttaaattctcagttgttatcctaatagggctggcagcaaattcttcccagtattcttgcatatcagcagccagggcct

SEQ ID NO: 9377 - DNA, 140 bp, Artificial Sequence
  Synthetic
aggccctggctgctgatatgtgtcatcgttgcattacgaaggcaaaatgcgcactacgaatgagtacaacaagccgattgtagtggacactacaggctcaacaaaacctgaccctggagagaccttttgggacagcggtg

SEQ ID NO: 9378 - DNA, 140 bp, Artificial Sequence
  Synthetic
caccgctgtcccaaaaggtctctccagggtcaggttttgttgagcctgtagtgtccactacaatcggcttgttgtactcattcgtagtgcgcattttgccttcgtaatgcaacgatgacacatatcagcagccagggcct

SEQ ID NO: 9379 - DNA, 140 bp, Artificial Sequence
  Synthetic
atacgccatgctgggtctcctatttgcaaaaactcataatctgctgccactgcaggaagtaccaatggataggttcacagtagatatgaaaagggatgtgaaggtaactcctggtacaaacgtacttgggagtcggccat

SEQ ID NO: 9380 - DNA, 140 bp, Artificial Sequence
  Synthetic
atggccgactcccaagtacgtttgtaccaggagttaccttcacatcccttttcatatctactgtgaacctatccattggtacttcctgcagtggcagcagattatgagtttttgcaaataggagacccagcatggcgtat

SEQ ID NO: 9381 - DNA, 140 bp, Artificial Sequence
  Synthetic
aggccctggctgctgatatgaggttcacagtagatatgaaaagggatgtgaaggtaactcctggtacaaagcacacagaggaaagacctaaggtacaggttatacaggcggctgaaccctgaccttttgggacagcggtg

SEQ ID NO: 9382 - DNA, 140 bp, Artificial Sequence
  Synthetic
caccgctgtcccaaaaggtcagggttcagccgcctgtataacctgtaccttaggtctttcctctgtgtgctttgtaccaggagttaccttcacatcccttttcatatctactgtgaacctcatatcagcagccagggcct

SEQ ID NO: 9383 - DNA, 140 bp, Artificial Sequence
  Synthetic
atacgccatgctgggtctcctggcgacagcatatctatgtgggattcacagagagctggttaggaggctgaacgccgtcctcctacccaatgtgcatacactatttgacatgtctgccgacgtacttgggagtcggccat

SEQ ID NO: 9384 - DNA, 140 bp, Artificial Sequence
  Synthetic
atggccgactcccaagtacgtcggcagacatgtcaaatagtgtatgcacattgggtaggaggacggcgttcagcctcctaaccagctctctgtgaatcccacatagatatgctgtcgccaggagacccagcatggcgtat

SEQ ID NO: 9385 - DNA, 140 bp, Artificial Sequence
  Synthetic
aggccctggctgctgatatgcttactgctttaatgctgttagaggatttaggggtggatcactccctgttggacttgatagaggctgctttcggagagatttctagctgtcatctaccgagaccttttgggacagcggtg

SEQ ID NO: 9386 - DNA, 140 bp, Artificial Sequence
  Synthetic
caccgctgtcccaaaaggtctcggtagatgacagctagaaatctctccgaaagcagcctctatcaagtccaacagggagtgatccacccctaaatcctctaacagcattaaagcagtaagcatatcagcagccagggcct

SEQ ID NO: 9387 - DNA, 140 bp, Artificial Sequence
  Synthetic
atacgccatgctgggtctcccaggtacgcgcttcaagttcggcgccatgatgaaatccggtatgtttctaactctgttcgtcaacacattgctaaatatcaccatcgctagccgagtgctcgtacttgggagtcggccat

SEQ ID NO: 9388 - DNA, 140 bp, Artificial Sequence
  Synthetic
atggccgactcccaagtacgagcactcggctagcgatggtgatatttagcaatgtgttgacgaacagagttagaaacataccggatttcatcatggcgccgaacttgaagcgcgtacctgggagacccagcatggcgtat

SEQ ID NO: 9389 - DNA, 140 bp, Artificial Sequence
  Synthetic
atacgccatgctgggtctccggaagatcgtctgacaaaatccgcgtgcgcggccttcatcggcgacgacaacataatacatggagtcgtctccgatgaattgatggcggccagatgcgcccgtacttgggagtcggccat

SEQ ID NO: 9390 - DNA, 140 bp, Artificial Sequence
  Synthetic
atggccgactcccaagtacgggcgcatctggccgccatcaattcatcggagacgactccatgtattatgttgtcgtcgccgatgaaggccgcgcacgcggattttgtcagacgatcttccggagacccagcatggcgtat

SEQ ID NO: 9391 - DNA, 140 bp, Artificial Sequence
  Synthetic
atacgccatgctgggtctccacttggatgaacatggaagtgaagatcatagatgcagttgtatctctgaaagccccttacttttgtggagggtttatactgcacgatactgtgacaggaacgtacttgggagtcggccat

SEQ ID NO: 9392 - DNA, 140 bp, Artificial Sequence
  Synthetic
atggccgactcccaagtacgttcctgtcacagtatcgtgcagtataaaccctccacaaaagtaaggggctttcagagatacaactgcatctatgatcttcacttccatgttcatccaagtggagacccagcatggcgtat

SEQ ID NO: 9393 - DNA, 140 bp, Artificial Sequence
  Synthetic
atacgccatgctgggtctcccagcttgcagagtggcagacccgctgaaaaggctatttaaactgggcaagccgctagcggcaggtgacgaacaagatgaggatagaagacgagcgctggccgtacttgggagtcggccat

SEQ ID NO: 9394 - DNA, 140 bp, Artificial Sequence
  Synthetic
atggccgactcccaagtacggccagcgctcgtcttctatcctcatcttgttcgtcacctgccgctagcggcttgcccagtttaaatagccttttcagcgggtctgccactctgcaagctgggagacccagcatggcgtat

SEQ ID NO: 9395 - DNA, 140 bp, Artificial Sequence
  Synthetic
aggccctggctgctgatatgccgctagcggcaggtgacgaacaagatgaggatagaagacgagcgctggctgacgaagtgatcagatggcaacgaacagggctaattgatgagctggagagaccttttgggacagcggtg

SEQ ID NO: 9396 - DNA, 140 bp, Artificial Sequence
  Synthetic
caccgctgtcccaaaaggtctctccagctcatcaattagccctgttcgttgccatctgatcacttcgtcagccagcgctcgtcttctatcctcatcttgttcgtcacctgccgctagcggcatatcagcagccagggcct

SEQ ID NO: 9397 - DNA, 140 bp, Artificial Sequence
  Synthetic
atacgccatgctgggtctccacccgtcataactttgtacggcggtcctaaataggtacgcactacagctacctattttgcagaagccgacggcaagtacctaaatactaatcagctacaacgtacttgggagtcggccat

SEQ ID NO: 9398 - DNA, 140 bp, Artificial Sequence
  Synthetic
atggccgactcccaagtacgttgtagctgattagtatttaggtacttgccgtcggcttctgcaaaataggtagctgtagtgcgtacctatttaggaccgccgtacaaagttatgacgggtggagacccagcatggcgtat

SEQ ID NO: 9399 - DNA, 140 bp, Artificial Sequence
  Synthetic
aggccctggctgctgatatgccctggactccgcgccctactatccaagtcatcaggcccagaccgcgcccgcagaggcaagctgggcaacttgcccagctgatctcagccgttaacaaacgaccttttgggacagcggtg

SEQ ID NO: 9400 - DNA, 140 bp, Artificial Sequence
  Synthetic
caccgctgtcccaaaaggtcgtttgttaacggctgagatcagctgggcaagttgcccagcttgcctctgcgggcgcggtctgggcctgatgacttggatagtagggcgcggagtccagggcatatcagcagccagggcct

SEQ ID NO: 9401 - DNA, 140 bp, Artificial Sequence
  Synthetic
aggccctggctgctgatatgaagcatgaaggtaaggtaacaggttacgcgtgcttggtgggggacaaagtaatgaaaccagcacacgtaaaggggactatcgataacgcggacctggccagaccttttgggacagcggtg

SEQ ID NO: 9402 - DNA, 140 bp, Artificial Sequence
  Synthetic
caccgctgtcccaaaaggtctggccaggtccgcgttatcgatagtcccctttacgtgtgctggtttcattactttgtcccccaccaagcacgcgtaacctgttaccttaccttcatgcttcatatcagcagccagggcct

SEQ ID NO: 9403 - DNA, 140 bp, Artificial Sequence
  Synthetic
aggccctggctgctgatatgaggagcccgtacagccctctcagtggtgacctggaataaagacattgtcactaaaatcacccctgagggggccgaagagtggagtcttgccatcccagttgaccttttgggacagcggtg

SEQ ID NO: 9404 - DNA, 140 bp, Artificial Sequence
  Synthetic
caccgctgtcccaaaaggtcaactgggatggcaagactccactcttcggccccctcaggggtgattttagtgacaatgtctttattccaggtcaccactgagagggctgtacgggctcctcatatcagcagccagggcct

SEQ ID NO: 9405 - DNA, 140 bp, Artificial Sequence
  Synthetic
atacgccatgctgggtctccatgtgcctgctggcaaataccacgttcccctgctcccagcccccttgcacaccctgctgctacgaaaaggaaccggagggaaccctacgcatgcttgaggcgtacttgggagtcggccat

SEQ ID NO: 9406 - DNA, 140 bp, Artificial Sequence
  Synthetic
atggccgactcccaagtacgcctcaagcatgcgtagggttccctccggttccttttcgtagcagcagggtgtgcaagggggctgggagcaggggaacgtggtatttgccagcaggcacatggagacccagcatggcgtat

SEQ ID NO: 9407 - DNA, 140 bp, Artificial Sequence
  Synthetic
aggccctggctgctgatatgaccctgctgctacgaaaaggaaccggagggaaccctacgcatgcttgaggacaacgtcatgagacctgggtactatcagctgctacaagcatccttaacagaccttttgggacagcggtg

SEQ ID NO: 9408 - DNA, 140 bp, Artificial Sequence
  Synthetic
caccgctgtcccaaaaggtctgttaaggatgcttgtagcagctgatagtacccaggtctcatgacgttgtcctcaagcatgcgtagggttccctccggttccttttcgtagcagcagggtcatatcagcagccagggcct

SEQ ID NO: 9409 - DNA, 140 bp, Artificial Sequence
  Synthetic
aggccctggctgctgatatgaaatggccggagtcctttaagaacagtgcaacaccagtgggaaccgcaaaaacagttatgtgtggtacgtatccagtaatccacgctgttggaccaaactgaccttttgggacagcggtg

SEQ ID NO: 9410 - DNA, 140 bp, Artificial Sequence
  Synthetic
caccgctgtcccaaaaggtcagtttggtccaacagcgtggattactggatacgtaccacacataactgtttttgcggttcccactggtgttgcactgttcttaaaggactccggccatttcatatcagcagccagggcct

SEQ ID NO: 9411 - DNA, 140 bp, Artificial Sequence
  Synthetic
aggccctggctgctgatatgtaaagccacaagaccatacttagctcactgtcccgactgtggagaagggcactcgtgccatagccccgtagcactagaacgcatcagaaatgaagcgacagaccttttgggacagcggtg

SEQ ID NO: 9412 - DNA, 140 bp, Artificial Sequence
  Synthetic
caccgctgtcccaaaaggtctgtcgcttcatttctgatgcgttctagtgctacggggctatggcacgagtgcccttctccacagtcgggacagtgagctaagtatggtcttgtggctttacatatcagcagccagggcct

SEQ ID NO: 9413 - DNA, 140 bp, Artificial Sequence
  Synthetic
aggccctggctgctgatatggacgggacgctgaaaatccaggtctccttgcaaatcggaataaagacggatgatagccacgattggaccaagctgcgttacatggacaatcacatgccaggaccttttgggacagcggtg

SEQ ID NO: 9414 - DNA, 140 bp, Artificial Sequence
  Synthetic
caccgctgtcccaaaaggtcctggcatgtgattgtccatgtaacgcagcttggtccaatcgtggctatcatccgtctttattccgatttgcaaggagacctggattttcagcgtcccgtccatatcagcagccagggcct

SEQ ID NO: 9415 - DNA, 140 bp, Artificial Sequence
  Synthetic
atacgccatgctgggtctcccagacgcagagagggccgggctatttgtaagaacatcagcaccgtgcacgattactggaacaatgggacacttcatcctggcccgatgcccgaaaggagacgtacttgggagtcggccat

SEQ ID NO: 9416 - DNA, 140 bp, Artificial Sequence
  Synthetic
atggccgactcccaagtacgtctcctttcgggcatcgggccaggatgaagtgtcccattgttccagtaatcgtgcacggtgctgatgttcttacaaatagcccggccctctctgcgtctgggagacccagcatggcgtat

SEQ ID NO: 9417 - DNA, 140 bp, Artificial Sequence
  Synthetic
aggccctggctgctgatatgattactggaacaatgggacacttcatcctggcccgatgcccgaaaggagaaactctgacggtgggattcactgacagcaggaaaattagtcactcatgtagaccttttgggacagcggtg

SEQ ID NO: 9418 - DNA, 140 bp, Artificial Sequence
  Synthetic
caccgctgtcccaaaaggtctacatgagtgactaattttcctgctgtcagtgaatcccaccgtcagagtttctcctttcgggcatcgggccaggatgaagtgtcccattgttccagtaatcatatcagcagccagggcct

SEQ ID NO: 9419 - DNA, 140 bp, Artificial Sequence
  Synthetic
atacgccatgctgggtctccgcgatattgttcgcgtgcaccctgacagcagcttggcaggcagaaaaggatacagcaccacggaaggcgcactgtactcatatctagaagggacccgtttcgtacttgggagtcggccat

SEQ ID NO: 9420 - DNA, 140 bp, Artificial Sequence
  Synthetic
atggccgactcccaagtacgaaacgggtcccttctagatatgagtacagtgcgccttccgtggtgctgtatccttttctgcctgccaagctgctgtcagggtgcacgcgaacaatatcgcggagacccagcatggcgtat

SEQ ID NO: 9421 - DNA, 140 bp, Artificial Sequence
  Synthetic
atacgccatgctgggtctccctgatcgcacattgatgtcacaacagtccggcaacgtaaagatcacagtcaatggccagacggtgcggtacaagtgtaattgcgggggctcaaatgaaggcgtacttgggagtcggccat

SEQ ID NO: 9422 - DNA, 140 bp, Artificial Sequence
  Synthetic
atggccgactcccaagtacgccttcatttgagcccccgcaattacacttgtaccgcaccgtctggccattgactgtgatctttacgttgccggactgttgtgacatcaatgtgcgatcagggagacccagcatggcgtat

SEQ ID NO: 9423 - DNA, 140 bp, Artificial Sequence
  Synthetic
aggccctggctgctgatatgtccgctggcaaatgtaacatgcagggtgcctaaagcaaggaaccccaccgtgacgtacgggaaaaaccaagtcatcatgcttctgtatcctgaccacccagaccttttgggacagcggtg

SEQ ID NO: 9424 - DNA, 140 bp, Artificial Sequence
  Synthetic
caccgctgtcccaaaaggtctgggtggtcaggatacagaagcatgatgacttggtttttcccgtacgtcacggtggggttccttgctttaggcaccctgcatgttacatttgccagcggacatatcagcagccagggcct

SEQ ID NO: 9425 - DNA, 140 bp, Artificial Sequence
  Synthetic
atacgccatgctgggtctccacactcctgtcctaccggaatatgggagaaaaaccaaactatcaagaagagtgggtaacgcataagaaggaggtcgtgctaaccgtgccgactgaagggccgtacttgggagtcggccat

SEQ ID NO: 9426 - DNA, 140 bp, Artificial Sequence
  Synthetic
atggccgactcccaagtacggcccttcagtcggcacggttagcacgacctccttcttatgcgttacccactcttcttgatagtttggtttttctcccatattccggtaggacaggagtgtggagacccagcatggcgtat

SEQ ID NO: 9427 - DNA, 140 bp, Artificial Sequence
  Synthetic
aggccctggctgctgatatggtgggtaacgcataagaaggaggtcgtgctaaccgtgccgactgaagggctcgaggtcacgtggggcaacaacgagccgtataagtattggccgcagttagaccttttgggacagcggtg

SEQ ID NO: 9428 - DNA, 140 bp, Artificial Sequence
  Synthetic
caccgctgtcccaaaaggtctaactgcggccaatacttatacggctcgttgttgccccacgtgacctcgagcccttcagtcggcacggttagcacgacctccttcttatgcgttacccaccatatcagcagccagggcct

SEQ ID NO: 9429 - DNA, 140 bp, Artificial Sequence
  Synthetic
atacgccatgctgggtctcctccacaaacggtacagcccacggccacccgcatgagataattttgtattactatgagctgtaccctactacgactgtagtagttgtgtcagtggcctcgtcgtacttgggagtcggccat

SEQ ID NO: 9430 - DNA, 140 bp, Artificial Sequence
  Synthetic
atggccgactcccaagtacgacgaggccactgacacaactactacagtcgtagtagggtacagctcatagtaatacaaaattatctcatgcgggtggccgtgggctgtaccgtttgtggaggagacccagcatggcgtat

SEQ ID NO: 9431 - DNA, 140 bp, Artificial Sequence
  Synthetic
aggccctggctgctgatatgctatgagctgtaccctactacgactgtagtagttgtgtcagtggcctcgttcatactcctgtcgatggtgggtacggcagtggggatgtgcatgtgtgcagaccttttgggacagcggtg

SEQ ID NO: 9432 - DNA, 140 bp, Artificial Sequence
  Synthetic
caccgctgtcccaaaaggtctgcacacatgcacatccccactgccgtacccaccatcgacaggagtatgaacgaggccactgacacaactactacagtcgtagtagggtacagctcatagcatatcagcagccagggcct

SEQ ID NO: 9433 - DNA, 140 bp, Artificial Sequence
  Synthetic
aggccctggctgctgatatgccatggctagcgtccgattctttagggcagagctgtgtccggtcgtacaagaaacagcggagacgcgtgacacagcaatgtctcttcaggcaccaccgaggaccttttgggacagcggtg

SEQ ID NO: 9434 - DNA, 140 bp, Artificial Sequence
  Synthetic
caccgctgtcccaaaaggtcctcggtggtgcctgaagagacattgctgtgtcacgcgtctccgctgtttcttgtacgaccggacacagctctgccctaaagaatcggacgctagccatggcatatcagcagccagggcct

SEQ ID NO: 9435 - DNA, 140 bp, Artificial Sequence
  Synthetic
atacgccatgctgggtctccaacacggtgggagtaccgtataagactctagtcaacagaccgggctacagccccatggtactggagatggagttactgtcagtcactttggagccaacgccgtacttgggagtcggccat

SEQ ID NO: 9436 - DNA, 140 bp, Artificial Sequence
  Synthetic
atggccgactcccaagtacggcgttggctccaaagtgactgacagtaactccatctccagtaccatggggctgtagcccggtctgttgactagagtcttatacggtactcccaccgtgttggagacccagcatggcgtat

SEQ ID NO: 9437 - DNA, 140 bp, Artificial Sequence
  Synthetic
aggccctggctgctgatatggagaagtccgaatcatgcaaaacagaatttgcatcagcatacagggctcataccgcatccgcatcagctaagctccgcgttctttaccaaggaaataacagaccttttgggacagcggtg

SEQ ID NO: 9438 - DNA, 140 bp, Artificial Sequence
  Synthetic
caccgctgtcccaaaaggtctgttatttccttggtaaagaacgcggagcttagctgatgcggatgcggtatgagccctgtatgctgatgcaaattctgttttgcatgattcggacttctccatatcagcagccagggcct

SEQ ID NO: 9439 - DNA, 140 bp, Artificial Sequence
  Synthetic
aggccctggctgctgatatggccaaattcattgtggggccaatgtcttcagcctggacacctttcgacaacaaaatcgtggtgtacaaaggtgacgtctacaacatggactacccgccctgaccttttgggacagcggtg

SEQ ID NO: 9440 - DNA, 140 bp, Artificial Sequence
  Synthetic
caccgctgtcccaaaaggtcagggcgggtagtccatgttgtagacgtcacctttgtacaccacgattttgttgtcgaaaggtgtccaggctgaagacattggccccacaatgaatttggccatatcagcagccagggcct

SEQ ID NO: 9441 - DNA, 140 bp, Artificial Sequence
  Synthetic
atacgccatgctgggtctcctgcgggtacggtacacgtgccatactctcaggcaccatccggctttaagtattggttaaaagaacgaggggcgtcgctgcagcacacagcaccatttggccgtacttgggagtcggccat

SEQ ID NO: 9442 - DNA, 140 bp, Artificial Sequence
  Synthetic
atggccgactcccaagtacggccaaatggtgctgtgtgctgcagcgacgcccctcgttcttttaaccaatacttaaagccggatggtgcctgagagtatggcacgtgtaccgtacccgcaggagacccagcatggcgtat

SEQ ID NO: 9443 - DNA, 140 bp, Artificial Sequence
  Synthetic
atacgccatgctgggtctcctgccaaatagcaacaaacccggtaagagcggtgaattgcgccgtagggaacatgcccatctccatcgacataccggatgcggccttcactagggtcgtcgcgtacttgggagtcggccat

SEQ ID NO: 9444 - DNA, 140 bp, Artificial Sequence
  Synthetic
atggccgactcccaagtacgcgacgaccctagtgaaggccgcatccggtatgtcgatggagatgggcatgttccctacggcgcaattcaccgctcttaccgggtttgttgctatttggcaggagacccagcatggcgtat

SEQ ID NO: 9445 - DNA, 140 bp, Artificial Sequence
  Synthetic
aggccctggctgctgatatgcatccagagactaaagagaggctgtagactatacttaatgtcagagaccccaaaagtccctacttaccggactacatatccggcgcctgtgtactcgcctgaccttttgggacagcggtg

SEQ ID NO: 9446 - DNA, 140 bp, Artificial Sequence
  Synthetic
caccgctgtcccaaaaggtcaggcgagtacacaggcgccggatatgtagtccggtaagtagggacttttggggtctctgacattaagtatagtctacagcctctctttagtctctggatgcatatcagcagccagggcct

SEQ ID NO: 9447 - DNA, 140 bp, Artificial Sequence
  Synthetic
atacgccatgctgggtctccacgcgccctccttaacggacatgtcgtgcgaggtaccagcctgcacccattcctcagactttgggggcgtcgccattattaaatatgcagccagcaagaacgtacttgggagtcggccat

SEQ ID NO: 9448 - DNA, 140 bp, Artificial Sequence
  Synthetic
atggccgactcccaagtacgttcttgctggctgcatatttaataatggcgacgcccccaaagtctgaggaatgggtgcaggctggtacctcgcacgacatgtccgttaaggagggcgcgtggagacccagcatggcgtat

SEQ ID NO: 9449 - DNA, 140 bp, Artificial Sequence
  Synthetic
aggccctggctgctgatatgtcctcagactttgggggcgtcgccattattaaatatgcagccagcaagaaaggcaagtgcgcggtgcattcgatgactaacgccgtcactattcgggaaggaccttttgggacagcggtg

SEQ ID NO: 9450 - DNA, 140 bp, Artificial Sequence
  Synthetic
caccgctgtcccaaaaggtccttcccgaatagtgacggcgttagtcatcgaatgcaccgcgcacttgcctttcttgctggctgcatatttaataatggcgacgcccccaaagtctgaggacatatcagcagccagggcct

SEQ ID NO: 9451 - DNA, 140 bp, Artificial Sequence
  Synthetic
aggccctggctgctgatatggaccgagcgacattcaatccgtcaaaactcaggagctacccgaaacagcacgcttaccacgcgtcctccatcagaagcgctgtaccgtccccattccagagaccttttgggacagcggtg

SEQ ID NO: 9452 - DNA, 140 bp, Artificial Sequence
  Synthetic
caccgctgtcccaaaaggtctctggaatggggacggtacagcgcttctgatggaggacgcgtggtaagcgtgctgtttcgggtagctcctgagttttgacggattgaatgtcgctcggtccatatcagcagccagggcct

SEQ ID NO: 9453 - DNA, 140 bp, Artificial Sequence
  Synthetic
aggccctggctgctgatatgtgggtgcagaagatcacgggaggtgtgggactggttgtcgctgttgcagcactgattctaatcgtggtgctatgcgtgtcgttcagtaggcactaatttggaccttttgggacagcggtg

SEQ ID NO: 9454 - DNA, 140 bp, Artificial Sequence
  Synthetic
caccgctgtcccaaaaggtccaaattagtgcctactgaacgacacgcatagcaccacgattagaatcagtgctgcaacagcgacaaccagtcccacacctcccgtgatcttctgcacccacatatcagcagccagggcct

SEQ ID NO: 9455 - DNA, 140 bp, Artificial Sequence
  Synthetic
atacgccatgctgggtctccacaactaagtatgaaggtatatgtgtcccctaagagacacaccgtacatagttaataatctatagatcaaagggctacacaacccctgaatagtaacaaacgtacttgggagtcggccat

SEQ ID NO: 9456 - DNA, 140 bp, Artificial Sequence
  Synthetic
atggccgactcccaagtacgtttgttactattcaggggttgtgtagccctttgatctatagattattaactatgtacggtgtgtctcttaggggacacatataccttcatacttagttgtggagacccagcatggcgtat

SEQ ID NO: 9457 - DNA, 140 bp, Artificial Sequence
  Synthetic
atacgccatgctgggtctccatacaaaatcactaaaaattataaaaacagaaaaatacataaataggtgtacgtgtcccctaagagacacattgtatgtaggtgataagtatagatcaaacgtacttgggagtcggccat

SEQ ID NO: 9458 - DNA, 140 bp, Artificial Sequence
  Synthetic
atggccgactcccaagtacgtttgatctatacttatcacctacatacaatgtgtctcttaggggacacgtacacctatttatgtatttttctgtttttataatttttagtgattttgtatggagacccagcatggcgtat

SEQ ID NO: 9459 - DNA, 140 bp, Artificial Sequence
  Synthetic
aggccctggctgctgatatgttggcaaacggaagagatgtaggtacttaagcttcctaaaagcagccgaactcactttgagatgtaggcatagcataccgaactcttccacgactctccggaccttttgggacagcggtg

SEQ ID NO: 9460 - DNA, 140 bp, Artificial Sequence
  Synthetic
caccgctgtcccaaaaggtccggagagtcgtggaagagttcggtatgctatgcctacatctcaaagtgagttcggctgcttttaggaagcttaagtacctacatctcttccgtttgccaacatatcagcagccagggcct

SEQ ID NO: 9461 - DNA, 140 bp, Artificial Sequence
  Synthetic
aggccctggctgctgatatgacatcaccatcgccagccgagtgctggaagatcgtctgacaaaatccgcgtgcgcggccttcatcggcgacgacaacataatacatggagtcgtctccgagaccttttgggacagcggtg

SEQ ID NO: 9462 - DNA, 140 bp, Artificial Sequence
  Synthetic
caccgctgtcccaaaaggtctcggagacgactccatgtattatgttgtcgtcgccgatgaaggccgcgcacgcggattttgtcagacgatcttccagcactcggctggcgatggtgatgtcatatcagcagccagggcct

SEQ ID NO: 9463 - DNA, 140 bp, Artificial Sequence
  Synthetic
aggccctggctgctgatatgagaaccagtgaacgagtcatctgcgtattgggacgcaagtttagatcgtctagagcgttgaaaccaccatgtgtcaccagcaacactgagatgtttttccgaccttttgggacagcggtg

SEQ ID NO: 9464 - DNA, 140 bp, Artificial Sequence
  Synthetic
caccgctgtcccaaaaggtcggaaaaacatctcagtgttgctggtgacacatggtggtttcaacgctctagacgatctaaacttgcgtcccaatacgcagatgactcgttcactggttctcatatcagcagccagggcct

SEQ ID NO: 9465 - DNA, 140 bp, Artificial Sequence
  Synthetic
aggccctggctgctgatatggaattggcagctgcctatcgagaagtcgcaaaggaagtaactaggctgggagtaaatagtgtagctatacctctcctctccacaggtgtatactcaggaggaccttttgggacagcggtg

SEQ ID NO: 9466 - DNA, 140 bp, Artificial Sequence
  Synthetic
caccgctgtcccaaaaggtcctcctgagtatacacctgtggagaggagaggtatagctacactatttactcccagcctagttacttcctttgcgacttctcgataggcagctgccaattccatatcagcagccagggcct

SEQ ID NO: 9467 - DNA, 140 bp, Artificial Sequence
  Synthetic
aggccctggctgctgatatggcgagtacaatcacgtcactgacgcatagtcaattcgacctaagcgttgatggcgagatactgcccgtcccgtcagacctggatgctgacgccccagcccgaccttttgggacagcggtg

SEQ ID NO: 9468 - DNA, 140 bp, Artificial Sequence
  Synthetic
caccgctgtcccaaaaggtcgggctggggcgtcagcatccaggtctgacgggacgggcagtatctcgccatcaacgcttaggtcgaattgactatgcgtcagtgacgtgattgtactcgccatatcagcagccagggcct

SEQ ID NO: 9469 - DNA, 140 bp, Artificial Sequence
  Synthetic
atacgccatgctgggtctcccgtcataccaaattaccgacgagtatgatgcatatctagacatggtggacgggtcggagagttgcctggaccgagcgacatttaatccgtcaaaactcagcgtacttgggagtcggccat

SEQ ID NO: 9470 - DNA, 140 bp, Artificial Sequence
  Synthetic
atggccgactcccaagtacgctgagttttgacggattaaatgtcgctcggtccaggcaactctccgacccgtccaccatgtctagatatgcatcatactcgtcggtaatttggtatgacgggagacccagcatggcgtat

SEQ ID NO: 9471 - DNA, 140 bp, Artificial Sequence
  Synthetic
aggccctggctgctgatatggaggaaaccctacgcatgcttgaggacaacgtcatgagacctgggtactatcagctgctacaagcatccttaacatgttctccccaccgccagcgacgcagaccttttgggacagcggtg

SEQ ID NO: 9472 - DNA, 140 bp, Artificial Sequence
  Synthetic
caccgctgtcccaaaaggtctgcgtcgctggcggtggggagaacatgttaaggatgcttgtagcagctgatagtacccaggtctcatgacgttgtcctcaagcatgcgtagggtttcctccatatcagcagccagggcct

SEQ ID NO: 9473 - DNA, 140 bp, Artificial Sequence
  Synthetic
aggccctggctgctgatatgagtatgaaggtatatgtgtcccctaagagacacactgtacatagcaaataatctatagatcaaagggctacgcaacccctgaatagtaacaaaatacaaagaccttttgggacagcggtg

SEQ ID NO: 9474 - DNA, 140 bp, Artificial Sequence
  Synthetic
caccgctgtcccaaaaggtctttgtattttgttactattcaggggttgcgtagccctttgatctatagattatttgctatgtacagtgtgtctcttaggggacacatataccttcatactcatatcagcagccagggcct

SEQ ID NO: 9475 - DNA, 140 bp, Artificial Sequence
  Synthetic
aggccctggctgctgatatgacggaagagatgtaggtacttaagcttcctaaaagcagccgaactcactttgagaagtaggcatagcataccgaactcttccacgattctccgaacccacgaccttttgggacagcggtg

SEQ ID NO: 9476 - DNA, 140 bp, Artificial Sequence
  Synthetic
caccgctgtcccaaaaggtcgtgggttcggagaatcgtggaagagttcggtatgctatgcctacttctcaaagtgagttcggctgcttttaggaagcttaagtacctacatctcttccgtcatatcagcagccagggcct

SEQ ID NO: 9477 - DNA, 140 bp, Artificial Sequence
  Synthetic
aggccctggctgctgatatggaactcactttgagaagtaggcatagcataccgaactcttccacgattctccgaacccacagggacgtaggagatgttattttgttttataaatatttcagaccttttgggacagcggtg

SEQ ID NO: 9478 - DNA, 140 bp, Artificial Sequence
  Synthetic
caccgctgtcccaaaaggtctgaaatatttataaaacaaaataacatctcctacgtccctgtgggttcggagaatcgtggaagagttcggtatgctatgcctacttctcaaagtgagttccatatcagcagccagggcct

SEQ ID NO: 9479 - DNA, 140 bp, Artificial Sequence
  Synthetic
atacgccatgctgggtctccgcagtgcaccagcaaggaggatgatgtcggacaggaagtaccactgcgtctgcccaatgcgcagcgcagaagatcccgagagactcgccaattatgcgagcgtacttgggagtcggccat

SEQ ID NO: 9480 - DNA, 140 bp, Artificial Sequence
  Synthetic
atggccgactcccaagtacgctcgcataattggcgagtctctcgggatcttctgcgctgcgcattgggcagacgcagtggtacttcctgtccgacatcatcctccttgctggtgcactgcggagacccagcatggcgtat

SEQ ID NO: 9481 - DNA, 140 bp, Artificial Sequence
  Synthetic
aggccctggctgctgatatgacattctgcttacacacagatgtctcatgtagacagagagcagacgtcgcgatataccaagacatctatgctgtacacgcacccacgtcgctataccaccgaccttttgggacagcggtg

SEQ ID NO: 9482 - DNA, 140 bp, Artificial Sequence
  Synthetic
caccgctgtcccaaaaggtcggtggtatagcgacgtgggtgcgtgtacagcatagatgtcttggtatatcgcgacgtctgctctctgtctacatgagacatctgtgtgtaagcagaatgtcatatcagcagccagggcct

SEQ ID NO: 9483 - DNA, 140 bp, Artificial Sequence
  Synthetic
aggccctggctgctgatatgacattctgcttacacacagatgtctcatgtagacagagagcagacgtcgcgatataccaagacttctatgctgtacacgcacccacgtcgctataccaccgaccttttgggacagcggtg

SEQ ID NO: 9484 - DNA, 140 bp, Artificial Sequence
  Synthetic
caccgctgtcccaaaaggtcggtggtatagcgacgtgggtgcgtgtacagcatagaagtcttggtatatcgcgacgtctgctctctgtctacatgagacatctgtgtgtaagcagaatgtcatatcagcagccagggcct

SEQ ID NO: 9485 - DNA, 140 bp, Artificial Sequence
  Synthetic
aggccctggctgctgatatgacattctgcttacacacagatgtctcatgtagacagagagcagacgtcgcgatataccaagacctctatgctgtacacgcacccacgtcgctataccaccgaccttttgggacagcggtg

SEQ ID NO: 9486 - DNA, 140 bp, Artificial Sequence
  Synthetic
caccgctgtcccaaaaggtcggtggtatagcgacgtgggtgcgtgtacagcatagaggtcttggtatatcgcgacgtctgctctctgtctacatgagacatctgtgtgtaagcagaatgtcatatcagcagccagggcct

SEQ ID NO: 9487 - DNA, 140 bp, Artificial Sequence
  Synthetic
aggccctggctgctgatatgacattctgcttacacacagatgtctcatgtagacagagagcagacgtcgcgatataccaagacgtctatgctgtacacgcacccacgtcgctataccaccgaccttttgggacagcggtg

SEQ ID NO: 9488 - DNA, 140 bp, Artificial Sequence
  Synthetic
caccgctgtcccaaaaggtcggtggtatagcgacgtgggtgcgtgtacagcatagacgtcttggtatatcgcgacgtctgctctctgtctacatgagacatctgtgtgtaagcagaatgtcatatcagcagccagggcct

SEQ ID NO: 9489 - DNA, 140 bp, Artificial Sequence
  Synthetic
aggccctggctgctgatatgatctaaagggcaaactcagcttcacatgccgctgtgatacagtggtttcgtgcgagggctacgtcgttaagagaataacgatgagcccaggcctttatgggaccttttgggacagcggtg

SEQ ID NO: 9490 - DNA, 140 bp, Artificial Sequence
  Synthetic
caccgctgtcccaaaaggtcccataaaggcctgggctcatcgttattctcttaacgacgtagccctcgcacgaaaccactgtatcacagcggcatgtgaagctgagtttgccctttagatcatatcagcagccagggcct

SEQ ID NO: 9491 - DNA, 140 bp, Artificial Sequence
  Synthetic
atacgccatgctgggtctccaaaaaccacagggtatgcggtaacccaccacgcagacggattcttgatgtgtaagactaccgacacggttgacggcgaaagagtgtcattcacggtgtgtcgtacttgggagtcggccat

SEQ ID NO: 9492 - DNA, 140 bp, Artificial Sequence
  Synthetic
atggccgactcccaagtacgacacaccgtgaatgacactctttcgccgtcaaccgtgtcggtagtcttacacatcaagaatccgtctgcgtggtgggttaccgcataccctgtggtttttggagacccagcatggcgtat

SEQ ID NO: 9493 - DNA, 140 bp, Artificial Sequence
  Synthetic
atacgccatgctgggtctccaaaaaccacagggtatgcggtaacccaccacgcagacggattcttgatgtgtaagactaccgacacggttgacggcgaaagagtgtcattctcggtgtgtcgtacttgggagtcggccat

SEQ ID NO: 9494 - DNA, 140 bp, Artificial Sequence
  Synthetic
atggccgactcccaagtacgacacaccgagaatgacactctttcgccgtcaaccgtgtcggtagtcttacacatcaagaatccgtctgcgtggtgggttaccgcataccctgtggtttttggagacccagcatggcgtat

SEQ ID NO: 9495 - DNA, 140 bp, Artificial Sequence
  Synthetic
atacgccatgctgggtctccaaaaaccacagggtatgcggtaacccaccacgcagacggattcttgatgtgtaagactaccgacacggttgacggcgaaagagtgtcattcccggtgtgtcgtacttgggagtcggccat

SEQ ID NO: 9496 - DNA, 140 bp, Artificial Sequence
  Synthetic
atggccgactcccaagtacgacacaccgggaatgacactctttcgccgtcaaccgtgtcggtagtcttacacatcaagaatccgtctgcgtggtgggttaccgcataccctgtggtttttggagacccagcatggcgtat

SEQ ID NO: 9497 - DNA, 140 bp, Artificial Sequence
  Synthetic
atacgccatgctgggtctccaaaaaccacagggtatgcggtaacccaccacgcagacggattcttgatgtgtaagactaccgacacggttgacggcgaaagagtgtcattcgcggtgtgtcgtacttgggagtcggccat

SEQ ID NO: 9498 - DNA, 140 bp, Artificial Sequence
  Synthetic
atggccgactcccaagtacgacacaccgcgaatgacactctttcgccgtcaaccgtgtcggtagtcttacacatcaagaatccgtctgcgtggtgggttaccgcataccctgtggtttttggagacccagcatggcgtat

SEQ ID NO: 9499 - DNA, 140 bp, Artificial Sequence
  Synthetic
aggccctggctgctgatatgggactagaatcaaatggttgttaagcaaggtgccaaaaaccgacctgatcccatacagcggggacgcccaagaagcccgggacgcagaaaaagaagcagagaccttttgggacagcggtg

SEQ ID NO: 9500 - DNA, 140 bp, Artificial Sequence
  Synthetic
caccgctgtcccaaaaggtctctgcttctttttctgcgtcccgggcttcttgggcgtccccgctgtatgggatcaggtcggtttttggcaccttgcttaacaaccatttgattctagtcccatatcagcagccagggcct

SEQ ID NO: 9501 - DNA, 140 bp, Artificial Sequence
  Synthetic
atacgccatgctgggtctcctgcccaaccaacagaccacgtcgtgggagagtacctggtactttccccgcagaccgtactacggagccagaagctcagcctaattcacgctttggcggagcgtacttgggagtcggccat

SEQ ID NO: 9502 - DNA, 140 bp, Artificial Sequence
  Synthetic
atggccgactcccaagtacgctccgccaaagcgtgaattaggctgagcttctggctccgtagtacggtctgcggggaaagtaccaggtactctcccacgacgtggtctgttggttgggcaggagacccagcatggcgtat

SEQ ID NO: 9503 - DNA, 140 bp, Artificial Sequence
  Synthetic
aggccctggctgctgatatgagaccgtactacggagccagaagctcagcctaattcacgctttggcggagcaagtgaagacatgcacgcacagcggacgagcagggaggtatgcggtcgagaccttttgggacagcggtg

SEQ ID NO: 9504 - DNA, 140 bp, Artificial Sequence
  Synthetic
caccgctgtcccaaaaggtctcgaccgcatacctccctgctcgtccgctgtgcgtgcatgtcttcacttgctccgccaaagcgtgaattaggctgagcttctggctccgtagtacggtctcatatcagcagccagggcct

SEQ ID NO: 9505 - DNA, 140 bp, Artificial Sequence
  Synthetic
atacgccatgctgggtctccacgagtacgtctacgatgtggaccagagaagatgctgtaagaaggaagaagctgcaggactggtactggtgggcgacttgactaatccgccctaccacgacgtacttgggagtcggccat

SEQ ID NO: 9506 - DNA, 140 bp, Artificial Sequence
  Synthetic
atggccgactcccaagtacgtcgtggtagggcggattagtcaagtcgcccaccagtaccagtcctgcagcttcttccttcttacagcatcttctctggtccacatcgtagacgtactcgtggagacccagcatggcgtat

SEQ ID NO: 9507 - DNA, 140 bp, Artificial Sequence
  Synthetic
atacgccatgctgggtctccctgccaagaaatcaccaccgacgtgatgagacagagaggtctagagatatctacacgtacggttgactcgctgctcttgaatggatgcaacagaccagtccgtacttgggagtcggccat

SEQ ID NO: 9508 - DNA, 140 bp, Artificial Sequence
  Synthetic
atggccgactcccaagtacggactggtctgttgcatccattcaagagcagcgagtcaaccgtacgtgtagatatctctagacctctctgtctcatcacgtcggtggtgatttcttggcagggagacccagcatggcgtat

SEQ ID NO: 9509 - DNA, 140 bp, Artificial Sequence
  Synthetic
atacgccatgctgggtctccgacgtgttgtacgtagacgaggcgtttgcgtgccactctggaacgttacttgctttgatcgccttggttagaccaaggcagaaagttgtactttgtggtgcgtacttgggagtcggccat

SEQ ID NO: 9510 - DNA, 140 bp, Artificial Sequence
  Synthetic
atggccgactcccaagtacgcaccacaaagtacaactttctgccttggtctaaccaaggcgatcaaagcaagtaacgttccagagtggcacgcaaacgcctcgtctacgtacaacacgtcggagacccagcatggcgtat

SEQ ID NO: 9511 - DNA, 140 bp, Artificial Sequence
  Synthetic
aggccctggctgctgatatgtacactgcctgtgaccgccattgtgtcatcgttgcattacgaaggcaaaatgcgcactacgaatgagtacaacaagccgattgtagtggatactacaggcgaccttttgggacagcggtg

SEQ ID NO: 9512 - DNA, 140 bp, Artificial Sequence
  Synthetic
caccgctgtcccaaaaggtcgcctgtagtatccactacaatcggcttgttgtactcattcgtagtgcgcattttgccttcgtaatgcaacgatgacacaatggcggtcacaggcagtgtacatatcagcagccagggcct

SEQ ID NO: 9513 - DNA, 140 bp, Artificial Sequence
  Synthetic
atacgccatgctgggtctcctgctagggggtgacttactgtgactgctcaaaccgggtggctctctattgatcagagcatacggttacgcagatagaaccagtgaacgagtaatctgcgtcgtacttgggagtcggccat

SEQ ID NO: 9514 - DNA, 140 bp, Artificial Sequence
  Synthetic
atggccgactcccaagtacgacgcagattactcgttcactggttctatctgcgtaaccgtatgctctgatcaatagagagccacccggtttgagcagtcacagtaagtcaccccctagcaggagacccagcatggcgtat

SEQ ID NO: 9515 - DNA, 140 bp, Artificial Sequence
  Synthetic
aggccctggctgctgatatgccgcatcccaagggttaaccagaaaaggagtttacgcagttaggcaaaaagttaatgaaaacccgctctatgcatcaacgtcagagcacgtcaacgtactgaccttttgggacagcggtg

SEQ ID NO: 9516 - DNA, 140 bp, Artificial Sequence
  Synthetic
caccgctgtcccaaaaggtcagtacgttgacgtgctctgacgttgatgcatagagcgggttttcattaactttttgcctaactgcgtaaactccttttctggttaacccttgggatgcggcatatcagcagccagggcct

SEQ ID NO: 9517 - DNA, 140 bp, Artificial Sequence
  Synthetic
aggccctggctgctgatatggttaatgaaaacccgctctatgcatcaacgtcagagcacgtcaacgtactcctaacacgtacagaaggtaaactggtatggaagacactttccggtgaccgaccttttgggacagcggtg

SEQ ID NO: 9518 - DNA, 140 bp, Artificial Sequence
  Synthetic
caccgctgtcccaaaaggtcggtcaccggaaagtgtcttccataccagtttaccttctgtacgtgttaggagtacgttgacgtgctctgacgttgatgcatagagcgggttttcattaaccatatcagcagccagggcct

SEQ ID NO: 9519 - DNA, 140 bp, Artificial Sequence
  Synthetic
aggccctggctgctgatatgtggaactgagccatccaccgatctccttcggagcaccaagcgagacgttccccatcacatttggggacttcgacgatggagaaatcgaaagcttgtctttgaccttttgggacagcggtg

SEQ ID NO: 9520 - DNA, 140 bp, Artificial Sequence
  Synthetic
caccgctgtcccaaaaggtcaaagacaagctttcgatttctccatcgtcgaagtccccaaatgtgatggggaacgtctcgcttggtgctccgaaggagatcggtggatggctcagttccacatatcagcagccagggcct

SEQ ID NO: 9521 - DNA, 140 bp, Artificial Sequence
  Synthetic
aggccctggctgctgatatgattaaggagtgggaggtggagcatgcatcaataatggcgggcatctgcagtcaccaaatgacctttgatacattccaaaacaaagccaacgtttgttggggaccttttgggacagcggtg

SEQ ID NO: 9522 - DNA, 140 bp, Artificial Sequence
  Synthetic
caccgctgtcccaaaaggtccccaacaaacgttggctttgttttggaatgtatcaaaggtcatttggtgactgcagatgcccgccattattgatgcatgctccacctcccactccttaatcatatcagcagccagggcct

SEQ ID NO: 9523 - DNA, 140 bp, Artificial Sequence
  Synthetic
aggccctggctgctgatatgacaacagaagtcggtacgccagtcagtgctgccggtaaacaccctggaggaagttcacgaggagaagtgttacccacctgagctggatgaattaaaggaggaccttttgggacagcggtg

SEQ ID NO: 9524 - DNA, 140 bp, Artificial Sequence
  Synthetic
caccgctgtcccaaaaggtcctcctttaattcatccagctcaggtgggtaacacttctcctcgtgaacttcctccagggtgtttaccggcagcactgactggcgtaccgacttctgttgtcatatcagcagccagggcct

SEQ ID NO: 9525 - DNA, 140 bp, Artificial Sequence
  Synthetic
aggccctggctgctgatatgaaccacctctttacagccatggactcgacggatgcagacgtggtcatctactgccgagacaaggaatgggagaagaaaatatttgaggccatacagatgcgaccttttgggacagcggtg

SEQ ID NO: 9526 - DNA, 140 bp, Artificial Sequence
  Synthetic
caccgctgtcccaaaaggtcgcatctgtatggcctcaaatattttcttctcccattccttgtctcggcagtagatgaccacgtctgcatccgtcgagtccatggctgtaaagaggtggttcatatcagcagccagggcct

SEQ ID NO: 9527 - DNA, 140 bp, Artificial Sequence
  Synthetic
aggccctggctgctgatatgatcgctagccgggtgttggaagatcgtctgacaaaatctgcatgcgcggccttcatcggcgacgacaacataatacatggtgtcgtctccgatgaagtgagaccttttgggacagcggtg

SEQ ID NO: 9528 - DNA, 140 bp, Artificial Sequence
  Synthetic
caccgctgtcccaaaaggtctcacttcatcggagacgacaccatgtattatgttgtcgtcgccgatgaaggccgcgcatgcagattttgtcagacgatcttccaacacccggctagcgatcatatcagcagccagggcct

SEQ ID NO: 9529 - DNA, 140 bp, Artificial Sequence
  Synthetic
aggccctggctgctgatatgacctgaagtagccctgaatgaaatatgtacgcgcatgtatggggtggatctagacagcgggctattttctaaaccgttggtgtctgtgtattacgcggatgaccttttgggacagcggtg

SEQ ID NO: 9530 - DNA, 140 bp, Artificial Sequence
  Synthetic
caccgctgtcccaaaaggtcatccgcgtaatacacagacaccaacggtttagaaaatagcccgctgtctagatccaccccatacatgcgcgtacatatttcattcagggctacttcaggtcatatcagcagccagggcct

SEQ ID NO: 9531 - DNA, 140 bp, Artificial Sequence
  Synthetic
aggccctggctgctgatatgtggacacctttcgacaataaaatcgtggtgtacaaaggcgacgtctacaacatggactacccgcccttcggcgcaggaaaaccaggacaatttggcgaccgaccttttgggacagcggtg

SEQ ID NO: 9532 - DNA, 140 bp, Artificial Sequence
  Synthetic
caccgctgtcccaaaaggtcggtcgccaaattgtcctggttttcctgcgccgaagggcgggtagtccatgttgtagacgtcgcctttgtacaccacgattttattgtcgaaaggtgtccacatatcagcagccagggcct

SEQ ID NO: 9533 - DNA, 140 bp, Artificial Sequence
  Synthetic
aggccctggctgctgatatgggcagcatccattctagaaagaaagtatccattcacaaaagggaagtggaacatcaacaagcagatctgcgtgactaccaggaggatagaagactttaacgaccttttgggacagcggtg

SEQ ID NO: 9534 - DNA, 140 bp, Artificial Sequence
  Synthetic
caccgctgtcccaaaaggtcgttaaagtcttctatcctcctggtagtcacgcagatctgcttgttgatgttccacttcccttttgtgaatggatactttctttctagaatggatgctgcccatatcagcagccagggcct

SEQ ID NO: 9535 - DNA, 140 bp, Artificial Sequence
  Synthetic
atacgccatgctgggtctcctcgctttgagatgtaggcgtagcacaccgaactcttccacgattctccgaacccacagggacgtaggagatgttcaaagtgactataaaaaccctgaacacgtacttgggagtcggccat

SEQ ID NO: 9536 - DNA, 140 bp, Artificial Sequence
  Synthetic
atggccgactcccaagtacgtgttcagggtttttatagtcactttgaacatctcctacgtccctgtgggttcggagaatcgtggaagagttcggtgtgctacgcctacatctcaaagcgaggagacccagcatggcgtat

SEQ ID NO: 9537 - DNA, 140 bp, Artificial Sequence
  Synthetic
atacgccatgctgggtctccaagcaaagagattaataacccatcatggatcctgtgtacgtggacatagacgctgacagcgcctttttgaaggccctgcaacgtgcgtaccccatgtttgcgtacttgggagtcggccat

SEQ ID NO: 9538 - DNA, 140 bp, Artificial Sequence
  Synthetic
atggccgactcccaagtacgcaaacatggggtacgcacgttgcagggccttcaaaaaggcgctgtcagcgtctatgtccacgtacacaggatccatgatgggttattaatctctttgcttggagacccagcatggcgtat

SEQ ID NO: 9539 - DNA, 140 bp, Artificial Sequence
  Synthetic
aggccctggctgctgatatgtgaagagtgcgtagtcaacgccgctaaccctcgcgggttaccgggtgacggtgtttgcaaggcagtatacaaaaaatggccggagtcctttaagaatagtgaccttttgggacagcggtg

SEQ ID NO: 9540 - DNA, 140 bp, Artificial Sequence
  Synthetic
caccgctgtcccaaaaggtcactattcttaaaggactccggccattttttgtatactgccttgcaaacaccgtcacccggtaacccgcgagggttagcggcgttgactacgcactcttcacatatcagcagccagggcct

SEQ ID NO: 9541 - DNA, 140 bp, Artificial Sequence
  Synthetic
atacgccatgctgggtctccaatccacgccgttggaccaaacttctctaattattcggagtctgaaggggaccgggaattggcagctgcctatcgagaagtcgcaaaggaagtaactagacgtacttgggagtcggccat

SEQ ID NO: 9542 - DNA, 140 bp, Artificial Sequence
  Synthetic
atggccgactcccaagtacgtctagttacttcctttgcgacttctcgataggcagctgccaattcccggtccccttcagactccgaataattagagaagtttggtccaacggcgtggattggagacccagcatggcgtat

SEQ ID NO: 9543 - DNA, 140 bp, Artificial Sequence
  Synthetic
atacgccatgctgggtctccggatcactccctgctggacttgatagaggctgctttcggagagatctccagctgtcacctaccgacaggtacgcgcttcaagttcggcgccatgatgaaacgtacttgggagtcggccat

SEQ ID NO: 9544 - DNA, 140 bp, Artificial Sequence
  Synthetic
atggccgactcccaagtacgtttcatcatggcgccgaacttgaagcgcgtacctgtcggtaggtgacagctggagatctctccgaaagcagcctctatcaagtccagcagggagtgatccggagacccagcatggcgtat

SEQ ID NO: 9545 - DNA, 140 bp, Artificial Sequence
  Synthetic
aggccctggctgctgatatgtggactcgacggatgcagacgtggtcatctactgccgcgacaaagaatgggagaagaaaatatccgaggccatacagatgcggactcaagtggagctgctgaccttttgggacagcggtg

SEQ ID NO: 9546 - DNA, 140 bp, Artificial Sequence
  Synthetic
caccgctgtcccaaaaggtcagcagctccacttgagtccgcatctgtatggcctcggatattttcttctcccattctttgtcgcggcagtagatgaccacgtctgcatccgtcgagtccacatatcagcagccagggcct

SEQ ID NO: 9547 - DNA, 140 bp, Artificial Sequence
  Synthetic
aggccctggctgctgatatgaggaatcggaagaataagaagcaaaagcaaaaacaacaggcgccacaaaacaacacaactcaaaagaagcagccacctaaaaagaaaccggctcaaaagagaccttttgggacagcggtg

SEQ ID NO: 9548 - DNA, 140 bp, Artificial Sequence
  Synthetic
caccgctgtcccaaaaggtctcttttgagccggtttctttttaggtggctgcttcttttgagttgtgttgttttgtggcgcctgttgtttttgcttttgcttcttattcttccgattcctcatatcagcagccagggcct

SEQ ID NO: 9549 - DNA, 140 bp, Artificial Sequence
  Synthetic
aggccctggctgctgatatggatatatactatgtggccaaagcaaacagaggccaacgagcaagtctgcctatatgccctgggggaaagtattgaatcgatcaggcagaaatgcccggtggaccttttgggacagcggtg

SEQ ID NO: 9550 - DNA, 140 bp, Artificial Sequence
  Synthetic
caccgctgtcccaaaaggtccaccgggcatttctgcctgatcgattcaatactttcccccagggcatataggcagacttgctcgttggcctctgtttgctttggccacatagtatatatccatatcagcagccagggcct

SEQ ID NO: 9551 - DNA, 140 bp, Artificial Sequence
  Synthetic
aggccctggctgctgatatgcaacttcaatgtctataaagccacaagaccatacttagctcactgtcccgattgtggagaagggcactcgtgccatagtcccgtagcactagaacgcatcgaccttttgggacagcggtg

SEQ ID NO: 9552 - DNA, 140 bp, Artificial Sequence
  Synthetic
caccgctgtcccaaaaggtcgatgcgttctagtgctacgggactatggcacgagtgcccttctccacaatcgggacagtgagctaagtatggtcttgtggctttatagacattgaagttgcatatcagcagccagggcct

SEQ ID NO: 9553 - DNA, 140 bp, Artificial Sequence
  Synthetic
aggccctggctgctgatatggatgatgcagatgcatcatctccccccaaaactgtcccgtgcctttgccgttacgccatgactccagaacgcgtcacccgacttcgcatgaaccatgtcagaccttttgggacagcggtg

SEQ ID NO: 9554 - DNA, 140 bp, Artificial Sequence
  Synthetic
caccgctgtcccaaaaggtctgacatggttcatgcgaagtcgggtgacgcgttctggagtcatggcgtaacggcaaaggcacgggacagttttggggggagatgatgcatctgcatcatccatatcagcagccagggcct

SEQ ID NO: 9555 - DNA, 140 bp, Artificial Sequence
  Synthetic
aggccctggctgctgatatgtcagcaccgtgtacgattactggaacaatgggacacttcatcctggcccgatgtccgaaaggggaaactctgacggtgggattcactgacagtaggaagagaccttttgggacagcggtg

SEQ ID NO: 9556 - DNA, 140 bp, Artificial Sequence
  Synthetic
caccgctgtcccaaaaggtctcttcctactgtcagtgaatcccaccgtcagagtttcccctttcggacatcgggccaggatgaagtgtcccattgttccagtaatcgtacacggtgctgacatatcagcagccagggcct

SEQ ID NO: 9557 - DNA, 140 bp, Artificial Sequence
  Synthetic
atacgccatgctgggtctcccaagcataattgtgtgttcttcgtttccccttccaaagtacaaaatagaaggagtgcaaaaagtcaaatgctctaaggtaatgctatttgaccacaacgtcgtacttgggagtcggccat

SEQ ID NO: 9558 - DNA, 140 bp, Artificial Sequence
  Synthetic
atggccgactcccaagtacgacgttgtggtcaaatagcattaccttagagcatttgactttttgcactccttctattttgtactttggaaggggaaacgaagaacacacaattatgcttgggagacccagcatggcgtat

SEQ ID NO: 9559 - DNA, 140 bp, Artificial Sequence
  Synthetic
aggccctggctgctgatatgggagtgcaaaaagtcaaatgctctaaggtaatgctatttgaccacaacgtgccatcgcgcgtaagtccaagggaatatagaccttccccggagtctgcacgaccttttgggacagcggtg

SEQ ID NO: 9560 - DNA, 140 bp, Artificial Sequence
  Synthetic
caccgctgtcccaaaaggtcgtgcagactccggggaaggtctatattcccttggacttacgcgcgatggcacgttgtggtcaaatagcattaccttagagcatttgactttttgcactcccatatcagcagccagggcct

SEQ ID NO: 9561 - DNA, 140 bp, Artificial Sequence
  Synthetic
atacgccatgctgggtctccagcgtacagggctcataccgcatctgcatcagctaagctccgcgtcctttaccaaggaaataatatcactgtaactgcctatgcaaacggcgaccatgcccgtacttgggagtcggccat

SEQ ID NO: 9562 - DNA, 140 bp, Artificial Sequence
  Synthetic
atggccgactcccaagtacgggcatggtcgccgtttgcataggcagttacagtgatattatttccttggtaaaggacgcggagcttagctgatgcagatgcggtatgagccctgtacgctggagacccagcatggcgtat

SEQ ID NO: 9563 - DNA, 140 bp, Artificial Sequence
  Synthetic
atacgccatgctgggtctccaggaagcgagtacaaccacgtcactgacgcatagccaattcgacctaagcgttgacggcgagatactacccgtcccgtcagatctggatgctgacgcccccgtacttgggagtcggccat

SEQ ID NO: 9564 - DNA, 140 bp, Artificial Sequence
  Synthetic
atggccgactcccaagtacgggggcgtcagcatccagatctgacgggacgggtagtatctcgccgtcaacgcttaggtcgaattggctatgcgtcagtgacgtggttgtactcgcttcctggagacccagcatggcgtat

SEQ ID NO: 9565 - DNA, 140 bp, Artificial Sequence
  Synthetic
atacgccatgctgggtctcctgttgctgttgccgcactgattctaatcgtggtgctatgcgtgtcgttcagcaggcactaacttgacaattaagtatgaaggtatatgtgtcccctaagacgtacttgggagtcggccat

SEQ ID NO: 9566 - DNA, 140 bp, Artificial Sequence
  Synthetic
atggccgactcccaagtacgtcttaggggacacatataccttcatacttaattgtcaagttagtgcctgctgaacgacacgcatagcaccacgattagaatcagtgcggcaacagcaacaggagacccagcatggcgtat

SEQ ID NO: 9567 - DNA, 140 bp, Artificial Sequence
  Synthetic
atacgccatgctgggtctcccgagagagaagggaacataacacccatggctagcgtccgattctttagggcagagctgcgtccggtcgtacaagaaacagcggagacgcgtgacacagcacgtacttgggagtcggccat

SEQ ID NO: 9568 - DNA, 140 bp, Artificial Sequence
  Synthetic
atggccgactcccaagtacgtgctgtgtcacgcgtctccgctgtttcttgtacgaccggacgcagctctgccctaaagaatcggacgctagccatgggtgttatgttcccttctctctcgggagacccagcatggcgtat

SEQ ID NO: 9569 - DNA, 140 bp, Artificial Sequence
  Synthetic
aggccctggctgctgatatgcagagctgcgtccggtcgtacaagaaacagcggagacgcgtgacacagcaacgtctcttcaggcaccgccgagtaccgccacggaactgaatcatccgccgaccttttgggacagcggtg

SEQ ID NO: 9570 - DNA, 140 bp, Artificial Sequence
  Synthetic
caccgctgtcccaaaaggtcggcggatgattcagttccgtggcggtactcggcggtgcctgaagagacgttgctgtgtcacgcgtctccgctgtttcttgtacgaccggacgcagctctgcatatcagcagccagggcct

SEQ ID NO: 9571 - DNA, 140 bp, Artificial Sequence
  Synthetic
atacgccatgctgggtctccacggaagagatgtaggtacttaagcttcctaaaagcagccgaactcactttgagaagtaggcatagcataccgaactctcctacgattctccgaaccccccgtacttgggagtcggccat

SEQ ID NO: 9572 - DNA, 140 bp, Artificial Sequence
  Synthetic
atggccgactcccaagtacggggggttcggagaatcgtaggagagttcggtatgctatgcctacttctcaaagtgagttcggctgcttttaggaagcttaagtacctacatctcttccgtggagacccagcatggcgtat

SEQ ID NO: 9573 - DNA, 140 bp, Artificial Sequence
  Synthetic
aggccctggctgctgatatggatctccttcggagcaccaagcgagacgttccccattacatttggggacttcaacgaaggagaaatcgaaagcttgtcttctgagctgctaactttcggagaccttttgggacagcggtg

SEQ ID NO: 9574 - DNA, 140 bp, Artificial Sequence
  Synthetic
caccgctgtcccaaaaggtctccgaaagttagcagctcagaagacaagctttcgatttctccttcgttgaagtccccaaatgtaatggggaacgtctcgcttggtgctccgaaggagatccatatcagcagccagggcct

SEQ ID NO: 9575 - DNA, 140 bp, Artificial Sequence
  Synthetic
atacgccatgctgggtctcctccaggagagtgcatccatggccaacagaagcaggtaccagtcgcgcaaagtagaaaacatgaaagcaacaatcatccagagactaaagagaggctgtagcgtacttgggagtcggccat

SEQ ID NO: 9576 - DNA, 140 bp, Artificial Sequence
  Synthetic
atggccgactcccaagtacgctacagcctctctttagtctctggatgattgttgctttcatgttttctactttgcgcgactggtacctgcttctgttggccatggatgcactctcctggaggagacccagcatggcgtat

SEQ ID NO: 9577 - DNA, 140 bp, Artificial Sequence
  Synthetic
atacgccatgctgggtctccatccggcgcctgtgtactcgcctccgatcagcgtccgactgtccaaccccgagtccgcagtggcagcatgcaatgagttcctagctagaaactatccaaccgtacttgggagtcggccat

SEQ ID NO: 9578 - DNA, 140 bp, Artificial Sequence
  Synthetic
atggccgactcccaagtacggttggatagtttctagctaggaactcattgcatgctgccactgcggactcggggttggacagtcggacgctgatcggaggcgagtacacaggcgccggatggagacccagcatggcgtat

SEQ ID NO: 9579 - DNA, 140 bp, Artificial Sequence
  Synthetic
atacgccatgctgggtctcctgtctcatcataccaaattaccgacgagtatgatgcatatctagacatggtggacgggtcggagagttgcctggatcgagcgacattcaatccgtcaaaacgtacttgggagtcggccat

SEQ ID NO: 9580 - DNA, 140 bp, Artificial Sequence
  Synthetic
atggccgactcccaagtacgttttgacggattgaatgtcgctcgatccaggcaactctccgacccgtccaccatgtctagatatgcatcatactcgtcggtaatttggtatgatgagacaggagacccagcatggcgtat

SEQ ID NO: 9581 - DNA, 140 bp, Artificial Sequence
  Synthetic
aggccctggctgctgatatgagaatactgggaagaatttgctgccagccctattaggataacaactgagaatttaacaacctatgttactaaactaaaagggccaaaagcagcagcgctagaccttttgggacagcggtg

SEQ ID NO: 9582 - DNA, 140 bp, Artificial Sequence
  Synthetic
caccgctgtcccaaaaggtctagcgctgctgcttttggcccttttagtttagtaacataggttgttaaattctcagttgttatcctaatagggctggcagcaaattcttcccagtattctcatatcagcagccagggcct

SEQ ID NO: 9583 - DNA, 140 bp, Artificial Sequence
  Synthetic
aggccctggctgctgatatgatttcgatgccatcatagccgcacactttaagccaggagacactgttttagaaacggacatagcctcctttgataagagccaagatgattcacttgcgctgaccttttgggacagcggtg

SEQ ID NO: 9584 - DNA, 140 bp, Artificial Sequence
  Synthetic
caccgctgtcccaaaaggtcagcgcaagtgaatcatcttggctcttatcaaaggaggctatgtccgtttctaaaacagtgtctcctggcttaaagtgtgcggctatgatggcatcgaaatcatatcagcagccagggcct

SEQ ID NO: 9585 - DNA, 140 bp, Artificial Sequence
  Synthetic
atacgccatgctgggtctcctactgctttgatgctgttagaagatttaggggtggatcactccctgttggacttgatagaggccgctttcggagagatttccagctgtcatctaccgacacgtacttgggagtcggccat

SEQ ID NO: 9586 - DNA, 140 bp, Artificial Sequence
  Synthetic
atggccgactcccaagtacgtgtcggtagatgacagctggaaatctctccgaaagcggcctctatcaagtccaacagggagtgatccacccctaaatcttctaacagcatcaaagcagtaggagacccagcatggcgtat

SEQ ID NO: 9587 - DNA, 140 bp, Artificial Sequence
  Synthetic
aggccctggctgctgatatggcttgcagagtggcagacccgctaaaaaggctattcaaactgggcaaaccgctagcggcaggtgacgaacaagatgaagatagaagacgagcactggctggaccttttgggacagcggtg

SEQ ID NO: 9588 - DNA, 140 bp, Artificial Sequence
  Synthetic
caccgctgtcccaaaaggtccagccagtgctcgtcttctatcttcatcttgttcgtcacctgccgctagcggtttgcccagtttgaatagcctttttagcgggtctgccactctgcaagccatatcagcagccagggcct

SEQ ID NO: 9589 - DNA, 140 bp, Artificial Sequence
  Synthetic
atacgccatgctgggtctcccatggccacctttgcaagctccagatctaacttcgagaagctcagaggacccgtcataactttgtacggcggtcctaaataggtacgcactacagctacccgtacttgggagtcggccat

SEQ ID NO: 9590 - DNA, 140 bp, Artificial Sequence
  Synthetic
atggccgactcccaagtacgggtagctgtagtgcgtacctatttaggaccgccgtacaaagttatgacgggtcctctgagcttctcgaagttagatctggagcttgcaaaggtggccatgggagacccagcatggcgtat

SEQ ID NO: 9591 - DNA, 140 bp, Artificial Sequence
  Synthetic
aggccctggctgctgatatgacaatgcgcgcggtaccccaacagaagccacgcaggaatcggaagaataagaagcaaaagcaaaagcaacaggcgccacaaaacaacacaaaccaaaagagaccttttgggacagcggtg

SEQ ID NO: 9592 - DNA, 140 bp, Artificial Sequence
  Synthetic
caccgctgtcccaaaaggtctcttttggtttgtgttgttttgtggcgcctgttgcttttgcttttgcttcttattcttccgattcctgcgtggcttctgttggggtaccgcgcgcattgtcatatcagcagccagggcct

SEQ ID NO: 9593 - DNA, 140 bp, Artificial Sequence
  Synthetic
atacgccatgctgggtctccaagatgattcacttgcgcttactgctttaatgctgttagaggatttaggggtggatcactccctgttggacttgatagaggctgctttcggagagatttccgtacttgggagtcggccat

SEQ ID NO: 9594 - DNA, 140 bp, Artificial Sequence
  Synthetic
atggccgactcccaagtacggaaatctctccgaaagcagcctctatcaagtccaacagggagtgatccacccctaaatcctctaacagcattaaagcagtaagcgcaagtgaatcatcttggagacccagcatggcgtat

SEQ ID NO: 9595 - DNA, 140 bp, Artificial Sequence
  Synthetic
atacgccatgctgggtctccaaaatcacccccgagggggccgaagagtggagtcttgccatcccagtcatgtgcctgttggcaaacaccacgttcccctgctcccagcccccttgcacaccgtacttgggagtcggccat

SEQ ID NO: 9596 - DNA, 140 bp, Artificial Sequence
  Synthetic
atggccgactcccaagtacggtgtgcaagggggctgggagcaggggaacgtggtgtttgccaacaggcacatgactgggatggcaagactccactcttcggccccctcgggggtgattttggagacccagcatggcgtat

SEQ ID NO: 9597 - DNA, 140 bp, Artificial Sequence
  Synthetic
atacgccatgctgggtctccaacgtcatgagacctgggtactatcagctgctacaagcatccttaacatgttctccccaccgccagcgacgcagtaccaaggacaacttcaatgtctatacgtacttgggagtcggccat

SEQ ID NO: 9598 - DNA, 140 bp, Artificial Sequence
  Synthetic
atggccgactcccaagtacgtatagacattgaagttgtccttggtactgcgtcgctggcggtggggagaacatgttaaggatgcttgtagcagctgatagtacccaggtctcatgacgttggagacccagcatggcgtat

SEQ ID NO: 9599 - DNA, 140 bp, Artificial Sequence
  Synthetic
atacgccatgctgggtctccacactaatcagctacaatggagttcatcccaacccaaactttttacaacaggaggtaccagcctcgaccctggactccgcgccctactatccaagtcatccgtacttgggagtcggccat

SEQ ID NO: 9600 - DNA, 140 bp, Artificial Sequence
  Synthetic
atggccgactcccaagtacggatgacttggatagtagggcgcggagtccagggtcgaggctggtacctcctgttgtaaaaagtttgggttgggatgaactccattgtagctgattagtgtggagacccagcatggcgtat

SEQ ID NO: 9601 - DNA, 140 bp, Artificial Sequence
  Synthetic
aggccctggctgctgatatggacgcagagagggcggggctatttgtaagaacatcagcaccgtgcacgattactggaacaatgggacacttcatcctggcccgatgtccgaaaggggaaagaccttttgggacagcggtg

SEQ ID NO: 9602 - DNA, 140 bp, Artificial Sequence
  Synthetic
caccgctgtcccaaaaggtctttcccctttcggacatcgggccaggatgaagtgtcccattgttccagtaatcgtgcacggtgctgatgttcttacaaatagccccgccctctctgcgtccatatcagcagccagggcct

SEQ ID NO: 9603 - DNA, 140 bp, Artificial Sequence
  Synthetic
aggccctggctgctgatatgctcagcagttaataaactgacaatgcgcgcggtaccccaacagaagccacgcaagaatcggaagaataagaagcaaaagcaaaagcagcaggcgccacaagaccttttgggacagcggtg

SEQ ID NO: 9604 - DNA, 140 bp, Artificial Sequence
  Synthetic
caccgctgtcccaaaaggtcttgtggcgcctgctgcttttgcttttgcttcttattcttccgattcttgcgtggcttctgttggggtaccgcgcgcattgtcagtttattaactgctgagcatatcagcagccagggcct

SEQ ID NO: 9605 - DNA, 140 bp, Artificial Sequence
  Synthetic
aggccctggctgctgatatgctctgacggtgggattcactgacagtaggaagatcagtcactcatgtacgcacccatttcaccacgaccctcctgtgataggccgggaaaaattccattcgaccttttgggacagcggtg

SEQ ID NO: 9606 - DNA, 140 bp, Artificial Sequence
  Synthetic
caccgctgtcccaaaaggtcgaatggaatttttcccggcctatcacaggagggtcgtggtgaaatgggtgcgtacatgagtgactgatcttcctactgtcagtgaatcccaccgtcagagcatatcagcagccagggcct

SEQ ID NO: 9607 - DNA, 140 bp, Artificial Sequence
  Synthetic
atacgccatgctgggtctccaacaacacaaaccaaaagaagcagccacctaaaaagaaaccagctcaaaagaaaaagaagccgggccgcagagagaggatgtgcatgaaaatcgaaaatgcgtacttgggagtcggccat

SEQ ID NO: 9608 - DNA, 140 bp, Artificial Sequence
  Synthetic
atggccgactcccaagtacgcattttcgattttcatgcacatcctctctctgcggcccggcttctttttcttttgagctggtttctttttaggtggctgcttcttttggtttgtgttgttggagacccagcatggcgtat

SEQ ID NO: 9609 - DNA, 140 bp, Artificial Sequence
  Synthetic
aggccctggctgctgatatgtggccagacggtgcggtacaagtgtaattgcggtggctcaaatgaaggactaataactacagacaaagtgattaataactgcaaggttgatcaatgtcatgaccttttgggacagcggtg

SEQ ID NO: 9610 - DNA, 140 bp, Artificial Sequence
  Synthetic
caccgctgtcccaaaaggtcatgacattgatcaaccttgcagttattaatcactttgtctgtagttattagtccttcatttgagccaccgcaattacacttgtaccgcaccgtctggccacatatcagcagccagggcct

SEQ ID NO: 9611 - DNA, 140 bp, Artificial Sequence
  Synthetic
atacgccatgctgggtctccgggtgacgcataagaaggaagtcgtgctaaccgtgccgactgaagggctcgaggtcacgtggggcaacaacgagccgtataagtattggccgcagttatccgtacttgggagtcggccat

SEQ ID NO: 9612 - DNA, 140 bp, Artificial Sequence
  Synthetic
atggccgactcccaagtacggataactgcggccaatacttatacggctcgttgttgccccacgtgacctcgagcccttcagtcggcacggttagcacgacttccttcttatgcgtcacccggagacccagcatggcgtat

SEQ ID NO: 9613 - DNA, 140 bp, Artificial Sequence
  Synthetic
atacgccatgctgggtctcctacaaacggtacagcccatggccacccgcatgagataattctgtattattatgagctgtaccctactaagactgtagtagttgtgtcagtggcctcgttccgtacttgggagtcggccat

SEQ ID NO: 9614 - DNA, 140 bp, Artificial Sequence
  Synthetic
atggccgactcccaagtacggaacgaggccactgacacaactactacagtcttagtagggtacagctcataataatacagaattatctcatgcgggtggccatgggctgtaccgtttgtaggagacccagcatggcgtat

SEQ ID NO: 9615 - DNA, 140 bp, Artificial Sequence
  Synthetic
aggccctggctgctgatatgtacaagcatcattaacatgttctccccaccgccagcgacgcagcaccaaggacaacttcaatgtctataaagccacaagaccatacctagctcactgtccgaccttttgggacagcggtg

SEQ ID NO: 9616 - DNA, 140 bp, Artificial Sequence
  Synthetic
caccgctgtcccaaaaggtcggacagtgagctaggtatggtcttgtggctttatagacattgaagttgtccttggtgctgcgtcgctggcggtggggagaacatgttaatgatgcttgtacatatcagcagccagggcct

SEQ ID NO: 9617 - DNA, 140 bp, Artificial Sequence
  Synthetic
atacgccatgctgggtctccacgcagatgcatcacaccgtacgaactgacaccaggagctaccgtccctttcttgcttagcctaatatgctgcatcagaacagctaaagcggccacataccgtacttgggagtcggccat

SEQ ID NO: 9618 - DNA, 140 bp, Artificial Sequence
  Synthetic
atggccgactcccaagtacggtatgtggccgctttagctgttctgatgcagcatattaggctaagcaagaaagggacggtagctcctggtgtcagttcgtacggtgtgatgcatctgcgtggagacccagcatggcgtat

SEQ ID NO: 9619 - DNA, 140 bp, Artificial Sequence
  Synthetic
aggccctggctgctgatatggattagtcactcatgtacgcacccatttcaccacgaccctcctgtgataggccgggaaaaattccattcccgaccgcagcacggtaaagagctaccttgcgaccttttgggacagcggtg

SEQ ID NO: 9620 - DNA, 140 bp, Artificial Sequence
  Synthetic
caccgctgtcccaaaaggtcgcaaggtagctctttaccgtgctgcggtcgggaatggaatttttcccggcctatcacaggagggtcgtggtgaaatgggtgcgtacatgagtgactaatccatatcagcagccagggcct

SEQ ID NO: 9621 - DNA, 140 bp, Artificial Sequence
  Synthetic
aggccctggctgctgatatgcatgcccccagacacccctgatcgcacattgctgtcacaacagtccggcaacgtaaagatcacagtcaatagtcagacggtgcggtataagtgtaattgcgaccttttgggacagcggtg

SEQ ID NO: 9622 - DNA, 140 bp, Artificial Sequence
  Synthetic
caccgctgtcccaaaaggtcgcaattacacttataccgcaccgtctgactattgactgtgatctttacgttgccggactgttgtgacagcaatgtgcgatcaggggtgtctgggggcatgcatatcagcagccagggcct

SEQ ID NO: 9623 - DNA, 140 bp, Artificial Sequence
  Synthetic
atacgccatgctgggtctccggtggctcaaatgaaggactaataactacagataaagtgattaataactgcaaggttgatcaatgtcatgccgcggtcaccaatcacaaaaagtggcagtcgtacttgggagtcggccat

SEQ ID NO: 9624 - DNA, 140 bp, Artificial Sequence
  Synthetic
atggccgactcccaagtacgactgccactttttgtgattggtgaccgcggcatgacattgatcaaccttgcagttattaatcactttatctgtagttattagtccttcatttgagccaccggagacccagcatggcgtat

SEQ ID NO: 9625 - DNA, 140 bp, Artificial Sequence
  Synthetic
atacgccatgctgggtctccaaaattcacatcccgtttccgctggcaaatgtaacatgcatggtgcctaaagcaaggaaccccaccgtgacgtacgggaaaaaccaagtcatcatgctaccgtacttgggagtcggccat

SEQ ID NO: 9626 - DNA, 140 bp, Artificial Sequence
  Synthetic
atggccgactcccaagtacggtagcatgatgacttggtttttcccgtacgtcacggtggggttccttgctttaggcaccatgcatgttacatttgccagcggaaacgggatgtgaattttggagacccagcatggcgtat

SEQ ID NO: 9627 - DNA, 140 bp, Artificial Sequence
  Synthetic
aggccctggctgctgatatgggcgcaggaagaccaggacaatttggcgatatccaaagtcgcacacctgagagtaaagacgtctacgctaatacacaactggtactgcagagaccggctggaccttttgggacagcggtg

SEQ ID NO: 9628 - DNA, 140 bp, Artificial Sequence
  Synthetic
caccgctgtcccaaaaggtccagccggtctctgcagtaccagttgtgtattagcgtagacgtctttactctcaggtgtgcgactttggatatcgccaaattgtcctggtcttcctgcgcccatatcagcagccagggcct

SEQ ID NO: 9629 - DNA, 140 bp, Artificial Sequence
  Synthetic
aggccctggctgctgatatgcgtgccgactgaagggctcgaggttacgtggggcaacaacgagccgtataagtattggccgcagttatctgcaaacggtacagcccacggccacccgcatgaccttttgggacagcggtg

SEQ ID NO: 9630 - DNA, 140 bp, Artificial Sequence
  Synthetic
caccgctgtcccaaaaggtcatgcgggtggccgtgggctgtaccgtttgcagataactgcggccaatacttatacggctcgttgttgccccacgtaacctcgagcccttcagtcggcacgcatatcagcagccagggcct

SEQ ID NO: 9631 - DNA, 140 bp, Artificial Sequence
  Synthetic
aggccctggctgctgatatggcgccctctttaacggacatgtcgtgcgaggtaccagcctgcacccattcctcagatttcgggggcgtcgccattattaaatatgcagccagtaagaaaggaccttttgggacagcggtg

SEQ ID NO: 9632 - DNA, 140 bp, Artificial Sequence
  Synthetic
caccgctgtcccaaaaggtcctttcttactggctgcatatttaataatggcgacgcccccgaaatctgaggaatgggtgcaggctggtacctcgcacgacatgtccgttaaagagggcgccatatcagcagccagggcct

SEQ ID NO: 9633 - DNA, 140 bp, Artificial Sequence
  Synthetic
atacgccatgctgggtctccgcaagtgtgcggtgcattcgatgaccaacgccgtcactattcgggaagctgagatagaagttgaagggaattcccagctgcaaatctctttctcgacggccgtacttgggagtcggccat

SEQ ID NO: 9634 - DNA, 140 bp, Artificial Sequence
  Synthetic
atggccgactcccaagtacggccgtcgagaaagagatttgcagctgggaattcccttcaacttctatctcagcttcccgaatagtgacggcgttggtcatcgaatgcaccgcacacttgcggagacccagcatggcgtat

SEQ ID NO: 9635 - DNA, 140 bp, Artificial Sequence
  Synthetic
atacgccatgctgggtctcccttagccagcgccgaattccgcgtacaagtctgttctacacaagcacactgtgcagccgagtgccaccctccgaaggaccacatagtcaattacccggcgcgtacttgggagtcggccat

SEQ ID NO: 9636 - DNA, 140 bp, Artificial Sequence
  Synthetic
atggccgactcccaagtacgcgccgggtaattgactatgtggtccttcggagggtggcactcggctgcacagtgtgcttgtgtagaacagacttgtacgcggaattcggcgctggctaagggagacccagcatggcgtat

SEQ ID NO: 9637 - DNA, 140 bp, Artificial Sequence
  Synthetic
aggccctggctgctgatatggtgcagccgagtgccaccctccgaaggaccacatagtcaattacccggcgtcacataccaccctcggggtccaggacatttccgccacggcgatgtcatggaccttttgggacagcggtg

SEQ ID NO: 9638 - DNA, 140 bp, Artificial Sequence
  Synthetic
caccgctgtcccaaaaggtccatgacatcgccgtggcggaaatgtcctggaccccgagggtggtatgtgacgccgggtaattgactatgtggtccttcggagggtggcactcggctgcaccatatcagcagccagggcct

SEQ ID NO: 9639 - DNA, 140 bp, Artificial Sequence
  Synthetic
aggccctggctgctgatatgtcacataccaccctcggggtccaggacatttccgccacggcgatgtcatgggtgcagaagatcacgggaggtgtgggactggttgtcgctgttgcagcacgaccttttgggacagcggtg

SEQ ID NO: 9640 - DNA, 140 bp, Artificial Sequence
  Synthetic
caccgctgtcccaaaaggtcgtgctgcaacagcgacaaccagtcccacacctcccgtgatcttctgcacccatgacatcgccgtggcggaaatgtcctggaccccgagggtggtatgtgacatatcagcagccagggcct

SEQ ID NO: 9641 - DNA, 140 bp, Artificial Sequence
  Synthetic
aggccctggctgctgatatgggtgcagaagatcacgggaggtgtgggactggttgtcgctgttgcagcactgattctaatcgtggtgctatgcgtgtcgtttagcaggcactaacttgacgaccttttgggacagcggtg

SEQ ID NO: 9642 - DNA, 140 bp, Artificial Sequence
  Synthetic
caccgctgtcccaaaaggtcgtcaagttagtgcctgctaaacgacacgcatagcaccacgattagaatcagtgctgcaacagcgacaaccagtcccacacctcccgtgatcttctgcacccatatcagcagccagggcct

SEQ ID NO: 9643 - DNA, 140 bp, Artificial Sequence
  Synthetic
atacgccatgctgggtctccaactaagtatgaaggtatatgtgtcccctaagagacacactgtacacagctaattatctatagatcaaagggctatacaacccctgaatagtaacaaaatcgtacttgggagtcggccat

SEQ ID NO: 9644 - DNA, 140 bp, Artificial Sequence
  Synthetic
atggccgactcccaagtacgattttgttactattcaggggttgtatagccctttgatctatagataattagctgtgtacagtgtgtctcttaggggacacatataccttcatacttagttggagacccagcatggcgtat

SEQ ID NO: 9645 - DNA, 140 bp, Artificial Sequence
  Synthetic
atacgccatgctgggtctccacaaaatcactaaaaattataaaaacagaaaaatatataaataggtatacgtgtcccctaagagacacattgtatgtaggtgataagtatagatcaaaggcgtacttgggagtcggccat

SEQ ID NO: 9646 - DNA, 140 bp, Artificial Sequence
  Synthetic
atggccgactcccaagtacgcctttgatctatacttatcacctacatacaatgtgtctcttaggggacacgtatacctatttatatatttttctgtttttataatttttagtgattttgtggagacccagcatggcgtat

SEQ ID NO: 9647 - DNA, 140 bp, Artificial Sequence
  Synthetic
atacgccatgctgggtctcctggacaccttttgacaacaaaatcgtggtgtacaaaggtgacgtttacaacatggactacccgccctttggcgcaggaagaccaggacaatttggcgatacgtacttgggagtcggccat

SEQ ID NO: 9648 - DNA, 140 bp, Artificial Sequence
  Synthetic
atggccgactcccaagtacgtatcgccaaattgtcctggtcttcctgcgccaaagggcgggtagtccatgttgtaaacgtcacctttgtacaccacgattttgttgtcaaaaggtgtccaggagacccagcatggcgtat

SEQ ID NO: 9649 - DNA, 140 bp, Artificial Sequence
  Synthetic
atacgccatgctgggtctccctaccagtttcttactgctctactctgcaaagcaagagattaataacccatcatggatcctgtgtacgtggatatagacgctgacagcgcctttttgaagcgtacttgggagtcggccat

SEQ ID NO: 9650 - DNA, 140 bp, Artificial Sequence
  Synthetic
atggccgactcccaagtacgcttcaaaaaggcgctgtcagcgtctatatccacgtacacaggatccatgatgggttattaatctcttgctttgcagagtagagcagtaagaaactggtagggagacccagcatggcgtat

SEQ ID NO: 9651 - DNA, 140 bp, Artificial Sequence
  Synthetic
aggccctggctgctgatatgaaaaccgtgcgaccgtgtgctgttctcagtagggtcaacgctctacccggaaagccgcaagctacttaagagctggcacctaccatcggtgttccatttagaccttttgggacagcggtg

SEQ ID NO: 9652 - DNA, 140 bp, Artificial Sequence
  Synthetic
caccgctgtcccaaaaggtctaaatggaacaccgatggtaggtgccagctcttaagtagcttgcggctttccgggtagagcgttgaccctactgagaacagcacacggtcgcacggttttcatatcagcagccagggcct

SEQ ID NO: 9653 - DNA, 140 bp, Artificial Sequence
  Synthetic
aggccctggctgctgatatgtgttctacacaagtacactgtgcagccgagtgccaccctccgaaggaccacatagtcaactacccggcgtcacataccaccctcggggtccaggacatttgaccttttgggacagcggtg

SEQ ID NO: 9654 - DNA, 140 bp, Artificial Sequence
  Synthetic
caccgctgtcccaaaaggtcaaatgtcctggaccccgagggtggtatgtgacgccgggtagttgactatgtggtccttcggagggtggcactcggctgcacagtgtacttgtgtagaacacatatcagcagccagggcct

SEQ ID NO: 9655 - DNA, 140 bp, Artificial Sequence
  Synthetic
atacgccatgctgggtctccccgctacggcgatgtcatgggtgcagaagatcacgggaggtgtgggactggttgtcgctgttgcagcactgattctaatcgtggtgctatgcgtgtcgttcgtacttgggagtcggccat

SEQ ID NO: 9656 - DNA, 140 bp, Artificial Sequence
  Synthetic
atggccgactcccaagtacgaacgacacgcatagcaccacgattagaatcagtgctgcaacagcgacaaccagtcccacacctcccgtgatcttctgcacccatgacatcgccgtagcggggagacccagcatggcgtat

SEQ ID NO: 9657 - DNA, 140 bp, Artificial Sequence
  Synthetic
atacgccatgctgggtctccgaaaatatctgaggccatacagatgcggacccaagtagagctgctggatgagcatatctccatagactgcgatattgttcgcgtgcaccctgacagcagccgtacttgggagtcggccat

SEQ ID NO: 9658 - DNA, 140 bp, Artificial Sequence
  Synthetic
atggccgactcccaagtacggctgctgtcagggtgcacgcgaacaatatcgcagtctatggagatatgctcatccagcagctctacttgggtccgcatctgtatggcctcagatattttcggagacccagcatggcgtat

SEQ ID NO: 9659 - DNA, 140 bp, Artificial Sequence
  Synthetic
aggccctggctgctgatatgccctgaatagtaacaaaatacaaaatcactaaaaattataaaaaaaaaaaaaaaaaaacagaaaaatatataaataggtatacgtgtcccctaagagacagaccttttgggacagcggtg

SEQ ID NO: 9660 - DNA, 140 bp, Artificial Sequence
  Synthetic
caccgctgtcccaaaaggtctgtctcttaggggacacgtatacctatttatatatttttctgtttttttttttttttttttataatttttagtgattttgtattttgttactattcagggcatatcagcagccagggcct

SEQ ID NO: 9661 - DNA, 140 bp, Artificial Sequence
  Synthetic
atacgccatgctgggtctccgaaggagaaatcgaaagcttgtcttctgagctactaactttcggagacttcttaccaggagaagtggacgacttgacagacagtgactggtccacgtgctcgtacttgggagtcggccat

SEQ ID NO: 9662 - DNA, 140 bp, Artificial Sequence
  Synthetic
atggccgactcccaagtacgagcacgtggaccagtcactgtctgtcaagtcgtccacttctcctggtaagaagtctccgaaagttagtagctcagaagacaagctttcgatttctccttcggagacccagcatggcgtat

SEQ ID NO: 9663 - DNA, 140 bp, Artificial Sequence
  Synthetic
aggccctggctgctgatatgaaacatgaaagcagcaatcatccagagactaaagagtggctgtagactatacttaatgtcagagaccccaaaagtccctacttatcggactacatatccggaccttttgggacagcggtg

SEQ ID NO: 9664 - DNA, 140 bp, Artificial Sequence
  Synthetic
caccgctgtcccaaaaggtccggatatgtagtccgataagtagggacttttggggtctctgacattaagtatagtctacagccactctttagtctctggatgattgctgctttcatgtttcatatcagcagccagggcct

SEQ ID NO: 9665 - DNA, 140 bp, Artificial Sequence
  Synthetic
aggccctggctgctgatatgccagcacatgtaaaggggaccatcgataacgcggacctggccaaactggccttcaagcggtcatctaagtatgaccttgaatgcgcgcagatacccgtgcgaccttttgggacagcggtg

SEQ ID NO: 9666 - DNA, 140 bp, Artificial Sequence
  Synthetic
caccgctgtcccaaaaggtcgcacgggtatctgcgcgcattcaaggtcatacttagatgaccgcttgaaggccagtttggccaggtccgcgttatcgatggtcccctttacatgtgctggcatatcagcagccagggcct

SEQ ID NO: 9667 - DNA, 140 bp, Artificial Sequence
  Synthetic
atacgccatgctgggtctccatccggcgcccgtgtactcgcctccgatcaacgtccgattgtccaatcccgagtccgcagtggcagcatgcaatgagttcttagctagaaactacccaaccgtacttgggagtcggccat

SEQ ID NO: 9668 - DNA, 140 bp, Artificial Sequence
  Synthetic
atggccgactcccaagtacggttgggtagtttctagctaagaactcattgcatgctgccactgcggactcgggattggacaatcggacgttgatcggaggcgagtacacgggcgccggatggagacccagcatggcgtat

SEQ ID NO: 9669 - DNA, 140 bp, Artificial Sequence
  Synthetic
atacgccatgctgggtctccatttcaccacgaccctcctgtgataggacgggaaaaattccattcccgaccgcagcacggtaaagagctaccttgcagcacttacgtgcagagcaccgcccgtacttgggagtcggccat

SEQ ID NO: 9670 - DNA, 140 bp, Artificial Sequence
  Synthetic
atggccgactcccaagtacgggcggtgctctgcacgtaagtgctgcaaggtagctctttaccgtgctgcggtcgggaatggaatttttcccgtcctatcacaggagggtcgtggtgaaatggagacccagcatggcgtat

SEQ ID NO: 9671 - DNA, 140 bp, Artificial Sequence
  Synthetic
atacgccatgctgggtctccatttcaccacgaccctcctgtgataggtcgggaaaaattccattcccgaccgcagcacggtaaagagctaccttgcagcacttacgtgcagagcaccgcccgtacttgggagtcggccat

SEQ ID NO: 9672 - DNA, 140 bp, Artificial Sequence
  Synthetic
atggccgactcccaagtacgggcggtgctctgcacgtaagtgctgcaaggtagctctttaccgtgctgcggtcgggaatggaatttttcccgacctatcacaggagggtcgtggtgaaatggagacccagcatggcgtat

SEQ ID NO: 9673 - DNA, 140 bp, Artificial Sequence
  Synthetic
atacgccatgctgggtctccatttcaccacgaccctcctgtgataggccgggaaaaattccattcccgaccgcagcacggtaaagagctaccttgcagcacttacgtgcagagcaccgcccgtacttgggagtcggccat

SEQ ID NO: 9674 - DNA, 140 bp, Artificial Sequence
  Synthetic
atggccgactcccaagtacgggcggtgctctgcacgtaagtgctgcaaggtagctctttaccgtgctgcggtcgggaatggaatttttcccggcctatcacaggagggtcgtggtgaaatggagacccagcatggcgtat

SEQ ID NO: 9675 - DNA, 140 bp, Artificial Sequence
  Synthetic
atacgccatgctgggtctccatttcaccacgaccctcctgtgatagggcgggaaaaattccattcccgaccgcagcacggtaaagagctaccttgcagcacttacgtgcagagcaccgcccgtacttgggagtcggccat

SEQ ID NO: 9676 - DNA, 140 bp, Artificial Sequence
  Synthetic
atggccgactcccaagtacgggcggtgctctgcacgtaagtgctgcaaggtagctctttaccgtgctgcggtcgggaatggaatttttcccgccctatcacaggagggtcgtggtgaaatggagacccagcatggcgtat

SEQ ID NO: 9677 - DNA, 140 bp, Artificial Sequence
  Synthetic
atacgccatgctgggtctccagacggtgcggtataagtgtaattgcggtggctcaaatgaaggactaacaactacagacaaagtgattaataactgcaaggttgatcaatgccatgccgccgtacttgggagtcggccat

SEQ ID NO: 9678 - DNA, 140 bp, Artificial Sequence
  Synthetic
atggccgactcccaagtacggcggcatggcattgatcaaccttgcagttattaatcactttgtctgtagttgttagtccttcatttgagccaccgcaattacacttataccgcaccgtctggagacccagcatggcgtat

SEQ ID NO: 9679 - DNA, 140 bp, Artificial Sequence
  Synthetic
atacgccatgctgggtctccggtcaccaatcacaaaaaatggcagtataactcccctctggtcccgcgtaatgctgaacttggggaccgacaaggaaaaattcacatcccgtttccgctgcgtacttgggagtcggccat

SEQ ID NO: 9680 - DNA, 140 bp, Artificial Sequence
  Synthetic
atggccgactcccaagtacgcagcggaaacgggatgtgaatttttccttgtcggtccccaagttcagcattacgcgggaccagaggggagttatactgccattttttgtgattggtgaccggagacccagcatggcgtat

SEQ ID NO: 9681 - DNA, 140 bp, Artificial Sequence
  Synthetic
atacgccatgctgggtctccacgtagcctaccagtttcttactgctctactctgcttagcaagagacttgagaacccatcatggatcccgtgtacgtggacatagacgctgacagcgcctcgtacttgggagtcggccat

SEQ ID NO: 9682 - DNA, 140 bp, Artificial Sequence
  Synthetic
atggccgactcccaagtacgaggcgctgtcagcgtctatgtccacgtacacgggatccatgatgggttctcaagtctcttgctaagcagagtagagcagtaagaaactggtaggctacgtggagacccagcatggcgtat

SEQ ID NO: 9683 - DNA, 140 bp, Artificial Sequence
  Synthetic
aggccctggctgctgatatgtgtcctaccggaatatgggagaagaaccaaactatcgagaagagtgggtgatgcataagaaggaagtcgtgctaaccgtgccgactgaagggctcgaggtgaccttttgggacagcggtg

SEQ ID NO: 9684 - DNA, 140 bp, Artificial Sequence
  Synthetic
caccgctgtcccaaaaggtcacctcgagcccttcagtcggcacggttagcacgacttccttcttatgcatcacccactcttctcgatagtttggttcttctcccatattccggtaggacacatatcagcagccagggcct

SEQ ID NO: 9685 - DNA, 140 bp, Artificial Sequence
  Synthetic
atacgccatgctgggtctccatgcataagaaggaagtcgtgctaaccgtgccgactgaagggctcgaggtcacgtggggcaacaacgagccgtataggtattggccgcagttatctacaacgtacttgggagtcggccat

SEQ ID NO: 9686 - DNA, 140 bp, Artificial Sequence
  Synthetic
atggccgactcccaagtacgttgtagataactgcggccaatacctatacggctcgttgttgccccacgtgacctcgagcccttcagtcggcacggttagcacgacttccttcttatgcatggagacccagcatggcgtat

SEQ ID NO: 9687 - DNA, 140 bp, Artificial Sequence
  Synthetic
aggccctggctgctgatatggagaaaactagcatctgccgcaggaaaagtcttggacagaaatatctccggaaaaatcggagatctacaagcagtaatggctgtacccgacgcagaaacggaccttttgggacagcggtg

SEQ ID NO: 9688 - DNA, 140 bp, Artificial Sequence
  Synthetic
caccgctgtcccaaaaggtccgtttctgcgtcgggtacagccattactgcttgtagatctccgatttttccggagatatttctgtccaagacttttcctgcggcagatgctagttttctccatatcagcagccagggcct

SEQ ID NO: 9689 - DNA, 140 bp, Artificial Sequence
  Synthetic
atacgccatgctgggtctcctctgcatcagctaagctccgcgtcctttaccaaggaaataacatcactgtaactgcctatgcaaacggcgatcatgccgttacagttaaggacgccaaatcgtacttgggagtcggccat

SEQ ID NO: 9690 - DNA, 140 bp, Artificial Sequence
  Synthetic
atggccgactcccaagtacgatttggcgtccttaactgtaacggcatgatcgccgtttgcataggcagttacagtgatgttatttccttggtaaaggacgcggagcttagctgatgcagaggagacccagcatggcgtat

SEQ ID NO: 9691 - DNA, 140 bp, Artificial Sequence; identical to SEQ ID NO: 6045
  Synthetic

SEQ ID NO: 9692 - DNA, 140 bp, Artificial Sequence; identical to SEQ ID NO: 6046
  Synthetic

SEQ ID NO: 9693 - DNA, 140 bp, Artificial Sequence
  Synthetic
aggccctggctgctgatatgtcgtgtgaaggctatgtcgttaagagaataacgattagcccgggcctctacggtaaaaccacagggtacgcagtaacccaccatgcagacggattcctatgaccttttgggacagcggtg

SEQ ID NO: 9694 - DNA, 140 bp, Artificial Sequence
  Synthetic
caccgctgtcccaaaaggtcataggaatccgtctgcatggtgggttactgcgtaccctgtggttttaccgtagaggcccgggctaatcgttattctcttaacgacatagccttcacacgacatatcagcagccagggcct

SEQ ID NO: 9695 - DNA, 140 bp, Artificial Sequence
  Synthetic
aggccctggctgctgatatgtcgtgtgaaggctatgtcgttaagagaataacgattagcccgggcctctacggtaaaaccacagggtacgcagtaacccaccatgcagacggattcctacgaccttttgggacagcggtg

SEQ ID NO: 9696 - DNA, 140 bp, Artificial Sequence
  Synthetic
caccgctgtcccaaaaggtcgtaggaatccgtctgcatggtgggttactgcgtaccctgtggttttaccgtagaggcccgggctaatcgttattctcttaacgacatagccttcacacgacatatcagcagccagggcct

SEQ ID NO: 9697 - DNA, 140 bp, Artificial Sequence
  Synthetic
aggccctggctgctgatatgtcgtgtgaaggctatgtcgttaagagaataacgattagcccgggcctctacggtaaaaccacagggtacgcagtaacccaccatgcagacggattcctaggaccttttgggacagcggtg

SEQ ID NO: 9698 - DNA, 140 bp, Artificial Sequence
  Synthetic
caccgctgtcccaaaaggtcctaggaatccgtctgcatggtgggttactgcgtaccctgtggttttaccgtagaggcccgggctaatcgttattctcttaacgacatagccttcacacgacatatcagcagccagggcct

SEQ ID NO: 9699 - DNA, 140 bp, Artificial Sequence
  Synthetic
atacgccatgctgggtctcctcattgtggggccaatgtcttcagcctggacacctttcgacaacaaaattgtggtgtacaaaggtgatgtctataacatggactacccgccctttggcgccgtacttgggagtcggccat

SEQ ID NO: 9700 - DNA, 140 bp, Artificial Sequence
  Synthetic
atggccgactcccaagtacggcgccaaagggcgggtagtccatgttatagacatcacctttgtacaccacaattttgttgtcgaaaggtgtccaggctgaagacattggccccacaatgaggagacccagcatggcgtat

SEQ ID NO: 9701 - DNA, 140 bp, Artificial Sequence
  Synthetic
atacgccatgctgggtctccgtctacaagaggcctgacactcagtcaattcagaaagtcccagccgagtttgacagctttgtggtaccaagtctgtggtcatctggactgtcgatcccgccgtacttgggagtcggccat

SEQ ID NO: 9702 - DNA, 140 bp, Artificial Sequence
  Synthetic
atggccgactcccaagtacggcgggatcgacagtccagatgaccacagacttggtaccacaaagctgtcaaactcggctgggactttctgaattgactgagtgtcaggcctcttgtagacggagacccagcatggcgtat

SEQ ID NO: 9703 - DNA, 140 bp, Artificial Sequence
  Synthetic
atacgccatgctgggtctccagggagttcgtaaataggaaattacaccatattgcgttgcacggaccagccctgaacactgacgaggagtcgtacgagctggtaagggcagaaaggacagcgtacttgggagtcggccat

SEQ ID NO: 9704 - DNA, 140 bp, Artificial Sequence
  Synthetic
atggccgactcccaagtacgctgtcctttctgcccttaccagctcgtacgactcctcgtcagtgttcagggctggtccgtgcaacgcaatatggtgtaatttcctatttacgaactccctggagacccagcatggcgtat

SEQ ID NO: 9705 - DNA, 140 bp, Artificial Sequence
  Synthetic
atacgccatgctgggtctccaagctaaaaccgtgcgaccgtgtgctgttctcagtagggtcaacgctctacccggaaagccgcaagctacttaagagctggcacctgccatccgtgttcccgtacttgggagtcggccat

SEQ ID NO: 9706 - DNA, 140 bp, Artificial Sequence
  Synthetic
atggccgactcccaagtacgggaacacggatggcaggtgccagctcttaagtagcttgcggctttccgggtagagcgttgaccctactgagaacagcacacggtcgcacggttttagcttggagacccagcatggcgtat

SEQ ID NO: 9707 - DNA, 140 bp, Artificial Sequence
  Synthetic
aggccctggctgctgatatgcctgaacactgacgaggagtcgtacgagctggtaagggcagaaaggacagagcacgagtacgtctatgatgtggaccaaagaaggtgctgcaagaaagaggaccttttgggacagcggtg

SEQ ID NO: 9708 - DNA, 140 bp, Artificial Sequence
  Synthetic
caccgctgtcccaaaaggtcctctttcttgcagcaccttctttggtccacatcatagacgtactcgtgctctgtcctttctgcccttaccagctcgtacgactcctcgtcagtgttcaggcatatcagcagccagggcct

SEQ ID NO: 9709 - DNA, 140 bp, Artificial Sequence
  Synthetic
aggccctggctgctgatatgtgagttcgcatatgaagggctgagaatccgccccgcctgcccatataagaccgcagtaataggggtctttggagtgccaggatccggcaaatcagcaatcgaccttttgggacagcggtg

SEQ ID NO: 9710 - DNA, 140 bp, Artificial Sequence
  Synthetic
caccgctgtcccaaaaggtcgattgctgatttgccggatcctggcactccaaagacccctattactgcggtcttatatgggcaggcggggcggattctcagcccttcatatgcgaactcacatatcagcagccagggcct

SEQ ID NO: 9711 - DNA, 140 bp, Artificial Sequence
  Synthetic
aggccctggctgctgatatgaaactgccaagaaatctccaccgacgtgatgcgacagaggaatctggagatatctgcacgcacggtcgactcactactcttgaacggatgcaacagaccagaccttttgggacagcggtg

SEQ ID NO: 9712 - DNA, 140 bp, Artificial Sequence
  Synthetic
caccgctgtcccaaaaggtctggtctgttgcatccgttcaagagtagtgagtcgaccgtgcgtgcagatatctccagattcctctgtcgcatcacgtcggtggagatttcttggcagtttcatatcagcagccagggcct

SEQ ID NO: 9713 - DNA, 140 bp, Artificial Sequence
  Synthetic
aggccctggctgctgatatgaacccgaacaccaacattatacctgccaacaggagactaccgcattcattggtggccgagcatcgcccggtaaaaggggagaggatggaatggttggtcagaccttttgggacagcggtg

SEQ ID NO: 9714 - DNA, 140 bp, Artificial Sequence
  Synthetic
caccgctgtcccaaaaggtctgaccaaccattccatcctctccccttttaccgggcgatgctcggccaccaatgaatgcggtagtctcctgttggcaggtataatgttggtgttcgggttcatatcagcagccagggcct

SEQ ID NO: 9715 - DNA, 140 bp, Artificial Sequence
  Synthetic
aggccctggctgctgatatgatgacctagtgattataaacatccacacaccctttcgcatacatcattaccaacagtgcgtggatcacgcgatgaagctgcagatgctcggaggagactcgaccttttgggacagcggtg

SEQ ID NO: 9716 - DNA, 140 bp, Artificial Sequence
  Synthetic
caccgctgtcccaaaaggtcgagtctcctccgagcatctgcagcttcatcgcgtgatccacgcactgttggtaatgatgtatgcgaaagggtgtgtggatgtttataatcactaggtcatcatatcagcagccagggcct

SEQ ID NO: 9717 - DNA, 140 bp, Artificial Sequence
  Synthetic
aggccctggctgctgatatgatttcgatgccatcatagccgcacactttaagccaggagacactgttttggaaacggacatagcctcctttgataagagccaagatgattcacttgcgctgaccttttgggacagcggtg

SEQ ID NO: 9718 - DNA, 140 bp, Artificial Sequence
  Synthetic
caccgctgtcccaaaaggtcagcgcaagtgaatcatcttggctcttatcaaaggaggctatgtccgtttccaaaacagtgtctcctggcttaaagtgtgcggctatgatggcatcgaaatcatatcagcagccagggcct

SEQ ID NO: 9719 - DNA, 140 bp, Artificial Sequence
  Synthetic
atacgccatgctgggtctcccattagactcaactgatgcagatgtggttatctactgccgcgacaaggagtgggagaagagaatagccgaggccatacaaatgaggacccaagtggaactcgtacttgggagtcggccat

SEQ ID NO: 9720 - DNA, 140 bp, Artificial Sequence
  Synthetic
atggccgactcccaagtacgagttccacttgggtcctcatttgtatggcctcggctattctcttctcccactccttgtcgcggcagtagataaccacatctgcatcagttgagtctaatgggagacccagcatggcgtat

SEQ ID NO: 9721 - DNA, 140 bp, Artificial Sequence
  Synthetic
aggccctggctgctgatatgactagatgaacacatctctgtagactgcgatatcatccgagtgcaccctgacagcagtttggcaggtagaaaagggtacagcactacagaaggttcactggaccttttgggacagcggtg

SEQ ID NO: 9722 - DNA, 140 bp, Artificial Sequence
  Synthetic
caccgctgtcccaaaaggtccagtgaaccttctgtagtgctgtacccttttctacctgccaaactgctgtcagggtgcactcggatgatatcgcagtctacagagatgtgttcatctagtcatatcagcagccagggcct

SEQ ID NO: 9723 - DNA, 140 bp, Artificial Sequence
  Synthetic
atacgccatgctgggtctccagtgttgacggtgaggtactgcccactccgtctgacctggaagctgatgctccgattccggagccaacaccagacgacagagcggtacttactttgcctccgtacttgggagtcggccat

SEQ ID NO: 9724 - DNA, 140 bp, Artificial Sequence
  Synthetic
atggccgactcccaagtacggaggcaaagtaagtaccgctctgtcgtctggtgttggctccggaatcggagcatcagcttccaggtcagacggagtgggcagtacctcaccgtcaacactggagacccagcatggcgtat

SEQ ID NO: 9725 - DNA, 140 bp, Artificial Sequence
  Synthetic
aggccctggctgctgatatgccagtcgcaccacccagaagaagacgtgggaaaaacttgaatgtcacctgcgacgatagagaagggaacgtacttcccatggctagcgttcggtttttcagaccttttgggacagcggtg

SEQ ID NO: 9726 - DNA, 140 bp, Artificial Sequence
  Synthetic
caccgctgtcccaaaaggtctgaaaaaccgaacgctagccatgggaagtacgttcccttctctatcgtcgcaggtgacattcaagtttttcccacgtcttcttctgggtggtgcgactggcatatcagcagccagggcct

SEQ ID NO: 9727 - DNA, 140 bp, Artificial Sequence
  Synthetic
aggccctggctgctgatatgtacaaacggtacagcccatggccacccgcatgagataattctgtattattatgagctgtaccctactatgactgtagtagttgtgtcagtggccacgttcgaccttttgggacagcggtg

SEQ ID NO: 9728 - DNA, 140 bp, Artificial Sequence
  Synthetic
caccgctgtcccaaaaggtcgaacgtggccactgacacaactactacagtcatagtagggtacagctcataataatacagaattatctcatgcgggtggccatgggctgtaccgtttgtacatatcagcagccagggcct

SEQ ID NO: 9729 - DNA, 140 bp, Artificial Sequence
  Synthetic
atacgccatgctgggtctccgagcggatctgcactccatcgtacaggaaacggcagagatacgcgatacggccgcgtccctccaggcgcccctgagtgtcgctacagaaccaaatcagctcgtacttgggagtcggccat

SEQ ID NO: 9730 - DNA, 140 bp, Artificial Sequence
  Synthetic
atggccgactcccaagtacgagctgatttggttctgtagcgacactcaggggcgcctggagggacgcggccgtatcgcgtatctctgccgtttcctgtacgatggagtgcagatccgctcggagacccagcatggcgtat

SEQ ID NO: 9731 - DNA, 140 bp, Artificial Sequence
  Synthetic
atacgccatgctgggtctccgccgatctcatttggagcaccaaacgagactttccccataacgttcggggattttgatgaaggggagatagaaagcttgtcctctgagttactgacctttcgtacttgggagtcggccat

SEQ ID NO: 9732 - DNA, 140 bp, Artificial Sequence
  Synthetic
atggccgactcccaagtacgaaaggtcagtaactcagaggacaagctttctatctccccttcatcaaaatccccgaacgttatggggaaagtctcgtttggtgctccaaatgagatcggcggagacccagcatggcgtat

SEQ ID NO: 9733 - DNA, 140 bp, Artificial Sequence
  Synthetic
aggccctggctgctgatatgcaaactctatttaatgtcggagaccccgaaagttcctacctaccgaactacatatccggcaccagtgtactcacccccaatcaatatccgactgtctaacgaccttttgggacagcggtg

SEQ ID NO: 9734 - DNA, 140 bp, Artificial Sequence
  Synthetic
caccgctgtcccaaaaggtcgttagacagtcggatattgattgggggtgagtacactggtgccggatatgtagttcggtaggtaggaactttcggggtctccgacattaaatagagtttgcatatcagcagccagggcct

SEQ ID NO: 9735 - DNA, 140 bp, Artificial Sequence
  Synthetic
aggccctggctgctgatatggacagttgcgtcgtaccaaatcaccgatgagtacgatgcatacctggacatggtggacgggtcagaaagctgccttgaccgggcgacgttcaatccatcagaccttttgggacagcggtg

SEQ ID NO: 9736 - DNA, 140 bp, Artificial Sequence
  Synthetic
caccgctgtcccaaaaggtctgatggattgaacgtcgcccggtcaaggcagctttctgacccgtccaccatgtccaggtatgcatcgtactcatcggtgatttggtacgacgcaactgtccatatcagcagccagggcct

SEQ ID NO: 9737 - DNA, 140 bp, Artificial Sequence
  Synthetic
atacgccatgctgggtctccaagcttagaagttatccaaaacagcactcctaccatgcacccacaatcagaagtgccgtaccttccccgttccagaatacgttgcagaacgtactggctgcgtacttgggagtcggccat

SEQ ID NO: 9738 - DNA, 140 bp, Artificial Sequence
  Synthetic
atggccgactcccaagtacgcagccagtacgttctgcaacgtattctggaacggggaaggtacggcacttctgattgtgggtgcatggtaggagtgctgttttggataacttctaagcttggagacccagcatggcgtat

SEQ ID NO: 9739 - DNA, 140 bp, Artificial Sequence
  Synthetic
aggccctggctgctgatatgaagtgccgtaccttccccgttccagaatacgttgcagaacgtactggctgctgccacgaaaagaaattgcaatgtcacacagatgagagaactgcctactgaccttttgggacagcggtg

SEQ ID NO: 9740 - DNA, 140 bp, Artificial Sequence
  Synthetic
caccgctgtcccaaaaggtcagtaggcagttctctcatctgtgtgacattgcaatttcttttcgtggcagcagccagtacgttctgcaacgtattctggaacggggaaggtacggcacttcatatcagcagccagggcct

SEQ ID NO: 9741 - DNA, 140 bp, Artificial Sequence
  Synthetic
aggccctggctgctgatatgagaacttgacgacctatgtcacaaaactaaaaggaccaaaagcagcagcattgtttgccaagacacataacctgctaccactgcaggaggtaccaatggagaccttttgggacagcggtg

SEQ ID NO: 9742 - DNA, 140 bp, Artificial Sequence
  Synthetic
caccgctgtcccaaaaggtctccattggtacctcctgcagtggtagcaggttatgtgtcttggcaaacaatgctgctgcttttggtccttttagttttgtgacataggtcgtcaagttctcatatcagcagccagggcct

SEQ ID NO: 9743 - DNA, 140 bp, Artificial Sequence
  Synthetic
atacgccatgctgggtctccgtgtcccctaagagacacattgtatgtagttgataagtatagatcaaagggccgaataacccctgaatagtaacaaaatatgaaaatcaataaaaaatcacgtacttgggagtcggccat

SEQ ID NO: 9744 - DNA, 140 bp, Artificial Sequence
  Synthetic
atggccgactcccaagtacgtgattttttattgattttcatattttgttactattcaggggttattcggccctttgatctatacttatcaactacatacaatgtgtctcttaggggacacggagacccagcatggcgtat

SEQ ID NO: 9745 - DNA, 140 bp, Artificial Sequence
  Synthetic
aggccctggctgctgatatggtctatggccacctttgcaagctctagatctaactttgagaagctcagaggacccatcgtaactctgtacggtggtcctaaataggtacgcattacagctgaccttttgggacagcggtg

SEQ ID NO: 9746 - DNA, 140 bp, Artificial Sequence
  Synthetic
caccgctgtcccaaaaggtcagctgtaatgcgtacctatttaggaccaccgtacagagttacgatgggtcctctgagcttctcaaagttagatctagagcttgcaaaggtggccatagaccatatcagcagccagggcct

SEQ ID NO: 9747 - DNA, 140 bp, Artificial Sequence
  Synthetic
aggccctggctgctgatatgaatggagttcatcccgacgcaaactttctacaacagaaggtaccaaccccgaccctgggccccacgccctacaatacaagtaattagacctagaccacgtgaccttttgggacagcggtg

SEQ ID NO: 9748 - DNA, 140 bp, Artificial Sequence
  Synthetic
caccgctgtcccaaaaggtcacgtggtctaggtctaattacttgtattgtagggcgtggggcccagggtcggggttggtaccttctgttgtagaaagtttgcgtcgggatgaactccattcatatcagcagccagggcct

SEQ ID NO: 9749 - DNA, 140 bp, Artificial Sequence
  Synthetic
aggccctggctgctgatatggcttcctaaaagcagccgaactcactttgagaagtaggcatagcataccgaactcttccacgattctccgaacccacagggacgtagagatgttattttggaccttttgggacagcggtg

SEQ ID NO: 9750 - DNA, 140 bp, Artificial Sequence
  Synthetic
caccgctgtcccaaaaggtccaaaataacatctctacgtccctgtgggttcggagaatcgtggaagagttcggtatgctatgcctacttctcaaagtgagttcggctgcttttaggaagccatatcagcagccagggcct

SEQ ID NO: 9751 - DNA, 140 bp, Artificial Sequence
  Synthetic
aggccctggctgctgatatgtactgctctactctgcaaagcaagagattaataacccatcatggatcctgtgtacgtggacatagacgctgacagcgcctttttgaaggccctgcaacgtgaccttttgggacagcggtg

SEQ ID NO: 9752 - DNA, 140 bp, Artificial Sequence
  Synthetic
caccgctgtcccaaaaggtcacgttgcagggccttcaaaaaggcgctgtcagcgtctatgtccacgtacacaggatccatgatgggttattaatctcttgctttgcagagtagagcagtacatatcagcagccagggcct

SEQ ID NO: 9753 - DNA, 140 bp, Artificial Sequence
  Synthetic
aggccctggctgctgatatgtgtacgtggacatagacgctgacagcgcctttttgaaggccctgcaacgtgcgtaccccatgtttgaggtggaaccaaggcaggtcacaccgaatgaccagaccttttgggacagcggtg

SEQ ID NO: 9754 - DNA, 140 bp, Artificial Sequence
  Synthetic
caccgctgtcccaaaaggtctggtcattcggtgtgacctgccttggttccacctcaaacatggggtacgcacgttgcagggccttcaaaaaggcgctgtcagcgtctatgtccacgtacacatatcagcagccagggcct

SEQ ID NO: 9755 - DNA, 140 bp, Artificial Sequence
  Synthetic
aggccctggctgctgatatggaggggtactataactggcatcacggagcagtgcagtattcaggaggccggttcactattccgacgggtgcaggcaagccgggagacagcggcagaccgagaccttttgggacagcggtg

SEQ ID NO: 9756 - DNA, 140 bp, Artificial Sequence
  Synthetic
caccgctgtcccaaaaggtctcggtctgccgctgtctcccggcttgcctgcacccgtcggaatagtgaaccggcctcctgaatactgcactgctccgtgatgccagttatagtacccctccatatcagcagccagggcct

SEQ ID NO: 9757 - DNA, 140 bp, Artificial Sequence
  Synthetic
aggccctggctgctgatatgcgattaccgggaccatgggacactttattctagcccgatgcccgaaaggagagacgctgacagtgggatttacggacagcagaaagatcagccacacatggaccttttgggacagcggtg

SEQ ID NO: 9758 - DNA, 140 bp, Artificial Sequence
  Synthetic
caccgctgtcccaaaaggtccatgtgtggctgatctttctgctgtccgtaaatcccactgtcagcgtctctcctttcgggcatcgggctagaataaagtgtcccatggtcccggtaatcgcatatcagcagccagggcct

SEQ ID NO: 9759 - DNA, 140 bp, Artificial Sequence
  Synthetic
aggccctggctgctgatatgaaattgaccccgactcaaccatcctggatatcggcagtgcgccagcaaggaggatgatgtcggacaggaagtaccactgcgtctgcccgatgcgcagtgcgaccttttgggacagcggtg

SEQ ID NO: 9760 - DNA, 140 bp, Artificial Sequence
  Synthetic
caccgctgtcccaaaaggtcgcactgcgcatcgggcagacgcagtggtacttcctgtccgacatcatcctccttgctggcgcactgccgatatccaggatggttgagtcggggtcaatttcatatcagcagccagggcct

SEQ ID NO: 9761 - DNA, 140 bp, Artificial Sequence
  Synthetic
aggccctggctgctgatatgatgctgtacacgcacccacgtcgctataccaccaggcgattaaaggggtccgagtggcgtactgggttgggttcgacacaaccccgttcatgtacaatgcgaccttttgggacagcggtg

SEQ ID NO: 9762 - DNA, 140 bp, Artificial Sequence
  Synthetic
caccgctgtcccaaaaggtcgcattgtacatgaacggggttgtgtcgaacccaacccagtacgccactcggacccctttaatcgcctggtggtatagcgacgtgggtgcgtgtacagcatcatatcagcagccagggcct

SEQ ID NO: 9763 - DNA, 140 bp, Artificial Sequence
  Synthetic
atacgccatgctgggtctccacgctaagtttgtcgtgggaccaatgtcctccgcctggacaccttttgacaacaaaatcgtggtgtataaaggcgacgtctacaacatggactacccacccgtacttgggagtcggccat

SEQ ID NO: 9764 - DNA, 140 bp, Artificial Sequence
  Synthetic
atggccgactcccaagtacgggtgggtagtccatgttgtagacgtcgcctttatacaccacgattttgttgtcaaaaggtgtccaggcggaggacattggtcccacgacaaacttagcgtggagacccagcatggcgtat

SEQ ID NO: 9765 - DNA, 140 bp, Artificial Sequence
  Synthetic
aggccctggctgctgatatgagacgaggcaagttgtctattatgagagggaaaaagctaaaaccgtgcgaccgtgtgctgttctcagtagggtcaacgctctacccggaaagccgcaagcgaccttttgggacagcggtg

SEQ ID NO: 9766 - DNA, 140 bp, Artificial Sequence
  Synthetic
caccgctgtcccaaaaggtcgcttgcggctttccgggtagagcgttgaccctactgagaacagcacacggtcgcacggttttagctttttccctctcataatagacaacttgcctcgtctcatatcagcagccagggcct

SEQ ID NO: 9767 - DNA, 140 bp, Artificial Sequence
  Synthetic
atacgccatgctgggtctccaaaggtaaatgtgcagtacattcgctgaccaacgccgttaccattcgagaagccgacgtagaagtagaggggaactcccagctgcaaatatccttctcaacgtacttgggagtcggccat

SEQ ID NO: 9768 - DNA, 140 bp, Artificial Sequence
  Synthetic
atggccgactcccaagtacgttgagaaggatatttgcagctgggagttcccctctacttctacgtcggcttctcgaatggtaacggcgttggtcagcgaatgtactgcacatttacctttggagacccagcatggcgtat

SEQ ID NO: 9769 - DNA, 140 bp, Artificial Sequence
  Synthetic
aggccctggctgctgatatgccgtgtgctgttctcagtagggtcaacgctctacccggaaagccgcaagctacttaagagctggcacctgccatcggtgttccatttaaagggcaaactcgaccttttgggacagcggtg

SEQ ID NO: 9770 - DNA, 140 bp, Artificial Sequence
  Synthetic
caccgctgtcccaaaaggtcgagtttgccctttaaatggaacaccgatggcaggtgccagctcttaagtagcttgcggctttccgggtagagcgttgaccctactgagaacagcacacggcatatcagcagccagggcct

SEQ ID NO: 9771 - DNA, 140 bp, Artificial Sequence
  Synthetic
aggccctggctgctgatatgcgatgataaggcacgaaataactaaatagtaaaagtagaaagtacataaccaggtatatgcgccccctaagaggcacaatatatatagctaagcactattgaccttttgggacagcggtg

SEQ ID NO: 9772 - DNA, 140 bp, Artificial Sequence
  Synthetic
caccgctgtcccaaaaggtcaatagtgcttagctatatatattgtgcctcttagggggcgcatatacctggttatgtactttctacttttactatttagttatttcgtgccttatcatcgcatatcagcagccagggcct

SEQ ID NO: 9773 - DNA, 140 bp, Artificial Sequence
  Synthetic
aggccctggctgctgatatgtacttaagagctggcacctgccatcggtgttccatttaaagggcaaactcagcttcacatgccgctgtgatacagtggtttcgtgtgagggctacgtcgtgaccttttgggacagcggtg

SEQ ID NO: 9774 - DNA, 140 bp, Artificial Sequence
  Synthetic
caccgctgtcccaaaaggtcacgacgtagccctcacacgaaaccactgtatcacagcggcatgtgaagctgagtttgccctttaaatggaacaccgatggcaggtgccagctcttaagtacatatcagcagccagggcct

SEQ ID NO: 9775 - DNA, 140 bp, Artificial Sequence
  Synthetic
aggccctggctgctgatatgcggtaacccaccacgcagacggattcctgatgtgcaagactaccgacacggttgacggcgaaagagtgtcattctcggtgtgcacatacgtgccggcgacgaccttttgggacagcggtg

SEQ ID NO: 9776 - DNA, 140 bp, Artificial Sequence
  Synthetic
caccgctgtcccaaaaggtcgtcgccggcacgtatgtgcacaccgagaatgacactctttcgccgtcaaccgtgtcggtagtcttgcacatcaggaatccgtctgcgtggtgggttaccgcatatcagcagccagggcct

SEQ ID NO: 9777 - DNA, 140 bp, Artificial Sequence
  Synthetic
atacgccatgctgggtctccagatcaaagggccatacaacccctgaatagtaacaaaacacaaaaatcaataaaaatcataaaaagaaaaatctcataaacaggtatacgtgtcccctaacgtacttgggagtcggccat

SEQ ID NO: 9778 - DNA, 140 bp, Artificial Sequence
  Synthetic
atggccgactcccaagtacgttaggggacacgtatacctgtttatgagatttttctttttatgatttttattgatttttgtgttttgttactattcaggggttgtatggccctttgatctggagacccagcatggcgtat

SEQ ID NO: 9779 - DNA, 140 bp, Artificial Sequence
  Synthetic
aggccctggctgctgatatggttgacggcgaaagagtgtcattctcggtgtgcacatacgtgccggcgaccatttgtgatcaaatgaccggcatccttgctacagaagtcacgccggagggaccttttgggacagcggtg

SEQ ID NO: 9780 - DNA, 140 bp, Artificial Sequence
  Synthetic
caccgctgtcccaaaaggtccctccggcgtgacttctgtagcaaggatgccggtcatttgatcacaaatggtcgccggcacgtatgtgcacaccgagaatgacactctttcgccgtcaaccatatcagcagccagggcct

SEQ ID NO: 9781 - DNA, 140 bp, Artificial Sequence
  Synthetic
aggccctggctgctgatatgatgcacagaagctgttggtggggctgaaccagagaatagtggttaacggcagaacgcaacggaatatgaacaccatgaaaaattatctgcttcccgtggtgaccttttgggacagcggtg

SEQ ID NO: 9782 - DNA, 140 bp, Artificial Sequence
  Synthetic
caccgctgtcccaaaaggtcaccacgggaagcagataatttttcatggtgttcatattccgttgcgttctgccgttaaccactattctctggttcagccccaccaacagcttctgtgcatcatatcagcagccagggcct

SEQ ID NO: 9783 - DNA, 140 bp, Artificial Sequence
  Synthetic
aggccctggctgctgatatgtaaaaatcataaaaagaaaaatctcataaacaggtatacgtgtcccctaagagacacattgtacgtaggtagtaagtatagatcaaagggctatattaacgaccttttgggacagcggtg

SEQ ID NO: 9784 - DNA, 140 bp, Artificial Sequence
  Synthetic
caccgctgtcccaaaaggtcgttaatatagccctttgatctatacttactacctacgtacaatgtgtctcttaggggacacgtatacctgtttatgagatttttctttttatgatttttacatatcagcagccagggcct

SEQ ID NO: 9785 - DNA, 140 bp, Artificial Sequence
  Synthetic
atacgccatgctgggtctccagcatcacacaccacccttggggtccaggatatatccacaacggcaatgtcttgggtgcagaagattacgggaggagtaggattaatcgttgctgttgctcgtacttgggagtcggccat

SEQ ID NO: 9786 - DNA, 140 bp, Artificial Sequence
  Synthetic
atggccgactcccaagtacgagcaacagcaacgattaatcctactcctcccgtaatcttctgcacccaagacattgccgttgtggatatatcctggaccccaagggtggtgtgtgatgctggagacccagcatggcgtat

SEQ ID NO: 9787 - DNA, 140 bp, Artificial Sequence
  Synthetic
aggccctggctgctgatatggcaacgagaagagacgtaggtatttaagcttcctaaaagcagccgaactcactttgagacgtaggcatagtataccgaactcttccactattctccgaacgaccttttgggacagcggtg

SEQ ID NO: 9788 - DNA, 140 bp, Artificial Sequence
  Synthetic
caccgctgtcccaaaaggtcgttcggagaatagtggaagagttcggtatactatgcctacgtctcaaagtgagttcggctgcttttaggaagcttaaatacctacgtctcttctcgttgccatatcagcagccagggcct

SEQ ID NO: 9789 - DNA, 140 bp, Artificial Sequence
  Synthetic
atacgccatgctgggtctcctgaggtggaaccaaggcaggtcacaccgaatgaccatgctaatgctagagcgttctcgcatctggctataaaactaatagagcaggaaattgaccccgaccgtacttgggagtcggccat

SEQ ID NO: 9790 - DNA, 140 bp, Artificial Sequence
  Synthetic
atggccgactcccaagtacggtcggggtcaatttcctgctctattagttttatagccagatgcgagaacgctctagcattagcatggtcattcggtgtgacctgccttggttccacctcaggagacccagcatggcgtat

SEQ ID NO: 9791 - DNA, 140 bp, Artificial Sequence
  Synthetic
atacgccatgctgggtctccaaccacctctttacagccatggactcgacggatgcagacgtggtcatctactgccgcgacaaagaatgggagaagaaaatatctgagaccatacagatgccgtacttgggagtcggccat

SEQ ID NO: 9792 - DNA, 140 bp, Artificial Sequence
  Synthetic
atggccgactcccaagtacggcatctgtatggtctcagatattttcttctcccattctttgtcgcggcagtagatgaccacgtctgcatccgtcgagtccatggctgtaaagaggtggttggagacccagcatggcgtat

SEQ ID NO: 9793 - DNA, 140 bp, Artificial Sequence
  Synthetic
atacgccatgctgggtctccagcgaaagcgcaacgatggtgtataacgaaagagagttcgtaaacagaaagctacaccatattgcgatgcacggaccagccctgaacaccgacgaagagtcgtacttgggagtcggccat

SEQ ID NO: 9794 - DNA, 140 bp, Artificial Sequence
  Synthetic
atggccgactcccaagtacgactcttcgtcggtgttcagggctggtccgtgcatcgcaatatggtgtagctttctgtttacgaactctctttcgttatacaccatcgttgcgctttcgctggagacccagcatggcgtat

SEQ ID NO: 9795 - DNA, 140 bp, Artificial Sequence
  Synthetic
aggccctggctgctgatatgacacagcaccatttggctgccaaatagcaacaaacccggtaagagcggtgaactgcgccgtagggaacatgcctatctccatcgacataccggaagcggcgaccttttgggacagcggtg

SEQ ID NO: 9796 - DNA, 140 bp, Artificial Sequence
  Synthetic
caccgctgtcccaaaaggtcgccgcttccggtatgtcgatggagataggcatgttccctacggcgcagttcaccgctcttaccgggtttgttgctatttggcagccaaatggtgctgtgtcatatcagcagccagggcct

SEQ ID NO: 9797 - DNA, 140 bp, Artificial Sequence
  Synthetic
atacgccatgctgggtctccaaaagctgaaaccgtgcgaccgtgtgctgttctcagtggggtcaacgctttacccggaaagccgcatgctacttaagagctggcacctaccatcggtgttcgtacttgggagtcggccat

SEQ ID NO: 9798 - DNA, 140 bp, Artificial Sequence
  Synthetic
atggccgactcccaagtacgaacaccgatggtaggtgccagctcttaagtagcatgcggctttccgggtaaagcgttgaccccactgagaacagcacacggtcgcacggtttcagcttttggagacccagcatggcgtat

SEQ ID NO: 9799 - DNA, 140 bp, Artificial Sequence
  Synthetic
aggccctggctgctgatatgtacccggaaagccgcatgctacttaagagctggcacctaccatcggtgttccatctaaagggcaaacttagcttcacatgccgctgtgacacagtggtttgaccttttgggacagcggtg

SEQ ID NO: 9800 - DNA, 140 bp, Artificial Sequence
  Synthetic
caccgctgtcccaaaaggtcaaaccactgtgtcacagcggcatgtgaagctaagtttgccctttagatggaacaccgatggtaggtgccagctcttaagtagcatgcggctttccgggtacatatcagcagccagggcct

SEQ ID NO: 9801 - DNA, 140 bp, Artificial Sequence
  Synthetic
aggccctggctgctgatatgcgtgtgagggctacgtcgtcaagagaataacgatgagcccaggcctttatggaaaaaccacggggtatgcggtaacccaccacgcagacggattcttgatgaccttttgggacagcggtg

SEQ ID NO: 9802 - DNA, 140 bp, Artificial Sequence
  Synthetic
caccgctgtcccaaaaggtcatcaagaatccgtctgcgtggtgggttaccgcataccccgtggtttttccataaaggcctgggctcatcgttattctcttgacgacgtagccctcacacgcatatcagcagccagggcct

SEQ ID NO: 9803 - DNA, 140 bp, Artificial Sequence
  Synthetic
atacgccatgctgggtctccgacagctttgtagtaccaggcctgtggtcgtccgggttgtcaatcccgttgaggactagaatcaagtggctgttacgcaaggtgccgaaagcagacctgacgtacttgggagtcggccat

SEQ ID NO: 9804 - DNA, 140 bp, Artificial Sequence
  Synthetic
atggccgactcccaagtacgtcaggtctgctttcggcaccttgcgtaacagccacttgattctagtcctcaacgggattgacaacccggacgaccacaggcctggtactacaaagctgtcggagacccagcatggcgtat

SEQ ID NO: 9805 - DNA, 140 bp, Artificial Sequence
  Synthetic
atacgccatgctgggtctccatagagctggtgctggaataatagagactccgagaggcgctattaaagttactgcccaactaaccgaccaagtcgtgggggagtacctggtactttcccccgtacttgggagtcggccat

SEQ ID NO: 9806 - DNA, 140 bp, Artificial Sequence
  Synthetic
atggccgactcccaagtacgggggaaagtaccaggtactcccccacgacttggtcggttagttgggcagtaactttaatagcgcctctcggagtctctattattccagcaccagctctatggagacccagcatggcgtat

SEQ ID NO: 9807 - DNA, 140 bp, Artificial Sequence
  Synthetic
atacgccatgctgggtctccgaatttgcatacgaagggctaaaaattcgccccgcttgtccatacaaaattgcagtcataggagtcttcggggtaccaggatctggtaagtcagccattacgtacttgggagtcggccat

SEQ ID NO: 9808 - DNA, 140 bp, Artificial Sequence
  Synthetic
atggccgactcccaagtacgtaatggctgacttaccagatcctggtaccccgaagactcctatgactgcaattttgtatggacaagcggggcgaatttttagcccttcgtatgcaaattcggagacccagcatggcgtat

SEQ ID NO: 9809 - DNA, 140 bp, Artificial Sequence
  Synthetic
atacgccatgctgggtctccaaagaaagtacccattcacaaaagggaagtggaacatcaacaagcagatctgcgtgactaccaggaggatagaagactttaaccctaccaccaacatcatcgtacttgggagtcggccat

SEQ ID NO: 9810 - DNA, 140 bp, Artificial Sequence
  Synthetic
atggccgactcccaagtacgatgatgttggtggtagggttaaagtcttctatcctcctggtagtcacgcagatctgcttgttgatgttccacttcccttttgtgaatgggtactttctttggagacccagcatggcgtat

SEQ ID NO: 9811 - DNA, 140 bp, Artificial Sequence
  Synthetic
aggccctggctgctgatatggtgctcctggtcagtggctataaccttgcactgcctactaagagagtcacttgggtagcgccgttaggtgtccgcggagcggactacacatacaacctaggaccttttgggacagcggtg

SEQ ID NO: 9812 - DNA, 140 bp, Artificial Sequence
  Synthetic
caccgctgtcccaaaaggtcctaggttgtatgtgtagtccgctccgcggacacctaacggcgctacccaagtgactctcttagtaggcagtgcaaggttatagccactgaccaggagcaccatatcagcagccagggcct

SEQ ID NO: 9813 - DNA, 140 bp, Artificial Sequence
  Synthetic
aggccctggctgctgatatgaatgaaactgcaaatgctcgggggtgactcattgagactgctcaaaccgggcggctctctattgatcagagcatatggttacgcagatagaaccagtgaagaccttttgggacagcggtg

SEQ ID NO: 9814 - DNA, 140 bp, Artificial Sequence
  Synthetic
caccgctgtcccaaaaggtcttcactggttctatctgcgtaaccatatgctctgatcaatagagagccgcccggtttgagcagtctcaatgagtcacccccgagcatttgcagtttcattcatatcagcagccagggcct

SEQ ID NO: 9815 - DNA, 140 bp, Artificial Sequence
  Synthetic
aggccctggctgctgatatgcgagtcatctgcgtattgggacgcaagtttagatcgtctagagcgttgaaaccaccatgtgtcaccagcaacactgagatgtttttcctattcagcaactgaccttttgggacagcggtg

SEQ ID NO: 9816 - DNA, 140 bp, Artificial Sequence
  Synthetic
caccgctgtcccaaaaggtcagttgctgaataggaaaaacatctcagtgttgctggtgacacatggtggtttcaacgctctagacgatctaaacttgcgtcccaatacgcagatgactcgcatatcagcagccagggcct

SEQ ID NO: 9817 - DNA, 140 bp, Artificial Sequence
  Synthetic
aggccctggctgctgatatgaatgcagccttcgtaggacaggtcacccgagcaggatgtgcaccgtcgtaccgggtaaaacgcatggacatcgcgaagaacgatgaagagtgcgtagtcagaccttttgggacagcggtg

SEQ ID NO: 9818 - DNA, 140 bp, Artificial Sequence
  Synthetic
caccgctgtcccaaaaggtctgactacgcactcttcatcgttcttcgcgatgtccatgcgttttacccggtacgacggtgcacatcctgctcgggtgacctgtcctacgaaggctgcattcatatcagcagccagggcct

SEQ ID NO: 9819 - DNA, 140 bp, Artificial Sequence
  Synthetic
aggccctggctgctgatatgctgagactgctcaaaccgggtggctctctattgatcagagcatacggttacgcagatagaaccagtgaacgagtaatctgcgtactgggacgtaagtttagaccttttgggacagcggtg

SEQ ID NO: 9820 - DNA, 140 bp, Artificial Sequence
  Synthetic
caccgctgtcccaaaaggtctaaacttacgtcccagtacgcagattactcgttcactggttctatctgcgtaaccgtatgctctgatcaatagagagccacccggtttgagcagtctcagcatatcagcagccagggcct

SEQ ID NO: 9821 - DNA, 140 bp, Artificial Sequence
  Synthetic
atacgccatgctgggtctccacgccgctaaccctcgcgggttaccgggtgacggtgtttgcaaggcagtatacaaaaaatggccggagtcctttaagaacagtgcaacaccagtgggaaccgtacttgggagtcggccat

SEQ ID NO: 9822 - DNA, 140 bp, Artificial Sequence
  Synthetic
atggccgactcccaagtacggttcccactggtgttgcactgttcttaaaggactccggccattttttgtatactgccttgcaaacaccgtcacccggtaacccgcgagggttagcggcgtggagacccagcatggcgtat

SEQ ID NO: 9823 - DNA, 140 bp, Artificial Sequence
  Synthetic
aggccctggctgctgatatgccgggtaaaacgcatggacatcgcgaagaacgatgaagagtgcgtagtcaacgccgctaaccctcgcgggttaccgggtgacggtgtttgcaaggcagtagaccttttgggacagcggtg

SEQ ID NO: 9824 - DNA, 140 bp, Artificial Sequence
  Synthetic
caccgctgtcccaaaaggtctactgccttgcaaacaccgtcacccggtaacccgcgagggttagcggcgttgactacgcactcttcatcgttcttcgcgatgtccatgcgttttacccggcatatcagcagccagggcct

SEQ ID NO: 9825 - DNA, 140 bp, Artificial Sequence
  Synthetic
aggccctggctgctgatatggcctatcgagaagtcgcaaaggaagtaactaggctgggagtaaatagtgtagctatacctctcctctccacaggtgtatactcaggagggaaagacaggcgaccttttgggacagcggtg

SEQ ID NO: 9826 - DNA, 140 bp, Artificial Sequence
  Synthetic
caccgctgtcccaaaaggtcgcctgtctttccctcctgagtatacacctgtggagaggagaggtatagctacactatttactcccagcctagttacttcctttgcgacttctcgataggccatatcagcagccagggcct

SEQ ID NO: 9827 - DNA, 140 bp, Artificial Sequence
  Synthetic
atacgccatgctgggtctccgacgtggtcatctactgccgcgacaaagaatgggagaagaaaatatctgaggccatacagatgcggacccaagtagagctgctggatgagcacatctccacgtacttgggagtcggccat

SEQ ID NO: 9828 - DNA, 140 bp, Artificial Sequence
  Synthetic
atggccgactcccaagtacgtggagatgtgctcatccagcagctctacttgggtccgcatctgtatggcctcagatattttcttctcccattctttgtcgcggcagtagatgaccacgtcggagacccagcatggcgtat

SEQ ID NO: 9829 - DNA, 140 bp, Artificial Sequence
  Synthetic
atacgccatgctgggtctccgactgggagtaaatagcgtagctatacctctcctctccacgggtgtatactcaggagggaaagacaggctaacccagtcactgaaccacctctttacagccgtacttgggagtcggccat

SEQ ID NO: 9830 - DNA, 140 bp, Artificial Sequence
  Synthetic
atggccgactcccaagtacggctgtaaagaggtggttcagtgactgggttagcctgtctttccctcctgagtatacacccgtggagaggagaggtatagctacgctatttactcccagtcggagacccagcatggcgtat

SEQ ID NO: 9831 - DNA, 140 bp, Artificial Sequence
  Synthetic
aggccctggctgctgatatgaacgcgtcacccggcttcgcatgaaccacgtcacaagcataattgtgtgttcttcgtttcccctcccaaagtacaaaatagaaggagtgcaaaaagtcaagaccttttgggacagcggtg

SEQ ID NO: 9832 - DNA, 140 bp, Artificial Sequence
  Synthetic
caccgctgtcccaaaaggtcttgactttttgcactccttctattttgtactttgggaggggaaacgaagaacacacaattatgcttgtgacgtggttcatgcgaagccgggtgacgcgttcatatcagcagccagggcct

SEQ ID NO: 9833 - DNA, 140 bp, Artificial Sequence
  Synthetic
aggccctggctgctgatatgcaagggaatatagatcttcccaggagtctgcacaggaggcgagtacaatcacgtcactgacgcatagtcaattcgacctaagcgttgatggcgagatactgaccttttgggacagcggtg

SEQ ID NO: 9834 - DNA, 140 bp, Artificial Sequence
  Synthetic
caccgctgtcccaaaaggtcagtatctcgccatcaacgcttaggtcgaattgactatgcgtcagtgacgtgattgtactcgcctcctgtgcagactcctgggaagatctatattcccttgcatatcagcagccagggcct

SEQ ID NO: 9835 - DNA, 140 bp, Artificial Sequence
  Synthetic
atacgccatgctgggtctccccagccctagaaccggccctagacgacggggcgatcggaaaccttgcggccgtgtctgactgggtaaagagcaccgtacctgtcgcgccgcctagaagaacgtacttgggagtcggccat

SEQ ID NO: 9836 - DNA, 140 bp, Artificial Sequence
  Synthetic
atggccgactcccaagtacgttcttctaggcggcgcgacaggtacggtgctctttacccagtcagacacggccgcaaggtttccgatcgccccgtcgtctagggccggttctagggctggggagacccagcatggcgtat

SEQ ID NO: 9837 - DNA, 140 bp, Artificial Sequence
  Synthetic
aggccctggctgctgatatgaaggcgagggagaaacctgactgtgacatgtgacgagagagaagggaatataacacccatggctagcgtccgattctttagggcagagctgtgtccggtcgaccttttgggacagcggtg

SEQ ID NO: 9838 - DNA, 140 bp, Artificial Sequence
  Synthetic
caccgctgtcccaaaaggtcgaccggacacagctctgccctaaagaatcggacgctagccatgggtgttatattcccttctctctcgtcacatgtcacagtcaggtttctccctcgccttcatatcagcagccagggcct

SEQ ID NO: 9839 - DNA, 140 bp, Artificial Sequence
  Synthetic
aggccctggctgctgatatggtacaagaaacagcggagacgcgtgacacagcaatgtctcttcaggcaccaccgagtaccgccacggaaccgaatcatccgccgatctccttcggagcatgaccttttgggacagcggtg

SEQ ID NO: 9840 - DNA, 140 bp, Artificial Sequence
  Synthetic
caccgctgtcccaaaaggtcatgctccgaaggagatcggcggatgattcggttccgtggcggtactcggtggtgcctgaagagacattgctgtgtcacgcgtctccgctgtttcttgtaccatatcagcagccagggcct

SEQ ID NO: 9841 - DNA, 140 bp, Artificial Sequence
  Synthetic
aggccctggctgctgatatgcaagcgagacgttccccattacatttggggacttcaacgaaggagaaatcgaaagcttgtcttctgagctactaactttcggagacttcttaccaggagagaccttttgggacagcggtg

SEQ ID NO: 9842 - DNA, 140 bp, Artificial Sequence
  Synthetic
caccgctgtcccaaaaggtctctcctggtaagaagtctccgaaagttagtagctcagaagacaagctttcgatttctccttcgttgaagtccccaaatgtaatggggaacgtctcgcttgcatatcagcagccagggcct

SEQ ID NO: 9843 - DNA, 140 bp, Artificial Sequence
  Synthetic
aggccctggctgctgatatgtggatgatttgacagatagcgactggtccacgtgctcagacacggacgacgagttatgactagacagggcaggtgggtatatattctcgtcggacactgggaccttttgggacagcggtg

SEQ ID NO: 9844 - DNA, 140 bp, Artificial Sequence
  Synthetic
caccgctgtcccaaaaggtcccagtgtccgacgagaatatatacccacctgccctgtctagtcataactcgtcgtccgtgtctgagcacgtggaccagtcgctatctgtcaaatcatccacatatcagcagccagggcct

SEQ ID NO: 9845 - DNA, 140 bp, Artificial Sequence
  Synthetic
aggccctggctgctgatatgacgagttatgactagacagggcaggtgggtatatattctcgtcggacaccggtccaggtcatttacaacagaagtcagtacgccagtcagtgctgccggtgaccttttgggacagcggtg

SEQ ID NO: 9846 - DNA, 140 bp, Artificial Sequence
  Synthetic
caccgctgtcccaaaaggtcaccggcagcactgactggcgtactgacttctgttgtaaatgacctggaccggtgtccgacgagaatatatacccacctgccctgtctagtcataactcgtcatatcagcagccagggcct

SEQ ID NO: 9847 - DNA, 140 bp, Artificial Sequence
  Synthetic
aggccctggctgctgatatgatgcaatgagttcttagctagaaactatccaactgtctcgtcataccaaattaccgacgagtatgatgcatatctagacatggtggacgggtcggagagtgaccttttgggacagcggtg

SEQ ID NO: 9848 - DNA, 140 bp, Artificial Sequence
  Synthetic
caccgctgtcccaaaaggtcactctccgacccgtccaccatgtctagatatgcatcatactcgtcggtaatttggtatgacgagacagttggatagtttctagctaagaactcattgcatcatatcagcagccagggcct

SEQ ID NO: 9849 - DNA, 140 bp, Artificial Sequence
  Synthetic
aggccctggctgctgatatggctgccagccctatcaggataacaactgagaatctaacaacctatgtcactaaactaaaggggccgaaagcagcagcgttgtttgcaagaacccataatcgaccttttgggacagcggtg

SEQ ID NO: 9850 - DNA, 140 bp, Artificial Sequence
  Synthetic
caccgctgtcccaaaaggtcgattatgggttcttgcaaacaacgctgctgctttcggcccctttagtttagtgacataggttgttagattctcagttgttatcctgatagggctggcagccatatcagcagccagggcct

SEQ ID NO: 9851 - DNA, 140 bp, Artificial Sequence
  Synthetic
aggccctggctgctgatatggaattcacagagaattggttaggagattgaacgccgtcctcctacccaatgtgcatacactatttgacatgtctgccgaggacttcgatgccattatagcgaccttttgggacagcggtg

SEQ ID NO: 9852 - DNA, 140 bp, Artificial Sequence
  Synthetic
caccgctgtcccaaaaggtcgctataatggcatcgaagtcctcggcagacatgtcaaatagtgtatgcacattgggtaggaggacggcgttcaatctcctaaccaattctctgtgaattccatatcagcagccagggcct

SEQ ID NO: 9853 - DNA, 140 bp, Artificial Sequence
  Synthetic
aggccctggctgctgatatgttgataagagccaggatgattcacttgcgctcaccgccttaatgctgttagaagatttgggagtggatcactctttgttggacctgatagaggctgctttgaccttttgggacagcggtg

SEQ ID NO: 9854 - DNA, 140 bp, Artificial Sequence
  Synthetic
caccgctgtcccaaaaggtcaaagcagcctctatcaggtccaacaaagagtgatccactcccaaatcttctaacagcattaaggcggtgagcgcaagtgaatcatcctggctcttatcaacatatcagcagccagggcct

SEQ ID NO: 9855 - DNA, 140 bp, Artificial Sequence
  Synthetic
atacgccatgctgggtctccttaaatatcaccatcgctagccgggtgttggaagatcgtctgacaaaatctgcgtgcgcggccttcatcggcgacgacaacataatacatggtgtcgtctcgtacttgggagtcggccat

SEQ ID NO: 9856 - DNA, 140 bp, Artificial Sequence
  Synthetic
atggccgactcccaagtacgagacgacaccatgtattatgttgtcgtcgccgatgaaggccgcgcacgcagattttgtcagacgatcttccaacacccggctagcgatggtgatatttaaggagacccagcatggcgtat

SEQ ID NO: 9857 - DNA, 140 bp, Artificial Sequence
  Synthetic
atacgccatgctgggtctccccgatgaattgatggcagccagatgcgctacttggatgaacatggaggtgaagatcatagatgcagttgtatcccagaaagctccttacttttgtggaggcgtacttgggagtcggccat

SEQ ID NO: 9858 - DNA, 140 bp, Artificial Sequence
  Synthetic
atggccgactcccaagtacgcctccacaaaagtaaggagctttctgggatacaactgcatctatgatcttcacctccatgttcatccaagtagcgcatctggctgccatcaattcatcggggagacccagcatggcgtat

SEQ ID NO: 9859 - DNA, 140 bp, Artificial Sequence
  Synthetic
atacgccatgctgggtctccggcggtcctaaataggtacgcactacagctacctattttgcagaagccgacagcaagtatctaaacactaatcagctacaatggagttcatcccaacccacgtacttgggagtcggccat

SEQ ID NO: 9860 - DNA, 140 bp, Artificial Sequence
  Synthetic
atggccgactcccaagtacgtgggttgggatgaactccattgtagctgattagtgtttagatacttgctgtcggcttctgcaaaataggtagctgtagtgcgtacctatttaggaccgccggagacccagcatggcgtat

SEQ ID NO: 9861 - DNA, 140 bp, Artificial Sequence
  Synthetic
aggccctggctgctgatatgcggtcctaaataggtacgcactacagctacctattttgcagaagccgacagtaggtacctaaataccaatcagccataatggagtttatcccaacccaaagaccttttgggacagcggtg

SEQ ID NO: 9862 - DNA, 140 bp, Artificial Sequence
  Synthetic
caccgctgtcccaaaaggtctttgggttgggataaactccattatggctgattggtatttaggtacctactgtcggcttctgcaaaataggtagctgtagtgcgtacctatttaggaccgcatatcagcagccagggcct

SEQ ID NO: 9863 - DNA, 140 bp, Artificial Sequence
  Synthetic
aggccctggctgctgatatgtgcccagctgatctcagcagttaataaactgacaatgcgcgtggtacctcaacagaagccgcgcaagaatcggaagaataagaagcaaaagcaaaagcaggaccttttgggacagcggtg

SEQ ID NO: 9864 - DNA, 140 bp, Artificial Sequence
  Synthetic
caccgctgtcccaaaaggtcctgcttttgcttttgcttcttattcttccgattcttgcgcggcttctgttgaggtaccacgcgcattgtcagtttattaactgctgagatcagctgggcacatatcagcagccagggcct

SEQ ID NO: 9865 - DNA, 140 bp, Artificial Sequence
  Synthetic
aggccctggctgctgatatgaaaccggctcaaaagaaaaagaagccgggccgcagagagaggatgtgcatgaaaatcgaaaatgattgtatttttgaagtcaagcacgaaggtaaggtaagaccttttgggacagcggtg

SEQ ID NO: 9866 - DNA, 140 bp, Artificial Sequence
  Synthetic
caccgctgtcccaaaaggtcttaccttaccttcgtgcttgacttcaaaaatacaatcattttcgattttcatgcacatcctctctctgcggcccggcttctttttcttttgagccggtttcatatcagcagccagggcct

SEQ ID NO: 9867 - DNA, 140 bp, Artificial Sequence
  Synthetic
aggccctggctgctgatatgggggaccatcgataacgcggacctggccaaattggccttcaagcggtcatctaagtacgaccttgaatgcgcgcagatacccgtgcacatgaagtccgacgaccttttgggacagcggtg

SEQ ID NO: 9868 - DNA, 140 bp, Artificial Sequence
  Synthetic
caccgctgtcccaaaaggtcgtcggacttcatgtgcacgggtatctgcgcgcattcaaggtcgtacttagatgaccgcttgaaggccaatttggccaggtccgcgttatcgatggtcccccatatcagcagccagggcct

SEQ ID NO: 9869 - DNA, 140 bp, Artificial Sequence
  Synthetic
atacgccatgctgggtctcccggagcagtacagtactcaggaggccgattcaccatccctacaggcgcgggcaaaccaggggatagtggtagaccgatcttcgacaacaaggggcgcgtgcgtacttgggagtcggccat

SEQ ID NO: 9870 - DNA, 140 bp, Artificial Sequence
  Synthetic
atggccgactcccaagtacgcacgcgccccttgttgtcgaagatcggtctaccactatcccctggtttgcccgcgcctgtagggatggtgaatcggcctcctgagtactgtactgctccgggagacccagcatggcgtat

SEQ ID NO: 9871 - DNA, 140 bp, Artificial Sequence
  Synthetic
aggccctggctgctgatatgccacgttcccctgctcccagcccccttgcacgccctgctgctacgaaaaggaaccggaggaaaccctacgcatgcttgaggacaacgtcatgagacctgggaccttttgggacagcggtg

SEQ ID NO: 9872 - DNA, 140 bp, Artificial Sequence
  Synthetic
caccgctgtcccaaaaggtcccaggtctcatgacgttgtcctcaagcatgcgtagggtttcctccggttccttttcgtagcagcagggcgtgcaagggggctgggagcaggggaacgtggcatatcagcagccagggcct

SEQ ID NO: 9873 - DNA, 140 bp, Artificial Sequence
  Synthetic
aggccctggctgctgatatgactatcagctgctacaagcatccttaacatgttctccccgacgccagcggcgcagtattaaggaccacttcaatgtctataaagccacaagaccgtacctgaccttttgggacagcggtg

SEQ ID NO: 9874 - DNA, 140 bp, Artificial Sequence
  Synthetic
caccgctgtcccaaaaggtcaggtacggtcttgtggctttatagacattgaagtggtccttaatactgcgccgctggcgtcggggagaacatgttaaggatgcttgtagcagctgatagtcatatcagcagccagggcct

SEQ ID NO: 9875 - DNA, 140 bp, Artificial Sequence
  Synthetic
atacgccatgctgggtctcccgcagtattaaggaccacttcaatgtctataaagccacaagaccgtacctagctcactgccccgactgtggagaagggcactcgtgccatagtcccgtagcgtacttgggagtcggccat

SEQ ID NO: 9876 - DNA, 140 bp, Artificial Sequence
  Synthetic
atggccgactcccaagtacgctacgggactatggcacgagtgcccttctccacagtcggggcagtgagctaggtacggtcttgtggctttatagacattgaagtggtccttaatactgcgggagacccagcatggcgtat

SEQ ID NO: 9877 - DNA, 140 bp, Artificial Sequence
  Synthetic
aggccctggctgctgatatgagctcactgccccgactgtggagaagggcactcgtgccatagtcccgtagcgctagaacgcatcagaaatgaagcgacagatgggacgttgaaaatccaggaccttttgggacagcggtg

SEQ ID NO: 9878 - DNA, 140 bp, Artificial Sequence
  Synthetic
caccgctgtcccaaaaggtcctggattttcaacgtcccatctgtcgcttcatttctgatgcgttctagcgctacgggactatggcacgagtgcccttctccacagtcggggcagtgagctcatatcagcagccagggcct

SEQ ID NO: 9879 - DNA, 140 bp, Artificial Sequence
  Synthetic
aggccctggctgctgatatgtatttgtaagaacgtcagcaccgtgcacgattactggaacaatgggacacttcattctggcccgatgtccgaaaggagaaactctgacggtggggttcacgaccttttgggacagcggtg

SEQ ID NO: 9880 - DNA, 140 bp, Artificial Sequence
  Synthetic
caccgctgtcccaaaaggtcgtgaaccccaccgtcagagtttctcctttcggacatcgggccagaatgaagtgtcccattgttccagtaatcgtgcacggtgctgacgttcttacaaatacatatcagcagccagggcct

SEQ ID NO: 9881 - DNA, 140 bp, Artificial Sequence
  Synthetic
atacgccatgctgggtctcctgacggtagaaagatcagtcactcatgtacgcacccatttcaccacgaccctcctgtgataggccgggaaaaatttcattcccgaccgcagcacggtaggcgtacttgggagtcggccat

SEQ ID NO: 9882 - DNA, 140 bp, Artificial Sequence
  Synthetic
atggccgactcccaagtacgcctaccgtgctgcggtcgggaatgaaatttttcccggcctatcacaggagggtcgtggtgaaatgggtgcgtacatgagtgactgatctttctaccgtcaggagacccagcatggcgtat

SEQ ID NO: 9883 - DNA, 140 bp, Artificial Sequence
  Synthetic
aggccctggctgctgatatgaagagctaccttgcagcacgtacgtgcagagcaccgccgcaactaccgaggagatagaggtacacatgcccccagacacccctgatcgcacattaatgtcgaccttttgggacagcggtg

SEQ ID NO: 9884 - DNA, 140 bp, Artificial Sequence
  Synthetic
caccgctgtcccaaaaggtcgacattaatgtgcgatcaggggtgtctgggggcatgtgtacctctatctcctcggtagttgcggcggtgctctgcacgtacgtgctgcaaggtagctcttcatatcagcagccagggcct

SEQ ID NO: 9885 - DNA, 140 bp, Artificial Sequence
  Synthetic
aggccctggctgctgatatggagatagaggtacacatgcccccagacacccctgatcgcacattaatgtcacaacagtccggcaacgtaaagatcacagtcaatggccagacggtgcggtgaccttttgggacagcggtg

SEQ ID NO: 9886 - DNA, 140 bp, Artificial Sequence
  Synthetic
caccgctgtcccaaaaggtcaccgcaccgtctggccattgactgtgatctttacgttgccggactgttgtgacattaatgtgcgatcaggggtgtctgggggcatgtgtacctctatctccatatcagcagccagggcct

SEQ ID NO: 9887 - DNA, 140 bp, Artificial Sequence
  Synthetic
aggccctggctgctgatatgaagtgcaattgtggtgattcaagcgaaggattaaccactacagataaagtgattaataactgcaaggttgatcaatgccatgccgcggtcaccaatcacagaccttttgggacagcggtg

SEQ ID NO: 9888 - DNA, 140 bp, Artificial Sequence
  Synthetic
caccgctgtcccaaaaggtctgtgattggtgaccgcggcatggcattgatcaaccttgcagttattaatcactttatctgtagtggttaatccttcgcttgaatcaccacaattgcacttcatatcagcagccagggcct

SEQ ID NO: 9889 - DNA, 140 bp, Artificial Sequence
  Synthetic
aggccctggctgctgatatggattaataactgcaaggttgatcaatgccatgccgcggtcaccaatcacaaaaaatggcagtacaattcccctctggtcccgcgcaatgctgaatccggggaccttttgggacagcggtg

SEQ ID NO: 9890 - DNA, 140 bp, Artificial Sequence
  Synthetic
caccgctgtcccaaaaggtccccggattcagcattgcgcgggaccagaggggaattgtactgccattttttgtgattggtgaccgcggcatggcattgatcaaccttgcagttattaatccatatcagcagccagggcct

SEQ ID NO: 9891 - DNA, 140 bp, Artificial Sequence
  Synthetic
atacgccatgctgggtctccgaccggaaaggaaaagttcacattccatttcctctggcaaatgtgacatgcagggtgcctaaagcaagaaaccccaccgtgacgtacggaaaaaaccaagcgtacttgggagtcggccat

SEQ ID NO: 9892 - DNA, 140 bp, Artificial Sequence
  Synthetic
atggccgactcccaagtacgcttggttttttccgtacgtcacggtggggtttcttgctttaggcaccctgcatgtcacatttgccagaggaaatggaatgtgaacttttcctttccggtcggagacccagcatggcgtat

SEQ ID NO: 9893 - DNA, 140 bp, Artificial Sequence
  Synthetic
aggccctggctgctgatatgcaacgagccgtataagtattggccgcagttatctacaaacggtacagcccatggccacccgcatgagataattctgtattattatgagctgtaccctactgaccttttgggacagcggtg

SEQ ID NO: 9894 - DNA, 140 bp, Artificial Sequence
  Synthetic
caccgctgtcccaaaaggtcagtagggtacagctcataataatacagaattatctcatgcgggtggccatgggctgtaccgtttgtagataactgcggccaatacttatacggctcgttgcatatcagcagccagggcct

SEQ ID NO: 9895 - DNA, 140 bp, Artificial Sequence
  Synthetic
atacgccatgctgggtctccatggccacccgcatgagataattctgtattattatgagctgtaccctactatgactgtagtagttgtatcagtggccacgttcatactcctgtcaatggtcgtacttgggagtcggccat

SEQ ID NO: 9896 - DNA, 140 bp, Artificial Sequence
  Synthetic
atggccgactcccaagtacgaccattgacaggagtatgaacgtggccactgatacaactactacagtcatagtagggtacagctcataataatacagaattatctcatgcgggtggccatggagacccagcatggcgtat

SEQ ID NO: 9897 - DNA, 140 bp, Artificial Sequence
  Synthetic
aggccctggctgctgatatgatgactgtagtagttgtatcagtggccacgttcatactcctgtcaatggtgggtatggcagcggggatgtgcatgtgtgcacgacgcagatgcatcacacgaccttttgggacagcggtg

SEQ ID NO: 9898 - DNA, 140 bp, Artificial Sequence
  Synthetic
caccgctgtcccaaaaggtcgtgtgatgcatctgcgtcgtgcacacatgcacatccccgctgccatacccaccattgacaggagtatgaacgtggccactgatacaactactacagtcatcatatcagcagccagggcct

SEQ ID NO: 9899 - DNA, 140 bp, Artificial Sequence
  Synthetic
aggccctggctgctgatatggggtatggcagcggggatgtgcatgtgtgcacgacgcagatgcatcacaccgtatgaactgacaccaggagctaccgtccctttcctgcttagcctaatagaccttttgggacagcggtg

SEQ ID NO: 9900 - DNA, 140 bp, Artificial Sequence
  Synthetic
caccgctgtcccaaaaggtctattaggctaagcaggaaagggacggtagctcctggtgtcagttcatacggtgtgatgcatctgcgtcgtgcacacatgcacatccccgctgccataccccatatcagcagccagggcct

SEQ ID NO: 9901 - DNA, 140 bp, Artificial Sequence
  Synthetic
aggccctggctgctgatatggtgtggcagtggggatgtgcatgtgtgcacgacgcagatgcattacaccatacgaactgacaccaggagctaccgtccctttcctgcttagcctaatatggaccttttgggacagcggtg

SEQ ID NO: 9902 - DNA, 140 bp, Artificial Sequence
  Synthetic
caccgctgtcccaaaaggtccatattaggctaagcaggaaagggacggtagctcctggtgtcagttcgtatggtgtaatgcatctgcgtcgtgcacacatgcacatccccactgccacaccatatcagcagccagggcct

SEQ ID NO: 9903 - DNA, 140 bp, Artificial Sequence
  Synthetic
aggccctggctgctgatatgtgtggaacgagcagcagcctttattttggctgcaagcccttattccgctggcagccctgatcgtcctatgcaactgtctgagactcctaccatgctgttggaccttttgggacagcggtg

SEQ ID NO: 9904 - DNA, 140 bp, Artificial Sequence
  Synthetic
caccgctgtcccaaaaggtccaacagcatggtaggagtctcagacagttgcataggacgatcagggctgccagcggaataagggcttgcagccaaaataaaggctgctgctcgttccacacatatcagcagccagggcct

SEQ ID NO: 9905 - DNA, 140 bp, Artificial Sequence
  Synthetic
aggccctggctgctgatatggcgcgtacgaacacgtaacagtgatcccgaacacggtgggagtaccgtataagactctagtcaacagaccgggctacagccccatggtactggagatggagaccttttgggacagcggtg

SEQ ID NO: 9906 - DNA, 140 bp, Artificial Sequence
  Synthetic
caccgctgtcccaaaaggtctccatctccagtaccatggggctgtagcccggtctgttgactagagtcttatacggtactcccaccgtgttcgggatcactgttacgtgttcgtacgcgccatatcagcagccagggcct

SEQ ID NO: 9907 - DNA, 140 bp, Artificial Sequence
  Synthetic
atacgccatgctgggtctccgcttctgtctgtcaccttggaaccgacgctatcgcttgattacatcacgtgcgagtataaaaccgttatcccgtctccgtacgtgaaatgctgcggtacgcgtacttgggagtcggccat

SEQ ID NO: 9908 - DNA, 140 bp, Artificial Sequence
  Synthetic
atggccgactcccaagtacgcgtaccgcagcatttcacgtacggagacgggataacggttttatactcgcacgtgatgtaatcaagcgatagcgtcggttccaaggtgacagacagaagcggagacccagcatggcgtat

SEQ ID NO: 9909 - DNA, 140 bp, Artificial Sequence
  Synthetic
aggccctggctgctgatatggaactactgtcagtcactttggagccaacactatcgcttgattacatcacgtgcgagtacaaaaccgtcatcccgtctccgtacgtgaagtgctgcggtagaccttttgggacagcggtg

SEQ ID NO: 9910 - DNA, 140 bp, Artificial Sequence
  Synthetic
caccgctgtcccaaaaggtctaccgcagcacttcacgtacggagacgggatgacggttttgtactcgcacgtgatgtaatcaagcgatagtgttggctccaaagtgactgacagtagttccatatcagcagccagggcct

SEQ ID NO: 9911 - DNA, 140 bp, Artificial Sequence
  Synthetic
atacgccatgctgggtctccgcagagtgtaaggacaagagcctacctgattacagctgtaaggtcttcaccggcgtctacccattcatgtggggcggcgcctactgcttctgcgacaccgcgtacttgggagtcggccat

SEQ ID NO: 9912 - DNA, 140 bp, Artificial Sequence
  Synthetic
atggccgactcccaagtacgcggtgtcgcagaagcagtaggcgccgccccacatgaatgggtagacgccggtgaagaccttacagctgtaatcaggtaggctcttgtccttacactctgcggagacccagcatggcgtat

SEQ ID NO: 9913 - DNA, 140 bp, Artificial Sequence
  Synthetic
atacgccatgctgggtctccagaatacgcaattgagcgaagcacatgtggagaagtccgaatcatgcaaaacagaatttgcatcagcatatagggctcataccgcatccgcatcagctaacgtacttgggagtcggccat

SEQ ID NO: 9914 - DNA, 140 bp, Artificial Sequence
  Synthetic
atggccgactcccaagtacgttagctgatgcggatgcggtatgagccctatatgctgatgcaaattctgttttgcatgattcggacttctccacatgtgcttcgctcaattgcgtattctggagacccagcatggcgtat

SEQ ID NO: 9915 - DNA, 140 bp, Artificial Sequence
  Synthetic
aggccctggctgctgatatgaagctccgcgtcctttaccaaggaaataacatcactgtaactgcctatgcaaacggcgaccatgccgtcacagttaaggacgccaaattcattgtggggcgaccttttgggacagcggtg

SEQ ID NO: 9916 - DNA, 140 bp, Artificial Sequence
  Synthetic
caccgctgtcccaaaaggtcgccccacaatgaatttggcgtccttaactgtgacggcatggtcgccgtttgcataggcagttacagtgatgttatttccttggtaaaggacgcggagcttcatatcagcagccagggcct

SEQ ID NO: 9917 - DNA, 140 bp, Artificial Sequence
  Synthetic
aggccctggctgctgatatgaatacacaactggtactgcagagaccgtccgcgggtacggtgcacgtgccgtactctcaggcaccatctggcttcaagtattggctaaaagaacgagggggaccttttgggacagcggtg

SEQ ID NO: 9918 - DNA, 140 bp, Artificial Sequence
  Synthetic
caccgctgtcccaaaaggtccccctcgttcttttagccaatacttgaagccagatggtgcctgagagtacggcacgtgcaccgtacccgcggacggtctctgcagtaccagttgtgtattcatatcagcagccagggcct

SEQ ID NO: 9919 - DNA, 140 bp, Artificial Sequence
  Synthetic
aggccctggctgctgatatggtaagagcgatgaactgcgccgtagggaacatgcctatctccatcgacataccggacgcggcctttaccagggtcgtcgacgcgccatctttaacggatagaccttttgggacagcggtg

SEQ ID NO: 9920 - DNA, 140 bp, Artificial Sequence
  Synthetic
caccgctgtcccaaaaggtctatccgttaaagatggcgcgtcgacgaccctggtaaaggccgcgtccggtatgtcgatggagataggcatgttccctacggcgcagttcatcgctcttaccatatcagcagccagggcct

SEQ ID NO: 9921 - DNA, 140 bp, Artificial Sequence
  Synthetic
atacgccatgctgggtctcctgtcgtgtgaggtatcagcctgcacccattcctcagactttgggggcgtagccatcattaaatatgcagccagtaagaaaggcaagtgtgcagtgcattccgtacttgggagtcggccat

SEQ ID NO: 9922 - DNA, 140 bp, Artificial Sequence
  Synthetic
atggccgactcccaagtacggaatgcactgcacacttgcctttcttactggctgcatatttaatgatggctacgcccccaaagtctgaggaatgggtgcaggctgatacctcacacgacaggagacccagcatggcgtat

SEQ ID NO: 9923 - DNA, 140 bp, Artificial Sequence
  Synthetic
aggccctggctgctgatatggatgactaacgccgtcactattcgggaagctgaaatagaagtagaagggaactctcagttgcaaatctctttttcgacggccctagccagcgccgaattcgaccttttgggacagcggtg

SEQ ID NO: 9924 - DNA, 140 bp, Artificial Sequence
  Synthetic
caccgctgtcccaaaaggtcgaattcggcgctggctagggccgtcgaaaaagagatttgcaactgagagttcccttctacttctatttcagcttcccgaatagtgacggcgttagtcatccatatcagcagccagggcct

SEQ ID NO: 9925 - DNA, 140 bp, Artificial Sequence
  Synthetic
aggccctggctgctgatatgtcgatgactaacgccgtcactattcgggaagctgagatagaagttgaagggaattctcagctgcaaatctctttctcgacggccttagccagcgccgaatgaccttttgggacagcggtg

SEQ ID NO: 9926 - DNA, 140 bp, Artificial Sequence
  Synthetic
caccgctgtcccaaaaggtcattcggcgctggctaaggccgtcgagaaagagatttgcagctgagaattcccttcaacttctatctcagcttcccgaatagtgacggcgttagtcatcgacatatcagcagccagggcct

SEQ ID NO: 9927 - DNA, 140 bp, Artificial Sequence
  Synthetic
atacgccatgctgggtctcccccccgaaggaccacatagtcaactacccggcgtcacataccaccctcggggtccaggacatctccgctacggcgatggcatgggtgcagaagatcacggcgtacttgggagtcggccat

SEQ ID NO: 9928 - DNA, 140 bp, Artificial Sequence
  Synthetic
atggccgactcccaagtacgccgtgatcttctgcacccatgccatcgccgtagcggagatgtcctggaccccgagggtggtatgtgacgccgggtagttgactatgtggtccttcgggggggagacccagcatggcgtat

SEQ ID NO: 9929 - DNA, 140 bp, Artificial Sequence
  Synthetic
aggccctggctgctgatatgcgcgtccctaaagagacacaccacatatagctaagaatcaatagataagtatagtaacaaaatataaaaatcaacaaaaatcataaaatagaaaactagagaccttttgggacagcggtg

SEQ ID NO: 9930 - DNA, 140 bp, Artificial Sequence
  Synthetic
caccgctgtcccaaaaggtctctagttttctattttatgatttttgttgatttttatattttgttactatacttatctattgattcttagctatatgtggtgtgtctctttagggacgcgcatatcagcagccagggcct

SEQ ID NO: 9931 - DNA, 140 bp, Artificial Sequence
  Synthetic
atacgccatgctgggtctccatagtaacaaaatataaaaatcaacaaaaatcataaaatagaaaactagaaatagaagtaggtaagaaggtatatgtgtcccctgagagacacaccatatcgtacttgggagtcggccat

SEQ ID NO: 9932 - DNA, 140 bp, Artificial Sequence
  Synthetic
atggccgactcccaagtacgatatggtgtgtctctcaggggacacatataccttcttacctacttctatttctagttttctattttatgatttttgttgatttttatattttgttactatggagacccagcatggcgtat

SEQ ID NO: 9933 - DNA, 140 bp, Artificial Sequence
  Synthetic
aggccctggctgctgatatgaaacagaagtagtttaaagggctataaaacccctgaatagtaacaaaacataaagttaataaaaatcaaatgaataccataattggcaaacggaagagatgaccttttgggacagcggtg

SEQ ID NO: 9934 - DNA, 140 bp, Artificial Sequence
  Synthetic
caccgctgtcccaaaaggtcatctcttccgtttgccaattatggtattcatttgatttttattaactttatgttttgttactattcaggggttttatagccctttaaactacttctgtttcatatcagcagccagggcct

SEQ ID NO: 9935 - DNA, 140 bp, Artificial Sequence
  Synthetic
atacgccatgctgggtctccaccaataaaaatcataaaatagaaaaccctaaacagaagtagttcaaagggctataaaacccctgaatagtaacaaaatataaaactaacaaaaatcaaacgtacttgggagtcggccat

SEQ ID NO: 9936 - DNA, 140 bp, Artificial Sequence
  Synthetic
atggccgactcccaagtacgtttgatttttgttagttttatattttgttactattcaggggttttatagccctttgaactacttctgtttagggttttctattttatgatttttattggtggagacccagcatggcgtat

SEQ ID NO: 9937 - DNA, 140 bp, Artificial Sequence
  Synthetic
atacgccatgctgggtctccatggctgcgtgagacacacgtagcctaccagtttcttactgctctactctgcttagcaagagacttgagaacccatcatggatcccgtgtacgtggacatcgtacttgggagtcggccat

SEQ ID NO: 9938 - DNA, 140 bp, Artificial Sequence
  Synthetic
atggccgactcccaagtacgatgtccacgtacacgggatccatgatgggttctcaagtctcttgctaagcagagtagagcagtaagaaactggtaggctacgtgtgtctcacgcagccatggagacccagcatggcgtat

SEQ ID NO: 9939 - DNA, 140 bp, Artificial Sequence
  Synthetic
atacgccatgctgggtctccagacgccgacagcgcctttttaaaggccctgcagcgtgcgtaccccatgtttgaggtggaaccaaggcaggtcacaccgaatgaccatgccaatgctagacgtacttgggagtcggccat

SEQ ID NO: 9940 - DNA, 140 bp, Artificial Sequence
  Synthetic
atggccgactcccaagtacgtctagcattggcatggtcattcggtgtgacctgccttggttccacctcaaacatggggtacgcacgctgcagggcctttaaaaaggcgctgtcggcgtctggagacccagcatggcgtat

SEQ ID NO: 9941 - DNA, 140 bp, Artificial Sequence
  Synthetic
aggccctggctgctgatatgtagcctaccagtttcttactgctctactctgcaaagcaagagattaataacccatcatggatcctgtgtacgtggacatagacgctgacagcgcctttttgaccttttgggacagcggtg

SEQ ID NO: 9942 - DNA, 140 bp, Artificial Sequence
  Synthetic
caccgctgtcccaaaaggtcaaaaaggcgctgtcagcgtctatgtccacgtacacaggatccatgatgggttattaatctcttgctttgcagagtagagcagtaagaaactggtaggctacatatcagcagccagggcct

SEQ ID NO: 9943 - DNA, 140 bp, Artificial Sequence
  Synthetic
aggccctggctgctgatatggcattctcgcatctagctataaaactaatagagcaggaaattgatcccgactcaaccatcctggacataggcagcgcgccagcaaggaggatgatgtcgggaccttttgggacagcggtg

SEQ ID NO: 9944 - DNA, 140 bp, Artificial Sequence
  Synthetic
caccgctgtcccaaaaggtcccgacatcatcctccttgctggcgcgctgcctatgtccaggatggttgagtcgggatcaatttcctgctctattagttttatagctagatgcgagaatgccatatcagcagccagggcct

SEQ ID NO: 9945 - DNA, 140 bp, Artificial Sequence
  Synthetic
aggccctggctgctgatatgtaaagttaataaaaatcaaatgaataccataattggcaaacggaagagatgtaggtacttaagcttcctaaaagcagccgaactcactttgagaagtagggaccttttgggacagcggtg

SEQ ID NO: 9946 - DNA, 140 bp, Artificial Sequence
  Synthetic
caccgctgtcccaaaaggtccctacttctcaaagtgagttcggctgcttttaggaagcttaagtacctacatctcttccgtttgccaattatggtattcatttgatttttattaactttacatatcagcagccagggcct

SEQ ID NO: 9947 - DNA, 140 bp, Artificial Sequence
  Synthetic
atacgccatgctgggtctccataggaagtaccactgcgtttgccctatgcgcagcgcagaagaccctgagagactcgccaactacgcgagaaaactagcatctgccgcaggaaaagtcttcgtacttgggagtcggccat

SEQ ID NO: 9948 - DNA, 140 bp, Artificial Sequence
  Synthetic
atggccgactcccaagtacgaagacttttcctgcggcagatgctagttttctcgcgtagttggcgagtctctcagggtcttctgcgctgcgcatagggcaaacgcagtggtacttcctatggagacccagcatggcgtat

SEQ ID NO: 9949 - DNA, 140 bp, Artificial Sequence
  Synthetic
aggccctggctgctgatatgagactcgccaactacgcgagaaaactagcatctgccgcaggaaaagtcttggacagaaacatctccgaaaaaattggagatctacaagcagtaatggctggaccttttgggacagcggtg

SEQ ID NO: 9950 - DNA, 140 bp, Artificial Sequence
  Synthetic
caccgctgtcccaaaaggtccagccattactgcttgtagatctccaattttttcggagatgtttctgtccaagacttttcctgcggcagatgctagttttctcgcgtagttggcgagtctcatatcagcagccagggcct

SEQ ID NO: 9951 - DNA, 140 bp, Artificial Sequence
  Synthetic
atacgccatgctgggtctcctaccagacgcagaaacgcccacattctgcttgcacactgacgtctcatgtagacaaagggcggacgtcgctatataccaggatgtctacgccgtgcatgccgtacttgggagtcggccat

SEQ ID NO: 9952 - DNA, 140 bp, Artificial Sequence
  Synthetic
atggccgactcccaagtacggcatgcacggcgtagacatcctggtatatagcgacgtccgccctttgtctacatgagacgtcagtgtgcaagcagaatgtgggcgtttctgcgtctggtaggagacccagcatggcgtat

SEQ ID NO: 9953 - DNA, 140 bp, Artificial Sequence
  Synthetic
aggccctggctgctgatatgagacaaagggcggacgtcgctatataccaggatgtctacgccgtgcatgcaccaacatcgctgtaccaccaggcgattaaaggagtccgtgtagcatactgaccttttgggacagcggtg

SEQ ID NO: 9954 - DNA, 140 bp, Artificial Sequence
  Synthetic
caccgctgtcccaaaaggtcagtatgctacacggactcctttaatcgcctggtggtacagcgatgttggtgcatgcacggcgtagacatcctggtatatagcgacgtccgccctttgtctcatatcagcagccagggcct

SEQ ID NO: 9955 - DNA, 140 bp, Artificial Sequence
  Synthetic
aggccctggctgctgatatgatataccaagacgtctatgctgtacacgcacccacgtcgctataccaccaggcgattaaaggggtccaagtggcgtactgggttgggttcgacacaacccgaccttttgggacagcggtg

SEQ ID NO: 9956 - DNA, 140 bp, Artificial Sequence
  Synthetic
caccgctgtcccaaaaggtcgggttgtgtcgaacccaacccagtacgccacttggacccctttaatcgcctggtggtatagcgacgtgggtgcgtgtacagcatagacgtcttggtatatcatatcagcagccagggcct

SEQ ID NO: 9957 - DNA, 140 bp, Artificial Sequence
  Synthetic
atacgccatgctgggtctccggcgattaaaggggtccaagtggcgtactgggttgggttcgacacaaccccgttcatgtacaatgccatggcgggtgcctacccctcatactcgacaaaccgtacttgggagtcggccat

SEQ ID NO: 9958 - DNA, 140 bp, Artificial Sequence
  Synthetic
atggccgactcccaagtacggtttgtcgagtatgaggggtaggcacccgccatggcattgtacatgaacggggttgtgtcgaacccaacccagtacgccacttggacccctttaatcgccggagacccagcatggcgtat

SEQ ID NO: 9959 - DNA, 140 bp, Artificial Sequence
  Synthetic
atacgccatgctgggtctcctgggccgatgagcaggtactgaaggctaagaacataggattatgttcaacagacctgacggaaggtagacgaggcaagttgtctatcatgagagggaaaacgtacttgggagtcggccat

SEQ ID NO: 9960 - DNA, 140 bp, Artificial Sequence
  Synthetic
atggccgactcccaagtacgttttccctctcatgatagacaacttgcctcgtctaccttccgtcaggtctgttgaacataatcctatgttcttagccttcagtacctgctcatcggcccaggagacccagcatggcgtat

SEQ ID NO: 9961 - DNA, 140 bp, Artificial Sequence
  Synthetic
aggccctggctgctgatatgtcagtcgggtcaacgctttacccggagagccgtaagcttcttaagagttggcacttaccttcagtgttccatctaaaagggaagctcagcttcacgtgccgaccttttgggacagcggtg

SEQ ID NO: 9962 - DNA, 140 bp, Artificial Sequence
  Synthetic
caccgctgtcccaaaaggtcggcacgtgaagctgagcttcccttttagatggaacactgaaggtaagtgccaactcttaagaagcttacggctctccgggtaaagcgttgacccgactgacatatcagcagccagggcct

SEQ ID NO: 9963 - DNA, 140 bp, Artificial Sequence
  Synthetic
aggccctggctgctgatatggctgtgatacagtggtttcgtgtgaaggctatgtcgttaagagaataacgattagcccgggcctctacggtaaaaccacagggtacgcagtaacccaccagaccttttgggacagcggtg

SEQ ID NO: 9964 - DNA, 140 bp, Artificial Sequence
  Synthetic
caccgctgtcccaaaaggtctggtgggttactgcgtaccctgtggttttaccgtagaggcccgggctaatcgttattctcttaacgacatagccttcacacgaaaccactgtatcacagccatatcagcagccagggcct

SEQ ID NO: 9965 - DNA, 140 bp, Artificial Sequence
  Synthetic
atacgccatgctgggtctcctgcagacggattcctaatgtgcaaaacaaccgatacggtagatggcgagagagtgtcattttcggtatgcacgtacgtacccgcaaccatttgtgatcaacgtacttgggagtcggccat

SEQ ID NO: 9966 - DNA, 140 bp, Artificial Sequence
  Synthetic
atggccgactcccaagtacgttgatcacaaatggttgcgggtacgtacgtgcataccgaaaatgacactctctcgccatctaccgtatcggttgttttgcacattaggaatccgtctgcaggagacccagcatggcgtat

SEQ ID NO: 9967 - DNA, 140 bp, Artificial Sequence
  Synthetic
aggccctggctgctgatatggagtgtcattttcggtatgcacgtacgtacccgcaaccatttgtgatcaaatgacaggtattcttgccacggaggttacaccggaggatgcacagaagctgaccttttgggacagcggtg

SEQ ID NO: 9968 - DNA, 140 bp, Artificial Sequence
  Synthetic
caccgctgtcccaaaaggtcagcttctgtgcatcctccggtgtaacctccgtggcaagaatacctgtcatttgatcacaaatggttgcgggtacgtacgtgcataccgaaaatgacactccatatcagcagccagggcct

SEQ ID NO: 9969 - DNA, 140 bp, Artificial Sequence
  Synthetic
aggccctggctgctgatatggtgagggctacgtcgttaagagaataacgatgagcccaggcctttatggaaaaaccacagggtacgcggtaacccaccacgcagacggattcctgatgtggaccttttgggacagcggtg

SEQ ID NO: 9970 - DNA, 140 bp, Artificial Sequence
  Synthetic
caccgctgtcccaaaaggtccacatcaggaatccgtctgcgtggtgggttaccgcgtaccctgtggtttttccataaaggcctgggctcatcgttattctcttaacgacgtagccctcaccatatcagcagccagggcct

SEQ ID NO: 9971 - DNA, 140 bp, Artificial Sequence
  Synthetic
aggccctggctgctgatatgcaagactaccgacacggttgacggcgaaagagtgtcattctcggtgtgcacatacgtgccggcgaccatttgtgatcaaatgaccggcatccttgctacagaccttttgggacagcggtg

SEQ ID NO: 9972 - DNA, 140 bp, Artificial Sequence
  Synthetic
caccgctgtcccaaaaggtctgtagcaaggatgccggtcatttgatcacaaatggtcgccggcacgtatgtgcacaccgagaatgacactctttcgccgtcaaccgtgtcggtagtcttgcatatcagcagccagggcct

SEQ ID NO: 9973 - DNA, 140 bp, Artificial Sequence
  Synthetic
aggccctggctgctgatatgacacgaacacaatgaagaattacttgcttcctgtagttgcccaagccttcagtaagtgggcaaaggaatgccggaaagatatggaagatgaaaaacttttgaccttttgggacagcggtg

SEQ ID NO: 9974 - DNA, 140 bp, Artificial Sequence
  Synthetic
caccgctgtcccaaaaggtcaaaagtttttcatcttccatatctttccggcattcctttgcccacttactgaaggcttgggcaactacaggaagcaagtaattcttcattgtgttcgtgtcatatcagcagccagggcct

SEQ ID NO: 9975 - DNA, 140 bp, Artificial Sequence
  Synthetic
aggccctggctgctgatatgagcagaagacacacacggtctacaagaggcctgacactcagtcaattcagaaagtcccagccgaatttgacagctttgtggtaccaagtctgtggtcatcgaccttttgggacagcggtg

SEQ ID NO: 9976 - DNA, 140 bp, Artificial Sequence
  Synthetic
caccgctgtcccaaaaggtcgatgaccacagacttggtaccacaaagctgtcaaattcggctgggactttctgaattgactgagtgtcaggcctcttgtagaccgtgtgtgtcttctgctcatatcagcagccagggcct

SEQ ID NO: 9977 - DNA, 140 bp, Artificial Sequence
  Synthetic
atacgccatgctgggtctcctggactgtcgatcccgctacggaccagaatcaagtggctgctaagcaaagtgccaaagactgatttgatcccttacagcggtgacgccaaagaagcccgccgtacttgggagtcggccat

SEQ ID NO: 9978 - DNA, 140 bp, Artificial Sequence
  Synthetic
atggccgactcccaagtacggcgggcttctttggcgtcaccgctgtaagggatcaaatcagtctttggcactttgcttagcagccacttgattctggtccgtagcgggatcgacagtccaggagacccagcatggcgtat

SEQ ID NO: 9979 - DNA, 140 bp, Artificial Sequence
  Synthetic
aggccctggctgctgatatgtgccaaagactgatttgatcccttacagcggtgacgccaaagaagcccgcgacgctgaaaaagaagcagaagaagaacgagaagcggagctaactcgcgagaccttttgggacagcggtg

SEQ ID NO: 9980 - DNA, 140 bp, Artificial Sequence
  Synthetic
caccgctgtcccaaaaggtctcgcgagttagctccgcttctcgttcttcttctgcttctttttcagcgtcgcgggcttctttggcgtcaccgctgtaagggatcaaatcagtctttggcacatatcagcagccagggcct

SEQ ID NO: 9981 - DNA, 140 bp, Artificial Sequence
  Synthetic
atacgccatgctgggtctccggcactaccaccactacaggcggcacaggacgacgtccaggtcgaaattgacgtggaacagctcgaagacagagctggggcaggaataattgaaactccacgtacttgggagtcggccat

SEQ ID NO: 9982 - DNA, 140 bp, Artificial Sequence
  Synthetic
atggccgactcccaagtacgtggagtttcaattattcctgccccagctctgtcttcgagctgttccacgtcaatttcgacctggacgtcgtcctgtgccgcctgtagtggtggtagtgccggagacccagcatggcgtat

SEQ ID NO: 9983 - DNA, 140 bp, Artificial Sequence
  Synthetic
aggccctggctgctgatatgcatacagcggagacgcccgagaagcccgggacgcagaaaaagaagcagaggaagaacgagaagcagaactgactcgcgaagccctaccacctctacaggcgaccttttgggacagcggtg

SEQ ID NO: 9984 - DNA, 140 bp, Artificial Sequence
  Synthetic
caccgctgtcccaaaaggtcgcctgtagaggtggtagggcttcgcgagtcagttctgcttctcgttcttcctctgcttctttttctgcgtcccgggcttctcgggcgtctccgctgtatgcatatcagcagccagggcct

SEQ ID NO: 9985 - DNA, 140 bp, Artificial Sequence
  Synthetic
aggccctggctgctgatatgtgatccacgcattggcggaacaagtgaagacatgcacacacagcggacgggcaggaaggtacgcggtcgaagcatatgacggcagaatccttgtgccctcgaccttttgggacagcggtg

SEQ ID NO: 9986 - DNA, 140 bp, Artificial Sequence
  Synthetic
caccgctgtcccaaaaggtcgagggcacaaggattctgccgtcatatgcttcgaccgcgtaccttcctgcccgtccgctgtgtgtgcatgtcttcacttgttccgccaatgcgtggatcacatatcagcagccagggcct

SEQ ID NO: 9987 - DNA, 140 bp, Artificial Sequence
  Synthetic
atacgccatgctgggtctccaggctatgcaatatcacctgaagacttccagagcctgagcgaaagtgcgacgatggtgtacaacgaaagggagttcgtaaataggaaattacaccatatccgtacttgggagtcggccat

SEQ ID NO: 9988 - DNA, 140 bp, Artificial Sequence
  Synthetic
atggccgactcccaagtacggatatggtgtaatttcctatttacgaactccctttcgttgtacaccatcgtcgcactttcgctcaggctctggaagtcttcaggtgatattgcatagcctggagacccagcatggcgtat

SEQ ID NO: 9989 - DNA, 140 bp, Artificial Sequence
  Synthetic
aggccctggctgctgatatgggtgctgcaagaaagaggaggcagccgggctggtactggtcggcgacttgaccaacccgccctaccatgagttcgcatatgaagggctgagaatccgcccgaccttttgggacagcggtg

SEQ ID NO: 9990 - DNA, 140 bp, Artificial Sequence
  Synthetic
caccgctgtcccaaaaggtcgggcggattctcagcccttcatatgcgaactcatggtagggcgggttggtcaagtcgccgaccagtaccagcccggctgcctcctctttcttgcagcacccatatcagcagccagggcct

SEQ ID NO: 9991 - DNA, 140 bp, Artificial Sequence
  Synthetic
aggccctggctgctgatatgccggcaaatcagcaatcattaagaacctagttaccaggcaagacctagtgaccagtggaaagaaagaaaactgccaagaaatctccaccgacgtgatgcggaccttttgggacagcggtg

SEQ ID NO: 9992 - DNA, 140 bp, Artificial Sequence
  Synthetic
caccgctgtcccaaaaggtccgcatcacgtcggtggagatttcttggcagttttctttctttccactggtcactaggtcttgcctggtaactaggttcttaatgattgctgatttgccggcatatcagcagccagggcct

SEQ ID NO: 9993 - DNA, 140 bp, Artificial Sequence
  Synthetic
atacgccatgctgggtctccacagaggaacctggagatatctgcacgcacggtcgactcactgctcttgaacggatgcaatagaccagtcgacgtgttgtacgtcgacgaagcttttgcgcgtacttgggagtcggccat

SEQ ID NO: 9994 - DNA, 140 bp, Artificial Sequence
  Synthetic
atggccgactcccaagtacgcgcaaaagcttcgtcgacgtacaacacgtcgactggtctattgcatccgttcaagagcagtgagtcgaccgtgcgtgcagatatctccaggttcctctgtggagacccagcatggcgtat

SEQ ID NO: 9995 - DNA, 140 bp, Artificial Sequence
  Synthetic
aggccctggctgctgatatgacggatgcaatagaccagtcgacgtgttgtacgtcgacgaagcttttgcgtgccattctggcacgctacttgctctgatagccttggtgagaccgaggcagaccttttgggacagcggtg

SEQ ID NO: 9996 - DNA, 140 bp, Artificial Sequence
  Synthetic
caccgctgtcccaaaaggtctgcctcggtctcaccaaggctatcagagcaagtagcgtgccagaatggcacgcaaaagcttcgtcgacgtacaacacgtcgactggtctattgcatccgtcatatcagcagccagggcct

SEQ ID NO: 9997 - DNA, 140 bp, Artificial Sequence
  Synthetic
aggccctggctgctgatatggaaagtcgtgctatgcggtgatccgaaacagtgcggcttcttcaatatgatgcagatgaaagttaactacaaccataacatctgcacccaagtgtaccatgaccttttgggacagcggtg

SEQ ID NO: 9998 - DNA, 140 bp, Artificial Sequence
  Synthetic
caccgctgtcccaaaaggtcatggtacacttgggtgcagatgttatggttgtagttaactttcatctgcatcatattgaagaagccgcactgtttcggatcaccgcatagcacgactttccatatcagcagccagggcct

SEQ ID NO: 9999 - DNA, 140 bp, Artificial Sequence
  Synthetic
aggccctggctgctgatatgacgtgttgtacgtagacgaggcgtttgcgtgccactctggaacgctacttgctttgatcgccttggtgagaccaaggcagaaagttgtactttgtggtgagaccttttgggacagcggtg

SEQ ID NO: 10000 - DNA, 140 bp, Artificial Sequence
  Synthetic
caccgctgtcccaaaaggtctcaccacaaagtacaactttctgccttggtctcaccaaggcgatcaaagcaagtagcgttccagagtggcacgcaaacgcctcgtctacgtacaacacgtcatatcagcagccagggcct

SEQ ID NO: 10001 - DNA, 140 bp, Artificial Sequence
  Synthetic
atacgccatgctgggtctccaaaagtatttccaggcggtgtacactgcctgtgactgccattgtgtcctcgttgcattacgaaggcaaaatgcgcacaacaaatgagtacaacaagccaacgtacttgggagtcggccat

SEQ ID NO: 10002 - DNA, 140 bp, Artificial Sequence
  Synthetic
atggccgactcccaagtacgttggcttgttgtactcatttgttgtgcgcattttgccttcgtaatgcaacgaggacacaatggcagtcacaggcagtgtacaccgcctggaaatacttttggagacccagcatggcgtat

SEQ ID NO: 10003 - DNA, 140 bp, Artificial Sequence
  Synthetic
aggccctggctgctgatatggttgcattacgaaggcaaaatgcgcacaacaaatgagtacaacaagccaattgtagtggatactacaggctcgacaaaacccgaccccggagaccttgtggaccttttgggacagcggtg

SEQ ID NO: 10004 - DNA, 140 bp, Artificial Sequence
  Synthetic
caccgctgtcccaaaaggtccacaaggtctccggggtcgggttttgtcgagcctgtagtatccactacaattggcttgttgtactcatttgttgtgcgcattttgccttcgtaatgcaaccatatcagcagccagggcct

SEQ ID NO: 10005 - DNA, 140 bp, Artificial Sequence
  Synthetic
aggccctggctgctgatatgtctatgccgtcaggcaaaaagttaatgaaaaccccctttacgcatcaacatcagagcacgtgaacgtgctactgacgcgtacggaaggcaaactagtatggaccttttgggacagcggtg

SEQ ID NO: 10006 - DNA, 140 bp, Artificial Sequence
  Synthetic
caccgctgtcccaaaaggtccatactagtttgccttccgtacgcgtcagtagcacgttcacgtgctctgatgttgatgcgtaaagggggttttcattaactttttgcctgacggcatagacatatcagcagccagggcct

SEQ ID NO: 10007 - DNA, 140 bp, Artificial Sequence
  Synthetic
atacgccatgctgggtctcctcagagcacgtgaacgtgctactgacgcgtacggaaggcaaactagtatggaagacactttctggagacccatggataaagacactgcagaacccgccgacgtacttgggagtcggccat

SEQ ID NO: 10008 - DNA, 140 bp, Artificial Sequence
  Synthetic
atggccgactcccaagtacgtcggcgggttctgcagtgtctttatccatgggtctccagaaagtgtcttccatactagtttgccttccgtacgcgtcagtagcacgttcacgtgctctgaggagacccagcatggcgtat

SEQ ID NO: 10009 - DNA, 140 bp, Artificial Sequence
  Synthetic
atacgccatgctgggtctccataatggcgggtatctgtaaccaccaagtgacctttgacacgttccagaataaagccaatgtctgctgggcgaagagcttagtccccatcctagaaacagcgtacttgggagtcggccat

SEQ ID NO: 10010 - DNA, 140 bp, Artificial Sequence
  Synthetic
atggccgactcccaagtacgctgtttctaggatggggactaagctcttcgcccagcagacattggctttattctggaacgtgtcaaaggtcacttggtggttacagatacccgccattatggagacccagcatggcgtat

SEQ ID NO: 10011 - DNA, 140 bp, Artificial Sequence
  Synthetic
aggccctggctgctgatatgtgtccgtgcattatgcggataatcactgggacaacaggccgggagggaagatgttcggattcaaccccgaagcggcgtccatactggagaggaaatacccgaccttttgggacagcggtg

SEQ ID NO: 10012 - DNA, 140 bp, Artificial Sequence
  Synthetic
caccgctgtcccaaaaggtcgggtatttcctctccagtatggacgccgcttcggggttgaatccgaacatcttccctcccggcctgttgtcccagtgattatccgcataatgcacggacacatatcagcagccagggcct

SEQ ID NO: 10013 - DNA, 140 bp, Artificial Sequence
  Synthetic
atacgccatgctgggtctccgtttacaaaagggaagtggaataccaacaagcaaatctgtgtgactactaggaggattgaagattttaacccgaacaccaacattatacctgccaacaggcgtacttgggagtcggccat

SEQ ID NO: 10014 - DNA, 140 bp, Artificial Sequence
  Synthetic
atggccgactcccaagtacgcctgttggcaggtataatgttggtgttcgggttaaaatcttcaatcctcctagtagtcacacagatttgcttgttggtattccacttcccttttgtaaacggagacccagcatggcgtat

SEQ ID NO: 10015 - DNA, 140 bp, Artificial Sequence
  Synthetic
aggccctggctgctgatatgggaggattgaagattttaacccgaacaccaacattatacctgccaacaggagattaccgcattcattggtggccgaacatcgcccggtaaaaggggagaggaccttttgggacagcggtg

SEQ ID NO: 10016 - DNA, 140 bp, Artificial Sequence
  Synthetic
caccgctgtcccaaaaggtcctctccccttttaccgggcgatgttcggccaccaatgaatgcggtaatctcctgttggcaggtataatgttggtgttcgggttaaaatcttcaatcctcccatatcagcagccagggcct

SEQ ID NO: 10017 - DNA, 140 bp, Artificial Sequence
  Synthetic
aggccctggctgctgatatggatggaatggttggtcaacaaaataaatggccaccatgtgctcctggtcagcggctacaacctcgttctgcccactaagagagtcacctgggtggcgccggaccttttgggacagcggtg

SEQ ID NO: 10018 - DNA, 140 bp, Artificial Sequence
  Synthetic
caccgctgtcccaaaaggtccggcgccacccaggtgactctcttagtgggcagaacgaggttgtagccgctgaccaggagcacatggtggccatttattttgttgaccaaccattccatccatatcagcagccagggcct

SEQ ID NO: 10019 - DNA, 140 bp, Artificial Sequence
  Synthetic
atacgccatgctgggtctccatgctcggaggagactccctgagactgctcaagccgggtggttcattactgatcagggcatacggctacgcagacagaacaagcgaacgagtagtctgcgcgtacttgggagtcggccat

SEQ ID NO: 10020 - DNA, 140 bp, Artificial Sequence
  Synthetic
atggccgactcccaagtacgcgcagactactcgttcgcttgttctgtctgcgtagccgtatgccctgatcagtaatgaaccacccggcttgagcagtctcagggagtctcctccgagcatggagacccagcatggcgtat

SEQ ID NO: 10021 - DNA, 140 bp, Artificial Sequence
  Synthetic
aggccctggctgctgatatggatcagggcatacggctacgcagacagaacaagcgaacgagtagtctgcgtattgggacgcaagtttcgatcatccagagcgttgaaaccgccgtgcgtcgaccttttgggacagcggtg

SEQ ID NO: 10022 - DNA, 140 bp, Artificial Sequence
  Synthetic
caccgctgtcccaaaaggtcgacgcacggcggtttcaacgctctggatgatcgaaacttgcgtcccaatacgcagactactcgttcgcttgttctgtctgcgtagccgtatgccctgatccatatcagcagccagggcct

SEQ ID NO: 10023 - DNA, 140 bp, Artificial Sequence
  Synthetic
aggccctggctgctgatatgttcctattcagcaactttgacaatggcagaaggaatttcacaactcatgtcatgaacaatcaactgaatgcagccttcgtaggacaggtcacccgagcaggaccttttgggacagcggtg

SEQ ID NO: 10024 - DNA, 140 bp, Artificial Sequence
  Synthetic
caccgctgtcccaaaaggtcctgctcgggtgacctgtcctacgaaggctgcattcagttgattgttcatgacatgagttgtgaaattccttctgccattgtcaaagttgctgaataggaacatatcagcagccagggcct

SEQ ID NO: 10025 - DNA, 140 bp, Artificial Sequence
  Synthetic
aggccctggctgctgatatgatggacatcgcaaagaacgatgaagagtgtgtagtcaacgccgccaaccctcgtgggctaccaggcgatggcgtctgtaaagcagtatacaaaaaatggcgaccttttgggacagcggtg

SEQ ID NO: 10026 - DNA, 140 bp, Artificial Sequence
  Synthetic
caccgctgtcccaaaaggtcgccattttttgtatactgctttacagacgccatcgcctggtagcccacgagggttggcggcgttgactacacactcttcatcgttctttgcgatgtccatcatatcagcagccagggcct

SEQ ID NO: 10027 - DNA, 140 bp, Artificial Sequence
  Synthetic
aggccctggctgctgatatgttactctgagtccgaaggagaccgggaattggcagctgcttaccgagaagtcgctaaggaggtgactagactaggagtaaacagcgtagctataccgctcgaccttttgggacagcggtg

SEQ ID NO: 10028 - DNA, 140 bp, Artificial Sequence
  Synthetic
caccgctgtcccaaaaggtcgagcggtatagctacgctgtttactcctagtctagtcacctccttagcgacttctcggtaagcagctgccaattcccggtctccttcggactcagagtaacatatcagcagccagggcct

SEQ ID NO: 10029 - DNA, 140 bp, Artificial Sequence
  Synthetic
aggccctggctgctgatatgtcgctaaggaggtgactagactaggagtaaacagcgtagctataccgctcctttccaccggtgtgtactctggagggaaagacaggctgactcagtcactgaccttttgggacagcggtg

SEQ ID NO: 10030 - DNA, 140 bp, Artificial Sequence
  Synthetic
caccgctgtcccaaaaggtcagtgactgagtcagcctgtctttccctccagagtacacaccggtggaaaggagcggtatagctacgctgtttactcctagtctagtcacctccttagcgacatatcagcagccagggcct

SEQ ID NO: 10031 - DNA, 140 bp, Artificial Sequence
  Synthetic
atacgccatgctgggtctcctgggagtaaatagtgtagctatacctctcctctccacaggtgtatactcaggagggaaagacaggctgacccagtcactgaaccacctctttacagccatcgtacttgggagtcggccat

SEQ ID NO: 10032 - DNA, 140 bp, Artificial Sequence
  Synthetic
atggccgactcccaagtacgatggctgtaaagaggtggttcagtgactgggtcagcctgtctttccctcctgagtatacacctgtggagaggagaggtatagctacactatttactcccaggagacccagcatggcgtat

SEQ ID NO: 10033 - DNA, 140 bp, Artificial Sequence
  Synthetic
atacgccatgctgggtctccaaaccacctttttacagcattagactcaactgatgcagatgtggttatctactgccgcgacaaggagtgggagaagaaaatagctgaggccatacaaatgcgtacttgggagtcggccat

SEQ ID NO: 10034 - DNA, 140 bp, Artificial Sequence
  Synthetic
atggccgactcccaagtacgcatttgtatggcctcagctattttcttctcccactccttgtcgcggcagtagataaccacatctgcatcagttgagtctaatgctgtaaaaaggtggtttggagacccagcatggcgtat

SEQ ID NO: 10035 - DNA, 140 bp, Artificial Sequence
  Synthetic
aggccctggctgctgatatgactgccgcgacaaggagtgggagaagaaaatagctgaggccatacaaatgaggacccaagtggaattactagacgaacacatctctgtagactgcgatatgaccttttgggacagcggtg

SEQ ID NO: 10036 - DNA, 140 bp, Artificial Sequence
  Synthetic
caccgctgtcccaaaaggtcatatcgcagtctacagagatgtgttcgtctagtaattccacttgggtcctcatttgtatggcctcagctattttcttctcccactccttgtcgcggcagtcatatcagcagccagggcct

SEQ ID NO: 10037 - DNA, 140 bp, Artificial Sequence
  Synthetic
atacgccatgctgggtctcccatccgagtgcaccctgacagcagtttggcaggtagaaaagggtacagcactacagaaggttcactgtactcctacttggaagggacacggttccatcagcgtacttgggagtcggccat

SEQ ID NO: 10038 - DNA, 140 bp, Artificial Sequence
  Synthetic
atggccgactcccaagtacgctgatggaaccgtgtcccttccaagtaggagtacagtgaaccttctgtagtgctgtacccttttctacctgccaaactgctgtcagggtgcactcggatgggagacccagcatggcgtat

SEQ ID NO: 10039 - DNA, 140 bp, Artificial Sequence
  Synthetic
atacgccatgctgggtctccggctaatgaacaagtttgcttgtacgcattgggggaaagtatagaatcaatcaggcaaaagtgcccagtggatgacgcagatgcatcgtcgcccccaaaacgtacttgggagtcggccat

SEQ ID NO: 10040 - DNA, 140 bp, Artificial Sequence
  Synthetic
atggccgactcccaagtacgttttgggggcgacgatgcatctgcgtcatccactgggcacttttgcctgattgattctatactttcccccaatgcgtacaagcaaacttgttcattagccggagacccagcatggcgtat

SEQ ID NO: 10041 - DNA, 140 bp, Artificial Sequence
  Synthetic
aggccctggctgctgatatgtcaggcaaaagtgcccagtggatgacgcagatgcatcgtcgcccccaaaaaccgtcccgtgcctctgccgttatgccatgacacccgaacgagtcaccaggaccttttgggacagcggtg

SEQ ID NO: 10042 - DNA, 140 bp, Artificial Sequence
  Synthetic
caccgctgtcccaaaaggtcctggtgactcgttcgggtgtcatggcataacggcagaggcacgggacggtttttgggggcgacgatgcatctgcgtcatccactgggcacttttgcctgacatatcagcagccagggcct

SEQ ID NO: 10043 - DNA, 140 bp, Artificial Sequence
  Synthetic
aggccctggctgctgatatgaccgtcccgtgcctctgccgttatgccatgacacccgaacgagtcaccaggcttcgtatgaaccatgtcacaagcataatagtatgctcatcattcccccgaccttttgggacagcggtg

SEQ ID NO: 10044 - DNA, 140 bp, Artificial Sequence
  Synthetic
caccgctgtcccaaaaggtcgggggaatgatgagcatactattatgcttgtgacatggttcatacgaagcctggtgactcgttcgggtgtcatggcataacggcagaggcacgggacggtcatatcagcagccagggcct

SEQ ID NO: 10045 - DNA, 140 bp, Artificial Sequence
  Synthetic
aggccctggctgctgatatgttccaaagtataaaatagaaggagtgcagaaagtcaagtgttctaaagtgatgctgttcgaccataacgtgccatcacgcgttagtccaagggaatataagaccttttgggacagcggtg

SEQ ID NO: 10046 - DNA, 140 bp, Artificial Sequence
  Synthetic
caccgctgtcccaaaaggtcttatattcccttggactaacgcgtgatggcacgttatggtcgaacagcatcactttagaacacttgactttctgcactccttctattttatactttggaacatatcagcagccagggcct

SEQ ID NO: 10047 - DNA, 140 bp, Artificial Sequence
  Synthetic
atacgccatgctgggtctccatcgcctcaggagaccgcacaagaagtaagttcgaccacgtcactgacgcacagccaattcgaccttagcgttgacggtgaggaactgcccgctccgtctcgtacttgggagtcggccat

SEQ ID NO: 10048 - DNA, 140 bp, Artificial Sequence
  Synthetic
atggccgactcccaagtacgagacggagcgggcagttcctcaccgtcaacgctaaggtcgaattggctgtgcgtcagtgacgtggtcgaacttacttcttgtgcggtctcctgaggcgatggagacccagcatggcgtat

SEQ ID NO: 10049 - DNA, 140 bp, Artificial Sequence
  Synthetic
atacgccatgctgggtctccgacttggaagctgacgctccgattccggaaccaacaccagacgacagagcggtacttactttgcctcccacgattgataatttttcggctgtgtcagactcgtacttgggagtcggccat

SEQ ID NO: 10050 - DNA, 140 bp, Artificial Sequence
  Synthetic
atggccgactcccaagtacgagtctgacacagccgaaaaattatcaatcgtgggaggcaaagtaagtaccgctctgtcgtctggtgttggttccggaatcggagcgtcagcttccaagtcggagacccagcatggcgtat

SEQ ID NO: 10051 - DNA, 140 bp, Artificial Sequence
  Synthetic
aggccctggctgctgatatgttgatggcgagatactgcccgtcccgtcagacctggatgctgacgccccagccctagaaccagcactagacgacggggcgatacacacgctgccatccacgaccttttgggacagcggtg

SEQ ID NO: 10052 - DNA, 140 bp, Artificial Sequence
  Synthetic
caccgctgtcccaaaaggtcgtggatggcagcgtgtgtatcgccccgtcgtctagtgctggttctagggctggggcgtcagcatccaggtctgacgggacgggcagtatctcgccatcaacatatcagcagccagggcct

SEQ ID NO: 10053 - DNA, 140 bp, Artificial Sequence
  Synthetic
aggccctggctgctgatatggggtaatgaataccgcgccagtcgcaccacccagaagaagacgtgggaaaaacttgaatgtcacctgcgacgagagagaagggaacgtacttcccatggcgaccttttgggacagcggtg

SEQ ID NO: 10054 - DNA, 140 bp, Artificial Sequence
  Synthetic
caccgctgtcccaaaaggtcgccatgggaagtacgttcccttctctctcgtcgcaggtgacattcaagtttttcccacgtcttcttctgggtggtgcgactggcgcggtattcattaccccatatcagcagccagggcct

SEQ ID NO: 10055 - DNA, 140 bp, Artificial Sequence
  Synthetic
atacgccatgctgggtctcctagcgttcggttcttcagagcggatctgcactccatcgtacaggaaacggcagagatacgcgatacggccgcgtccctccaggcgcccctgagtgtcgctcgtacttgggagtcggccat

SEQ ID NO: 10056 - DNA, 140 bp, Artificial Sequence
  Synthetic
atggccgactcccaagtacgagcgacactcaggggcgcctggagggacgcggccgtatcgcgtatctctgccgtttcctgtacgatggagtgcagatccgctctgaagaaccgaacgctaggagacccagcatggcgtat

SEQ ID NO: 10057 - DNA, 140 bp, Artificial Sequence
  Synthetic
aggccctggctgctgatatgcagagatacgcgatacggccgcgtccctccaggcgcccctgagtgtcgctacagaaccgaatcaactgccgatctcatttggagcaccaaacgagactttgaccttttgggacagcggtg

SEQ ID NO: 10058 - DNA, 140 bp, Artificial Sequence
  Synthetic
caccgctgtcccaaaaggtcaaagtctcgtttggtgctccaaatgagatcggcagttgattcggttctgtagcgacactcaggggcgcctggagggacgcggccgtatcgcgtatctctgcatatcagcagccagggcct

SEQ ID NO: 10059 - DNA, 140 bp, Artificial Sequence
  Synthetic
aggccctggctgctgatatggcagaaaacacacacggtctacaagaggcctgatacccagtcaattcagaaggttcaggccgagtttgacagctttgtggtaccgagtctgtggtcgaccgaccttttgggacagcggtg

SEQ ID NO: 10060 - DNA, 140 bp, Artificial Sequence
  Synthetic
caccgctgtcccaaaaggtcggtcgaccacagactcggtaccacaaagctgtcaaactcggcctgaaccttctgaattgactgggtatcaggcctcttgtagaccgtgtgtgttttctgccatatcagcagccagggcct

SEQ ID NO: 10061 - DNA, 140 bp, Artificial Sequence
  Synthetic
aggccctggctgctgatatgagatagggcaggtgggtacatattctcatctgacaccggccccggccacctgcaacagaggtctgtccgtcagacagtactgccggtaaataccttggaggaccttttgggacagcggtg

SEQ ID NO: 10062 - DNA, 140 bp, Artificial Sequence
  Synthetic
caccgctgtcccaaaaggtcctccaaggtatttaccggcagtactgtctgacggacagacctctgttgcaggtggccggggccggtgtcagatgagaatatgtacccacctgccctatctcatatcagcagccagggcct

SEQ ID NO: 10063 - DNA, 140 bp, Artificial Sequence
  Synthetic
atacgccatgctgggtctcctgctcagacacggacgacgagttacgactagacagggcaggtgggtatatattctcgtcggacaccggtccaggtcatttacaacagaagtcagtacgcccgtacttgggagtcggccat

SEQ ID NO: 10064 - DNA, 140 bp, Artificial Sequence
  Synthetic
atggccgactcccaagtacgggcgtactgacttctgttgtaaatgacctggaccggtgtccgacgagaatatatacccacctgccctgtctagtcgtaactcgtcgtccgtgtctgagcaggagacccagcatggcgtat

SEQ ID NO: 10065 - DNA, 140 bp, Artificial Sequence
  Synthetic
atacgccatgctgggtctcctgcaacagaggtctgtccgtcagacagtactgccggtaaataccttggaggaagttcaggaggagaaatgttacccacctaagttggatgaagtgaaagacgtacttgggagtcggccat

SEQ ID NO: 10066 - DNA, 140 bp, Artificial Sequence
  Synthetic
atggccgactcccaagtacgtctttcacttcatccaacttaggtgggtaacatttctcctcctgaacttcctccaaggtatttaccggcagtactgtctgacggacagacctctgttgcaggagacccagcatggcgtat

SEQ ID NO: 10067 - DNA, 140 bp, Artificial Sequence
  Synthetic
aggccctggctgctgatatgattctcgtcggacaccggtccaggtcatttacaacagaagtcagtacgccagtcagtgctgccggtgaacaccttggaggaagtccacgaggagaagtgtgaccttttgggacagcggtg

SEQ ID NO: 10068 - DNA, 140 bp, Artificial Sequence
  Synthetic
caccgctgtcccaaaaggtcacacttctcctcgtggacttcctccaaggtgttcaccggcagcactgactggcgtactgacttctgttgtaaatgacctggaccggtgtccgacgagaatcatatcagcagccagggcct

SEQ ID NO: 10069 - DNA, 140 bp, Artificial Sequence
  Synthetic
aggccctggctgctgatatgatatccgactgtccaaccccgagtctgctgtggcagcgtgcaatgagttcctagcaaggaactatccgacagttgcgtcgtaccaaatcaccgatgagtagaccttttgggacagcggtg

SEQ ID NO: 10070 - DNA, 140 bp, Artificial Sequence
  Synthetic
caccgctgtcccaaaaggtctactcatcggtgatttggtacgacgcaactgtcggatagttccttgctaggaactcattgcacgctgccacagcagactcggggttggacagtcggatatcatatcagcagccagggcct

SEQ ID NO: 10071 - DNA, 140 bp, Artificial Sequence
  Synthetic
aggccctggctgctgatatgctagcaaggaactatccgacagttgcgtcgtaccaaatcaccgatgagtacgatgcatacctagacatggtggacgggtcggaaagttgccttgaccggggaccttttgggacagcggtg

SEQ ID NO: 10072 - DNA, 140 bp, Artificial Sequence
  Synthetic
caccgctgtcccaaaaggtccccggtcaaggcaactttccgacccgtccaccatgtctaggtatgcatcgtactcatcggtgatttggtacgacgcaactgtcggatagttccttgctagcatatcagcagccagggcct

SEQ ID NO: 10073 - DNA, 140 bp, Artificial Sequence
  Synthetic
atacgccatgctgggtctcccgacgttcaacccatcaaagcttagaagttatccaaaacagcactcctaccatgcacccacaatcagaagtgccgtaccttccccgttccagaacacgctcgtacttgggagtcggccat

SEQ ID NO: 10074 - DNA, 140 bp, Artificial Sequence
  Synthetic
atggccgactcccaagtacgagcgtgttctggaacggggaaggtacggcacttctgattgtgggtgcatggtaggagtgctgttttggataacttctaagctttgatgggttgaacgtcgggagacccagcatggcgtat

SEQ ID NO: 10075 - DNA, 140 bp, Artificial Sequence
  Synthetic
aggccctggctgctgatatgtgagagaactgcctactttggattcagcggtatttaatgttgagtgctttaaaaaatttgcgtgcaatcaagaatactggaaggaatttgccgccagcccgaccttttgggacagcggtg

SEQ ID NO: 10076 - DNA, 140 bp, Artificial Sequence
  Synthetic
caccgctgtcccaaaaggtcgggctggcggcaaattccttccagtattcttgattgcacgcaaattttttaaagcactcaacattaaataccgctgaatccaaagtaggcagttctctcacatatcagcagccagggcct

SEQ ID NO: 10077 - DNA, 140 bp, Artificial Sequence
  Synthetic
atacgccatgctgggtctcctattaggataacgactgagaacttgacaacttatgtcacaaaactaaaaggaccaaaagcagcagcactgtttgccaagacacataacctgctaccactgcgtacttgggagtcggccat

SEQ ID NO: 10078 - DNA, 140 bp, Artificial Sequence
  Synthetic
atggccgactcccaagtacgcagtggtagcaggttatgtgtcttggcaaacagtgctgctgcttttggtccttttagttttgtgacataagttgtcaagttctcagtcgttatcctaataggagacccagcatggcgtat

SEQ ID NO: 10079 - DNA, 140 bp, Artificial Sequence
  Synthetic
aggccctggctgctgatatggaccaaaagcagcagcactgtttgccaagacacataacctgctaccactgcaggaggtgccgatggacaggtttactgtagacatgaaaagggacgtgaagaccttttgggacagcggtg

SEQ ID NO: 10080 - DNA, 140 bp, Artificial Sequence
  Synthetic
caccgctgtcccaaaaggtcttcacgtcccttttcatgtctacagtaaacctgtccatcggcacctcctgcagtggtagcaggttatgtgtcttggcaaacagtgctgctgcttttggtccatatcagcagccagggcct

SEQ ID NO: 10081 - DNA, 140 bp, Artificial Sequence
  Synthetic
aggccctggctgctgatatgtacaggcagccgaacctttggcaacagcatatctgtgtgggatccacagagagttggtcagaaggctgaatgcagtccttctacctaatgtacacacgctgaccttttgggacagcggtg

SEQ ID NO: 10082 - DNA, 140 bp, Artificial Sequence
  Synthetic
caccgctgtcccaaaaggtcagcgtgtgtacattaggtagaaggactgcattcagccttctgaccaactctctgtggatcccacacagatatgctgttgccaaaggttcggctgcctgtacatatcagcagccagggcct

SEQ ID NO: 10083 - DNA, 140 bp, Artificial Sequence
  Synthetic
atacgccatgctgggtctccgagttggtcagaaggctgaatgcagtccttctacctaatgtacacacgctgtttgacatgtctgccgaggactttgacgccattattgccgcgcacttcacgtacttgggagtcggccat

SEQ ID NO: 10084 - DNA, 140 bp, Artificial Sequence
  Synthetic
atggccgactcccaagtacgtgaagtgcgcggcaataatggcgtcaaagtcctcggcagacatgtcaaacagcgtgtgtacattaggtagaaggactgcattcagccttctgaccaactcggagacccagcatggcgtat

SEQ ID NO: 10085 - DNA, 140 bp, Artificial Sequence
  Synthetic
aggccctggctgctgatatgggtggatcatcccctgttggacttgatagaggctgccttcggggagatctccagctgccacctaccgacgggcacccgttttaagttcggcgccatgatggaccttttgggacagcggtg

SEQ ID NO: 10086 - DNA, 140 bp, Artificial Sequence
  Synthetic
caccgctgtcccaaaaggtccatcatggcgccgaacttaaaacgggtgcccgtcggtaggtggcagctggagatctccccgaaggcagcctctatcaagtccaacaggggatgatccacccatatcagcagccagggcct

SEQ ID NO: 10087 - DNA, 140 bp, Artificial Sequence
  Synthetic
aggccctggctgctgatatgccagctgccacctaccgacgggcacccgttttaagttcggcgccatgatgaagtctggtatgttcctaaccctgttcgtcaacacactgctaaacatcacgaccttttgggacagcggtg

SEQ ID NO: 10088 - DNA, 140 bp, Artificial Sequence
  Synthetic
caccgctgtcccaaaaggtcgtgatgtttagcagtgtgttgacgaacagggttaggaacataccagacttcatcatggcgccgaacttaaaacgggtgcccgtcggtaggtggcagctggcatatcagcagccagggcct

SEQ ID NO: 10089 - DNA, 140 bp, Artificial Sequence
  Synthetic
atacgccatgctgggtctcccatagccagccgagtgctggaggaccgcttgacaaggtctgcgtgcgcggccttcatcggcgacgacaatataatacatggggttgtctctgacgaactgcgtacttgggagtcggccat

SEQ ID NO: 10090 - DNA, 140 bp, Artificial Sequence
  Synthetic
atggccgactcccaagtacgcagttcgtcagagacaaccccatgtattatattgtcgtcgccgatgaaggccgcgcacgcagaccttgtcaagcggtcctccagcactcggctggctatgggagacccagcatggcgtat

SEQ ID NO: 10091 - DNA, 140 bp, Artificial Sequence
  Synthetic
aggccctggctgctgatatgccttcatcggcgacgacaatataatacatggggttgtctctgacgaactgatggcagcaaggtgtgctacatggatgaacatggaagtgaagatcatagagaccttttgggacagcggtg

SEQ ID NO: 10092 - DNA, 140 bp, Artificial Sequence
  Synthetic
caccgctgtcccaaaaggtctctatgatcttcacttccatgttcatccatgtagcacaccttgctgccatcagttcgtcagagacaaccccatgtattatattgtcgtcgccgatgaaggcatatcagcagccagggcct

SEQ ID NO: 10093 - DNA, 140 bp, Artificial Sequence
  Synthetic
atacgccatgctgggtctccctgttcaagctgggcaaaccgctggcagcgggagatgaacaagacgacgacagaagacgtgcactggctgacgaagtggttagatggcaacgaacaggaccgtacttgggagtcggccat

SEQ ID NO: 10094 - DNA, 140 bp, Artificial Sequence
  Synthetic
atggccgactcccaagtacggtcctgttcgttgccatctaaccacttcgtcagccagtgcacgtcttctgtcgtcgtcttgttcatctcccgctgccagcggtttgcccagcttgaacagggagacccagcatggcgtat

SEQ ID NO: 10095 - DNA, 140 bp, Artificial Sequence
  Synthetic
aggccctggctgctgatatgcagaagacgtgcactggctgacgaagtggttagatggcaacgaacaggactaactgatgagctagaaaaagcggtacactccaggtatgaagtgcagggcgaccttttgggacagcggtg

SEQ ID NO: 10096 - DNA, 140 bp, Artificial Sequence
  Synthetic
caccgctgtcccaaaaggtcgccctgcacttcatacctggagtgtaccgctttttctagctcatcagttagtcctgttcgttgccatctaaccacttcgtcagccagtgcacgtcttctgcatatcagcagccagggcct

SEQ ID NO: 10097 - DNA, 140 bp, Artificial Sequence
  Synthetic
aggccctggctgctgatatgatatctgtcgtggtaatgtctatggccacctttgcaagctctagatctaactttgagaagctcagaggacccgtcgtaaccctgtacggtggtcctaaatgaccttttgggacagcggtg

SEQ ID NO: 10098 - DNA, 140 bp, Artificial Sequence
  Synthetic
caccgctgtcccaaaaggtcatttaggaccaccgtacagggttacgacgggtcctctgagcttctcaaagttagatctagagcttgcaaaggtggccatagacattaccacgacagatatcatatcagcagccagggcct

SEQ ID NO: 10099 - DNA, 140 bp, Artificial Sequence
  Synthetic
atacgccatgctgggtctccaggtacgcactacagctacctatttcgtcagaaaccaatcgcagctacttgcatacctaccagctacaatggagttcatcccgacgcaaactttctataacgtacttgggagtcggccat

SEQ ID NO: 10100 - DNA, 140 bp, Artificial Sequence
  Synthetic
atggccgactcccaagtacgttatagaaagtttgcgtcgggatgaactccattgtagctggtaggtatgcaagtagctgcgattggtttctgacgaaataggtagctgtagtgcgtacctggagacccagcatggcgtat

SEQ ID NO: 10101 - DNA, 140 bp, Artificial Sequence
  Synthetic
atacgccatgctgggtctcccagaaggtaccaaccccgaccctgggccccacgccctacaattcaagtaattagacctagaccacgtccacagaggcaggctgggcaactcgcccagctgcgtacttgggagtcggccat

SEQ ID NO: 10102 - DNA, 140 bp, Artificial Sequence
  Synthetic
atggccgactcccaagtacgcagctgggcgagttgcccagcctgcctctgtggacgtggtctaggtctaattacttgaattgtagggcgtggggcccagggtcggggttggtaccttctgggagacccagcatggcgtat

SEQ ID NO: 10103 - DNA, 140 bp, Artificial Sequence
  Synthetic
aggccctggctgctgatatgttagacctagaccacgtccacagaggcaggctgggcaactcgcccagctgatctccgcagtcaacaaattgaccatgcgcgcggtacctcaacagaagccgaccttttgggacagcggtg

SEQ ID NO: 10104 - DNA, 140 bp, Artificial Sequence
  Synthetic
caccgctgtcccaaaaggtcggcttctgttgaggtaccgcgcgcatggtcaatttgttgactgcggagatcagctgggcgagttgcccagcctgcctctgtggacgtggtctaggtctaacatatcagcagccagggcct

SEQ ID NO: 10105 - DNA, 140 bp, Artificial Sequence
  Synthetic
aggccctggctgctgatatgaaaacgacccaaagcaaaagaagcaaccaccacaaaagaagccggctcaaaagaagaagaaaccaggccgtagggagagaatgtgcatgaaaattgaaaagaccttttgggacagcggtg

SEQ ID NO: 10106 - DNA, 140 bp, Artificial Sequence
  Synthetic
caccgctgtcccaaaaggtcttttcaattttcatgcacattctctccctacggcctggtttcttcttcttttgagccggcttcttttgtggtggttgcttcttttgctttgggtcgttttcatatcagcagccagggcct

SEQ ID NO: 10107 - DNA, 140 bp, Artificial Sequence
  Synthetic
aggccctggctgctgatatgaagcaaaagcaaaaacaacaggcgccacaaaacaacacaaatcaaaagaagcagccacctaaaaagaaaccggctcaaaagaaaaagaagccgggccgcagaccttttgggacagcggtg

SEQ ID NO: 10108 - DNA, 140 bp, Artificial Sequence
  Synthetic
caccgctgtcccaaaaggtctgcggcccggcttctttttcttttgagccggtttctttttaggtggctgcttcttttgatttgtgttgttttgtggcgcctgttgtttttgcttttgcttcatatcagcagccagggcct

SEQ ID NO: 10109 - DNA, 140 bp, Artificial Sequence
  Synthetic
atacgccatgctgggtctcctgattgcatcttcgaagtcaagcatgaaggcaaagtgatgggctacgcatgcctggtgggggataaagtaatgaaaccagcacatgtgaagggaactatccgtacttgggagtcggccat

SEQ ID NO: 10110 - DNA, 140 bp, Artificial Sequence
  Synthetic
atggccgactcccaagtacggatagttcccttcacatgtgctggtttcattactttatcccccaccaggcatgcgtagcccatcactttgccttcatgcttgacttcgaagatgcaatcaggagacccagcatggcgtat

SEQ ID NO: 10111 - DNA, 140 bp, Artificial Sequence
  Synthetic
aggccctggctgctgatatggcctggtgggggataaagtaatgaaaccagcacatgtgaagggaactatcgacaatgccgatctggctaaactggcctttaagcggtcgtctaaatacgagaccttttgggacagcggtg

SEQ ID NO: 10112 - DNA, 140 bp, Artificial Sequence
  Synthetic
caccgctgtcccaaaaggtctcgtatttagacgaccgcttaaaggccagtttagccagatcggcattgtcgatagttcccttcacatgtgctggtttcattactttatcccccaccaggccatatcagcagccagggcct

SEQ ID NO: 10113 - DNA, 140 bp, Artificial Sequence
  Synthetic
atacgccatgctgggtctcctcttgaatgtgcacagataccggtgcacatgaagtctgatgcctcgaagtttacccacgagaaacccgaggggtactataactggcatcacggagcagtgcgtacttgggagtcggccat

SEQ ID NO: 10114 - DNA, 140 bp, Artificial Sequence
  Synthetic
atggccgactcccaagtacgcactgctccgtgatgccagttatagtacccctcgggtttctcgtgggtaaacttcgaggcatcagacttcatgtgcaccggtatctgtgcacattcaagaggagacccagcatggcgtat

SEQ ID NO: 10115 - DNA, 140 bp, Artificial Sequence
  Synthetic
aggccctggctgctgatatgagacagcggcagaccgatcttcgacaacaaaggacgggtggtggccatcgtcctaggaggggccaacgaaggtgcccgcacggccctctccgtggtgacggaccttttgggacagcggtg

SEQ ID NO: 10116 - DNA, 140 bp, Artificial Sequence
  Synthetic
caccgctgtcccaaaaggtccgtcaccacggagagggccgtgcgggcaccttcgttggcccctcctaggacgatggccaccacccgtcctttgttgtcgaagatcggtctgccgctgtctcatatcagcagccagggcct

SEQ ID NO: 10117 - DNA, 140 bp, Artificial Sequence
  Synthetic
aggccctggctgctgatatggctctcagccgccttgcacaccctgctgctacgaaaaggaaccggaaagcaccttgcgcatgcttgaggacaacgtgatgagacccggatactaccagctgaccttttgggacagcggtg

SEQ ID NO: 10118 - DNA, 140 bp, Artificial Sequence
  Synthetic
caccgctgtcccaaaaggtcagctggtagtatccgggtctcatcacgttgtcctcaagcatgcgcaaggtgctttccggttccttttcgtagcagcagggtgtgcaaggcggctgagagccatatcagcagccagggcct

SEQ ID NO: 10119 - DNA, 140 bp, Artificial Sequence
  Synthetic
atacgccatgctgggtctccaccttgcgcatgcttgaggacaacgtgatgagacccggatactaccagctactaaaagcatcgctgacttgctctccccaccgccaaagacgcagtactacgtacttgggagtcggccat

SEQ ID NO: 10120 - DNA, 140 bp, Artificial Sequence
  Synthetic
atggccgactcccaagtacgtagtactgcgtctttggcggtggggagagcaagtcagcgatgcttttagtagctggtagtatccgggtctcatcacgttgtcctcaagcatgcgcaaggtggagacccagcatggcgtat

SEQ ID NO: 10121 - DNA, 140 bp, Artificial Sequence
  Synthetic
aggccctggctgctgatatgaggacaattttaatgtctataaagccacaagaccatatctagctcattgtcctgactgcggagaagggcattcgtgccacagccctatcgcattggagcggaccttttgggacagcggtg

SEQ ID NO: 10122 - DNA, 140 bp, Artificial Sequence
  Synthetic
caccgctgtcccaaaaggtccgctccaatgcgatagggctgtggcacgaatgcccttctccgcagtcaggacaatgagctagatatggtcttgtggctttatagacattaaaattgtcctcatatcagcagccagggcct

SEQ ID NO: 10123 - DNA, 140 bp, Artificial Sequence
  Synthetic
aggccctggctgctgatatgtctccccaccgccagcgacgcagcaccaaggacaacttcaatgtctataaagccacaagaccatacttagctcactgtcccgactgtggagaagggcactgaccttttgggacagcggtg

SEQ ID NO: 10124 - DNA, 140 bp, Artificial Sequence
  Synthetic
caccgctgtcccaaaaggtcagtgcccttctccacagtcgggacagtgagctaagtatggtcttgtggctttatagacattgaagttgtccttggtgctgcgtcgctggcggtggggagacatatcagcagccagggcct

SEQ ID NO: 10125 - DNA, 140 bp, Artificial Sequence
  Synthetic
aggccctggctgctgatatgcgtgccatagtcccgtagcactagaacgcatcagaaatgaagcgacagacgggacgctgaaaatccaggtctccttgcaaatcggaataaagacggatgagaccttttgggacagcggtg

SEQ ID NO: 10126 - DNA, 140 bp, Artificial Sequence
  Synthetic
caccgctgtcccaaaaggtctcatccgtctttattccgatttgcaaggagacctggattttcagcgtcccgtctgtcgcttcatttctgatgcgttctagtgctacgggactatggcacgcatatcagcagccagggcct

SEQ ID NO: 10127 - DNA, 140 bp, Artificial Sequence
  Synthetic
aggccctggctgctgatatgtctgacggtgggattcactgacagtaggaagattagtcattcatgtacgcacccatttcaccacgaccctcctgtgataggtcgggaaaaattccattccgaccttttgggacagcggtg

SEQ ID NO: 10128 - DNA, 140 bp, Artificial Sequence
  Synthetic
caccgctgtcccaaaaggtcggaatggaatttttcccgacctatcacaggagggtcgtggtgaaatgggtgcgtacatgaatgactaatcttcctactgtcagtgaatcccaccgtcagacatatcagcagccagggcct

SEQ ID NO: 10129 - DNA, 140 bp, Artificial Sequence
  Synthetic
aggccctggctgctgatatgaggtagggagaggttccactctcgaccacaacatggtaaagagttaccttgcagcacgtacgtgcagagcaccgctgccactgctgaggagatagaggtggaccttttgggacagcggtg

SEQ ID NO: 10130 - DNA, 140 bp, Artificial Sequence
  Synthetic
caccgctgtcccaaaaggtccacctctatctcctcagcagtggcagcggtgctctgcacgtacgtgctgcaaggtaactctttaccatgttgtggtcgagagtggaacctctccctacctcatatcagcagccagggcct

SEQ ID NO: 10131 - DNA, 140 bp, Artificial Sequence
  Synthetic
aggccctggctgctgatatgcgaccgcagcacggtaaagagctaccttgcagcacgtacgtgcagagcaccgccgcaactaccgaggagatagaggtacacatgcccccagacacccctggaccttttgggacagcggtg

SEQ ID NO: 10132 - DNA, 140 bp, Artificial Sequence
  Synthetic
caccgctgtcccaaaaggtccaggggtgtctgggggcatgtgtacctctatctcctcggtagttgcggcggtgctctgcacgtacgtgctgcaaggtagctctttaccgtgctgcggtcgcatatcagcagccagggcct

SEQ ID NO: 10133 - DNA, 140 bp, Artificial Sequence
  Synthetic
atacgccatgctgggtctcccatatgcccccagatactcctgaccgcacgctgatgacgcagcagtctggcaacgtgaagatcacagttaatgggcagacggtgcggtacaagtgcaactcgtacttgggagtcggccat

SEQ ID NO: 10134 - DNA, 140 bp, Artificial Sequence
  Synthetic
atggccgactcccaagtacgagttgcacttgtaccgcaccgtctgcccattaactgtgatcttcacgttgccagactgctgcgtcatcagcgtgcggtcaggagtatctgggggcatatgggagacccagcatggcgtat

SEQ ID NO: 10135 - DNA, 140 bp, Artificial Sequence
  Synthetic
atacgccatgctgggtctccgcggtggctcaaacgagggactgacaaccacagacaaagtgatcaataactgcaaaattgatcagtgccatgctgcagtcactaatcacaagaattggcacgtacttgggagtcggccat

SEQ ID NO: 10136 - DNA, 140 bp, Artificial Sequence
  Synthetic
atggccgactcccaagtacgtgccaattcttgtgattagtgactgcagcatggcactgatcaattttgcagttattgatcactttgtctgtggttgtcagtccctcgtttgagccaccgcggagacccagcatggcgtat

SEQ ID NO: 10137 - DNA, 140 bp, Artificial Sequence
  Synthetic
atacgccatgctgggtctccatacaactcccctttagtcccgcgcaacgctgaactcggggaccgtaaaggaaagatccacatcccattcccattggcaaacgtgacttgcagagtgccacgtacttgggagtcggccat

SEQ ID NO: 10138 - DNA, 140 bp, Artificial Sequence
  Synthetic
atggccgactcccaagtacgtggcactctgcaagtcacgtttgccaatgggaatgggatgtggatctttcctttacggtccccgagttcagcgttgcgcgggactaaaggggagttgtatggagacccagcatggcgtat

SEQ ID NO: 10139 - DNA, 140 bp, Artificial Sequence
  Synthetic
aggccctggctgctgatatggaaagatccacatcccattcccattggcaaacgtgacttgcagagtgccaaaagcaagaaaccctacagtaacttacggaaaaaaccaagtcaccatgctgaccttttgggacagcggtg

SEQ ID NO: 10140 - DNA, 140 bp, Artificial Sequence
  Synthetic
caccgctgtcccaaaaggtcagcatggtgacttggttttttccgtaagttactgtagggtttcttgcttttggcactctgcaagtcacgtttgccaatgggaatgggatgtggatctttccatatcagcagccagggcct

SEQ ID NO: 10141 - DNA, 140 bp, Artificial Sequence
  Synthetic
atacgccatgctgggtctccgctgtatcctgaccatccgacactcttgtcttaccgtaacatgggacaggaaccaaattaccacgaggagtgggtgacacacaagaaggaggttaccttgcgtacttgggagtcggccat

SEQ ID NO: 10142 - DNA, 140 bp, Artificial Sequence
  Synthetic
atggccgactcccaagtacgcaaggtaacctccttcttgtgtgtcacccactcctcgtggtaatttggttcctgtcccatgttacggtaagacaagagtgtcggatggtcaggatacagcggagacccagcatggcgtat

SEQ ID NO: 10143 - DNA, 140 bp, Artificial Sequence
  Synthetic
aggccctggctgctgatatgaaccaaattaccacgaggagtgggtgacacacaagaaggaggttaccttgaccgtgcctactgagggtctggaggtcacttggggcaacaacgaaccatagaccttttgggacagcggtg

SEQ ID NO: 10144 - DNA, 140 bp, Artificial Sequence
  Synthetic
caccgctgtcccaaaaggtctatggttcgttgttgccccaagtgacctccagaccctcagtaggcacggtcaaggtaacctccttcttgtgtgtcacccactcctcgtggtaatttggttcatatcagcagccagggcct

SEQ ID NO: 10145 - DNA, 140 bp, Artificial Sequence
  Synthetic
atacgccatgctgggtctccatgagataatcttgtactattatgagctgtaccccactatgactgtagtcattgtgtcggtggcctcgttcgtgcttctgtcgatggtgggcacagcagtcgtacttgggagtcggccat

SEQ ID NO: 10146 - DNA, 140 bp, Artificial Sequence
  Synthetic
atggccgactcccaagtacgactgctgtgcccaccatcgacagaagcacgaacgaggccaccgacacaatgactacagtcatagtggggtacagctcataatagtacaagattatctcatggagacccagcatggcgtat

SEQ ID NO: 10147 - DNA, 140 bp, Artificial Sequence
  Synthetic
aggccctggctgctgatatggggaatgtgtgtgtgcgcacggcgcagatgcattacaccatatgaattaacaccaggagccactgttcccttcctgctcagcctgctatgctgcgtcagagaccttttgggacagcggtg

SEQ ID NO: 10148 - DNA, 140 bp, Artificial Sequence
  Synthetic
caccgctgtcccaaaaggtctctgacgcagcatagcaggctgagcaggaagggaacagtggctcctggtgttaattcatatggtgtaatgcatctgcgccgtgcgcacacacacattccccatatcagcagccagggcct

SEQ ID NO: 10149 - DNA, 140 bp, Artificial Sequence
  Synthetic
atacgccatgctgggtctccacgaccaaggcggccacatattacgaggctgcggcatatctatggaacgaacagcagcccctgttctggttgcaggctcttatcccgctggccgccttgacgtacttgggagtcggccat

SEQ ID NO: 10150 - DNA, 140 bp, Artificial Sequence
  Synthetic
atggccgactcccaagtacgtcaaggcggccagcgggataagagcctgcaaccagaacaggggctgctgttcgttccatagatatgccgcagcctcgtaatatgtggccgccttggtcgtggagacccagcatggcgtat

SEQ ID NO: 10151 - DNA, 140 bp, Artificial Sequence
  Synthetic
aggccctggctgctgatatgacacgtaacagtgatcccgaacacggtgggagtaccgtataagactcttgtcaacagaccgggttacagccccatggtgttggagatggagctacaatcagaccttttgggacagcggtg

SEQ ID NO: 10152 - DNA, 140 bp, Artificial Sequence
  Synthetic
caccgctgtcccaaaaggtctgattgtagctccatctccaacaccatggggctgtaacccggtctgttgacaagagtcttatacggtactcccaccgtgttcgggatcactgttacgtgtcatatcagcagccagggcct

SEQ ID NO: 10153 - DNA, 140 bp, Artificial Sequence
  Synthetic
atacgccatgctgggtctccgtcaccttggaaccaacactgtcacttgactacatcacgtgcgagtacaaaactgtcatcccctccccgtacgtgaagtgctgtggtacagcagagtgcacgtacttgggagtcggccat

SEQ ID NO: 10154 - DNA, 140 bp, Artificial Sequence
  Synthetic
atggccgactcccaagtacgtgcactctgctgtaccacagcacttcacgtacggggaggggatgacagttttgtactcgcacgtgatgtagtcaagtgacagtgttggttccaaggtgacggagacccagcatggcgtat

SEQ ID NO: 10155 - DNA, 140 bp, Artificial Sequence
  Synthetic
aggccctggctgctgatatgcatcggcctacagagcccacaccgcatcggcgtcggcgaagctccgcgtcctttaccaaggaaacaacattaccgtagctgcctacgctaacggtgaccagaccttttgggacagcggtg

SEQ ID NO: 10156 - DNA, 140 bp, Artificial Sequence
  Synthetic
caccgctgtcccaaaaggtctggtcaccgttagcgtaggcagctacggtaatgttgtttccttggtaaaggacgcggagcttcgccgacgccgatgcggtgtgggctctgtaggccgatgcatatcagcagccagggcct

SEQ ID NO: 10157 - DNA, 140 bp, Artificial Sequence
  Synthetic
atacgccatgctgggtctcctgccgtcacagtaaaggacgccaagtttgtcgtgggcccaatgtcctccgcctggacaccttttgacaacaaaatcgtggtgtacaaaggcgacgtctaccgtacttgggagtcggccat

SEQ ID NO: 10158 - DNA, 140 bp, Artificial Sequence
  Synthetic
atggccgactcccaagtacggtagacgtcgcctttgtacaccacgattttgttgtcaaaaggtgtccaggcggaggacattgggcccacgacaaacttggcgtcctttactgtgacggcaggagacccagcatggcgtat

SEQ ID NO: 10159 - DNA, 140 bp, Artificial Sequence
  Synthetic
aggccctggctgctgatatgcctggacaccttttgacaacaaaatcgtggtgtacaaaggcgacgtctacaacatggactacccaccttttggcgcaggaagaccaggacaatttggtgagaccttttgggacagcggtg

SEQ ID NO: 10160 - DNA, 140 bp, Artificial Sequence
  Synthetic
caccgctgtcccaaaaggtctcaccaaattgtcctggtcttcctgcgccaaaaggtgggtagtccatgttgtagacgtcgcctttgtacaccacgattttgttgtcaaaaggtgtccaggcatatcagcagccagggcct

SEQ ID NO: 10161 - DNA, 140 bp, Artificial Sequence
  Synthetic
aggccctggctgctgatatgcgcatccgcatcagctaagctccgcgtcctttaccaaggaaataacatcactgtaactgcctatgcaaacggtgaccatgccgtcacagttaaggacgccgaccttttgggacagcggtg

SEQ ID NO: 10162 - DNA, 140 bp, Artificial Sequence
  Synthetic
caccgctgtcccaaaaggtcggcgtccttaactgtgacggcatggtcaccgtttgcataggcagttacagtgatgttatttccttggtaaaggacgcggagcttagctgatgcggatgcgcatatcagcagccagggcct

SEQ ID NO: 10163 - DNA, 140 bp, Artificial Sequence
  Synthetic
aggccctggctgctgatatggcaaatatccttctcaacagccctggcaagcgccgagtttcgcgtgcaagtgtgctccacacaagtacactgcgcagccgcatgccaccctccaaaggacgaccttttgggacagcggtg

SEQ ID NO: 10164 - DNA, 140 bp, Artificial Sequence
  Synthetic
caccgctgtcccaaaaggtcgtcctttggagggtggcatgcggctgcgcagtgtacttgtgtggagcacacttgcacgcgaaactcggcgcttgccagggctgttgagaaggatatttgccatatcagcagccagggcct

SEQ ID NO: 10165 - DNA, 140 bp, Artificial Sequence
  Synthetic
aggccctggctgctgatatgtgtgctccacacaagtacactgcgcagccgcatgccaccctccaaaggaccacatagtcaattacccagcatcacacaccacccttggggtccaggatatgaccttttgggacagcggtg

SEQ ID NO: 10166 - DNA, 140 bp, Artificial Sequence
  Synthetic
caccgctgtcccaaaaggtcatatcctggaccccaagggtggtgtgtgatgctgggtaattgactatgtggtcctttggagggtggcatgcggctgcgcagtgtacttgtgtggagcacacatatcagcagccagggcct

SEQ ID NO: 10167 - DNA, 140 bp, Artificial Sequence
  Synthetic
aggccctggctgctgatatgcacatagtcaattacccagcatcacacaccacccttggggtccaggatatatccacaacggcaatgtcttgggtgcagaagattacgggaggagtaggatgaccttttgggacagcggtg

SEQ ID NO: 10168 - DNA, 140 bp, Artificial Sequence
  Synthetic
caccgctgtcccaaaaggtcatcctactcctcccgtaatcttctgcacccaagacattgccgttgtggatatatcctggaccccaagggtggtgtgtgatgctgggtaattgactatgtgcatatcagcagccagggcct

SEQ ID NO: 10169 - DNA, 140 bp, Artificial Sequence
  Synthetic
aggccctggctgctgatatgtttagcaggcactaaaccgatgataaggcacgaaataactaaatagcaaaagtagaaagtacataaccaggtatatgtgccccttaagaggcacaatatagaccttttgggacagcggtg

SEQ ID NO: 10170 - DNA, 140 bp, Artificial Sequence
  Synthetic
caccgctgtcccaaaaggtctatattgtgcctcttaaggggcacatatacctggttatgtactttctacttttgctatttagttatttcgtgccttatcatcggtttagtgcctgctaaacatatcagcagccagggcct

SEQ ID NO: 10171 - DNA, 140 bp, Artificial Sequence
  Synthetic
atacgccatgctgggtctcctatagctaagcactattagatcaaagggctatacaacccctgaatagtaacaaaacacaaaaaccaataaaaatcataaaaagaaaaatctcataaacagcgtacttgggagtcggccat

SEQ ID NO: 10172 - DNA, 140 bp, Artificial Sequence
  Synthetic
atggccgactcccaagtacgctgtttatgagatttttctttttatgatttttattggtttttgtgttttgttactattcaggggttgtatagccctttgatctaatagtgcttagctataggagacccagcatggcgtat

SEQ ID NO: 10173 - DNA, 140 bp, Artificial Sequence
  Synthetic
atacgccatgctgggtctccgtataagtgtcccctaagagacacattgtatgtaggtagtaagtatagatcaaagggctatattaacccctgaatagtaacaaaacacaaaaacaataaacgtacttgggagtcggccat

SEQ ID NO: 10174 - DNA, 140 bp, Artificial Sequence
  Synthetic
atggccgactcccaagtacgtttattgtttttgtgttttgttactattcaggggttaatatagccctttgatctatacttactacctacatacaatgtgtctcttaggggacacttatacggagacccagcatggcgtat

SEQ ID NO: 10175 - DNA, 140 bp, Artificial Sequence
  Synthetic
aggccctggctgctgatatgacccctgaatagtaacaaaacataaaatgtaataaaaattaagtgtgtacccaaaagaggtacagtaagaatcagtgaatatcacaattggcaacgagaagaccttttgggacagcggtg

SEQ ID NO: 10176 - DNA, 140 bp, Artificial Sequence
  Synthetic
caccgctgtcccaaaaggtcttctcgttgccaattgtgatattcactgattcttactgtacctcttttgggtacacacttaatttttattacattttatgttttgttactattcaggggtcatatcagcagccagggcct

SEQ ID NO: 10177 - DNA, 140 bp, Artificial Sequence
  Synthetic
atacgccatgctgggtctccagtcaattcgacctaagcgttgatggcgagatactgcccgtcccgccagacctggatgctgacgccccagccctagaaccagcactagacgacggggcgacgtacttgggagtcggccat

SEQ ID NO: 10178 - DNA, 140 bp, Artificial Sequence
  Synthetic
atggccgactcccaagtacgtcgccccgtcgtctagtgctggttctagggctggggcgtcagcatccaggtctggcgggacgggcagtatctcgccatcaacgcttaggtcgaattgactggagacccagcatggcgtat

SEQ ID NO: 10179 - DNA, 140 bp, Artificial Sequence
  Synthetic
aggccctggctgctgatatggccgaactcactttgagacgtaggcatagcataccgaactcttccactattctccgaacccacagggacgtaggagatgttattttgtttttaatatttcgaccttttgggacagcggtg

SEQ ID NO: 10180 - DNA, 140 bp, Artificial Sequence
  Synthetic
caccgctgtcccaaaaggtcgaaatattaaaaacaaaataacatctcctacgtccctgtgggttcggagaatagtggaagagttcggtatgctatgcctacgtctcaaagtgagttcggccatatcagcagccagggcct

SEQ ID NO: 10181 - DNA, 140 bp, Artificial Sequence
  Synthetic
aggccctggctgctgatatgattagtcactcatgtacgcacccatttcaccacgaccctcctgtgataggtcgggaaaaattccattcccgaccgcggcacggtaaagagctaccttgcagaccttttgggacagcggtg

SEQ ID NO: 10182 - DNA, 140 bp, Artificial Sequence
  Synthetic
caccgctgtcccaaaaggtctgcaaggtagctctttaccgtgccgcggtcgggaatggaatttttcccgacctatcacaggagggtcgtggtgaaatgggtgcgtacatgagtgactaatcatatcagcagccagggcct

SEQ ID NO: 10183 - DNA, 140 bp, Artificial Sequence
  Synthetic
atacgccatgctgggtctccatggctgcgtgagacacacgtagcctaccagtttcttactgctctactctgcaaagcaagagattaataacccatcatggattctgtgtacgtggatatacgtacttgggagtcggccat

SEQ ID NO: 10184 - DNA, 140 bp, Artificial Sequence
  Synthetic
atggccgactcccaagtacgtatatccacgtacacagaatccatgatgggttattaatctcttgctttgcagagtagagcagtaagaaactggtaggctacgtgtgtctcacgcagccatggagacccagcatggcgtat

SEQ ID NO: 10185 - DNA, 140 bp, Artificial Sequence
  Synthetic
atacgccatgctgggtctccaggaagaccaggacaatttggcgatatccaaagtcgcacacctgagagtaacgacgtctatgctaatacacagctggtactgcagagaccggctgtgggtcgtacttgggagtcggccat

SEQ ID NO: 10186 - DNA, 140 bp, Artificial Sequence
  Synthetic
atggccgactcccaagtacgacccacagccggtctctgcagtaccagctgtgtattagcatagacgtcgttactctcaggtgtgcgactttggatatcgccaaattgtcctggtcttcctggagacccagcatggcgtat

SEQ ID NO: 10187 - DNA, 140 bp, Artificial Sequence
  Synthetic
aggccctggctgctgatatggtaacaaaacataaaattaataaaaatcaaatgaataccataattggcaaacggaagagatgtaggtacttaagcttcctaaaagcagccgaactcacttgaccttttgggacagcggtg

SEQ ID NO: 10188 - DNA, 140 bp, Artificial Sequence
  Synthetic
caccgctgtcccaaaaggtcaagtgagttcggctgcttttaggaagcttaagtacctacatctcttccgtttgccaattatggtattcatttgatttttattaattttatgttttgttaccatatcagcagccagggcct

SEQ ID NO: 10189 - DNA, 140 bp, Artificial Sequence
  Synthetic
atacgccatgctgggtctccgacagaaacatttctggaaagatcggggacttacaagaggtgatggccgtgccagacacggagacgccaacattttgcttacacacagatgtctcatgtacgtacttgggagtcggccat

SEQ ID NO: 10190 - DNA, 140 bp, Artificial Sequence
  Synthetic
atggccgactcccaagtacgtacatgagacatctgtgtgtaagcaaaatgttggcgtctccgtgtctggcacggccatcacctcttgtaagtccccgatctttccagaaatgtttctgtcggagacccagcatggcgtat

SEQ ID NO: 10191 - DNA, 140 bp, Artificial Sequence
  Synthetic
aggccctggctgctgatatggccgcaggactggtactggtgggcgacttgactaatccgccctaccacgaattcgcatatgaagggctaaaaatccgccctgcctgcccgtacaaaattggaccttttgggacagcggtg

SEQ ID NO: 10192 - DNA, 140 bp, Artificial Sequence
  Synthetic
caccgctgtcccaaaaggtccaattttgtacgggcaggcagggcggatttttagcccttcatatgcgaattcgtggtagggcggattagtcaagtcgcccaccagtaccagtcctgcggccatatcagcagccagggcct

SEQ ID NO: 10193 - DNA, 140 bp, Artificial Sequence
  Synthetic
aggccctggctgctgatatgctgtgacacagtggtttcgtgtgagggctacgtcgttaagagaataacgatgagcccaggcctttatggaaaaaccacggggtatgcggtaacccaccacgaccttttgggacagcggtg

SEQ ID NO: 10194 - DNA, 140 bp, Artificial Sequence
  Synthetic
caccgctgtcccaaaaggtcgtggtgggttaccgcataccccgtggtttttccataaaggcctgggctcatcgttattctcttaacgacgtagccctcacacgaaaccactgtgtcacagcatatcagcagccagggcct

SEQ ID NO: 10195 - DNA, 140 bp, Artificial Sequence
  Synthetic
aggccctggctgctgatatgtgagcccaggcctttatggaaaaaccacggggtatgcggtaacccaccacgcagacggattcttgatgtgcaagactaccgacacggtagacggtgaaaggaccttttgggacagcggtg

SEQ ID NO: 10196 - DNA, 140 bp, Artificial Sequence
  Synthetic
caccgctgtcccaaaaggtcctttcaccgtctaccgtgtcggtagtcttgcacatcaagaatccgtctgcgtggtgggttaccgcataccccgtggtttttccataaaggcctgggctcacatatcagcagccagggcct

SEQ ID NO: 10197 - DNA, 140 bp, Artificial Sequence
  Synthetic
atacgccatgctgggtctccaatccacgctgttggaccaaacttctctaattattcggagtctgaaggggaccgggaattggcagctgcctatcgagaagtcgcacaggaagtaactaggcgtacttgggagtcggccat

SEQ ID NO: 10198 - DNA, 140 bp, Artificial Sequence
  Synthetic
atggccgactcccaagtacgcctagttacttcctgtgcgacttctcgataggcagctgccaattcccggtccccttcagactccgaataattagagaagtttggtccaacagcgtggattggagacccagcatggcgtat

SEQ ID NO: 10199 - DNA, 140 bp, Artificial Sequence
  Synthetic
aggccctggctgctgatatgcacgaacaccatgaagaactacctgcttcccgtggtcgcccaggccttcagtaagtgggcgaaggagtgccggaaggacatggaagatgagaagcttttggaccttttgggacagcggtg

SEQ ID NO: 10200 - DNA, 140 bp, Artificial Sequence
  Synthetic
caccgctgtcccaaaaggtccaaaagcttctcatcttccatgtccttccggcactccttcgcccacttactgaaggcctgggcgaccacgggaagcaggtagttcttcatggtgttcgtgcatatcagcagccagggcct

SEQ ID NO: 10201 - DNA, 140 bp, Artificial Sequence
  Synthetic
atacgccatgctgggtctccggggtcagagaaagaacactgacctgctgctgtctgtgggcatttaagaagcagaaaacacacacggtctacaagaggcctgatacccagtcaatccagacgtacttgggagtcggccat

SEQ ID NO: 10202 - DNA, 140 bp, Artificial Sequence
  Synthetic
atggccgactcccaagtacgtctggattgactgggtatcaggcctcttgtagaccgtgtgtgttttctgcttcttaaatgcccacagacagcagcaggtcagtgttctttctctgaccccggagacccagcatggcgtat

SEQ ID NO: 10203 - DNA, 140 bp, Artificial Sequence
  Synthetic
aggccctggctgctgatatggcagaaaacacacacggtctacaagaggcctgatacccagtcaatccagaaggttcaggccgaattcgacagctttgtagtaccaggcctgtggtcgtccgaccttttgggacagcggtg

SEQ ID NO: 10204 - DNA, 140 bp, Artificial Sequence
  Synthetic
caccgctgtcccaaaaggtcggacgaccacaggcctggtactacaaagctgtcgaattcggcctgaaccttctggattgactgggtatcaggcctcttgtagaccgtgtgtgttttctgccatatcagcagccagggcct

SEQ ID NO: 10205 - DNA, 140 bp, Artificial Sequence
  Synthetic
aggccctggctgctgatatgggtgcagaagatcacgggaggtgtgggactggttgttgctgttgccgcactgattctaatcgtggtgctacgcgtgtcgttcagcaggcactaacttgacgaccttttgggacagcggtg

SEQ ID NO: 10206 - DNA, 140 bp, Artificial Sequence
  Synthetic
caccgctgtcccaaaaggtcgtcaagttagtgcctgctgaacgacacgcgtagcaccacgattagaatcagtgcggcaacagcaacaaccagtcccacacctcccgtgatcttctgcacccatatcagcagccagggcct

SEQ ID NO: 10207 - DNA, 140 bp, Artificial Sequence
  Synthetic
aggccctggctgctgatatgcgtggaacaacttgaggatagagctggtgctggaataatagagactccgagaggcgctattaaagttactgcccaactaacggaccacgtcgtgggggaggaccttttgggacagcggtg

SEQ ID NO: 10208 - DNA, 140 bp, Artificial Sequence
  Synthetic
caccgctgtcccaaaaggtcctcccccacgacgtggtccgttagttgggcagtaactttaatagcgcctctcggagtctctattattccagcaccagctctatcctcaagttgttccacgcatatcagcagccagggcct

SEQ ID NO: 10209 - DNA, 140 bp, Artificial Sequence
  Synthetic
atacgccatgctgggtctccatggaatggatggttaacaagataaacggccaccacgtgctcctggtcagtggctataaccttgcactgcctactaagagagtcacttgggtaacgccgtcgtacttgggagtcggccat

SEQ ID NO: 10210 - DNA, 140 bp, Artificial Sequence
  Synthetic
atggccgactcccaagtacgacggcgttacccaagtgactctcttagtaggcagtgcaaggttatagccactgaccaggagcacgtggtggccgtttatcttgttaaccatccattccatggagacccagcatggcgtat

SEQ ID NO: 10211 - DNA, 140 bp, Artificial Sequence
  Synthetic
atacgccatgctgggtctccatggaatggatggttaacaagataaacggccaccacgtgctcctggtcagtggctataaccttgcactgcctactaagagagtcacttgggtatcgccgtcgtacttgggagtcggccat

SEQ ID NO: 10212 - DNA, 140 bp, Artificial Sequence
  Synthetic
atggccgactcccaagtacgacggcgatacccaagtgactctcttagtaggcagtgcaaggttatagccactgaccaggagcacgtggtggccgtttatcttgttaaccatccattccatggagacccagcatggcgtat

SEQ ID NO: 10213 - DNA, 140 bp, Artificial Sequence
  Synthetic
atacgccatgctgggtctccatggaatggatggttaacaagataaacggccaccacgtgctcctggtcagtggctataaccttgcactgcctactaagagagtcacttgggtaccgccgtcgtacttgggagtcggccat

SEQ ID NO: 10214 - DNA, 140 bp, Artificial Sequence
  Synthetic
atggccgactcccaagtacgacggcggtacccaagtgactctcttagtaggcagtgcaaggttatagccactgaccaggagcacgtggtggccgtttatcttgttaaccatccattccatggagacccagcatggcgtat

SEQ ID NO: 10215 - DNA, 140 bp, Artificial Sequence
  Synthetic
atacgccatgctgggtctccatggaatggatggttaacaagataaacggccaccacgtgctcctggtcagtggctataaccttgcactgcctactaagagagtcacttgggtagcgccgtcgtacttgggagtcggccat

SEQ ID NO: 10216 - DNA, 140 bp, Artificial Sequence
  Synthetic
atggccgactcccaagtacgacggcgctacccaagtgactctcttagtaggcagtgcaaggttatagccactgaccaggagcacgtggtggccgtttatcttgttaaccatccattccatggagacccagcatggcgtat

SEQ ID NO: 10217 - DNA, 140 bp, Artificial Sequence
  Synthetic
atacgccatgctgggtctccatggaatggttggttaacaagataaacggccaccacgtgctcctggtcagtggctataaccttgcactgcctactaagagagtcacttgggtaacgccgtcgtacttgggagtcggccat

SEQ ID NO: 10218 - DNA, 140 bp, Artificial Sequence
  Synthetic
atggccgactcccaagtacgacggcgttacccaagtgactctcttagtaggcagtgcaaggttatagccactgaccaggagcacgtggtggccgtttatcttgttaaccaaccattccatggagacccagcatggcgtat

SEQ ID NO: 10219 - DNA, 140 bp, Artificial Sequence
  Synthetic
atacgccatgctgggtctccatggaatggttggttaacaagataaacggccaccacgtgctcctggtcagtggctataaccttgcactgcctactaagagagtcacttgggtatcgccgtcgtacttgggagtcggccat

SEQ ID NO: 10220 - DNA, 140 bp, Artificial Sequence
  Synthetic
atggccgactcccaagtacgacggcgatacccaagtgactctcttagtaggcagtgcaaggttatagccactgaccaggagcacgtggtggccgtttatcttgttaaccaaccattccatggagacccagcatggcgtat

SEQ ID NO: 10221 - DNA, 140 bp, Artificial Sequence
  Synthetic
atacgccatgctgggtctccatggaatggttggttaacaagataaacggccaccacgtgctcctggtcagtggctataaccttgcactgcctactaagagagtcacttgggtaccgccgtcgtacttgggagtcggccat

SEQ ID NO: 10222 - DNA, 140 bp, Artificial Sequence
  Synthetic
atggccgactcccaagtacgacggcggtacccaagtgactctcttagtaggcagtgcaaggttatagccactgaccaggagcacgtggtggccgtttatcttgttaaccaaccattccatggagacccagcatggcgtat

SEQ ID NO: 10223 - DNA, 140 bp, Artificial Sequence
  Synthetic
atacgccatgctgggtctccatggaatggttggttaacaagataaacggccaccacgtgctcctggtcagtggctataaccttgcactgcctactaagagagtcacttgggtagcgccgtcgtacttgggagtcggccat

SEQ ID NO: 10224 - DNA, 140 bp, Artificial Sequence
  Synthetic
atggccgactcccaagtacgacggcgctacccaagtgactctcttagtaggcagtgcaaggttatagccactgaccaggagcacgtggtggccgtttatcttgttaaccaaccattccatggagacccagcatggcgtat

SEQ ID NO: 10225 - DNA, 140 bp, Artificial Sequence
  Synthetic
atacgccatgctgggtctccatggaatggctggttaacaagataaacggccaccacgtgctcctggtcagtggctataaccttgcactgcctactaagagagtcacttgggtaacgccgtcgtacttgggagtcggccat

SEQ ID NO: 10226 - DNA, 140 bp, Artificial Sequence
  Synthetic
atggccgactcccaagtacgacggcgttacccaagtgactctcttagtaggcagtgcaaggttatagccactgaccaggagcacgtggtggccgtttatcttgttaaccagccattccatggagacccagcatggcgtat

SEQ ID NO: 10227 - DNA, 140 bp, Artificial Sequence
  Synthetic
atacgccatgctgggtctccatggaatggctggttaacaagataaacggccaccacgtgctcctggtcagtggctataaccttgcactgcctactaagagagtcacttgggtatcgccgtcgtacttgggagtcggccat

SEQ ID NO: 10228 - DNA, 140 bp, Artificial Sequence
  Synthetic
atggccgactcccaagtacgacggcgatacccaagtgactctcttagtaggcagtgcaaggttatagccactgaccaggagcacgtggtggccgtttatcttgttaaccagccattccatggagacccagcatggcgtat

SEQ ID NO: 10229 - DNA, 140 bp, Artificial Sequence
  Synthetic
atacgccatgctgggtctccatggaatggctggttaacaagataaacggccaccacgtgctcctggtcagtggctataaccttgcactgcctactaagagagtcacttgggtaccgccgtcgtacttgggagtcggccat

SEQ ID NO: 10230 - DNA, 140 bp, Artificial Sequence
  Synthetic
atggccgactcccaagtacgacggcggtacccaagtgactctcttagtaggcagtgcaaggttatagccactgaccaggagcacgtggtggccgtttatcttgttaaccagccattccatggagacccagcatggcgtat

SEQ ID NO: 10231 - DNA, 140 bp, Artificial Sequence
  Synthetic
atacgccatgctgggtctccatggaatggctggttaacaagataaacggccaccacgtgctcctggtcagtggctataaccttgcactgcctactaagagagtcacttgggtagcgccgtcgtacttgggagtcggccat

SEQ ID NO: 10232 - DNA, 140 bp, Artificial Sequence
  Synthetic
atggccgactcccaagtacgacggcgctacccaagtgactctcttagtaggcagtgcaaggttatagccactgaccaggagcacgtggtggccgtttatcttgttaaccagccattccatggagacccagcatggcgtat

SEQ ID NO: 10233 - DNA, 140 bp, Artificial Sequence
  Synthetic
atacgccatgctgggtctccatggaatgggtggttaacaagataaacggccaccacgtgctcctggtcagtggctataaccttgcactgcctactaagagagtcacttgggtaacgccgtcgtacttgggagtcggccat

SEQ ID NO: 10234 - DNA, 140 bp, Artificial Sequence
  Synthetic
atggccgactcccaagtacgacggcgttacccaagtgactctcttagtaggcagtgcaaggttatagccactgaccaggagcacgtggtggccgtttatcttgttaaccacccattccatggagacccagcatggcgtat

SEQ ID NO: 10235 - DNA, 140 bp, Artificial Sequence
  Synthetic
atacgccatgctgggtctccatggaatgggtggttaacaagataaacggccaccacgtgctcctggtcagtggctataaccttgcactgcctactaagagagtcacttgggtatcgccgtcgtacttgggagtcggccat

SEQ ID NO: 10236 - DNA, 140 bp, Artificial Sequence
  Synthetic
atggccgactcccaagtacgacggcgatacccaagtgactctcttagtaggcagtgcaaggttatagccactgaccaggagcacgtggtggccgtttatcttgttaaccacccattccatggagacccagcatggcgtat

SEQ ID NO: 10237 - DNA, 140 bp, Artificial Sequence
  Synthetic
atacgccatgctgggtctccatggaatgggtggttaacaagataaacggccaccacgtgctcctggtcagtggctataaccttgcactgcctactaagagagtcacttgggtaccgccgtcgtacttgggagtcggccat

SEQ ID NO: 10238 - DNA, 140 bp, Artificial Sequence
  Synthetic
atggccgactcccaagtacgacggcggtacccaagtgactctcttagtaggcagtgcaaggttatagccactgaccaggagcacgtggtggccgtttatcttgttaaccacccattccatggagacccagcatggcgtat

SEQ ID NO: 10239 - DNA, 140 bp, Artificial Sequence
  Synthetic
atacgccatgctgggtctccatggaatgggtggttaacaagataaacggccaccacgtgctcctggtcagtggctataaccttgcactgcctactaagagagtcacttgggtagcgccgtcgtacttgggagtcggccat

SEQ ID NO: 10240 - DNA, 140 bp, Artificial Sequence
  Synthetic
atggccgactcccaagtacgacggcgctacccaagtgactctcttagtaggcagtgcaaggttatagccactgaccaggagcacgtggtggccgtttatcttgttaaccacccattccatggagacccagcatggcgtat

SEQ ID NO: 10241 - DNA, 140 bp, Artificial Sequence
  Synthetic
aggccctggctgctgatatgagggcagagaggacagaacacgagtacgtctacgacgtggaccagagaagatgctgcaagaaggaagaagctgcaggattggtactggtgggcgacttgagaccttttgggacagcggtg

SEQ ID NO: 10242 - DNA, 140 bp, Artificial Sequence
  Synthetic
caccgctgtcccaaaaggtctcaagtcgcccaccagtaccaatcctgcagcttcttccttcttgcagcatcttctctggtccacgtcgtagacgtactcgtgttctgtcctctctgccctcatatcagcagccagggcct

SEQ ID NO: 10243 - DNA, 140 bp, Artificial Sequence
  Synthetic
atacgccatgctgggtctcctaggtgtccgcggagcggactacacatacaacctaaagttgggtctgccagcaacgcttggtaggtatgacctagtggtcataaacatccacacacctttcgtacttgggagtcggccat

SEQ ID NO: 10244 - DNA, 140 bp, Artificial Sequence
  Synthetic
atggccgactcccaagtacgaaaggtgtgtggatgtttatgaccactaggtcatacctaccaagcgttgctggcagacccaactttaggttgtatgtgtagtccgctccgcggacacctaggagacccagcatggcgtat

SEQ ID NO: 10245 - DNA, 140 bp, Artificial Sequence
  Synthetic
atacgccatgctgggtctcctaggtgtccgcggagcggactacacatacaacctatagttgggtctgccagcaacgcttggtaggtatgacctagtggtcataaacatccacacacctttcgtacttgggagtcggccat

SEQ ID NO: 10246 - DNA, 140 bp, Artificial Sequence
  Synthetic
atggccgactcccaagtacgaaaggtgtgtggatgtttatgaccactaggtcatacctaccaagcgttgctggcagacccaactataggttgtatgtgtagtccgctccgcggacacctaggagacccagcatggcgtat

SEQ ID NO: 10247 - DNA, 140 bp, Artificial Sequence
  Synthetic
atacgccatgctgggtctcctaggtgtccgcggagcggactacacatacaacctacagttgggtctgccagcaacgcttggtaggtatgacctagtggtcataaacatccacacacctttcgtacttgggagtcggccat

SEQ ID NO: 10248 - DNA, 140 bp, Artificial Sequence
  Synthetic
atggccgactcccaagtacgaaaggtgtgtggatgtttatgaccactaggtcatacctaccaagcgttgctggcagacccaactgtaggttgtatgtgtagtccgctccgcggacacctaggagacccagcatggcgtat

SEQ ID NO: 10249 - DNA, 140 bp, Artificial Sequence
  Synthetic
atacgccatgctgggtctcctaggtgtccgcggagcggactacacatacaacctagagttgggtctgccagcaacgcttggtaggtatgacctagtggtcataaacatccacacacctttcgtacttgggagtcggccat

SEQ ID NO: 10250 - DNA, 140 bp, Artificial Sequence
  Synthetic
atggccgactcccaagtacgaaaggtgtgtggatgtttatgaccactaggtcatacctaccaagcgttgctggcagacccaactctaggttgtatgtgtagtccgctccgcggacacctaggagacccagcatggcgtat

SEQ ID NO: 10251 - DNA, 140 bp, Artificial Sequence
  Synthetic
atacgccatgctgggtctccctaatccgccctaccacgaattcgcgtacgaagggctaaaaattcgccccgcttgtccatataaaattgcagtcataggagtcttcggggtaccaggatccgtacttgggagtcggccat

SEQ ID NO: 10252 - DNA, 140 bp, Artificial Sequence
  Synthetic
atggccgactcccaagtacggatcctggtaccccgaagactcctatgactgcaattttatatggacaagcggggcgaatttttagcccttcgtacgcgaattcgtggtagggcggattagggagacccagcatggcgtat

SEQ ID NO: 10253 - DNA, 140 bp, Artificial Sequence
  Synthetic
aggccctggctgctgatatgaggcccagaccgcgccctcagaggcaagctgggcaacttgcccagctgatctcagcagttaataaactgacaatgtgcgcggtaccccaacagaagccacgaccttttgggacagcggtg

SEQ ID NO: 10254 - DNA, 140 bp, Artificial Sequence
  Synthetic
caccgctgtcccaaaaggtcgtggcttctgttggggtaccgcgcacattgtcagtttattaactgctgagatcagctgggcaagttgcccagcttgcctctgagggcgcggtctgggcctcatatcagcagccagggcct

SEQ ID NO: 10255 - DNA, 140 bp, Artificial Sequence
  Synthetic
atacgccatgctgggtctccgcaggaatcggaagaataagaagcaaaagcaaaaacaacaggcgccacaaaacaacacaaatcaaaagaagcagccacctaaaaagaaaccggctcaaaacgtacttgggagtcggccat

SEQ ID NO: 10256 - DNA, 140 bp, Artificial Sequence
  Synthetic
atggccgactcccaagtacgttttgagccggtttctttttaggtggctgcttcttttgatttgtgttgttttgtggcgcctgttgtttttgcttttgcttcttattcttccgattcctgcggagacccagcatggcgtat

SEQ ID NO: 10257 - DNA, 140 bp, Artificial Sequence
  Synthetic
atacgccatgctgggtctccgcaggaatcggaagaataagaagcaaaagcaaaaacaacaggcgccacaaaacaacacaaatcataagaagcagccacctaaaaagaaaccggctcaaaacgtacttgggagtcggccat

SEQ ID NO: 10258 - DNA, 140 bp, Artificial Sequence
  Synthetic
atggccgactcccaagtacgttttgagccggtttctttttaggtggctgcttcttatgatttgtgttgttttgtggcgcctgttgtttttgcttttgcttcttattcttccgattcctgcggagacccagcatggcgtat

SEQ ID NO: 10259 - DNA, 140 bp, Artificial Sequence
  Synthetic
atacgccatgctgggtctccgcaggaatcggaagaataagaagcaaaagcaaaaacaacaggcgccacaaaacaacacaaatcacaagaagcagccacctaaaaagaaaccggctcaaaacgtacttgggagtcggccat

SEQ ID NO: 10260 - DNA, 140 bp, Artificial Sequence
  Synthetic
atggccgactcccaagtacgttttgagccggtttctttttaggtggctgcttcttgtgatttgtgttgttttgtggcgcctgttgtttttgcttttgcttcttattcttccgattcctgcggagacccagcatggcgtat

SEQ ID NO: 10261 - DNA, 140 bp, Artificial Sequence
  Synthetic
atacgccatgctgggtctccgcaggaatcggaagaataagaagcaaaagcaaaaacaacaggcgccacaaaacaacacaaatcagaagaagcagccacctaaaaagaaaccggctcaaaacgtacttgggagtcggccat

SEQ ID NO: 10262 - DNA, 140 bp, Artificial Sequence
  Synthetic
atggccgactcccaagtacgttttgagccggtttctttttaggtggctgcttcttctgatttgtgttgttttgtggcgcctgttgtttttgcttttgcttcttattcttccgattcctgcggagacccagcatggcgtat

SEQ ID NO: 10263 - DNA, 140 bp, Artificial Sequence
  Synthetic
aggccctggctgctgatatgttgcattacgaaggcaaaatgcgcactacgaatgagtacaacatgccgattgtagtggacactacgggctcaacaaaacctgaccctggagacctcgtgtgaccttttgggacagcggtg

SEQ ID NO: 10264 - DNA, 140 bp, Artificial Sequence
  Synthetic
caccgctgtcccaaaaggtcacacgaggtctccagggtcaggttttgttgagcccgtagtgtccactacaatcggcatgttgtactcattcgtagtgcgcattttgccttcgtaatgcaacatatcagcagccagggcct

SEQ ID NO: 10265 - DNA, 140 bp, Artificial Sequence
  Synthetic
atacgccatgctgggtctccgaaaaagaagccgggccgcagagagaggatgtgcatgaaaatcgaaaatgattgtattttcgaagtcaagcacgaaggtaaggtaacaggttacacgtgccgtacttgggagtcggccat

SEQ ID NO: 10266 - DNA, 140 bp, Artificial Sequence
  Synthetic
atggccgactcccaagtacggcacgtgtaacctgttaccttaccttcgtgcttgacttcgaaaatacaatcattttcgattttcatgcacatcctctctctgcggcccggcttctttttcggagacccagcatggcgtat

SEQ ID NO: 10267 - DNA, 140 bp, Artificial Sequence
  Synthetic
atacgccatgctgggtctccgaaaaagaagccgggccgcagagagaggatgtgcatgaaaatcgaaaatgattgtattttcgaagtcaagcacgaaggtaaggtaacaggttactcgtgccgtacttgggagtcggccat

SEQ ID NO: 10268 - DNA, 140 bp, Artificial Sequence
  Synthetic
atggccgactcccaagtacggcacgagtaacctgttaccttaccttcgtgcttgacttcgaaaatacaatcattttcgattttcatgcacatcctctctctgcggcccggcttctttttcggagacccagcatggcgtat

SEQ ID NO: 10269 - DNA, 140 bp, Artificial Sequence
  Synthetic
atacgccatgctgggtctccgaaaaagaagccgggccgcagagagaggatgtgcatgaaaatcgaaaatgattgtattttcgaagtcaagcacgaaggtaaggtaacaggttacccgtgccgtacttgggagtcggccat

SEQ ID NO: 10270 - DNA, 140 bp, Artificial Sequence
  Synthetic
atggccgactcccaagtacggcacgggtaacctgttaccttaccttcgtgcttgacttcgaaaatacaatcattttcgattttcatgcacatcctctctctgcggcccggcttctttttcggagacccagcatggcgtat

SEQ ID NO: 10271 - DNA, 140 bp, Artificial Sequence
  Synthetic
atacgccatgctgggtctccgaaaaagaagccgggccgcagagagaggatgtgcatgaaaatcgaaaatgattgtattttcgaagtcaagcacgaaggtaaggtaacaggttacgcgtgccgtacttgggagtcggccat

SEQ ID NO: 10272 - DNA, 140 bp, Artificial Sequence
  Synthetic
atggccgactcccaagtacggcacgcgtaacctgttaccttaccttcgtgcttgacttcgaaaatacaatcattttcgattttcatgcacatcctctctctgcggcccggcttctttttcggagacccagcatggcgtat

SEQ ID NO: 10273 - DNA, 140 bp, Artificial Sequence
  Synthetic
atacgccatgctgggtctccgaaaaagaagccgggccgcagagagaggatgtgcatgaaaatcgaaaatgattgttttttcgaagtcaagcacgaaggtaaggtaacaggttacacgtgccgtacttgggagtcggccat

SEQ ID NO: 10274 - DNA, 140 bp, Artificial Sequence
  Synthetic
atggccgactcccaagtacggcacgtgtaacctgttaccttaccttcgtgcttgacttcgaaaaaacaatcattttcgattttcatgcacatcctctctctgcggcccggcttctttttcggagacccagcatggcgtat

SEQ ID NO: 10275 - DNA, 140 bp, Artificial Sequence
  Synthetic
atacgccatgctgggtctccgaaaaagaagccgggccgcagagagaggatgtgcatgaaaatcgaaaatgattgttttttcgaagtcaagcacgaaggtaaggtaacaggttactcgtgccgtacttgggagtcggccat

SEQ ID NO: 10276 - DNA, 140 bp, Artificial Sequence
  Synthetic
atggccgactcccaagtacggcacgagtaacctgttaccttaccttcgtgcttgacttcgaaaaaacaatcattttcgattttcatgcacatcctctctctgcggcccggcttctttttcggagacccagcatggcgtat

SEQ ID NO: 10277 - DNA, 140 bp, Artificial Sequence
  Synthetic
atacgccatgctgggtctccgaaaaagaagccgggccgcagagagaggatgtgcatgaaaatcgaaaatgattgttttttcgaagtcaagcacgaaggtaaggtaacaggttacccgtgccgtacttgggagtcggccat

SEQ ID NO: 10278 - DNA, 140 bp, Artificial Sequence
  Synthetic
atggccgactcccaagtacggcacgggtaacctgttaccttaccttcgtgcttgacttcgaaaaaacaatcattttcgattttcatgcacatcctctctctgcggcccggcttctttttcggagacccagcatggcgtat

SEQ ID NO: 10279 - DNA, 140 bp, Artificial Sequence
  Synthetic
atacgccatgctgggtctccgaaaaagaagccgggccgcagagagaggatgtgcatgaaaatcgaaaatgattgttttttcgaagtcaagcacgaaggtaaggtaacaggttacgcgtgccgtacttgggagtcggccat

SEQ ID NO: 10280 - DNA, 140 bp, Artificial Sequence
  Synthetic
atggccgactcccaagtacggcacgcgtaacctgttaccttaccttcgtgcttgacttcgaaaaaacaatcattttcgattttcatgcacatcctctctctgcggcccggcttctttttcggagacccagcatggcgtat

SEQ ID NO: 10281 - DNA, 140 bp, Artificial Sequence
  Synthetic
atacgccatgctgggtctccgaaaaagaagccgggccgcagagagaggatgtgcatgaaaatcgaaaatgattgtcttttcgaagtcaagcacgaaggtaaggtaacaggttacacgtgccgtacttgggagtcggccat

SEQ ID NO: 10282 - DNA, 140 bp, Artificial Sequence
  Synthetic
atggccgactcccaagtacggcacgtgtaacctgttaccttaccttcgtgcttgacttcgaaaagacaatcattttcgattttcatgcacatcctctctctgcggcccggcttctttttcggagacccagcatggcgtat

SEQ ID NO: 10283 - DNA, 140 bp, Artificial Sequence
  Synthetic
atacgccatgctgggtctccgaaaaagaagccgggccgcagagagaggatgtgcatgaaaatcgaaaatgattgtcttttcgaagtcaagcacgaaggtaaggtaacaggttactcgtgccgtacttgggagtcggccat

SEQ ID NO: 10284 - DNA, 140 bp, Artificial Sequence
  Synthetic
atggccgactcccaagtacggcacgagtaacctgttaccttaccttcgtgcttgacttcgaaaagacaatcattttcgattttcatgcacatcctctctctgcggcccggcttctttttcggagacccagcatggcgtat

SEQ ID NO: 10285 - DNA, 140 bp, Artificial Sequence
  Synthetic
atacgccatgctgggtctccgaaaaagaagccgggccgcagagagaggatgtgcatgaaaatcgaaaatgattgtcttttcgaagtcaagcacgaaggtaaggtaacaggttacccgtgccgtacttgggagtcggccat

SEQ ID NO: 10286 - DNA, 140 bp, Artificial Sequence
  Synthetic
atggccgactcccaagtacggcacgggtaacctgttaccttaccttcgtgcttgacttcgaaaagacaatcattttcgattttcatgcacatcctctctctgcggcccggcttctttttcggagacccagcatggcgtat

SEQ ID NO: 10287 - DNA, 140 bp, Artificial Sequence
  Synthetic
atacgccatgctgggtctccgaaaaagaagccgggccgcagagagaggatgtgcatgaaaatcgaaaatgattgtcttttcgaagtcaagcacgaaggtaaggtaacaggttacgcgtgccgtacttgggagtcggccat

SEQ ID NO: 10288 - DNA, 140 bp, Artificial Sequence
  Synthetic
atggccgactcccaagtacggcacgcgtaacctgttaccttaccttcgtgcttgacttcgaaaagacaatcattttcgattttcatgcacatcctctctctgcggcccggcttctttttcggagacccagcatggcgtat

SEQ ID NO: 10289 - DNA, 140 bp, Artificial Sequence
  Synthetic
atacgccatgctgggtctccgaaaaagaagccgggccgcagagagaggatgtgcatgaaaatcgaaaatgattgtgttttcgaagtcaagcacgaaggtaaggtaacaggttacacgtgccgtacttgggagtcggccat

SEQ ID NO: 10290 - DNA, 140 bp, Artificial Sequence
  Synthetic
atggccgactcccaagtacggcacgtgtaacctgttaccttaccttcgtgcttgacttcgaaaacacaatcattttcgattttcatgcacatcctctctctgcggcccggcttctttttcggagacccagcatggcgtat

SEQ ID NO: 10291 - DNA, 140 bp, Artificial Sequence
  Synthetic
atacgccatgctgggtctccgaaaaagaagccgggccgcagagagaggatgtgcatgaaaatcgaaaatgattgtgttttcgaagtcaagcacgaaggtaaggtaacaggttactcgtgccgtacttgggagtcggccat

SEQ ID NO: 10292 - DNA, 140 bp, Artificial Sequence
  Synthetic
atggccgactcccaagtacggcacgagtaacctgttaccttaccttcgtgcttgacttcgaaaacacaatcattttcgattttcatgcacatcctctctctgcggcccggcttctttttcggagacccagcatggcgtat

SEQ ID NO: 10293 - DNA, 140 bp, Artificial Sequence
  Synthetic
atacgccatgctgggtctccgaaaaagaagccgggccgcagagagaggatgtgcatgaaaatcgaaaatgattgtgttttcgaagtcaagcacgaaggtaaggtaacaggttacccgtgccgtacttgggagtcggccat

SEQ ID NO: 10294 - DNA, 140 bp, Artificial Sequence
  Synthetic
atggccgactcccaagtacggcacgggtaacctgttaccttaccttcgtgcttgacttcgaaaacacaatcattttcgattttcatgcacatcctctctctgcggcccggcttctttttcggagacccagcatggcgtat

SEQ ID NO: 10295 - DNA, 140 bp, Artificial Sequence
  Synthetic
atacgccatgctgggtctccgaaaaagaagccgggccgcagagagaggatgtgcatgaaaatcgaaaatgattgtgttttcgaagtcaagcacgaaggtaaggtaacaggttacgcgtgccgtacttgggagtcggccat

SEQ ID NO: 10296 - DNA, 140 bp, Artificial Sequence
  Synthetic
atggccgactcccaagtacggcacgcgtaacctgttaccttaccttcgtgcttgacttcgaaaacacaatcattttcgattttcatgcacatcctctctctgcggcccggcttctttttcggagacccagcatggcgtat

SEQ ID NO: 10297 - DNA, 140 bp, Artificial Sequence
  Synthetic
aggccctggctgctgatatgattgtattttcgaagtcaagcacgaaggtaaggtaacaggttacacgtgcctggtggggaacaaagtaatgaaaccagcacacgtaaaggggaccatcgagaccttttgggacagcggtg

SEQ ID NO: 10298 - DNA, 140 bp, Artificial Sequence
  Synthetic
caccgctgtcccaaaaggtctcgatggtcccctttacgtgtgctggtttcattactttgttccccaccaggcacgtgtaacctgttaccttaccttcgtgcttgacttcgaaaatacaatcatatcagcagccagggcct

SEQ ID NO: 10299 - DNA, 140 bp, Artificial Sequence
  Synthetic
aggccctggctgctgatatgattgtattttcgaagtcaagcacgaaggtaaggtaacaggttactcgtgcctggtggggaacaaagtaatgaaaccagcacacgtaaaggggaccatcgagaccttttgggacagcggtg

SEQ ID NO: 10300 - DNA, 140 bp, Artificial Sequence
  Synthetic
caccgctgtcccaaaaggtctcgatggtcccctttacgtgtgctggtttcattactttgttccccaccaggcacgagtaacctgttaccttaccttcgtgcttgacttcgaaaatacaatcatatcagcagccagggcct

SEQ ID NO: 10301 - DNA, 140 bp, Artificial Sequence
  Synthetic
aggccctggctgctgatatgattgtattttcgaagtcaagcacgaaggtaaggtaacaggttacccgtgcctggtggggaacaaagtaatgaaaccagcacacgtaaaggggaccatcgagaccttttgggacagcggtg

SEQ ID NO: 10302 - DNA, 140 bp, Artificial Sequence
  Synthetic
caccgctgtcccaaaaggtctcgatggtcccctttacgtgtgctggtttcattactttgttccccaccaggcacgggtaacctgttaccttaccttcgtgcttgacttcgaaaatacaatcatatcagcagccagggcct

SEQ ID NO: 10303 - DNA, 140 bp, Artificial Sequence
  Synthetic
aggccctggctgctgatatgattgtattttcgaagtcaagcacgaaggtaaggtaacaggttacgcgtgcctggtggggaacaaagtaatgaaaccagcacacgtaaaggggaccatcgagaccttttgggacagcggtg

SEQ ID NO: 10304 - DNA, 140 bp, Artificial Sequence
  Synthetic
caccgctgtcccaaaaggtctcgatggtcccctttacgtgtgctggtttcattactttgttccccaccaggcacgcgtaacctgttaccttaccttcgtgcttgacttcgaaaatacaatcatatcagcagccagggcct

SEQ ID NO: 10305 - DNA, 140 bp, Artificial Sequence
  Synthetic
aggccctggctgctgatatgattgttttttcgaagtcaagcacgaaggtaaggtaacaggttacacgtgcctggtggggaacaaagtaatgaaaccagcacacgtaaaggggaccatcgagaccttttgggacagcggtg

SEQ ID NO: 10306 - DNA, 140 bp, Artificial Sequence
  Synthetic
caccgctgtcccaaaaggtctcgatggtcccctttacgtgtgctggtttcattactttgttccccaccaggcacgtgtaacctgttaccttaccttcgtgcttgacttcgaaaaaacaatcatatcagcagccagggcct

SEQ ID NO: 10307 - DNA, 140 bp, Artificial Sequence
  Synthetic
aggccctggctgctgatatgattgttttttcgaagtcaagcacgaaggtaaggtaacaggttactcgtgcctggtggggaacaaagtaatgaaaccagcacacgtaaaggggaccatcgagaccttttgggacagcggtg

SEQ ID NO: 10308 - DNA, 140 bp, Artificial Sequence
  Synthetic
caccgctgtcccaaaaggtctcgatggtcccctttacgtgtgctggtttcattactttgttccccaccaggcacgagtaacctgttaccttaccttcgtgcttgacttcgaaaaaacaatcatatcagcagccagggcct

SEQ ID NO: 10309 - DNA, 140 bp, Artificial Sequence
  Synthetic
aggccctggctgctgatatgattgttttttcgaagtcaagcacgaaggtaaggtaacaggttacccgtgcctggtggggaacaaagtaatgaaaccagcacacgtaaaggggaccatcgagaccttttgggacagcggtg

SEQ ID NO: 10310 - DNA, 140 bp, Artificial Sequence
  Synthetic
caccgctgtcccaaaaggtctcgatggtcccctttacgtgtgctggtttcattactttgttccccaccaggcacgggtaacctgttaccttaccttcgtgcttgacttcgaaaaaacaatcatatcagcagccagggcct

SEQ ID NO: 10311 - DNA, 140 bp, Artificial Sequence
  Synthetic
aggccctggctgctgatatgattgttttttcgaagtcaagcacgaaggtaaggtaacaggttacgcgtgcctggtggggaacaaagtaatgaaaccagcacacgtaaaggggaccatcgagaccttttgggacagcggtg

SEQ ID NO: 10312 - DNA, 140 bp, Artificial Sequence
  Synthetic
caccgctgtcccaaaaggtctcgatggtcccctttacgtgtgctggtttcattactttgttccccaccaggcacgcgtaacctgttaccttaccttcgtgcttgacttcgaaaaaacaatcatatcagcagccagggcct

SEQ ID NO: 10313 - DNA, 140 bp, Artificial Sequence
  Synthetic
aggccctggctgctgatatgattgtcttttcgaagtcaagcacgaaggtaaggtaacaggttacacgtgcctggtggggaacaaagtaatgaaaccagcacacgtaaaggggaccatcgagaccttttgggacagcggtg

SEQ ID NO: 10314 - DNA, 140 bp, Artificial Sequence
  Synthetic
caccgctgtcccaaaaggtctcgatggtcccctttacgtgtgctggtttcattactttgttccccaccaggcacgtgtaacctgttaccttaccttcgtgcttgacttcgaaaagacaatcatatcagcagccagggcct

SEQ ID NO: 10315 - DNA, 140 bp, Artificial Sequence
  Synthetic
aggccctggctgctgatatgattgtcttttcgaagtcaagcacgaaggtaaggtaacaggttactcgtgcctggtggggaacaaagtaatgaaaccagcacacgtaaaggggaccatcgagaccttttgggacagcggtg

SEQ ID NO: 10316 - DNA, 140 bp, Artificial Sequence
  Synthetic
caccgctgtcccaaaaggtctcgatggtcccctttacgtgtgctggtttcattactttgttccccaccaggcacgagtaacctgttaccttaccttcgtgcttgacttcgaaaagacaatcatatcagcagccagggcct

SEQ ID NO: 10317 - DNA, 140 bp, Artificial Sequence
  Synthetic
aggccctggctgctgatatgattgtcttttcgaagtcaagcacgaaggtaaggtaacaggttacccgtgcctggtggggaacaaagtaatgaaaccagcacacgtaaaggggaccatcgagaccttttgggacagcggtg

SEQ ID NO: 10318 - DNA, 140 bp, Artificial Sequence
  Synthetic
caccgctgtcccaaaaggtctcgatggtcccctttacgtgtgctggtttcattactttgttccccaccaggcacgggtaacctgttaccttaccttcgtgcttgacttcgaaaagacaatcatatcagcagccagggcct

SEQ ID NO: 10319 - DNA, 140 bp, Artificial Sequence
  Synthetic
aggccctggctgctgatatgattgtcttttcgaagtcaagcacgaaggtaaggtaacaggttacgcgtgcctggtggggaacaaagtaatgaaaccagcacacgtaaaggggaccatcgagaccttttgggacagcggtg

SEQ ID NO: 10320 - DNA, 140 bp, Artificial Sequence
  Synthetic
caccgctgtcccaaaaggtctcgatggtcccctttacgtgtgctggtttcattactttgttccccaccaggcacgcgtaacctgttaccttaccttcgtgcttgacttcgaaaagacaatcatatcagcagccagggcct

SEQ ID NO: 10321 - DNA, 140 bp, Artificial Sequence
  Synthetic
aggccctggctgctgatatgattgtgttttcgaagtcaagcacgaaggtaaggtaacaggttacacgtgcctggtggggaacaaagtaatgaaaccagcacacgtaaaggggaccatcgagaccttttgggacagcggtg

SEQ ID NO: 10322 - DNA, 140 bp, Artificial Sequence
  Synthetic
caccgctgtcccaaaaggtctcgatggtcccctttacgtgtgctggtttcattactttgttccccaccaggcacgtgtaacctgttaccttaccttcgtgcttgacttcgaaaacacaatcatatcagcagccagggcct

SEQ ID NO: 10323 - DNA, 140 bp, Artificial Sequence
  Synthetic
aggccctggctgctgatatgattgtgttttcgaagtcaagcacgaaggtaaggtaacaggttactcgtgcctggtggggaacaaagtaatgaaaccagcacacgtaaaggggaccatcgagaccttttgggacagcggtg

SEQ ID NO: 10324 - DNA, 140 bp, Artificial Sequence
  Synthetic
caccgctgtcccaaaaggtctcgatggtcccctttacgtgtgctggtttcattactttgttccccaccaggcacgagtaacctgttaccttaccttcgtgcttgacttcgaaaacacaatcatatcagcagccagggcct

SEQ ID NO: 10325 - DNA, 140 bp, Artificial Sequence
  Synthetic
aggccctggctgctgatatgattgtgttttcgaagtcaagcacgaaggtaaggtaacaggttacccgtgcctggtggggaacaaagtaatgaaaccagcacacgtaaaggggaccatcgagaccttttgggacagcggtg

SEQ ID NO: 10326 - DNA, 140 bp, Artificial Sequence
  Synthetic
caccgctgtcccaaaaggtctcgatggtcccctttacgtgtgctggtttcattactttgttccccaccaggcacgggtaacctgttaccttaccttcgtgcttgacttcgaaaacacaatcatatcagcagccagggcct

SEQ ID NO: 10327 - DNA, 140 bp, Artificial Sequence
  Synthetic
aggccctggctgctgatatgattgtgttttcgaagtcaagcacgaaggtaaggtaacaggttacgcgtgcctggtggggaacaaagtaatgaaaccagcacacgtaaaggggaccatcgagaccttttgggacagcggtg

SEQ ID NO: 10328 - DNA, 140 bp, Artificial Sequence
  Synthetic
caccgctgtcccaaaaggtctcgatggtcccctttacgtgtgctggtttcattactttgttccccaccaggcacgcgtaacctgttaccttaccttcgtgcttgacttcgaaaacacaatcatatcagcagccagggcct

SEQ ID NO: 10329 - DNA, 140 bp, Artificial Sequence
  Synthetic
atacgccatgctgggtctcctaatggcgggcatctgcagtcaccaagtgacctttgacacgttccaaaacaaagccaacgtttgctgggctaagagcttggtccctatcctcgaaacagccgtacttgggagtcggccat

SEQ ID NO: 10330 - DNA, 140 bp, Artificial Sequence
  Synthetic
atggccgactcccaagtacggctgtttcgaggatagggaccaagctcttagcccagcaaacgttggctttgttttggaacgtgtcaaaggtcacttggtgactgcagatgcccgccattaggagacccagcatggcgtat

SEQ ID NO: 10331 - DNA, 140 bp, Artificial Sequence
  Synthetic
aggccctggctgctgatatgaaagccaacgtttgctgggctaagagcttggtccctatcctcgaaacagcggggataaaactaaatgataggcagtggtcccagataattcaagctttcagaccttttgggacagcggtg

SEQ ID NO: 10332 - DNA, 140 bp, Artificial Sequence
  Synthetic
caccgctgtcccaaaaggtctgaaagcttgaattatctgggaccactgcctatcatttagttttatccccgctgtttcgaggatagggaccaagctcttagcccagcaaacgttggctttcatatcagcagccagggcct

SEQ ID NO: 10333 - DNA, 140 bp, Artificial Sequence
  Synthetic
atacgccatgctgggtctcccatcagcaccgtgtacgattactgggacaatgggacacttcatcctggcccgatgtccaaaaggggaaactctgacggtgggattcactgacagtaggaacgtacttgggagtcggccat

SEQ ID NO: 10334 - DNA, 140 bp, Artificial Sequence
  Synthetic
atggccgactcccaagtacgttcctactgtcagtgaatcccaccgtcagagtttccccttttggacatcgggccaggatgaagtgtcccattgtcccagtaatcgtacacggtgctgatgggagacccagcatggcgtat

SEQ ID NO: 10335 - DNA, 140 bp, Artificial Sequence
  Synthetic
aggccctggctgctgatatgaaagcagccgaactcactttgagaagtaggcatagcataccgaactcttccacgattctccgaacccacagggacgtaggagatgttattttgtttttaagaccttttgggacagcggtg

SEQ ID NO: 10336 - DNA, 140 bp, Artificial Sequence
  Synthetic
caccgctgtcccaaaaggtcttaaaaacaaaataacatctcctacgtccctgtgggttcggagaatcgtggaagagttcggtatgctatgcctacttctcaaagtgagttcggctgctttcatatcagcagccagggcct

SEQ ID NO: 10337 - DNA, 140 bp, Artificial Sequence
  Synthetic
atacgccatgctgggtctcctttgcccgatgcacagcgcagaagatcccgagagactcgctaattatgcgagaaagctcgcatctgccgcaggaaaagtcctggacagaaacatttcaggcgtacttgggagtcggccat

SEQ ID NO: 10338 - DNA, 140 bp, Artificial Sequence
  Synthetic
atggccgactcccaagtacgcctgaaatgtttctgtccaggacttttcctgcggcagatgcgagctttctcgcataattagcgagtctctcgggatcttctgcgctgtgcatcgggcaaaggagacccagcatggcgtat

SEQ ID NO: 10339 - DNA, 140 bp, Artificial Sequence
  Synthetic
atacgccatgctgggtctcctttgcccgatgctcagcgcagaagatcccgagagactcgctaattatgcgagaaagctcgcatctgccgcaggaaaagtcctggacagaaacatttcaggcgtacttgggagtcggccat

SEQ ID NO: 10340 - DNA, 140 bp, Artificial Sequence
  Synthetic
atggccgactcccaagtacgcctgaaatgtttctgtccaggacttttcctgcggcagatgcgagctttctcgcataattagcgagtctctcgggatcttctgcgctgagcatcgggcaaaggagacccagcatggcgtat

SEQ ID NO: 10341 - DNA, 140 bp, Artificial Sequence
  Synthetic
atacgccatgctgggtctcctttgcccgatgcccagcgcagaagatcccgagagactcgctaattatgcgagaaagctcgcatctgccgcaggaaaagtcctggacagaaacatttcaggcgtacttgggagtcggccat

SEQ ID NO: 10342 - DNA, 140 bp, Artificial Sequence
  Synthetic
atggccgactcccaagtacgcctgaaatgtttctgtccaggacttttcctgcggcagatgcgagctttctcgcataattagcgagtctctcgggatcttctgcgctgggcatcgggcaaaggagacccagcatggcgtat

SEQ ID NO: 10343 - DNA, 140 bp, Artificial Sequence
  Synthetic
atacgccatgctgggtctcctttgcccgatgcgcagcgcagaagatcccgagagactcgctaattatgcgagaaagctcgcatctgccgcaggaaaagtcctggacagaaacatttcaggcgtacttgggagtcggccat

SEQ ID NO: 10344 - DNA, 140 bp, Artificial Sequence
  Synthetic
atggccgactcccaagtacgcctgaaatgtttctgtccaggacttttcctgcggcagatgcgagctttctcgcataattagcgagtctctcgggatcttctgcgctgcgcatcgggcaaaggagacccagcatggcgtat

SEQ ID NO: 10345 - DNA, 140 bp, Artificial Sequence
  Synthetic
atacgccatgctgggtctcctgccggaaggacatggaagatgagaagcttctgggggtcagagaaagaacactaacctgctgctgtctgtgggcatttaagaagcagaaaaaacacacggcgtacttgggagtcggccat

SEQ ID NO: 10346 - DNA, 140 bp, Artificial Sequence
  Synthetic
atggccgactcccaagtacgccgtgtgttttttctgcttcttaaatgcccacagacagcagcaggttagtgttctttctctgacccccagaagcttctcatcttccatgtccttccggcaggagacccagcatggcgtat

SEQ ID NO: 10347 - DNA, 140 bp, Artificial Sequence
  Synthetic
atacgccatgctgggtctcctgccggaaggacatggaagatgagaagcttctgggggtcagagaaagaacactaacctgctgctgtctgtgggcatttaagaagcagaaaatacacacggcgtacttgggagtcggccat

SEQ ID NO: 10348 - DNA, 140 bp, Artificial Sequence
  Synthetic
atggccgactcccaagtacgccgtgtgtattttctgcttcttaaatgcccacagacagcagcaggttagtgttctttctctgacccccagaagcttctcatcttccatgtccttccggcaggagacccagcatggcgtat

SEQ ID NO: 10349 - DNA, 140 bp, Artificial Sequence
  Synthetic
atacgccatgctgggtctcctgccggaaggacatggaagatgagaagcttctgggggtcagagaaagaacactaacctgctgctgtctgtgggcatttaagaagcagaaaacacacacggcgtacttgggagtcggccat

SEQ ID NO: 10350 - DNA, 140 bp, Artificial Sequence
  Synthetic
atggccgactcccaagtacgccgtgtgtgttttctgcttcttaaatgcccacagacagcagcaggttagtgttctttctctgacccccagaagcttctcatcttccatgtccttccggcaggagacccagcatggcgtat

SEQ ID NO: 10351 - DNA, 140 bp, Artificial Sequence
  Synthetic
atacgccatgctgggtctcctgccggaaggacatggaagatgagaagcttctgggggtcagagaaagaacactaacctgctgctgtctgtgggcatttaagaagcagaaaagacacacggcgtacttgggagtcggccat

SEQ ID NO: 10352 - DNA, 140 bp, Artificial Sequence
  Synthetic
atggccgactcccaagtacgccgtgtgtcttttctgcttcttaaatgcccacagacagcagcaggttagtgttctttctctgacccccagaagcttctcatcttccatgtccttccggcaggagacccagcatggcgtat

SEQ ID NO: 10353 - DNA, 140 bp, Artificial Sequence
  Synthetic
aggccctggctgctgatatggcagaccgtactacgcagccagaagctcagcctgatccacgctttagcggagcaagtgaagacgtgtacgcatagcggtcgagcagggaggtatgcggtcgaccttttgggacagcggtg

SEQ ID NO: 10354 - DNA, 140 bp, Artificial Sequence
  Synthetic
caccgctgtcccaaaaggtcgaccgcatacctccctgctcgaccgctatgcgtacacgtcttcacttgctccgctaaagcgtggatcaggctgagcttctggctgcgtagtacggtctgccatatcagcagccagggcct

SEQ ID NO: 10355 - DNA, 140 bp, Artificial Sequence
  Synthetic
atacgccatgctgggtctccatggaatggctggttaacaagataaacggacatcatgtgctcctggttagcggctataaccttgcactacctactaagagagtcacctgggtagcgccaccgtacttgggagtcggccat

SEQ ID NO: 10356 - DNA, 140 bp, Artificial Sequence
  Synthetic
atggccgactcccaagtacggtggcgctacccaggtgactctcttagtaggtagtgcaaggttatagccgctaaccaggagcacatgatgtccgtttatcttgttaaccagccattccatggagacccagcatggcgtat

SEQ ID NO: 10357 - DNA, 140 bp, Artificial Sequence
  Synthetic
aggccctggctgctgatatggactatacatacaacctagagctgggtctaccggcaacacttggtaggtatgacctagtggtcataaacatctacacaccttttcgcatacaccattatcgaccttttgggacagcggtg

SEQ ID NO: 10358 - DNA, 140 bp, Artificial Sequence
  Synthetic
caccgctgtcccaaaaggtcgataatggtgtatgcgaaaaggtgtgtagatgtttatgaccactaggtcatacctaccaagtgttgccggtagacccagctctaggttgtatgtatagtccatatcagcagccagggcct

SEQ ID NO: 10359 - DNA, 140 bp, Artificial Sequence
  Synthetic
atacgccatgctgggtctcctaggtgtccgcggagcggactatacatacaacctagagctgggtctaccggcaacacttggtaggtatgacctagtggtcataaacatccacacacctttcgtacttgggagtcggccat

SEQ ID NO: 10360 - DNA, 140 bp, Artificial Sequence
  Synthetic
atggccgactcccaagtacgaaaggtgtgtggatgtttatgaccactaggtcatacctaccaagtgttgccggtagacccagctctaggttgtatgtatagtccgctccgcggacacctaggagacccagcatggcgtat

SEQ ID NO: 10361 - DNA, 140 bp, Artificial Sequence
  Synthetic
atacgccatgctgggtctcccaggatgtgcaccatcgtaccgggtaaaacgcatggacatcgcgaagaacgatgaagagtgcgtggtcaacgccgccaaccctcgcgggttaccgggcgacgtacttgggagtcggccat

SEQ ID NO: 10362 - DNA, 140 bp, Artificial Sequence
  Synthetic
atggccgactcccaagtacgtcgcccggtaacccgcgagggttggcggcgttgaccacgcactcttcatcgttcttcgcgatgtccatgcgttttacccggtacgatggtgcacatcctgggagacccagcatggcgtat

SEQ ID NO: 10363 - DNA, 140 bp, Artificial Sequence
  Synthetic
atacgccatgctgggtctccactccaggagagtgcgtccacggccaatagaagcaggtatcaatcacgcaaggtggaaaatatgaaagcaacaatcatccaaagactgaagagaggctgtcgtacttgggagtcggccat

SEQ ID NO: 10364 - DNA, 140 bp, Artificial Sequence
  Synthetic
atggccgactcccaagtacgacagcctctcttcagtctttggatgattgttgctttcatattttccaccttgcgtgattgatacctgcttctattggccgtggacgcactctcctggagtggagacccagcatggcgtat

SEQ ID NO: 10365 - DNA, 140 bp, Artificial Sequence
  Synthetic
aggccctggctgctgatatgatcagagcatacggttacgcagatagaaccagtgaacgagtaatctgcgtactgggacgtaagtttagatcgtccagagcattgaaaccaccatgtatcagaccttttgggacagcggtg

SEQ ID NO: 10366 - DNA, 140 bp, Artificial Sequence
  Synthetic
caccgctgtcccaaaaggtctgatacatggtggtttcaatgctctggacgatctaaacttacgtcccagtacgcagattactcgttcactggttctatctgcgtaaccgtatgctctgatcatatcagcagccagggcct

SEQ ID NO: 10367 - DNA, 140 bp, Artificial Sequence
  Synthetic
atacgccatgctgggtctccgcatacagaggaaagacctaaggtgcaggttatacaggcggctgaacccttggcaacagcatacctatgtggaattcacagagaattggttaggagattgcgtacttgggagtcggccat

SEQ ID NO: 10368 - DNA, 140 bp, Artificial Sequence
  Synthetic
atggccgactcccaagtacgcaatctcctaaccaattctctgtgaattccacataggtatgctgttgccaagggttcagccgcctgtataacctgcaccttaggtctttcctctgtatgcggagacccagcatggcgtat

SEQ ID NO: 10369 - DNA, 140 bp, Artificial Sequence
  Synthetic
atacgccatgctgggtctcccagatcgcacattgatgtcacaacagtccggcaatgtaaagatcacagtcaatggtcagacggtgcggtacaggtgtaattgcggtgactcaaatgaaggcgtacttgggagtcggccat

SEQ ID NO: 10370 - DNA, 140 bp, Artificial Sequence
  Synthetic
atggccgactcccaagtacgccttcatttgagtcaccgcaattacacctgtaccgcaccgtctgaccattgactgtgatctttacattgccggactgttgtgacatcaatgtgcgatctgggagacccagcatggcgtat

SEQ ID NO: 10371 - DNA, 140 bp, Artificial Sequence
  Synthetic
atacgccatgctgggtctcccgcgggttaccgggtgacggtgtttgcaaggcagtatataaaaaatggccggagtcctttaaaaatagtgcaacaccagtaggaaccgcaaaaacagttacgtacttgggagtcggccat

SEQ ID NO: 10372 - DNA, 140 bp, Artificial Sequence
  Synthetic
atggccgactcccaagtacgtaactgtttttgcggttcctactggtgttgcactatttttaaaggactccggccattttttatatactgccttgcaaacaccgtcacccggtaacccgcgggagacccagcatggcgtat

SEQ ID NO: 10373 - DNA, 140 bp, Artificial Sequence
  Synthetic
aggccctggctgctgatatgtgacgtacggaaaaaaccaagtcatcatgctgctgtatcctgaccatccgacactcctgtcctaccggaatatgggagaagaaccaaactatcaagaagagaccttttgggacagcggtg

SEQ ID NO: 10374 - DNA, 140 bp, Artificial Sequence
  Synthetic
caccgctgtcccaaaaggtctcttcttgatagtttggttcttctcccatattccggtaggacaggagtgtcggatggtcaggatacagcagcatgatgacttggttttttccgtacgtcacatatcagcagccagggcct

SEQ ID NO: 10375 - DNA, 140 bp, Artificial Sequence
  Synthetic
aggccctggctgctgatatgtcgtgctcctgtcgatggtgggtgtggcagtggggatgtgcatgtgtgcacgacgcagatgtattacaccgtacgaactgacaccaagagctaccgtcccgaccttttgggacagcggtg

SEQ ID NO: 10376 - DNA, 140 bp, Artificial Sequence
  Synthetic
caccgctgtcccaaaaggtcgggacggtagctcttggtgtcagttcgtacggtgtaatacatctgcgtcgtgcacacatgcacatccccactgccacacccaccatcgacaggagcacgacatatcagcagccagggcct

SEQ ID NO: 10377 - DNA, 140 bp, Artificial Sequence
  Synthetic
aggccctggctgctgatatgtcgtgctcctgtcgatggtgggtgtggcagtggggatgtgcatgtgtgcacgacgcagatgtattacaccgtacgaactgacaccatgagctaccgtcccgaccttttgggacagcggtg

SEQ ID NO: 10378 - DNA, 140 bp, Artificial Sequence
  Synthetic
caccgctgtcccaaaaggtcgggacggtagctcatggtgtcagttcgtacggtgtaatacatctgcgtcgtgcacacatgcacatccccactgccacacccaccatcgacaggagcacgacatatcagcagccagggcct

SEQ ID NO: 10379 - DNA, 140 bp, Artificial Sequence
  Synthetic
aggccctggctgctgatatgtcgtgctcctgtcgatggtgggtgtggcagtggggatgtgcatgtgtgcacgacgcagatgtattacaccgtacgaactgacaccacgagctaccgtcccgaccttttgggacagcggtg

SEQ ID NO: 10380 - DNA, 140 bp, Artificial Sequence
  Synthetic
caccgctgtcccaaaaggtcgggacggtagctcgtggtgtcagttcgtacggtgtaatacatctgcgtcgtgcacacatgcacatccccactgccacacccaccatcgacaggagcacgacatatcagcagccagggcct

SEQ ID NO: 10381 - DNA, 140 bp, Artificial Sequence
  Synthetic
aggccctggctgctgatatgtcgtgctcctgtcgatggtgggtgtggcagtggggatgtgcatgtgtgcacgacgcagatgtattacaccgtacgaactgacaccaggagctaccgtcccgaccttttgggacagcggtg

SEQ ID NO: 10382 - DNA, 140 bp, Artificial Sequence
  Synthetic
caccgctgtcccaaaaggtcgggacggtagctcctggtgtcagttcgtacggtgtaatacatctgcgtcgtgcacacatgcacatccccactgccacacccaccatcgacaggagcacgacatatcagcagccagggcct

SEQ ID NO: 10383 - DNA, 140 bp, Artificial Sequence
  Synthetic
atacgccatgctgggtctcccacggaaggcgcactgtattcatatctagaagggacacgttttcaccagacggcagtggatgtggcagagatacatactatgtggccaaagcaaatagagcgtacttgggagtcggccat

SEQ ID NO: 10384 - DNA, 140 bp, Artificial Sequence
  Synthetic
atggccgactcccaagtacgctctatttgctttggccacatagtatgtatctctgccacatccactgccgtctggtgaaaacgtgtcccttctagatatgaatacagtgcgccttccgtgggagacccagcatggcgtat

SEQ ID NO: 10385 - DNA, 140 bp, Artificial Sequence
  Synthetic
aggccctggctgctgatatggccctagccagcgccgaattccgcgtacaagtctgttctacacaagtacactgtgcagccgagtgccatccaccgaaagaccatatagttaattatccgggaccttttgggacagcggtg

SEQ ID NO: 10386 - DNA, 140 bp, Artificial Sequence
  Synthetic
caccgctgtcccaaaaggtcccggataattaactatatggtctttcggtggatggcactcggctgcacagtgtacttgtgtagaacagacttgtacgcggaattcggcgctggctagggccatatcagcagccagggcct

SEQ ID NO: 10387 - DNA, 140 bp, Artificial Sequence
  Synthetic
aggccctggctgctgatatggctaagaatcaatagataagtatagatcaaagggctgaacaacccctgaatagtaacaaaatataaaaatcaacaaaaattataaaatagaaaactagaagaccttttgggacagcggtg

SEQ ID NO: 10388 - DNA, 140 bp, Artificial Sequence
  Synthetic
caccgctgtcccaaaaggtcttctagttttctattttataatttttgttgatttttatattttgttactattcaggggttgttcagccctttgatctatacttatctattgattcttagccatatcagcagccagggcct

SEQ ID NO: 10389 - DNA, 140 bp, Artificial Sequence
  Synthetic
atacgccatgctgggtctcctcttcccaggagtctgtacgggaagtgagtatgacaacgtcattgacgcatagtcagtttgatctaagcgccgatggcgagacactgcccgtcccgtcagcgtacttgggagtcggccat

SEQ ID NO: 10390 - DNA, 140 bp, Artificial Sequence
  Synthetic
atggccgactcccaagtacgctgacgggacgggcagtgtctcgccatcggcgcttagatcaaactgactatgcgtcaatgacgttgtcatactcacttcccgtacagactcctgggaagaggagacccagcatggcgtat

SEQ ID NO: 10391 - DNA, 140 bp, Artificial Sequence
  Synthetic
aggccctggctgctgatatgtggcaaacggaagagacgtaggtacttaagcttcctaaaagtagccgaactcactttgagacgtaggcatagcataccgaactcttccacaattctccgtgaccttttgggacagcggtg

SEQ ID NO: 10392 - DNA, 140 bp, Artificial Sequence
  Synthetic
caccgctgtcccaaaaggtcacggagaattgtggaagagttcggtatgctatgcctacgtctcaaagtgagttcggctacttttaggaagcttaagtacctacgtctcttccgtttgccacatatcagcagccagggcct

SEQ ID NO: 10393 - DNA, 140 bp, Artificial Sequence
  Synthetic
atacgccatgctgggtctccacctggatgctgacgccccagccctagaaccggccctagacgacggggcgatacatacgaccggaaaccttgcggccgtgtctgactgggtaatgagcaccgtacttgggagtcggccat

SEQ ID NO: 10394 - DNA, 140 bp, Artificial Sequence
  Synthetic
atggccgactcccaagtacggtgctcattacccagtcagacacggccgcaaggtttccggtcgtatgtatcgccccgtcgtctagggccggttctagggctggggcgtcagcatccaggtggagacccagcatggcgtat

SEQ ID NO: 10395 - DNA, 140 bp, Artificial Sequence
  Synthetic
aggccctggctgctgatatgatacatacgaccggaaaccttgcggccgtgtctgactgggtaatgagcaccgtacccgtcgcgccgcctagaagaaggagagggagaaacctgaccgtgagaccttttgggacagcggtg

SEQ ID NO: 10396 - DNA, 140 bp, Artificial Sequence
  Synthetic
caccgctgtcccaaaaggtctcacggtcaggtttctccctctccttcttctaggcggcgcgacgggtacggtgctcattacccagtcagacacggccgcaaggtttccggtcgtatgtatcatatcagcagccagggcct

SEQ ID NO: 10397 - DNA, 140 bp, Artificial Sequence
  Synthetic
atacgccatgctgggtctcccacagctatttcctttcgggcaccgccaagtatcaccgtggaactgagccatccaccgatctccttcggagcaccaagcgagacgttccccatcacatttcgtacttgggagtcggccat

SEQ ID NO: 10398 - DNA, 140 bp, Artificial Sequence
  Synthetic
atggccgactcccaagtacgaaatgtgatggggaacgtctcgcttggtgctccgaaggagatcggtggatggctcagttccacggtgatacttggcggtgcccgaaaggaaatagctgtgggagacccagcatggcgtat

SEQ ID NO: 10399 - DNA, 140 bp, Artificial Sequence
  Synthetic
aggccctggctgctgatatgatccaccgatctccttcggagcaccaagcgagacgttccccatcacatttggggacttcaacgatggagaaatcgaaagcttgtcttctgagctactaacgaccttttgggacagcggtg

SEQ ID NO: 10400 - DNA, 140 bp, Artificial Sequence
  Synthetic
caccgctgtcccaaaaggtcgttagtagctcagaagacaagctttcgatttctccatcgttgaagtccccaaatgtgatggggaacgtctcgcttggtgctccgaaggagatcggtggatcatatcagcagccagggcct

SEQ ID NO: 10401 - DNA, 140 bp, Artificial Sequence
  Synthetic
atacgccatgctgggtctccactatacttaatgtcagagaccccaaaagtccctacttaccggactacatatccggcgcctgtgtactcgcctccgattaacgtccgattgtccaatccccgtacttgggagtcggccat

SEQ ID NO: 10402 - DNA, 140 bp, Artificial Sequence
  Synthetic
atggccgactcccaagtacggggattggacaatcggacgttaatcggaggcgagtacacaggcgccggatatgtagtccggtaagtagggacttttggggtctctgacattaagtatagtggagacccagcatggcgtat

SEQ ID NO: 10403 - DNA, 140 bp, Artificial Sequence
  Synthetic
atacgccatgctgggtctccccgccgcaactaccgaggagatagaggtacacatgcccccagacacccctgatcgcacactaatgtcacaacagtccggcaacgtaaagatcacggtcaacgtacttgggagtcggccat

SEQ ID NO: 10404 - DNA, 140 bp, Artificial Sequence
  Synthetic
atggccgactcccaagtacgttgaccgtgatctttacgttgccggactgttgtgacattagtgtgcgatcaggggtgtctgggggcatgtgtacctctatctcctcggtagttgcggcggggagacccagcatggcgtat

SEQ ID NO: 10405 - DNA, 140 bp, Artificial Sequence
  Synthetic
atacgccatgctgggtctccagaagtgttacccacctaagctggatgaattaaaggagcaactactacttaagaaactccaggagagtgcgtccacggccaatagaagcaggtatcaatccgtacttgggagtcggccat

SEQ ID NO: 10406 - DNA, 140 bp, Artificial Sequence
  Synthetic
atggccgactcccaagtacggattgatacctgcttctattggccgtggacgcactctcctggagtttcttaagtagtagttgctcctttaattcatccagcttaggtgggtaacacttctggagacccagcatggcgtat

SEQ ID NO: 10407 - DNA, 140 bp, Artificial Sequence
  Synthetic
aggccctggctgctgatatgacagctgtaaggtcttcaccggcgtctacccatttatgtggggcggcgcttactgcttctgcgacgctgaaaacacgcagttgagcgaagcacatgtggagaccttttgggacagcggtg

SEQ ID NO: 10408 - DNA, 140 bp, Artificial Sequence
  Synthetic
caccgctgtcccaaaaggtctccacatgtgcttcgctcaactgcgtgttttcagcgtcgcagaagcagtaagcgccgccccacataaatgggtagacgccggtgaagaccttacagctgtcatatcagcagccagggcct

SEQ ID NO: 10409 - DNA, 140 bp, Artificial Sequence
  Synthetic
aggccctggctgctgatatgaagaaactccaggagagtgcgtccacggccaatagaagcaggtatcaatcacgcaaagtggaaaatatgaaagcaacaatcatccagagactaaagagaggaccttttgggacagcggtg

SEQ ID NO: 10410 - DNA, 140 bp, Artificial Sequence
  Synthetic
caccgctgtcccaaaaggtcctctctttagtctctggatgattgttgctttcatattttccactttgcgtgattgatacctgcttctattggccgtggacgcactctcctggagtttcttcatatcagcagccagggcct

SEQ ID NO: 10411 - DNA, 140 bp, Artificial Sequence
  Synthetic
atacgccatgctgggtctccgtgcagctgagtgccaccccccgaaggaccacatagttaactacccggcgtcacataccaccctcggggtccaggacatctccgctacggcgatgtcatgcgtacttgggagtcggccat

SEQ ID NO: 10412 - DNA, 140 bp, Artificial Sequence
  Synthetic
atggccgactcccaagtacgcatgacatcgccgtagcggagatgtcctggaccccgagggtggtatgtgacgccgggtagttaactatgtggtccttcggggggtggcactcagctgcacggagacccagcatggcgtat

SEQ ID NO: 10413 - DNA, 140 bp, Artificial Sequence
  Synthetic
atacgccatgctgggtctccgggctgaataacccctgaataataacaaaatataaaaatcaataaaaatcataaaatagaaaaccataaacagaagtagttcaaagggctatgaaacccccgtacttgggagtcggccat

SEQ ID NO: 10414 - DNA, 140 bp, Artificial Sequence
  Synthetic
atggccgactcccaagtacgggggtttcatagccctttgaactacttctgtttatggttttctattttatgatttttattgatttttatattttgttattattcaggggttattcagcccggagacccagcatggcgtat

SEQ ID NO: 10415 - DNA, 140 bp, Artificial Sequence
  Synthetic
atacgccatgctgggtctccggacagaaacatttctggaaagatcggggacttacaagaggtgatggccgtgccagacacggagacaccaacattttgcttacacacagatgtctcatgtcgtacttgggagtcggccat

SEQ ID NO: 10416 - DNA, 140 bp, Artificial Sequence
  Synthetic
atggccgactcccaagtacgacatgagacatctgtgtgtaagcaaaatgttggtgtctccgtgtctggcacggccatcacctcttgtaagtccccgatctttccagaaatgtttctgtccggagacccagcatggcgtat

SEQ ID NO: 10417 - DNA, 140 bp, Artificial Sequence
  Synthetic
aggccctggctgctgatatggacatggtggacgggtcggagagttgcttggaccgagcgacattcaatccgtcaaaacttaggagctacccgaaacaacatgcttatcacgcgccctctagaccttttgggacagcggtg

SEQ ID NO: 10418 - DNA, 140 bp, Artificial Sequence
  Synthetic
caccgctgtcccaaaaggtctagagggcgcgtgataagcatgttgtttcgggtagctcctaagttttgacggattgaatgtcgctcggtccaagcaactctccgacccgtccaccatgtccatatcagcagccagggcct

SEQ ID NO: 10419 - DNA, 140 bp, Artificial Sequence
  Synthetic
aggccctggctgctgatatgtggggacttcaacgatggagaaatcgaaagcttgtcttctgagctactaactttcggagacttcctacccggtgaagtggatgatttgacagataacgacgaccttttgggacagcggtg

SEQ ID NO: 10420 - DNA, 140 bp, Artificial Sequence
  Synthetic
caccgctgtcccaaaaggtcgtcgttatctgtcaaatcatccacttcaccgggtaggaagtctccgaaagttagtagctcagaagacaagctttcgatttctccatcgttgaagtccccacatatcagcagccagggcct

SEQ ID NO: 10421 - DNA, 140 bp, Artificial Sequence
  Synthetic
aggccctggctgctgatatgtgccgacaggtacgcgcttcaagttcggcgctatgatgaaatccggtatgttcctaactctgttcgtcaacacattgttaaatattaccatcgctagccggaccttttgggacagcggtg

SEQ ID NO: 10422 - DNA, 140 bp, Artificial Sequence
  Synthetic
caccgctgtcccaaaaggtccggctagcgatggtaatatttaacaatgtgttgacgaacagagttaggaacataccggatttcatcatagcgccgaacttgaagcgcgtacctgtcggcacatatcagcagccagggcct

SEQ ID NO: 10423 - DNA, 140 bp, Artificial Sequence
  Synthetic
atacgccatgctgggtctccactgagaatctaacaacctatgtcactaaattaaaggggccaaaagcagcagcgttgcttgcaagaacccatgatctgctgccgctgcaggatgtaccaacgtacttgggagtcggccat

SEQ ID NO: 10424 - DNA, 140 bp, Artificial Sequence
  Synthetic
atggccgactcccaagtacgttggtacatcctgcagcggcagcagatcatgggttcttgcaagcaacgctgctgcttttggcccctttaatttagtgacataggttgttagattctcagtggagacccagcatggcgtat

SEQ ID NO: 10425 - DNA, 140 bp, Artificial Sequence
  Synthetic
aggccctggctgctgatatgtgaaggattaaccactacagataaagtgattaataactgcaaggtcgatcaatgccatgccgcggtcaccaatcacaaaaaatggcagtataactcccctgaccttttgggacagcggtg

SEQ ID NO: 10426 - DNA, 140 bp, Artificial Sequence
  Synthetic
caccgctgtcccaaaaggtcaggggagttatactgccattttttgtgattggtgaccgcggcatggcattgatcgaccttgcagttattaatcactttatctgtagtggttaatccttcacatatcagcagccagggcct

SEQ ID NO: 10427 - DNA, 140 bp, Artificial Sequence
  Synthetic
aggccctggctgctgatatgctgtctgagactcttaccatgctgttgtaaaatgttgacttttttagccgtactgagcgtcggtgtccacactgtgagcgcgtacgaacacgtaacagtggaccttttgggacagcggtg

SEQ ID NO: 10428 - DNA, 140 bp, Artificial Sequence
  Synthetic
caccgctgtcccaaaaggtccactgttacgtgttcgtacgcgctcacagtgtggacaccgacgctcagtacggctaaaaaagtcaacattttacaacagcatggtaagagtctcagacagcatatcagcagccagggcct

SEQ ID NO: 10429 - DNA, 140 bp, Artificial Sequence
  Synthetic
aggccctggctgctgatatgacccttggcaacagcgtacctatgtggaattcacagagaattggttaggagattgaacgccgtcctcctacccaacgtgcatacactatttgacatgtctgaccttttgggacagcggtg

SEQ ID NO: 10430 - DNA, 140 bp, Artificial Sequence
  Synthetic
caccgctgtcccaaaaggtcagacatgtcaaatagtgtatgcacgttgggtaggaggacggcgttcaatctcctaaccaattctctgtgaattccacataggtacgctgttgccaagggtcatatcagcagccagggcct

SEQ ID NO: 10431 - DNA, 140 bp, Artificial Sequence
  Synthetic
aggccctggctgctgatatggaaatagaagtaggtaagaaggtatatgtgtcccctaagagacacaccatatatagctaagaatcaatagataagcatagattaaagggctgaacaacccgaccttttgggacagcggtg

SEQ ID NO: 10432 - DNA, 140 bp, Artificial Sequence
  Synthetic
caccgctgtcccaaaaggtcgggttgttcagccctttaatctatgcttatctattgattcttagctatatatggtgtgtctcttaggggacacatataccttcttacctacttctatttccatatcagcagccagggcct

SEQ ID NO: 10433 - DNA, 140 bp, Artificial Sequence
  Synthetic
atacgccatgctgggtctccgccgaggacttcgatgccattatagccgcacactttaagccaggagacgccgttttagaaacggacatagcctcctttgataagagccaggatgattcaccgtacttgggagtcggccat

SEQ ID NO: 10434 - DNA, 140 bp, Artificial Sequence
  Synthetic
atggccgactcccaagtacggtgaatcatcctggctcttatcaaaggaggctatgtccgtttctaaaacggcgtctcctggcttaaagtgtgcggctataatggcatcgaagtcctcggcggagacccagcatggcgtat

SEQ ID NO: 10435 - DNA, 140 bp, Artificial Sequence
  Synthetic
atacgccatgctgggtctccctgaataataacaaaatataaaaaccaataaaaatcataaaatagaaaatcaacaaaaaatcataaaatagaaaactagaaatagaagtaggtaagaaggcgtacttgggagtcggccat

SEQ ID NO: 10436 - DNA, 140 bp, Artificial Sequence
  Synthetic
atggccgactcccaagtacgccttcttacctacttctatttctagttttctattttatgattttttgttgattttctattttatgatttttattggtttttatattttgttattattcagggagacccagcatggcgtat

SEQ ID NO: 10437 - DNA, 140 bp, Artificial Sequence
  Synthetic
atacgccatgctgggtctccctgttggacttgatagaggctgcttttggagagatttccagctgtcacctgccgacaggtacgcgcttcaagttcggcgcaatgatgaaatccggcacgtcgtacttgggagtcggccat

SEQ ID NO: 10438 - DNA, 140 bp, Artificial Sequence
  Synthetic
atggccgactcccaagtacgacgtgccggatttcatcattgcgccgaacttgaagcgcgtacctgtcggcaggtgacagctggaaatctctccaaaagcagcctctatcaagtccaacagggagacccagcatggcgtat

SEQ ID NO: 10439 - DNA, 140 bp, Artificial Sequence
  Synthetic
atacgccatgctgggtctccgcgctacttggatgaacatggaagtgaagatcatagatgcagttgtatcccagaaagctccctacttttgtggagggtttatactgcatgatactgtgaccgtacttgggagtcggccat

SEQ ID NO: 10440 - DNA, 140 bp, Artificial Sequence
  Synthetic
atggccgactcccaagtacggtcacagtatcatgcagtataaaccctccacaaaagtagggagctttctgggatacaactgcatctatgatcttcacttccatgttcatccaagtagcgcggagacccagcatggcgtat

SEQ ID NO: 10441 - DNA, 140 bp, Artificial Sequence
  Synthetic
atacgccatgctgggtctccaaagatcggggacttacaagcagtaatggccgtgccagacacggagacgccaacattctgcttacacacagatgtctcatgtagacagagagcagacgtccgtacttgggagtcggccat

SEQ ID NO: 10442 - DNA, 140 bp, Artificial Sequence
  Synthetic
atggccgactcccaagtacggacgtctgctctctgtctacatgagacatctgtgtgtaagcagaatgttggcgtctccgtgtctggcacggccattactgcttgtaagtccccgatctttggagacccagcatggcgtat

SEQ ID NO: 10443 - DNA, 140 bp, Artificial Sequence
  Synthetic
atacgccatgctgggtctccaggaacagcttgcagggtggcggacccgctaaaaaggttatttaaactgggcaaaccgttagcggcaggtgacgaacaagacgaagacagaaggcgggcgcgtacttgggagtcggccat

SEQ ID NO: 10444 - DNA, 140 bp, Artificial Sequence
  Synthetic
atggccgactcccaagtacgcgcccgccttctgtcttcgtcttgttcgtcacctgccgctaacggtttgcccagtttaaataacctttttagcgggtccgccaccctgcaagctgttcctggagacccagcatggcgtat

SEQ ID NO: 10445 - DNA, 140 bp, Artificial Sequence
  Synthetic
atacgccatgctgggtctccggagaaagcggtgtactctaggtacgaagtgcagggtatatcagttgctgtaatgtccatggccacctttgcaagctccagatccaacttcgagaagctccgtacttgggagtcggccat

SEQ ID NO: 10446 - DNA, 140 bp, Artificial Sequence
  Synthetic
atggccgactcccaagtacggagcttctcgaagttggatctggagcttgcaaaggtggccatggacattacagcaactgatataccctgcacttcgtacctagagtacaccgctttctccggagacccagcatggcgtat

SEQ ID NO: 10447 - DNA, 140 bp, Artificial Sequence
  Synthetic
atacgccatgctgggtctccaagacgattcgcttgcgcttactgctttgatgctgttagaggatttaggggtggatcactccctgctggacctgatagaggctgctttcggagagatttccgtacttgggagtcggccat

SEQ ID NO: 10448 - DNA, 140 bp, Artificial Sequence
  Synthetic
atggccgactcccaagtacggaaatctctccgaaagcagcctctatcaggtccagcagggagtgatccacccctaaatcctctaacagcatcaaagcagtaagcgcaagcgaatcgtcttggagacccagcatggcgtat

SEQ ID NO: 10449 - DNA, 140 bp, Artificial Sequence
  Synthetic
atacgccatgctgggtctccgtcttgtcatcccagttatgtgcctgttggcaaacaccacgttcccctgctcccagcccccttgcacgccctgctgctacgaaaaggaaccggaggaaaccgtacttgggagtcggccat

SEQ ID NO: 10450 - DNA, 140 bp, Artificial Sequence
  Synthetic
atggccgactcccaagtacggtttcctccggttccttttcgtagcagcagggcgtgcaagggggctgggagcaggggaacgtggtgtttgccaacaggcacataactgggatgacaagacggagacccagcatggcgtat

SEQ ID NO: 10451 - DNA, 140 bp, Artificial Sequence
  Synthetic
aggccctggctgctgatatgccgattcaccatccctacaggtgcgggcaaaccaggggatagtggtagaccgatcttcgacaacaaggggcgcgtggtggccatagttttaggaggagctgaccttttgggacagcggtg

SEQ ID NO: 10452 - DNA, 140 bp, Artificial Sequence
  Synthetic
caccgctgtcccaaaaggtcagctcctcctaaaactatggccaccacgcgccccttgttgtcgaagatcggtctaccactatcccctggtttgcccgcacctgtagggatggtgaatcggcatatcagcagccagggcct

SEQ ID NO: 10453 - DNA, 140 bp, Artificial Sequence
  Synthetic
atacgccatgctgggtctcctgaagacaatgtcatgagccccgggtactatcagctgctgcaagcatccttaacatgttctccccgacgccagcggcgcagtattaaggaccacttcaatcgtacttgggagtcggccat

SEQ ID NO: 10454 - DNA, 140 bp, Artificial Sequence
  Synthetic
atggccgactcccaagtacgattgaagtggtccttaatactgcgccgctggcgtcggggagaacatgttaaggatgcttgcagcagctgatagtacccggggctcatgacattgtcttcaggagacccagcatggcgtat

SEQ ID NO: 10455 - DNA, 140 bp, Artificial Sequence
  Synthetic
aggccctggctgctgatatgcgacagacgggacgttgaaaatccaggtttccttgcaaatcggaataaagacggatgatagccatgattggaccaagctgcgttatatggacaatcacatgaccttttgggacagcggtg

SEQ ID NO: 10456 - DNA, 140 bp, Artificial Sequence
  Synthetic
caccgctgtcccaaaaggtcatgtgattgtccatataacgcagcttggtccaatcatggctatcatccgtctttattccgatttgcaaggaaacctggattttcaacgtcccgtctgtcgcatatcagcagccagggcct

SEQ ID NO: 10457 - DNA, 140 bp, Artificial Sequence
  Synthetic
atacgccatgctgggtctccaaaagctaaaaccgtgcgaccgtgtgctgttctcagtagggtcaacgctctacccggaaagccgcaagctacttacgagctggcacctaccatcggtgttcgtacttgggagtcggccat

SEQ ID NO: 10458 - DNA, 140 bp, Artificial Sequence
  Synthetic
atggccgactcccaagtacgaacaccgatggtaggtgccagctcgtaagtagcttgcggctttccgggtagagcgttgaccctactgagaacagcacacggtcgcacggttttagcttttggagacccagcatggcgtat

SEQ ID NO: 10459 - DNA, 140 bp, Artificial Sequence
  Synthetic
atacgccatgctgggtctcccagagcaccgctgcaactgccgaggagatagaggtacacatgcccccagacaccccagatcgcacattaatgtcacaacagtccggcaatgtaaagatcacgtacttgggagtcggccat

SEQ ID NO: 10460 - DNA, 140 bp, Artificial Sequence
  Synthetic
atggccgactcccaagtacgtgatctttacattgccggactgttgtgacattaatgtgcgatctggggtgtctgggggcatgtgtacctctatctcctcggcagttgcagcggtgctctgggagacccagcatggcgtat

SEQ ID NO: 10461 - DNA, 140 bp, Artificial Sequence
  Synthetic
aggccctggctgctgatatgatgccatgccgcggtcaccaatcacaaaaaatggcagtataattcccctctggtcccgcgtaatgctgaattcggggaccggaaaggaaaagttcacattgaccttttgggacagcggtg

SEQ ID NO: 10462 - DNA, 140 bp, Artificial Sequence
  Synthetic
caccgctgtcccaaaaggtcaatgtgaacttttcctttccggtccccgaattcagcattacgcgggaccagaggggaattatactgccattttttgtgattggtgaccgcggcatggcatcatatcagcagccagggcct

SEQ ID NO: 10463 - DNA, 140 bp, Artificial Sequence
  Synthetic
atacgccatgctgggtctccacccaacgctcctgtcctacaggaatatgggagaagaaccaaactatcaagaagagtgggtgacgcataagaaggagatcaggttaaccgtgccgactgacgtacttgggagtcggccat

SEQ ID NO: 10464 - DNA, 140 bp, Artificial Sequence
  Synthetic
atggccgactcccaagtacgtcagtcggcacggttaacctgatctccttcttatgcgtcacccactcttcttgatagtttggttcttctcccatattcctgtaggacaggagcgttgggtggagacccagcatggcgtat

SEQ ID NO: 10465 - DNA, 140 bp, Artificial Sequence
  Synthetic
aggccctggctgctgatatgtattattatgagctgtacccaactatgactgcggtagttttgtcagtggcctcgttcatactcctgtcgatggtgggtgtggcagtggggatgtgcatgtgaccttttgggacagcggtg

SEQ ID NO: 10466 - DNA, 140 bp, Artificial Sequence
  Synthetic
caccgctgtcccaaaaggtcacatgcacatccccactgccacacccaccatcgacaggagtatgaacgaggccactgacaaaactaccgcagtcatagttgggtacagctcataataatacatatcagcagccagggcct

SEQ ID NO: 10467 - DNA, 140 bp, Artificial Sequence
  Synthetic
atacgccatgctgggtctccggaaaaaccacagggtatgcggtaacccaccacgcagacggattcctgatgtgcaagaccaccgacacggttgacggcgaaagagtgtcattctcggtgtcgtacttgggagtcggccat

SEQ ID NO: 10468 - DNA, 140 bp, Artificial Sequence
  Synthetic
atggccgactcccaagtacgacaccgagaatgacactctttcgccgtcaaccgtgtcggtggtcttgcacatcaggaatccgtctgcgtggtgggttaccgcataccctgtggtttttccggagacccagcatggcgtat

SEQ ID NO: 10469 - DNA, 140 bp, Artificial Sequence
  Synthetic
aggccctggctgctgatatgttgacagctttgtggtaccgagtctgtggtcgtccgggttgtcaatccctttgaggactagaatcaaatggttgttaagcaaggtgccaaaaaccgacctgaccttttgggacagcggtg

SEQ ID NO: 10470 - DNA, 140 bp, Artificial Sequence
  Synthetic
caccgctgtcccaaaaggtcaggtcggtttttggcaccttgcttaacaaccatttgattctagtcctcaaagggattgacaacccggacgaccacagactcggtaccacaaagctgtcaacatatcagcagccagggcct

SEQ ID NO: 10471 - DNA, 140 bp, Artificial Sequence
  Synthetic
aggccctggctgctgatatggctcataccgcatccgcatcagctaagctccgcgtcctttaccaaggaaataatatcactgtggctgcttatgcaaacggcgaccatgccgtcacagttagaccttttgggacagcggtg

SEQ ID NO: 10472 - DNA, 140 bp, Artificial Sequence
  Synthetic
caccgctgtcccaaaaggtctaactgtgacggcatggtcgccgtttgcataagcagccacagtgatattatttccttggtaaaggacgcggagcttagctgatgcggatgcggtatgagccatatcagcagccagggcct

SEQ ID NO: 10473 - DNA, 140 bp, Artificial Sequence
  Synthetic
aggccctggctgctgatatggaaaggcaagtgtgcggtgcattcgatgactaacgccgtcactattcgggaagctgagatagaagttgaagggaattctcagctgcaaatctctttctcggaccttttgggacagcggtg

SEQ ID NO: 10474 - DNA, 140 bp, Artificial Sequence
  Synthetic
caccgctgtcccaaaaggtccgagaaagagatttgcagctgagaattcccttcaacttctatctcagcttcccgaatagtgacggcgttagtcatcgaatgcaccgcacacttgcctttccatatcagcagccagggcct

SEQ ID NO: 10475 - DNA, 140 bp, Artificial Sequence
  Synthetic
atacgccatgctgggtctccaagaaaggcaagtgtgcagtgcactcgatgactaacgccgtcactattcgggaagctgaaatagaagtagaagggaactctcagttgcaaatctctttttcgtacttgggagtcggccat

SEQ ID NO: 10476 - DNA, 140 bp, Artificial Sequence
  Synthetic
atggccgactcccaagtacgaaaaagagatttgcaactgagagttcccttctacttctatttcagcttcccgaatagtgacggcgttagtcatcgagtgcactgcacacttgcctttcttggagacccagcatggcgtat

SEQ ID NO: 10477 - DNA, 140 bp, Artificial Sequence
  Synthetic
atacgccatgctgggtctcctgccggaaagacatggaagatgaaaaactcctgggggtcagagaaagaacactgacctgctgctgtctatgggcatttaagaagcagaaaatacacacggcgtacttgggagtcggccat

SEQ ID NO: 10478 - DNA, 140 bp, Artificial Sequence
  Synthetic
atggccgactcccaagtacgccgtgtgtattttctgcttcttaaatgcccatagacagcagcaggtcagtgttctttctctgacccccaggagtttttcatcttccatgtctttccggcaggagacccagcatggcgtat

SEQ ID NO: 10479 - DNA, 140 bp, Artificial Sequence
  Synthetic
aggccctggctgctgatatgctataatcacaacatctgcacccaagtgtaccacaaaagtatctccaggcggtgtacactgcctgtgaccgccattgtgtcatcgttgcattacgaaggcgaccttttgggacagcggtg

SEQ ID NO: 10480 - DNA, 140 bp, Artificial Sequence
  Synthetic
caccgctgtcccaaaaggtcgccttcgtaatgcaacgatgacacaatggcggtcacaggcagtgtacaccgcctggagatacttttgtggtacacttgggtgcagatgttgtgattatagcatatcagcagccagggcct

SEQ ID NO: 10481 - DNA, 140 bp, Artificial Sequence
  Synthetic
aggccctggctgctgatatgacttgacaactaggtatgaaggcatacgcgtccctaaagagacacaccgcatatagctaggaatcaacagataagtatagatctaagggctgaacaacccgaccttttgggacagcggtg

SEQ ID NO: 10482 - DNA, 140 bp, Artificial Sequence
  Synthetic
caccgctgtcccaaaaggtcgggttgttcagcccttagatctatacttatctgttgattcctagctatatgcggtgtgtctctttagggacgcgtatgccttcatacctagttgtcaagtcatatcagcagccagggcct

SEQ ID NO: 10483 - DNA, 140 bp, Artificial Sequence
  Synthetic
aggccctggctgctgatatgatgtaggtacttaagcttcttaaaagcagccgaactcgctttgagatgtaggcgtagcacaccgaactcttccataattctccgaacccacagggacgtagaccttttgggacagcggtg

SEQ ID NO: 10484 - DNA, 140 bp, Artificial Sequence
  Synthetic
caccgctgtcccaaaaggtctacgtccctgtgggttcggagaattatggaagagttcggtgtgctacgcctacatctcaaagcgagttcggctgcttttaagaagcttaagtacctacatcatatcagcagccagggcct

SEQ ID NO: 10485 - DNA, 140 bp, Artificial Sequence
  Synthetic
atacgccatgctgggtctccggcgtagcacaccgaactcttccataattctccgaacccacagggacgtaggagatgtttaaagtgactataaaaccctgaacagtaataaaatataaaacgtacttgggagtcggccat

SEQ ID NO: 10486 - DNA, 140 bp, Artificial Sequence
  Synthetic
atggccgactcccaagtacgttttatattttattactgttcagggttttatagtcactttaaacatctcctacgtccctgtgggttcggagaattatggaagagttcggtgtgctacgccggagacccagcatggcgtat

SEQ ID NO: 10487 - DNA, 140 bp, Artificial Sequence
  Synthetic
aggccctggctgctgatatgttccagagtctaagcgaaagcgcaacgatggtgtataacgaaagagagttcgtaaatagaaagctacaccatattgcgatgcacggaccggccctgaacagaccttttgggacagcggtg

SEQ ID NO: 10488 - DNA, 140 bp, Artificial Sequence
  Synthetic
caccgctgtcccaaaaggtctgttcagggccggtccgtgcatcgcaatatggtgtagctttctatttacgaactctctttcgttatacaccatcgttgcgctttcgcttagactctggaacatatcagcagccagggcct

SEQ ID NO: 10489 - DNA, 140 bp, Artificial Sequence
  Synthetic
aggccctggctgctgatatggtggtcataaacatccacacaccttttcgcatacaccattaccaacagtgcgtcgaccactcaatgaaactgcaaatgctcgggggtgactcattgagacgaccttttgggacagcggtg

SEQ ID NO: 10490 - DNA, 140 bp, Artificial Sequence
  Synthetic
caccgctgtcccaaaaggtcgtctcaatgagtcacccccgagcatttgcagtttcattgagtggtcgacgcactgttggtaatggtgtatgcgaaaaggtgtgtggatgtttatgaccaccatatcagcagccagggcct

SEQ ID NO: 10491 - DNA, 140 bp, Artificial Sequence
  Synthetic
aggccctggctgctgatatgcgcgcgtaagtccaagggaatatagatcttcccaggagtctgcacaggaggcgagtacaatcacgtcactgacgcatagtcaatttgacctaagcgttgagaccttttgggacagcggtg

SEQ ID NO: 10492 - DNA, 140 bp, Artificial Sequence
  Synthetic
caccgctgtcccaaaaggtctcaacgcttaggtcaaattgactatgcgtcagtgacgtgattgtactcgcctcctgtgcagactcctgggaagatctatattcccttggacttacgcgcgcatatcagcagccagggcct

SEQ ID NO: 10493 - DNA, 140 bp, Artificial Sequence
  Synthetic
aggccctggctgctgatatgcattgagactgctcaaaccgggcggctctctattgatcagagcatatggttacgcagatagaaccagtgaacgagtcatctgcgtattgggacgcaagttgaccttttgggacagcggtg

SEQ ID NO: 10494 - DNA, 140 bp, Artificial Sequence
  Synthetic
caccgctgtcccaaaaggtcaacttgcgtcccaatacgcagatgactcgttcactggttctatctgcgtaaccatatgctctgatcaatagagagccgcccggtttgagcagtctcaatgcatatcagcagccagggcct

SEQ ID NO: 10495 - DNA, 140 bp, Artificial Sequence
  Synthetic
aggccctggctgctgatatggagagtgcatccatggccaacagaagcaggtatcagtcgcgcaaagtagaaaacatgaaagcagcaatcatccagagactaaagagaggctgtagactatgaccttttgggacagcggtg

SEQ ID NO: 10496 - DNA, 140 bp, Artificial Sequence
  Synthetic
caccgctgtcccaaaaggtcatagtctacagcctctctttagtctctggatgattgctgctttcatgttttctactttgcgcgactgatacctgcttctgttggccatggatgcactctccatatcagcagccagggcct

SEQ ID NO: 10497 - DNA, 140 bp, Artificial Sequence
  Synthetic
aggccctggctgctgatatgaaacatgaaagcagcaatcatccagagactaaagagaggctgtagactatacttaatgtcagagaccccaaaagtccctacttaccggactacatatccggaccttttgggacagcggtg

SEQ ID NO: 10498 - DNA, 140 bp, Artificial Sequence
  Synthetic
caccgctgtcccaaaaggtccggatatgtagtccggtaagtagggacttttggggtctctgacattaagtatagtctacagcctctctttagtctctggatgattgctgctttcatgtttcatatcagcagccagggcct

SEQ ID NO: 10499 - DNA, 140 bp, Artificial Sequence
  Synthetic
aggccctggctgctgatatgggtcaccaatcacaaaaaatggcagtataactcccctctggtcccgcgtaatgctgaacttggggaccgaaaaggaaaaattcacatcccgtttccgctggaccttttgggacagcggtg

SEQ ID NO: 10500 - DNA, 140 bp, Artificial Sequence
  Synthetic
caccgctgtcccaaaaggtccagcggaaacgggatgtgaatttttccttttcggtccccaagttcagcattacgcgggaccagaggggagttatactgccattttttgtgattggtgacccatatcagcagccagggcct

SEQ ID NO: 10501 - DNA, 140 bp, Artificial Sequence
  Synthetic
atacgccatgctgggtctcctagcaacaaacccggtaagagcgatgaactgcgccgtagggaacatgcccatctccatcgacataccggaagcggccttcactagggtcgtcgacgcgcccgtacttgggagtcggccat

SEQ ID NO: 10502 - DNA, 140 bp, Artificial Sequence
  Synthetic
atggccgactcccaagtacgggcgcgtcgacgaccctagtgaaggccgcttccggtatgtcgatggagatgggcatgttccctacggcgcagttcatcgctcttaccgggtttgttgctaggagacccagcatggcgtat

SEQ ID NO: 10503 - DNA, 140 bp, Artificial Sequence
  Synthetic
aggccctggctgctgatatgatagaaaaaccataaacagaagtagttcaaagggctataaaacccctgaatagtaacaaaacataaaattaataaaaatcaaatgaataccataattggcgaccttttgggacagcggtg

SEQ ID NO: 10504 - DNA, 140 bp, Artificial Sequence
  Synthetic
caccgctgtcccaaaaggtcgccaattatggtattcatttgatttttattaattttatgttttgttactattcaggggttttatagccctttgaactacttctgtttatggtttttctatcatatcagcagccagggcct

SEQ ID NO: 10505 - DNA, 140 bp, Artificial Sequence
  Synthetic
aggccctggctgctgatatgagtgttacccacctaagctggatgaagcaaaggagcaactattacttaagaaactccaggagagtgcatccatggccaacagaagcaggtatcagtcgcggaccttttgggacagcggtg

SEQ ID NO: 10506 - DNA, 140 bp, Artificial Sequence
  Synthetic
caccgctgtcccaaaaggtccgcgactgatacctgcttctgttggccatggatgcactctcctggagtttcttaagtaatagttgctcctttgcttcatccagcttaggtgggtaacactcatatcagcagccagggcct

SEQ ID NO: 10507 - DNA, 140 bp, Artificial Sequence
  Synthetic
atacgccatgctgggtctccacgccaacattctgcttacacacagacgtctcatgtagacagagagcagacgtcgctatataccaagacgtctatgctgtacacgcacccacgtcgctatcgtacttgggagtcggccat

SEQ ID NO: 10508 - DNA, 140 bp, Artificial Sequence
  Synthetic
atggccgactcccaagtacgatagcgacgtgggtgcgtgtacagcatagacgtcttggtatatagcgacgtctgctctctgtctacatgagacgtctgtgtgtaagcagaatgttggcgtggagacccagcatggcgtat

SEQ ID NO: 10509 - DNA, 140 bp, Artificial Sequence
  Synthetic
aggccctggctgctgatatggacaaactgggcagatgagcaggtactgaaggctaagaacataggattatgttcaacagacctgacggaaggtagacgaggcaagttgtctattatgagagaccttttgggacagcggtg

SEQ ID NO: 10510 - DNA, 140 bp, Artificial Sequence
  Synthetic
caccgctgtcccaaaaggtctctcataatagacaacttgcctcgtctaccttccgtcaggtctgttgaacataatcctatgttcttagccttcagtacctgctcatctgcccagtttgtccatatcagcagccagggcct

SEQ ID NO: 10511 - DNA, 140 bp, Artificial Sequence
  Synthetic
aggccctggctgctgatatggctctacccggaaagccgcaagctacttaagagctggcacctgccatcggtgttccatttaaagggcaaactcagcttcacatgccgctgtgatacagtggaccttttgggacagcggtg

SEQ ID NO: 10512 - DNA, 140 bp, Artificial Sequence
  Synthetic
caccgctgtcccaaaaggtccactgtatcacagcggcatgtgaagctgagtttgccctttaaatggaacaccgatggcaggtgccagctcttaagtagcttgcggctttccgggtagagccatatcagcagccagggcct

SEQ ID NO: 10513 - DNA, 140 bp, Artificial Sequence
  Synthetic
aggccctggctgctgatatggcagccacgaaaagaaactgcaacgtcacacagatgagggaattacccactttggactcagcagtattcaacgtggagtgtttcaaaaaattcgcatgcagaccttttgggacagcggtg

SEQ ID NO: 10514 - DNA, 140 bp, Artificial Sequence
  Synthetic
caccgctgtcccaaaaggtctgcatgcgaattttttgaaacactccacgttgaatactgctgagtccaaagtgggtaattccctcatctgtgtgacgttgcagtttcttttcgtggctgccatatcagcagccagggcct

SEQ ID NO: 10515 - DNA, 140 bp, Artificial Sequence
  Synthetic
aggccctggctgctgatatgcgcctgaagacttccagagtctaagcgaaagcgcaacgatggtgtataacgaaagagagttcgtaaacagaaagctacaccatattgcgatgcacggaccgaccttttgggacagcggtg

SEQ ID NO: 10516 - DNA, 140 bp, Artificial Sequence
  Synthetic
caccgctgtcccaaaaggtcggtccgtgcatcgcaatatggtgtagctttctgtttacgaactctctttcgttatacaccatcgttgcgctttcgcttagactctggaagtcttcaggcgcatatcagcagccagggcct

SEQ ID NO: 10517 - DNA, 140 bp, Artificial Sequence
  Synthetic
aggccctggctgctgatatggaaagagagttcgtaaacagaaagctacaccatattgcgatgcacggaccagccctgaacaccgacgaagagtcgtatgagctggtgagggcagagaggagaccttttgggacagcggtg

SEQ ID NO: 10518 - DNA, 140 bp, Artificial Sequence
  Synthetic
caccgctgtcccaaaaggtctcctctctgccctcaccagctcatacgactcttcgtcggtgttcagggctggtccgtgcatcgcaatatggtgtagctttctgtttacgaactctctttccatatcagcagccagggcct

SEQ ID NO: 10519 - DNA, 140 bp, Artificial Sequence
  Synthetic
aggccctggctgctgatatggtggtgacccgaagcagtgcggcttcttcaatatgatgcagatgaaagtcaactataatcacaacatctgcacccaagtgtaccacaaaagtatctccaggaccttttgggacagcggtg

SEQ ID NO: 10520 - DNA, 140 bp, Artificial Sequence
  Synthetic
caccgctgtcccaaaaggtcctggagatacttttgtggtacacttgggtgcagatgttgtgattatagttgactttcatctgcatcatattgaagaagccgcactgcttcgggtcaccaccatatcagcagccagggcct

SEQ ID NO: 10521 - DNA, 140 bp, Artificial Sequence
  Synthetic
aggccctggctgctgatatgtacccgtgcacatgaagtccgacgcttcgaagttcacccatgagaaaccggaggggtactacaactggcaccacggagcagtacagtactcaggaggccggaccttttgggacagcggtg

SEQ ID NO: 10522 - DNA, 140 bp, Artificial Sequence
  Synthetic
caccgctgtcccaaaaggtccggcctcctgagtactgtactgctccgtggtgccagttgtagtacccctccggtttctcatgggtgaacttcgaagcgtcggacttcatgtgcacgggtacatatcagcagccagggcct

SEQ ID NO: 10523 - DNA, 140 bp, Artificial Sequence
  Synthetic
aggccctggctgctgatatggcgacccgtggataaagacgctgcagaacccaccgaaaggaaacttcaaagcaactattaaggagtgggaggtggagcatgcatcaataatggcgggcatgaccttttgggacagcggtg

SEQ ID NO: 10524 - DNA, 140 bp, Artificial Sequence
  Synthetic
caccgctgtcccaaaaggtcatgcccgccattattgatgcatgctccacctcccactccttaatagttgctttgaagtttcctttcggtgggttctgcagcgtctttatccacgggtcgccatatcagcagccagggcct

SEQ ID NO: 10525 - DNA, 140 bp, Artificial Sequence
  Synthetic
aggccctggctgctgatatggacagagctggggcaggaataattgaaactccaagaggagctatcaaagtcactgcccaaccaacagaccacgtcgtgggagagtacttggtactttcccgaccttttgggacagcggtg

SEQ ID NO: 10526 - DNA, 140 bp, Artificial Sequence
  Synthetic
caccgctgtcccaaaaggtcgggaaagtaccaagtactctcccacgacgtggtctgttggttgggcagtgactttgatagctcctcttggagtttcaattattcctgccccagctctgtccatatcagcagccagggcct

SEQ ID NO: 10527 - DNA, 140 bp, Artificial Sequence
  Synthetic
aggccctggctgctgatatggttacgcagatagaaccagtgaacgagtcatctgcgtattgggacgcaagtttagatcgtctagagcgttgaaaccaccatgtgtcaccagcaacactgagaccttttgggacagcggtg

SEQ ID NO: 10528 - DNA, 140 bp, Artificial Sequence
  Synthetic
caccgctgtcccaaaaggtctcagtgttgctggtgacacatggtggtttcaacgctctagacgatctaaacttgcgtcccaatacgcagatgactcgttcactggttctatctgcgtaaccatatcagcagccagggcct

SEQ ID NO: 10529 - DNA, 140 bp, Artificial Sequence
  Synthetic
atacgccatgctgggtctcccgtgacgtacgggaaaaaccaagtcatcatgctactgtatcctgaccacccaacgctcctgtcctaccggaatatgggagaagaaccaaactatcaagaacgtacttgggagtcggccat

SEQ ID NO: 10530 - DNA, 140 bp, Artificial Sequence
  Synthetic
atggccgactcccaagtacgttcttgatagtttggttcttctcccatattccggtaggacaggagcgttgggtggtcaggatacagtagcatgatgacttggtttttcccgtacgtcacgggagacccagcatggcgtat

SEQ ID NO: 10531 - DNA, 140 bp, Artificial Sequence
  Synthetic
aggccctggctgctgatatgctcatgtcatgaacaatcaactgaatgcagccttcgtaggacaggtcacccgagcaggatgtgcaccgtcgtaccgggtaaaacgcatggacatcgcgaagaccttttgggacagcggtg

SEQ ID NO: 10532 - DNA, 140 bp, Artificial Sequence
  Synthetic
caccgctgtcccaaaaggtcttcgcgatgtccatgcgttttacccggtacgacggtgcacatcctgctcgggtgacctgtcctacgaaggctgcattcagttgattgttcatgacatgagcatatcagcagccagggcct

SEQ ID NO: 10533 - DNA, 140 bp, Artificial Sequence
  Synthetic
aggccctggctgctgatatgacgtcacaagcataattgtgtgttcttcgtttcccctcccaaagtacaaaatagaaggagtgcaaaaagtcaaatgctctaaggtaatgctatttgaccagaccttttgggacagcggtg

SEQ ID NO: 10534 - DNA, 140 bp, Artificial Sequence
  Synthetic
caccgctgtcccaaaaggtctggtcaaatagcattaccttagagcatttgactttttgcactccttctattttgtactttgggaggggaaacgaagaacacacaattatgcttgtgacgtcatatcagcagccagggcct

SEQ ID NO: 10535 - DNA, 140 bp, Artificial Sequence
  Synthetic
aggccctggctgctgatatggcttgtacgcattgggggaaagtatagaatcaatcaggcaaaagtgcccagtggatgacgcagatgcatcgtcgcccccaaaaacagtcccgtgcctctggaccttttgggacagcggtg

SEQ ID NO: 10536 - DNA, 140 bp, Artificial Sequence
  Synthetic
caccgctgtcccaaaaggtccagaggcacgggactgtttttgggggcgacgatgcatctgcgtcatccactgggcacttttgcctgattgattctatactttcccccaatgcgtacaagccatatcagcagccagggcct

SEQ ID NO: 10537 - DNA, 140 bp, Artificial Sequence
  Synthetic
aggccctggctgctgatatgaatcccgagtccgcagtggcagcatgcaatgagttcttagctagaaactatccaactgtctcatcataccaaattaccgacgagtatgatgcatatctaggaccttttgggacagcggtg

SEQ ID NO: 10538 - DNA, 140 bp, Artificial Sequence
  Synthetic
caccgctgtcccaaaaggtcctagatatgcatcatactcgtcggtaatttggtatgatgagacagttggatagtttctagctaagaactcattgcatgctgccactgcggactcgggattcatatcagcagccagggcct

SEQ ID NO: 10539 - DNA, 140 bp, Artificial Sequence
  Synthetic
aggccctggctgctgatatgaccataattggcaaacggaagagatgtaggtacttaagcttcctaaaagcagccgaactcactttgagaagtaggcatagcataccgaactcttccacgagaccttttgggacagcggtg

SEQ ID NO: 10540 - DNA, 140 bp, Artificial Sequence
  Synthetic
caccgctgtcccaaaaggtctcgtggaagagttcggtatgctatgcctacttctcaaagtgagttcggctgcttttaggaagcttaagtacctacatctcttccgtttgccaattatggtcatatcagcagccagggcct

SEQ ID NO: 10541 - DNA, 140 bp, Artificial Sequence
  Synthetic
aggccctggctgctgatatgcgtccgattgtccaatcccgagtccgcagtggcagcatgcaatgagttcttagccagaaactatccaactgtctcgtcataccaaattaccgacgagtatgaccttttgggacagcggtg

SEQ ID NO: 10542 - DNA, 140 bp, Artificial Sequence
  Synthetic
caccgctgtcccaaaaggtcatactcgtcggtaatttggtatgacgagacagttggatagtttctggctaagaactcattgcatgctgccactgcggactcgggattggacaatcggacgcatatcagcagccagggcct

SEQ ID NO: 10543 - DNA, 140 bp, Artificial Sequence
  Synthetic
aggccctggctgctgatatgactacgaatgagtacaacaagccgattgtagtggacactacaggctcaacaaaacctgaccctagagacctcgtgttaacgtgcttcagagggtgggttagaccttttgggacagcggtg

SEQ ID NO: 10544 - DNA, 140 bp, Artificial Sequence
  Synthetic
caccgctgtcccaaaaggtctaacccaccctctgaagcacgttaacacgaggtctctagggtcaggttttgttgagcctgtagtgtccactacaatcggcttgttgtactcattcgtagtcatatcagcagccagggcct

SEQ ID NO: 10545 - DNA, 140 bp, Artificial Sequence
  Synthetic
aggccctggctgctgatatgcctaactctgttcgtcaacacattgttaaacatcaccatcgccagccgagtgctggaagatcgtctgacaaaatccgcgtgcgcggccttcatcggcgacgaccttttgggacagcggtg

SEQ ID NO: 10546 - DNA, 140 bp, Artificial Sequence
  Synthetic
caccgctgtcccaaaaggtcgtcgccgatgaaggccgcgcacgcggattttgtcagacgatcttccagcactcggctggcgatggtgatgtttaacaatgtgttgacgaacagagttaggcatatcagcagccagggcct

SEQ ID NO: 10547 - DNA, 140 bp, Artificial Sequence
  Synthetic
aggccctggctgctgatatgtgctggaagatcgtctgacaaaatccgcgtgcgcggccttcatcggcgacgacaacataatacatggagtcgtctccgatgaattgatggcagccagatggaccttttgggacagcggtg

SEQ ID NO: 10548 - DNA, 140 bp, Artificial Sequence
  Synthetic
caccgctgtcccaaaaggtccatctggctgccatcaattcatcggagacgactccatgtattatgttgtcgtcgccgatgaaggccgcgcacgcggattttgtcagacgatcttccagcacatatcagcagccagggcct

SEQ ID NO: 10549 - DNA, 140 bp, Artificial Sequence
  Synthetic
aggccctggctgctgatatgaagtaatgaaaccagcacacgtaaaggggaccatcgataacgcggacctggccaaactggcctttaagcggtcatctaagtatgaccttgaatgcgcgcagaccttttgggacagcggtg

SEQ ID NO: 10550 - DNA, 140 bp, Artificial Sequence
  Synthetic
caccgctgtcccaaaaggtctgcgcgcattcaaggtcatacttagatgaccgcttaaaggccagtttggccaggtccgcgttatcgatggtcccctttacgtgtgctggtttcattacttcatatcagcagccagggcct

SEQ ID NO: 10551 - DNA, 140 bp, Artificial Sequence
  Synthetic
aggccctggctgctgatatggccaaactggcctttaagcggtcatctaagtatgaccttgaatgcgcgcagatacccgtgcacatgaagtccgacgcttcgaagttcacccatgagaaacgaccttttgggacagcggtg

SEQ ID NO: 10552 - DNA, 140 bp, Artificial Sequence
  Synthetic
caccgctgtcccaaaaggtcgtttctcatgggtgaacttcgaagcgtcggacttcatgtgcacgggtatctgcgcgcattcaaggtcatacttagatgaccgcttaaaggccagtttggccatatcagcagccagggcct

SEQ ID NO: 10553 - DNA, 140 bp, Artificial Sequence
  Synthetic
aggccctggctgctgatatgcggaggggtactacaactggcaccacggagcagtacagtactcaggaggccggttcaccatccctacaggtgctggcaaaccaggggacagcggcagaccgaccttttgggacagcggtg

SEQ ID NO: 10554 - DNA, 140 bp, Artificial Sequence
  Synthetic
caccgctgtcccaaaaggtcggtctgccgctgtcccctggtttgccagcacctgtagggatggtgaaccggcctcctgagtactgtactgctccgtggtgccagttgtagtacccctccgcatatcagcagccagggcct

SEQ ID NO: 10555 - DNA, 140 bp, Artificial Sequence
  Synthetic
aggccctggctgctgatatgcggatgacagccacgattggaccaagctgcgttatatggacaaccacatgccagcagacgcagagagggcggggctatttgtaagaacatcagcaccgtggaccttttgggacagcggtg

SEQ ID NO: 10556 - DNA, 140 bp, Artificial Sequence
  Synthetic
caccgctgtcccaaaaggtccacggtgctgatgttcttacaaatagccccgccctctctgcgtctgctggcatgtggttgtccatataacgcagcttggtccaatcgtggctgtcatccgcatatcagcagccagggcct

SEQ ID NO: 10557 - DNA, 140 bp, Artificial Sequence
  Synthetic
aggccctggctgctgatatggggaaactctgacggtgggattcactgacagtaggaagattagtcattcatgtacgcacccatttcaccacgaccctcctgtgataggtcgggaaaaattgaccttttgggacagcggtg

SEQ ID NO: 10558 - DNA, 140 bp, Artificial Sequence
  Synthetic
caccgctgtcccaaaaggtcaatttttcccgacctatcacaggagggtcgtggtgaaatgggtgcgtacatgaatgactaatcttcctactgtcagtgaatcccaccgtcagagtttccccatatcagcagccagggcct

SEQ ID NO: 10559 - DNA, 140 bp, Artificial Sequence
  Synthetic
atacgccatgctgggtctccctggtgagggcagagaggacagaacacgagtacgtctacgacgtggatcagagaagatgctgtaagaaggaagaagccgcaggactggtactggtgggcgcgtacttgggagtcggccat

SEQ ID NO: 10560 - DNA, 140 bp, Artificial Sequence
  Synthetic
atggccgactcccaagtacgcgcccaccagtaccagtcctgcggcttcttccttcttacagcatcttctctgatccacgtcgtagacgtactcgtgttctgtcctctctgccctcaccagggagacccagcatggcgtat

SEQ ID NO: 10561 - DNA, 140 bp, Artificial Sequence
  Synthetic
aggccctggctgctgatatgacttgactaatccgccctaccacgaattcgcatatgaagggctaaaaatccgccctgcctgcccatacaaaattgcagtcataggagtcttcggagtaccgaccttttgggacagcggtg

SEQ ID NO: 10562 - DNA, 140 bp, Artificial Sequence
  Synthetic
caccgctgtcccaaaaggtcggtactccgaagactcctatgactgcaattttgtatgggcaggcagggcggatttttagcccttcatatgcgaattcgtggtagggcggattagtcaagtcatatcagcagccagggcct

SEQ ID NO: 10563 - DNA, 140 bp, Artificial Sequence
  Synthetic
aggccctggctgctgatatgacagccccatggtattggagatggaactactgtcagtcactttggagccaacactatcgcttgattacatcacgtgcgagtacaaaaccgtcatcccgtcgaccttttgggacagcggtg

SEQ ID NO: 10564 - DNA, 140 bp, Artificial Sequence
  Synthetic
caccgctgtcccaaaaggtcgacgggatgacggttttgtactcgcacgtgatgtaatcaagcgatagtgttggctccaaagtgactgacagtagttccatctccaataccatggggctgtcatatcagcagccagggcct

SEQ ID NO: 10565 - DNA, 140 bp, Artificial Sequence
  Synthetic
aggccctggctgctgatatggtatggaagacactttccggcgacccgtggataaagacgctgcagaacccaccgaaaggaaacttcaaagcaactattaaggagtgggaggtggagcatggaccttttgggacagcggtg

SEQ ID NO: 10566 - DNA, 140 bp, Artificial Sequence
  Synthetic
caccgctgtcccaaaaggtccatgctccacctcccactccttaatagttgctttgaagtttcctttcggtgggttctgcagcgtctttatccacgggtcgccggaaagtgtcttccataccatatcagcagccagggcct

SEQ ID NO: 10567 - DNA, 140 bp, Artificial Sequence
  Synthetic
aggccctggctgctgatatgctgactacagctgtaaggtcttcaccggcgtctacccatttatgtggggcggcgcctactgcttctgcgacgctgaaaacacgcagttgagcgaagcacagaccttttgggacagcggtg

SEQ ID NO: 10568 - DNA, 140 bp, Artificial Sequence
  Synthetic
caccgctgtcccaaaaggtctgtgcttcgctcaactgcgtgttttcagcgtcgcagaagcagtaggcgccgccccacataaatgggtagacgccggtgaagaccttacagctgtagtcagcatatcagcagccagggcct

SEQ ID NO: 10569 - DNA, 140 bp, Artificial Sequence
  Synthetic
aggccctggctgctgatatgcgtcagacagtactgccggtaaataccttggaggaagttcaggaggagaaatgttacccacctaagttggatgaagtgaaagagcagttgttacttaagagaccttttgggacagcggtg

SEQ ID NO: 10570 - DNA, 140 bp, Artificial Sequence
  Synthetic
caccgctgtcccaaaaggtctcttaagtaacaactgctctttcacttcatccaacttaggtgggtaacatttctcctcctgaacttcctccaaggtatttaccggcagtactgtctgacgcatatcagcagccagggcct

SEQ ID NO: 10571 - DNA, 140 bp, Artificial Sequence
  Synthetic
aggccctggctgctgatatgtggctgccaaatagcaacaaacccggtaagagcggtgaactgcgccgtagggaacatgcccatctccatcgacataccggaagcggccttcactagggtcgaccttttgggacagcggtg

SEQ ID NO: 10572 - DNA, 140 bp, Artificial Sequence
  Synthetic
caccgctgtcccaaaaggtcgaccctagtgaaggccgcttccggtatgtcgatggagatgggcatgttccctacggcgcagttcaccgctcttaccgggtttgttgctatttggcagccacatatcagcagccagggcct

SEQ ID NO: 10573 - DNA, 140 bp, Artificial Sequence
  Synthetic
aggccctggctgctgatatgggaacatgcccatctccatcgacataccggaagcggccttcactagggtcgtcgacgcgccctctttaacggacatgtcgtgcgaggtaccagcctgcacgaccttttgggacagcggtg

SEQ ID NO: 10574 - DNA, 140 bp, Artificial Sequence
  Synthetic
caccgctgtcccaaaaggtcgtgcaggctggtacctcgcacgacatgtccgttaaagagggcgcgtcgacgaccctagtgaaggccgcttccggtatgtcgatggagatgggcatgttcccatatcagcagccagggcct

SEQ ID NO: 10575 - DNA, 140 bp, Artificial Sequence
  Synthetic
aggccctggctgctgatatgctattgatcagagcatatggttacgcagatagaaccagtgaacgagtcatctgcgtattgggacgcaagtttagatcgtctagagcgttgaaaccaccatgaccttttgggacagcggtg

SEQ ID NO: 10576 - DNA, 140 bp, Artificial Sequence
  Synthetic
caccgctgtcccaaaaggtcatggtggtttcaacgctctagacgatctaaacttgcgtcccaatacgcagatgactcgttcactggttctatctgcgtaaccatatgctctgatcaatagcatatcagcagccagggcct

SEQ ID NO: 10577 - DNA, 140 bp, Artificial Sequence
  Synthetic
aggccctggctgctgatatgccgcactgattctaatcgtggtgctatgcgtgtcgttcagcaggcactaacttgacaattaagtatgaaggtatatgtgtcccctaagagacacactgtagaccttttgggacagcggtg

SEQ ID NO: 10578 - DNA, 140 bp, Artificial Sequence
  Synthetic
caccgctgtcccaaaaggtctacagtgtgtctcttaggggacacatataccttcatacttaattgtcaagttagtgcctgctgaacgacacgcatagcaccacgattagaatcagtgcggcatatcagcagccagggcct

SEQ ID NO: 10579 - DNA, 140 bp, Artificial Sequence
  Synthetic
aggccctggctgctgatatgatggccggagtcctttaagaacagtgcaacaccagtgggaaccgcaaaaacagttatgtgcggtacgtatccagtaatccacgctgttggaccaaacttcgaccttttgggacagcggtg

SEQ ID NO: 10580 - DNA, 140 bp, Artificial Sequence
  Synthetic
caccgctgtcccaaaaggtcgaagtttggtccaacagcgtggattactggatacgtaccgcacataactgtttttgcggttcccactggtgttgcactgttcttaaaggactccggccatcatatcagcagccagggcct

SEQ ID NO: 10581 - DNA, 140 bp, Artificial Sequence
  Synthetic
atacgccatgctgggtctcccatagcaaataatctatagatcaaagggctacgcaacccctgaatagtaacaaaatataaaatcactaaaaattataaaaacagaaaaatacataaatagcgtacttgggagtcggccat

SEQ ID NO: 10582 - DNA, 140 bp, Artificial Sequence
  Synthetic
atggccgactcccaagtacgctatttatgtatttttctgtttttataatttttagtgattttatattttgttactattcaggggttgcgtagccctttgatctatagattatttgctatgggagacccagcatggcgtat

SEQ ID NO: 10583 - DNA, 140 bp, Artificial Sequence
  Synthetic
atacgccatgctgggtctcctaccgaactcttccacgattctccgaacccacagggacgtaggagatgttattttgtttttaatatttcaaaaaaaaaaaaaaaaaaaaaaaaaaaaaaacgtacttgggagtcggccat

SEQ ID NO: 10584 - DNA, 140 bp, Artificial Sequence
  Synthetic
atggccgactcccaagtacgtttttttttttttttttttttttttttttttgaaatattaaaaacaaaataacatctcctacgtccctgtgggttcggagaatcgtggaagagttcggtaggagacccagcatggcgtat

SEQ ID NO: 10585 - DNA, 140 bp, Artificial Sequence
  Synthetic
aggccctggctgctgatatgtttgaaggccctgcaacgtgcgtaccccatgtttgaggtggaacctaggcaggtcacatcgaatgaccatgctaatgctagagcattctcgcatctagccgaccttttgggacagcggtg

SEQ ID NO: 10586 - DNA, 140 bp, Artificial Sequence
  Synthetic
caccgctgtcccaaaaggtcggctagatgcgagaatgctctagcattagcatggtcattcgatgtgacctgcctaggttccacctcaaacatggggtacgcacgttgcagggccttcaaacatatcagcagccagggcct

SEQ ID NO: 10587 - DNA, 140 bp, Artificial Sequence
  Synthetic
aggccctggctgctgatatgccaggcgattaaaggagttcgagtggcgtactgggtagggttcgacacaaccccgttcatgtacaacgctatggcgggtgcttacccctcatactcgacagaccttttgggacagcggtg

SEQ ID NO: 10588 - DNA, 140 bp, Artificial Sequence
  Synthetic
caccgctgtcccaaaaggtctgtcgagtatgaggggtaagcacccgccatagcgttgtacatgaacggggttgtgtcgaaccctacccagtacgccactcgaactcctttaatcgcctggcatatcagcagccagggcct

SEQ ID NO: 10589 - DNA, 140 bp, Artificial Sequence
  Synthetic
atacgccatgctgggtctccaattgggcggatgagcaggtactgaaggctaagaacataggattatgttcaacagacctgacggaaggtagacgaggcaaattgtctatcatgagaggaacgtacttgggagtcggccat

SEQ ID NO: 10590 - DNA, 140 bp, Artificial Sequence
  Synthetic
atggccgactcccaagtacgttcctctcatgatagacaatttgcctcgtctaccttccgtcaggtctgttgaacataatcctatgttcttagccttcagtacctgctcatccgcccaattggagacccagcatggcgtat

SEQ ID NO: 10591 - DNA, 140 bp, Artificial Sequence
  Synthetic
aggccctggctgctgatatgaggtaatgctatttgaccacaacgtgccatcgcgcgtaagtccaagggaatatagatcttcccaggagtctgcacaggaggcgagtacaatcacgtcactgaccttttgggacagcggtg

SEQ ID NO: 10592 - DNA, 140 bp, Artificial Sequence
  Synthetic
caccgctgtcccaaaaggtcagtgacgtgattgtactcgcctcctgtgcagactcctgggaagatctatattcccttggacttacgcgcgatggcacgttgtggtcaaatagcattacctcatatcagcagccagggcct

SEQ ID NO: 10593 - DNA, 140 bp, Artificial Sequence
  Synthetic
atacgccatgctgggtctccccatctaaagggcaagcttagcttcacatgccgctgtgacacagtggtttcgtgtgagggctacgtcgttaagagaataacgatgagcccgggcctttatcgtacttgggagtcggccat

SEQ ID NO: 10594 - DNA, 140 bp, Artificial Sequence
  Synthetic
atggccgactcccaagtacgataaaggcccgggctcatcgttattctcttaacgacgtagccctcacacgaaaccactgtgtcacagcggcatgtgaagctaagcttgccctttagatggggagacccagcatggcgtat

SEQ ID NO: 10595 - DNA, 140 bp, Artificial Sequence
  Synthetic
aggccctggctgctgatatgcgtcagacctggatgctgacgccccagccctagaaccagcactagacgacggggcgacacacacgctgccatccacaaccggaaaccttgcggccgtgtcgaccttttgggacagcggtg

SEQ ID NO: 10596 - DNA, 140 bp, Artificial Sequence
  Synthetic
caccgctgtcccaaaaggtcgacacggccgcaaggtttccggttgtggatggcagcgtgtgtgtcgccccgtcgtctagtgctggttctagggctggggcgtcagcatccaggtctgacgcatatcagcagccagggcct

SEQ ID NO: 10597 - DNA, 140 bp, Artificial Sequence
  Synthetic
atacgccatgctgggtctccacatgagtacgtctacgacgtggaccagaggagatgctgtaagaaggaagaagctgcaggattggtactggtgggcgacttgactaatccgccctaccaccgtacttgggagtcggccat

SEQ ID NO: 10598 - DNA, 140 bp, Artificial Sequence
  Synthetic
atggccgactcccaagtacggtggtagggcggattagtcaagtcgcccaccagtaccaatcctgcagcttcttccttcttacagcatctcctctggtccacgtcgtagacgtactcatgtggagacccagcatggcgtat

SEQ ID NO: 10599 - DNA, 140 bp, Artificial Sequence
  Synthetic
atacgccatgctgggtctcctcaagaacctagttaccaggcaagacctggtgactagtggaaagaaagaaaactgccaagaaatcagcaccgacgtgatgagacagagaggtctagaaatcgtacttgggagtcggccat

SEQ ID NO: 10600 - DNA, 140 bp, Artificial Sequence
  Synthetic
atggccgactcccaagtacgatttctagacctctctgtctcatcacgtcggtgctgatttcttggcagttttctttctttccactagtcaccaggtcttgcctggtaactaggttcttgaggagacccagcatggcgtat

SEQ ID NO: 10601 - DNA, 140 bp, Artificial Sequence
  Synthetic
atacgccatgctgggtctccatctgcacgtacggttgattcgctgcttttgaacggatgcaatagaccagtcgacgtgttgtacgtagacgaggcgtttgcgtgccactctggaacgttacgtacttgggagtcggccat

SEQ ID NO: 10602 - DNA, 140 bp, Artificial Sequence
  Synthetic
atggccgactcccaagtacgtaacgttccagagtggcacgcaaacgcctcgtctacgtacaacacgtcgactggtctattgcatccgttcaaaagcagcgaatcaaccgtacgtgcagatggagacccagcatggcgtat

SEQ ID NO: 10603 - DNA, 140 bp, Artificial Sequence
  Synthetic
atacgccatgctgggtctccaatgcgcactacgaatgagtacaacatgccgattgtagtggacactacgggctcaacgaaacctgaccctggagatctcgtgttaacgtgcttcagagggcgtacttgggagtcggccat

SEQ ID NO: 10604 - DNA, 140 bp, Artificial Sequence
  Synthetic
atggccgactcccaagtacgccctctgaagcacgttaacacgagatctccagggtcaggtttcgttgagcccgtagtgtccactacaatcggcatgttgtactcattcgtagtgcgcattggagacccagcatggcgtat

SEQ ID NO: 10605 - DNA, 140 bp, Artificial Sequence
  Synthetic
atacgccatgctgggtctccaagttaacgaaaacccactctatgcatcaacatcagagcacgtcaacgtactcctaacgcgtacggaaggtaagctggtatggaagacactctctggtgacgtacttgggagtcggccat

SEQ ID NO: 10606 - DNA, 140 bp, Artificial Sequence
  Synthetic
atggccgactcccaagtacgtcaccagagagtgtcttccataccagcttaccttccgtacgcgttaggagtacgttgacgtgctctgatgttgatgcatagagtgggttttcgttaacttggagacccagcatggcgtat

SEQ ID NO: 10607 - DNA, 140 bp, Artificial Sequence
  Synthetic
aggccctggctgctgatatgtggaggaagtccacgaggagaagtgttacccacctaagctggatgaagcaaaggagcaactattacttaagaaactccaggagagtgcatccatggccaagaccttttgggacagcggtg

SEQ ID NO: 10608 - DNA, 140 bp, Artificial Sequence
  Synthetic
caccgctgtcccaaaaggtcttggccatggatgcactctcctggagtttcttaagtaatagttgctcctttgcttcatccagcttaggtgggtaacacttctcctcgtggacttcctccacatatcagcagccagggcct

SEQ ID NO: 10609 - DNA, 140 bp, Artificial Sequence
  Synthetic
atacgccatgctgggtctcccccgtggataaagacgctgcagaacccaccgaaaggaaacttcaaggcaactattaaggagtgggaggtggagcacgcatcgataatggcgggcatccgccgtacttgggagtcggccat

SEQ ID NO: 10610 - DNA, 140 bp, Artificial Sequence
  Synthetic
atggccgactcccaagtacggcggatgcccgccattatcgatgcgtgctccacctcccactccttaatagttgccttgaagtttcctttcggtgggttctgcagcgtctttatccacgggggagacccagcatggcgtat

SEQ ID NO: 10611 - DNA, 140 bp, Artificial Sequence
  Synthetic
atacgccatgctgggtctccagtcaccaagtgaccttcgacacgttccaaaacaaagccaacgtttgctgggctaagagcttggtccctatcctcgaaacagcggggataaaactaaatgcgtacttgggagtcggccat

SEQ ID NO: 10612 - DNA, 140 bp, Artificial Sequence
  Synthetic
atggccgactcccaagtacgcatttagttttatccccgctgtttcgaggatagggaccaagctcttagcccagcaaacgttggctttgttttggaacgtgtcgaaggtcacttggtgactggagacccagcatggcgtat

SEQ ID NO: 10613 - DNA, 140 bp, Artificial Sequence
  Synthetic
atacgccatgctgggtctccaccctaccaccaacattataccggtcaacaggagactaccacactcattagtggccgaacaccgcccagtaaaaggggaaaggatggaatggctggttaacgtacttgggagtcggccat

SEQ ID NO: 10614 - DNA, 140 bp, Artificial Sequence
  Synthetic
atggccgactcccaagtacgttaaccagccattccatcctttccccttttactgggcggtgttcggccactaatgagtgtggtagtctcctgttgaccggtataatgttggtggtagggtggagacccagcatggcgtat

SEQ ID NO: 10615 - DNA, 140 bp, Artificial Sequence
  Synthetic
aggccctggctgctgatatggactatacatacaacctagagctgggtctaccggcaacacttggtaggtatgacctagtggtcataaacatccacacacctttccgcatacaccattatcgaccttttgggacagcggtg

SEQ ID NO: 10616 - DNA, 140 bp, Artificial Sequence
  Synthetic
caccgctgtcccaaaaggtcgataatggtgtatgcggaaaggtgtgtggatgtttatgaccactaggtcatacctaccaagtgttgccggtagacccagctctaggttgtatgtatagtccatatcagcagccagggcct

SEQ ID NO: 10617 - DNA, 140 bp, Artificial Sequence
  Synthetic
atacgccatgctgggtctccaacagtgcgtagatcacgcaatgaaactgcaaatgctagggggtgactcactgagactgcttaaaccgggtggctctctattgatcagagcatacggttacgtacttgggagtcggccat

SEQ ID NO: 10618 - DNA, 140 bp, Artificial Sequence
  Synthetic
atggccgactcccaagtacgtaaccgtatgctctgatcaatagagagccacccggtttaagcagtctcagtgagtcaccccctagcatttgcagtttcattgcgtgatctacgcactgttggagacccagcatggcgtat

SEQ ID NO: 10619 - DNA, 140 bp, Artificial Sequence
  Synthetic
aggccctggctgctgatatggatcgtctagagcattgaaaccaccatgtatcaccagtaatactgagatgtttttcctattcagcaattttgacaatggcagaaggaattttacaacgcagaccttttgggacagcggtg

SEQ ID NO: 10620 - DNA, 140 bp, Artificial Sequence
  Synthetic
caccgctgtcccaaaaggtctgcgttgtaaaattccttctgccattgtcaaaattgctgaataggaaaaacatctcagtattactggtgatacatggtggtttcaatgctctagacgatccatatcagcagccagggcct

SEQ ID NO: 10621 - DNA, 140 bp, Artificial Sequence
  Synthetic
atacgccatgctgggtctcctttttcctattcagcaattttgacaatggcagaaggaattttacaacgcatgtcatgaacaatcaattgaatgcagcctttgtaggacaggccacccgagcgtacttgggagtcggccat

SEQ ID NO: 10622 - DNA, 140 bp, Artificial Sequence
  Synthetic
atggccgactcccaagtacgctcgggtggcctgtcctacaaaggctgcattcaattgattgttcatgacatgcgttgtaaaattccttctgccattgtcaaaattgctgaataggaaaaaggagacccagcatggcgtat

SEQ ID NO: 10623 - DNA, 140 bp, Artificial Sequence
  Synthetic
atacgccatgctgggtctccacagatgagggaattacccactttggactcagcagtattcaacgtggagtgtttcaaaaaattcgcatgcaaccaagaatactgggaagaatttgctgcccgtacttgggagtcggccat

SEQ ID NO: 10624 - DNA, 140 bp, Artificial Sequence
  Synthetic
atggccgactcccaagtacgggcagcaaattcttcccagtattcttggttgcatgcgaattttttgaaacactccacgttgaatactgctgagtccaaagtgggtaattccctcatctgtggagacccagcatggcgtat

SEQ ID NO: 10625 - DNA, 140 bp, Artificial Sequence
  Synthetic
atacgccatgctgggtctccgactgggagtaaatagcgtagctatacctctcctctccacaggtgtatactcaggagggaaagacaggttaacccagtcactgaaccacctctttacagccgtacttgggagtcggccat

SEQ ID NO: 10626 - DNA, 140 bp, Artificial Sequence
  Synthetic
atggccgactcccaagtacggctgtaaagaggtggttcagtgactgggttaacctgtctttccctcctgagtatacacctgtggagaggagaggtatagctacgctatttactcccagtcggagacccagcatggcgtat

SEQ ID NO: 10627 - DNA, 140 bp, Artificial Sequence
  Synthetic
aggccctggctgctgatatgcctatatgccctgggggaaagtattgaatcaatcaggcagaaatgcccggtggatgatgcagacgcatcatctcccccgaaaaccgtcccatgcctttgcgaccttttgggacagcggtg

SEQ ID NO: 10628 - DNA, 140 bp, Artificial Sequence
  Synthetic
caccgctgtcccaaaaggtcgcaaaggcatgggacggttttcgggggagatgatgcgtctgcatcatccaccgggcatttctgcctgattgattcaatactttcccccagggcatataggcatatcagcagccagggcct

SEQ ID NO: 10629 - DNA, 140 bp, Artificial Sequence
  Synthetic
aggccctggctgctgatatgaaggagtgcaaaaagtcaaatgctccaaggtaatgttattcgatcacaatgtgccatcgcgcataagcccaagggaatacagatcttcccaggagtctgtgaccttttgggacagcggtg

SEQ ID NO: 10630 - DNA, 140 bp, Artificial Sequence
  Synthetic
caccgctgtcccaaaaggtcacagactcctgggaagatctgtattcccttgggcttatgcgcgatggcacattgtgatcgaataacattaccttggagcatttgactttttgcactccttcatatcagcagccagggcct

SEQ ID NO: 10631 - DNA, 140 bp, Artificial Sequence
  Synthetic
atacgccatgctgggtctccccagccctggaaccggccctagacgacggggcgatacatacgttaccaaccactatcggaaatcttgcggccgtgtctgactgggtaatgagcaccgtaccgtacttgggagtcggccat

SEQ ID NO: 10632 - DNA, 140 bp, Artificial Sequence
  Synthetic
atggccgactcccaagtacggtacggtgctcattacccagtcagacacggccgcaagatttccgatagtggttggtaacgtatgtatcgccccgtcgtctagggccggttccagggctggggagacccagcatggcgtat

SEQ ID NO: 10633 - DNA, 140 bp, Artificial Sequence
  Synthetic
atacgccatgctgggtctccctatttcctttcaggcaccgccaagtaccaccatggaactgagccatccaccgatctccttcggagcaccaagcgagacgttccccatcacatttggggacgtacttgggagtcggccat

SEQ ID NO: 10634 - DNA, 140 bp, Artificial Sequence
  Synthetic
atggccgactcccaagtacgtccccaaatgtgatggggaacgtctcgcttggtgctccgaaggagatcggtggatggctcagttccatggtggtacttggcggtgcctgaaaggaaatagggagacccagcatggcgtat

SEQ ID NO: 10635 - DNA, 140 bp, Artificial Sequence
  Synthetic
aggccctggctgctgatatgccgatctccttcggagcaccaagcgagacgttccccatcacatttggggacttcgacgaaggagaaatagaaagtttgtcttccgagctactaactttcggaccttttgggacagcggtg

SEQ ID NO: 10636 - DNA, 140 bp, Artificial Sequence
  Synthetic
caccgctgtcccaaaaggtccgaaagttagtagctcggaagacaaactttctatttctccttcgtcgaagtccccaaatgtgatggggaacgtctcgcttggtgctccgaaggagatcggcatatcagcagccagggcct

SEQ ID NO: 10637 - DNA, 140 bp, Artificial Sequence
  Synthetic
atacgccatgctgggtctccgagacttcctacccggtgaagtggatgatttgacagatagcgactggtccacgtgcccagacacggacgacgagttatgactagacagggcaggcggatacgtacttgggagtcggccat

SEQ ID NO: 10638 - DNA, 140 bp, Artificial Sequence
  Synthetic
atggccgactcccaagtacgtatccgcctgccctgtctagtcataactcgtcgtccgtgtctgggcacgtggaccagtcgctatctgtcaaatcatccacttcaccgggtaggaagtctcggagacccagcatggcgtat

SEQ ID NO: 10639 - DNA, 140 bp, Artificial Sequence
  Synthetic
aggccctggctgctgatatgacgtgcccagacacggacgacgagttatgactagacagggcaggcggatatatattctcgtcggacaccggtccaggccatttacaacagaagtcggtacgaccttttgggacagcggtg

SEQ ID NO: 10640 - DNA, 140 bp, Artificial Sequence
  Synthetic
caccgctgtcccaaaaggtcgtaccgacttctgttgtaaatggcctggaccggtgtccgacgagaatatatatccgcctgccctgtctagtcataactcgtcgtccgtgtctgggcacgtcatatcagcagccagggcct

SEQ ID NO: 10641 - DNA, 140 bp, Artificial Sequence
  Synthetic
atacgccatgctgggtctccaggtggaaaatatgaaagcaacaatcatccaaggacttgatagaggctgcaaactgtatttaatggcagagaccccgaaagtcccgacttatcggaccgtcgtacttgggagtcggccat

SEQ ID NO: 10642 - DNA, 140 bp, Artificial Sequence
  Synthetic
atggccgactcccaagtacgacggtccgataagtcgggactttcggggtctctgccattaaatacagtttgcagcctctatcaagtccttggatgattgttgctttcatattttccacctggagacccagcatggcgtat

SEQ ID NO: 10643 - DNA, 140 bp, Artificial Sequence
  Synthetic
atacgccatgctgggtctccatacccggcgcctgtgtactcgcctccgatcaacgtccgattgtccaaccccgagtccgcagtggcagcatgtaatgagttcctagctagaaactacccacgtacttgggagtcggccat

SEQ ID NO: 10644 - DNA, 140 bp, Artificial Sequence
  Synthetic
atggccgactcccaagtacgtgggtagtttctagctaggaactcattacatgctgccactgcggactcggggttggacaatcggacgttgatcggaggcgagtacacaggcgccgggtatggagacccagcatggcgtat

SEQ ID NO: 10645 - DNA, 140 bp, Artificial Sequence
  Synthetic
aggccctggctgctgatatgagggctaattgatgagctggagaaagcggtatactctaggtacgaagtgcagggtatatcagttgtagtaatgtccatggccacctttgcaagctccagagaccttttgggacagcggtg

SEQ ID NO: 10646 - DNA, 140 bp, Artificial Sequence
  Synthetic
caccgctgtcccaaaaggtctctggagcttgcaaaggtggccatggacattactacaactgatataccctgcacttcgtacctagagtataccgctttctccagctcatcaattagccctcatatcagcagccagggcct

SEQ ID NO: 10647 - DNA, 140 bp, Artificial Sequence
  Synthetic
atacgccatgctgggtctcctggcaacagcgtacctatgtggaattcacagagaattggttaggagattgaacgccgtcctcctacccaatgtgcatacattatttgacatgtctgccgacgtacttgggagtcggccat

SEQ ID NO: 10648 - DNA, 140 bp, Artificial Sequence
  Synthetic
atggccgactcccaagtacgtcggcagacatgtcaaataatgtatgcacattgggtaggaggacggcgttcaatctcctaaccaattctctgtgaattccacataggtacgctgttgccaggagacccagcatggcgtat

SEQ ID NO: 10649 - DNA, 140 bp, Artificial Sequence
  Synthetic
aggccctggctgctgatatgggacttgatagaggctgcttttggagagatttccagctgtcacctgccgacaggtacgcgcttcaagttcggtgctatgatgaaatccggtatgttcctagaccttttgggacagcggtg

SEQ ID NO: 10650 - DNA, 140 bp, Artificial Sequence
  Synthetic
caccgctgtcccaaaaggtctaggaacataccggatttcatcatagcaccgaacttgaagcgcgtacctgtcggcaggtgacagctggaaatctctccaaaagcagcctctatcaagtcccatatcagcagccagggcct

SEQ ID NO: 10651 - DNA, 140 bp, Artificial Sequence
  Synthetic
atacgccatgctgggtctcccaggtacgcgcttcaagttcggtgctatgatgaaatccggtatgttcctaactctgttcgtcaacacattgttaaacatcaccatcgctagccgggtgttcgtacttgggagtcggccat

SEQ ID NO: 10652 - DNA, 140 bp, Artificial Sequence
  Synthetic
atggccgactcccaagtacgaacacccggctagcgatggtgatgtttaacaatgtgttgacgaacagagttaggaacataccggatttcatcatagcaccgaacttgaagcgcgtacctgggagacccagcatggcgtat

SEQ ID NO: 10653 - DNA, 140 bp, Artificial Sequence
  Synthetic
aggccctggctgctgatatgaacgccgtcctcctacccaatgtgcatacattatttgacatgtctgccgaggacttcgatgccattatagccgcacactttaagccaggagacgctgtttgaccttttgggacagcggtg

SEQ ID NO: 10654 - DNA, 140 bp, Artificial Sequence
  Synthetic
caccgctgtcccaaaaggtcaaacagcgtctcctggcttaaagtgtgcggctataatggcatcgaagtcctcggcagacatgtcaaataatgtatgcacattgggtaggaggacggcgttcatatcagcagccagggcct

SEQ ID NO: 10655 - DNA, 140 bp, Artificial Sequence
  Synthetic
aggccctggctgctgatatgcgttacgccatgacaccagaacgcgttacccgacttcgcatgaaccatgtcacaagcataattgtgtgttcttcgtttccccttccaaagtacaaaataggaccttttgggacagcggtg

SEQ ID NO: 10656 - DNA, 140 bp, Artificial Sequence
  Synthetic
caccgctgtcccaaaaggtcctattttgtactttggaaggggaaacgaagaacacacaattatgcttgtgacatggttcatgcgaagtcgggtaacgcgttctggtgtcatggcgtaacgcatatcagcagccagggcct

SEQ ID NO: 10657 - DNA, 140 bp, Artificial Sequence
  Synthetic
aggccctggctgctgatatgacccgtcataactttgtacggcggtcctaaataggtacgcactacagctacctattttgcagaagccgacagcaggtacccaaataccaatcagccataagaccttttgggacagcggtg

SEQ ID NO: 10658 - DNA, 140 bp, Artificial Sequence
  Synthetic
caccgctgtcccaaaaggtcttatggctgattggtatttgggtacctgctgtcggcttctgcaaaataggtagctgtagtgcgtacctatttaggaccgccgtacaaagttatgacgggtcatatcagcagccagggcct

SEQ ID NO: 10659 - DNA, 140 bp, Artificial Sequence
  Synthetic
atacgccatgctgggtctccgaagcagccccctaaaaagaaaccggttcaaaagaaaaagaagccaggccgtagagagagaatgtgcatgaaaatcgaaaatgattgcatcttcgaagtccgtacttgggagtcggccat

SEQ ID NO: 10660 - DNA, 140 bp, Artificial Sequence
  Synthetic
atggccgactcccaagtacggacttcgaagatgcaatcattttcgattttcatgcacattctctctctacggcctggcttctttttcttttgaaccggtttctttttagggggctgcttcggagacccagcatggcgtat

SEQ ID NO: 10661 - DNA, 140 bp, Artificial Sequence
  Synthetic
aggccctggctgctgatatgaatgaagccagcacacgtaaaggggaccatcgataacgcggacctggccaaattggccttcaagcggtcatccaagtacgaccttgaatgcgcgcagatagaccttttgggacagcggtg

SEQ ID NO: 10662 - DNA, 140 bp, Artificial Sequence
  Synthetic
caccgctgtcccaaaaggtctatctgcgcgcattcaaggtcgtacttggatgaccgcttgaaggccaatttggccaggtccgcgttatcgatggtcccctttacgtgtgctggcttcattcatatcagcagccagggcct

SEQ ID NO: 10663 - DNA, 140 bp, Artificial Sequence
  Synthetic
aggccctggctgctgatatgggcagtataactcccctctggtcccgcgtaatgctgaacttggggaccgaaaaggaaaaattcacatcccgtttccgctggcaaatgtaacatgcagggtgaccttttgggacagcggtg

SEQ ID NO: 10664 - DNA, 140 bp, Artificial Sequence
  Synthetic
caccgctgtcccaaaaggtcaccctgcatgttacatttgccagcggaaacgggatgtgaatttttccttttcggtccccaagttcagcattacgcgggaccagaggggagttatactgcccatatcagcagccagggcct

SEQ ID NO: 10665 - DNA, 140 bp, Artificial Sequence
  Synthetic
atacgccatgctgggtctccttcgacaacaaggggcgcgtggtggccatagttttaggaggagctaatgaaggagcccgcacagccctctcggtggtgacctggaacaaagacatcgtcacgtacttgggagtcggccat

SEQ ID NO: 10666 - DNA, 140 bp, Artificial Sequence
  Synthetic
atggccgactcccaagtacgtgacgatgtctttgttccaggtcaccaccgagagggctgtgcgggctccttcattagctcctcctaaaactatggccaccacgcgccccttgttgtcgaaggagacccagcatggcgtat

SEQ ID NO: 10667 - DNA, 140 bp, Artificial Sequence
  Synthetic
aggccctggctgctgatatgatgtgcctgctggcaaataccacgttcccctgctcccagcccccttgcacaccctgctgctacgaaaaagagccggagaataccctgcgcatgcttgaaggaccttttgggacagcggtg

SEQ ID NO: 10668 - DNA, 140 bp, Artificial Sequence
  Synthetic
caccgctgtcccaaaaggtccttcaagcatgcgcagggtattctccggctctttttcgtagcagcagggtgtgcaagggggctgggagcaggggaacgtggtatttgccagcaggcacatcatatcagcagccagggcct

SEQ ID NO: 10669 - DNA, 140 bp, Artificial Sequence
  Synthetic
atacgccatgctgggtctccacaacgtcatgagccccgggtactatcagttgctacaagcatccttaacatgctctccccgacgccagcgacgcagtattaaggacaacttcaatgtctacgtacttgggagtcggccat

SEQ ID NO: 10670 - DNA, 140 bp, Artificial Sequence
  Synthetic
atggccgactcccaagtacgtagacattgaagttgtccttaatactgcgtcgctggcgtcggggagagcatgttaaggatgcttgtagcaactgatagtacccggggctcatgacgttgtggagacccagcatggcgtat

SEQ ID NO: 10671 - DNA, 140 bp, Artificial Sequence
  Synthetic
atacgccatgctgggtctcctgatagccatgattggaccaagctgcgttatatggacaatcatatgccagcagacgcagagcgggccgggctatttgtaagaacgtcagcaccgtgcacgcgtacttgggagtcggccat

SEQ ID NO: 10672 - DNA, 140 bp, Artificial Sequence
  Synthetic
atggccgactcccaagtacgcgtgcacggtgctgacgttcttacaaatagcccggcccgctctgcgtctgctggcatatgattgtccatataacgcagcttggtccaatcatggctatcaggagacccagcatggcgtat

SEQ ID NO: 10673 - DNA, 140 bp, Artificial Sequence
  Synthetic
aggccctggctgctgatatgtttgcatcagcatacagggctcataccgcatctgcatcagctaagctccgcgtcctttaccaaggaaataacatcactgtaactgcctatgcaaacggcggaccttttgggacagcggtg

SEQ ID NO: 10674 - DNA, 140 bp, Artificial Sequence
  Synthetic
caccgctgtcccaaaaggtccgccgtttgcataggcagttacagtgatgttatttccttggtaaaggacgcggagcttagctgatgcagatgcggtatgagccctgtatgctgatgcaaacatatcagcagccagggcct

SEQ ID NO: 10675 - DNA, 140 bp, Artificial Sequence
  Synthetic
atacgccatgctgggtctccattactggaacaatgggacatttcattctggcccgatgtccgaaaggagaaactctgacggtgggattcactgatggtaggaagatcagtcactcatgtacgtacttgggagtcggccat

SEQ ID NO: 10676 - DNA, 140 bp, Artificial Sequence
  Synthetic
atggccgactcccaagtacgtacatgagtgactgatcttcctaccatcagtgaatcccaccgtcagagtttctcctttcggacatcgggccagaatgaaatgtcccattgttccagtaatggagacccagcatggcgtat

SEQ ID NO: 10677 - DNA, 140 bp, Artificial Sequence
  Synthetic
aggccctggctgctgatatgcaccgctgcaactgccgaggagatagaggtacatatgcccccagacactccagatcgcacattgatgtcacaacagtccggcaatgtaaagatcacagtcgaccttttgggacagcggtg

SEQ ID NO: 10678 - DNA, 140 bp, Artificial Sequence
  Synthetic
caccgctgtcccaaaaggtcgactgtgatctttacattgccggactgttgtgacatcaatgtgcgatctggagtgtctgggggcatatgtacctctatctcctcggcagttgcagcggtgcatatcagcagccagggcct

SEQ ID NO: 10679 - DNA, 140 bp, Artificial Sequence
  Synthetic
aggccctggctgctgatatgattaaccactacagacaaagtgattaataactgcaaggttgatcaatgccatgccgcggtcaccaaccacaaaaaatggcagtataattcccctctggtcgaccttttgggacagcggtg

SEQ ID NO: 10680 - DNA, 140 bp, Artificial Sequence
  Synthetic
caccgctgtcccaaaaggtcgaccagaggggaattatactgccattttttgtggttggtgaccgcggcatggcattgatcaaccttgcagttattaatcactttgtctgtagtggttaatcatatcagcagccagggcct

SEQ ID NO: 10681 - DNA, 140 bp, Artificial Sequence
  Synthetic
aggccctggctgctgatatgatgccgcggtcaccaaccacaaaaaatggcagtataattcccctctggtcccgcgcaatgctgaactcggggaccgaaaaggaaaagttcatattccgttgaccttttgggacagcggtg

SEQ ID NO: 10682 - DNA, 140 bp, Artificial Sequence
  Synthetic
caccgctgtcccaaaaggtcaacggaatatgaacttttccttttcggtccccgagttcagcattgcgcgggaccagaggggaattatactgccattttttgtggttggtgaccgcggcatcatatcagcagccagggcct

SEQ ID NO: 10683 - DNA, 140 bp, Artificial Sequence
  Synthetic
aggccctggctgctgatatgacatctccgctacggcgatgtcatgggtgcagaagatcacgggaggtgtgggactggttgttgctgttgccgcactgattctaatcgtggtgctatgcgtgaccttttgggacagcggtg

SEQ ID NO: 10684 - DNA, 140 bp, Artificial Sequence
  Synthetic
caccgctgtcccaaaaggtcacgcatagcaccacgattagaatcagtgcggcaacagcaacaaccagtcccacacctcccgtgatcttctgcacccatgacatcgccgtagcggagatgtcatatcagcagccagggcct

SEQ ID NO: 10685 - DNA, 140 bp, Artificial Sequence
  Synthetic
atacgccatgctgggtctccgtgggtgacgcataagaaggagatcaggctaaccgtgccgactgaagggctcgaggtcacgtggggtaacaatgagccgtacaagtattggccgcagttacgtacttgggagtcggccat

SEQ ID NO: 10686 - DNA, 140 bp, Artificial Sequence
  Synthetic
atggccgactcccaagtacgtaactgcggccaatacttgtacggctcattgttaccccacgtgacctcgagcccttcagtcggcacggttagcctgatctccttcttatgcgtcacccacggagacccagcatggcgtat

SEQ ID NO: 10687 - DNA, 140 bp, Artificial Sequence
  Synthetic
atacgccatgctgggtctcctttcctgcttagcctaatatgctgcattagaacagctaaagcggccacataccaggaggccgcggtatacctgtggaacgagcagcagcctttgttttggcgtacttgggagtcggccat

SEQ ID NO: 10688 - DNA, 140 bp, Artificial Sequence
  Synthetic
atggccgactcccaagtacgccaaaacaaaggctgctgctcgttccacaggtataccgcggcctcctggtatgtggccgctttagctgttctaatgcagcatattaggctaagcaggaaaggagacccagcatggcgtat

SEQ ID NO: 10689 - DNA, 140 bp, Artificial Sequence
  Synthetic
atacgccatgctgggtctccgcgtcggtgcccacactgtgagcgcgtacgaacacgtaacagtgatcccgaacacggtgggagtaccgtataagactctagtcaacagaccgggttacagcgtacttgggagtcggccat

SEQ ID NO: 10690 - DNA, 140 bp, Artificial Sequence
  Synthetic
atggccgactcccaagtacgctgtaacccggtctgttgactagagtcttatacggtactcccaccgtgttcgggatcactgttacgtgttcgtacgcgctcacagtgtgggcaccgacgcggagacccagcatggcgtat

SEQ ID NO: 10691 - DNA, 140 bp, Artificial Sequence
  Synthetic
atacgccatgctgggtctccccccatggtactggagatggagcttctgtcagtcactttggagccaacgctatcgctcgattacatcacgtgcgagtataaaaccgtcatcccgtctccgcgtacttgggagtcggccat

SEQ ID NO: 10692 - DNA, 140 bp, Artificial Sequence
  Synthetic
atggccgactcccaagtacgcggagacgggatgacggttttatactcgcacgtgatgtaatcgagcgatagcgttggctccaaagtgactgacagaagctccatctccagtaccatggggggagacccagcatggcgtat

SEQ ID NO: 10693 - DNA, 140 bp, Artificial Sequence
  Synthetic
aggccctggctgctgatatgtatcgctcgattacatcacgtgcgagtataaaaccgtcatcccgtctccgtacgtgaaatgctgcggtacagcagagtgcaaggacaagagcctacctgagaccttttgggacagcggtg

SEQ ID NO: 10694 - DNA, 140 bp, Artificial Sequence
  Synthetic
caccgctgtcccaaaaggtctcaggtaggctcttgtccttgcactctgctgtaccgcagcatttcacgtacggagacgggatgacggttttatactcgcacgtgatgtaatcgagcgatacatatcagcagccagggcct

SEQ ID NO: 10695 - DNA, 140 bp, Artificial Sequence
  Synthetic
atacgccatgctgggtctccttacagctgtaaggtcttcaccggcgtctatccattcatgtggggcggcgcctactgcttctgcgacactgaaaatacgcaattgagcgaagcacatgtgcgtacttgggagtcggccat

SEQ ID NO: 10696 - DNA, 140 bp, Artificial Sequence
  Synthetic
atggccgactcccaagtacgcacatgtgcttcgctcaattgcgtattttcagtgtcgcagaagcagtaggcgccgccccacatgaatggatagacgccggtgaagaccttacagctgtaaggagacccagcatggcgtat

SEQ ID NO: 10697 - DNA, 140 bp, Artificial Sequence
  Synthetic
aggccctggctgctgatatgcctactgcttctgcgacactgaaaatacgcaattgagcgaagcacatgtggagaagtctgaatcatgcaaaacggaatttgcatcagcatacagggcccagaccttttgggacagcggtg

SEQ ID NO: 10698 - DNA, 140 bp, Artificial Sequence
  Synthetic
caccgctgtcccaaaaggtctgggccctgtatgctgatgcaaattccgttttgcatgattcagacttctccacatgtgcttcgctcaattgcgtattttcagtgtcgcagaagcagtaggcatatcagcagccagggcct

SEQ ID NO: 10699 - DNA, 140 bp, Artificial Sequence
  Synthetic
aggccctggctgctgatatgtaaaatcgtggtgtacaaaggcgacgtctacaacatggactacccgcccttcggcgcaggaagaccaggacaatttggtgacatccaaagccgcacgcctgaccttttgggacagcggtg

SEQ ID NO: 10700 - DNA, 140 bp, Artificial Sequence
  Synthetic
caccgctgtcccaaaaggtcaggcgtgcggctttggatgtcaccaaattgtcctggtcttcctgcgccgaagggcgggtagtccatgttgtagacgtcgcctttgtacaccacgattttacatatcagcagccagggcct

SEQ ID NO: 10701 - DNA, 140 bp, Artificial Sequence
  Synthetic
atacgccatgctgggtctcctcagcaggcactaacttgataattaagtatgaaggtatatgtgtcccctaagagacacactgtatatagcaaataatctatagatcaaagggctacgcaacgtacttgggagtcggccat

SEQ ID NO: 10702 - DNA, 140 bp, Artificial Sequence
  Synthetic
atggccgactcccaagtacgttgcgtagccctttgatctatagattatttgctatatacagtgtgtctcttaggggacacatataccttcatacttaattatcaagttagtgcctgctgaggagacccagcatggcgtat

SEQ ID NO: 10703 - DNA, 140 bp, Artificial Sequence
  Synthetic
atacgccatgctgggtctcctgaaaatcaataaaaatcataaaatagaaaaaccataaacagaagtagttcaaagggctgtaaaacccctgaatagtaacaaaacataaaattaataaaacgtacttgggagtcggccat

SEQ ID NO: 10704 - DNA, 140 bp, Artificial Sequence
  Synthetic
atggccgactcccaagtacgttttattaattttatgttttgttactattcaggggttttacagccctttgaactacttctgtttatggtttttctattttatgatttttattgattttcaggagacccagcatggcgtat

SEQ ID NO: 10705 - DNA, 140 bp, Artificial Sequence
  Synthetic
aggccctggctgctgatatgattggctaaaagaacgaggggcgtcgctgcaacacacagcaccatttggctgtcaaatagcaacaaacccggtaagagcgatgaactgcgccgtagggaagaccttttgggacagcggtg

SEQ ID NO: 10706 - DNA, 140 bp, Artificial Sequence
  Synthetic
caccgctgtcccaaaaggtcttccctacggcgcagttcatcgctcttaccgggtttgttgctatttgacagccaaatggtgctgtgtgttgcagcgacgcccctcgttcttttagccaatcatatcagcagccagggcct

SEQ ID NO: 10707 - DNA, 140 bp, Artificial Sequence
  Synthetic
atacgccatgctgggtctcctgtcaaatagcaacaaacccggtaagagcgatgaactgcgccgtagggaacatgcctatctccatcgacataccggacgcagccttcactagggtcgtcgcgtacttgggagtcggccat

SEQ ID NO: 10708 - DNA, 140 bp, Artificial Sequence
  Synthetic
atggccgactcccaagtacgcgacgaccctagtgaaggctgcgtccggtatgtcgatggagataggcatgttccctacggcgcagttcatcgctcttaccgggtttgttgctatttgacaggagacccagcatggcgtat

SEQ ID NO: 10709 - DNA, 140 bp, Artificial Sequence
  Synthetic
aggccctggctgctgatatgaggcaagtgtgcggtgcattcgatgactaacgccgtcactattcgggaagctgaaatagaagtagaagggagctctcagttgcaaatctctttttcgacggaccttttgggacagcggtg

SEQ ID NO: 10710 - DNA, 140 bp, Artificial Sequence
  Synthetic
caccgctgtcccaaaaggtccgtcgaaaaagagatttgcaactgagagctcccttctacttctatttcagcttcccgaatagtgacggcgttagtcatcgaatgcaccgcacacttgcctcatatcagcagccagggcct

SEQ ID NO: 10711 - DNA, 140 bp, Artificial Sequence
  Synthetic
atacgccatgctgggtctcccgtcacacaccaccctcggggtccaagacatttccgctacggcaatgtcatgggtgcagaagatcacgggaggtgtgggactggttgtcgctgttgcagccgtacttgggagtcggccat

SEQ ID NO: 10712 - DNA, 140 bp, Artificial Sequence
  Synthetic
atggccgactcccaagtacggctgcaacagcgacaaccagtcccacacctcccgtgatcttctgcacccatgacattgccgtagcggaaatgtcttggaccccgagggtggtgtgtgacgggagacccagcatggcgtat

SEQ ID NO: 10713 - DNA, 140 bp, Artificial Sequence
  Synthetic
atacgccatgctgggtctccacaactaggtatgaaggcatatgcgtccctaaagagacacaccacatacagctaagaatcaatagataagtatagatcaaagggctgaacaacccctgaacgtacttgggagtcggccat

SEQ ID NO: 10714 - DNA, 140 bp, Artificial Sequence
  Synthetic
atggccgactcccaagtacgttcaggggttgttcagccctttgatctatacttatctattgattcttagctgtatgtggtgtgtctctttagggacgcatatgccttcatacctagttgtggagacccagcatggcgtat

SEQ ID NO: 10715 - DNA, 140 bp, Artificial Sequence
  Synthetic
aggccctggctgctgatatggctaagaatcaatagataagtatagatcaaagggctgaacaacccctgaatagtaacaaaatataaaaatcaacaaaaattataaaatagaaaactagaggaccttttgggacagcggtg

SEQ ID NO: 10716 - DNA, 140 bp, Artificial Sequence
  Synthetic
caccgctgtcccaaaaggtcctctagttttctattttataatttttgttgatttttatattttgttactattcaggggttgttcagccctttgatctatacttatctattgattcttagccatatcagcagccagggcct

SEQ ID NO: 10717 - DNA, 140 bp, Artificial Sequence
  Synthetic
aggccctggctgctgatatgggatgtgcatgtgtgcacgacgcagatgcatcacaccgtatgaactgacaccaggagctaccgtccctttcctgctcagcctaatatgctgcatcagaacgaccttttgggacagcggtg

SEQ ID NO: 10718 - DNA, 140 bp, Artificial Sequence
  Synthetic
caccgctgtcccaaaaggtcgttctgatgcagcatattaggctgagcaggaaagggacggtagctcctggtgtcagttcatacggtgtgatgcatctgcgtcgtgcacacatgcacatcccatatcagcagccagggcct

SEQ ID NO: 10719 - DNA, 140 bp, Artificial Sequence
  Synthetic
atacgccatgctgggtctccatagaagtaggttagaaggtatatgtgtcccctaagagacacactatatatagctaagaatcaatagataagcatagatcaaagggctgaataacccctgcgtacttgggagtcggccat

SEQ ID NO: 10720 - DNA, 140 bp, Artificial Sequence
  Synthetic
atggccgactcccaagtacgcaggggttattcagccctttgatctatgcttatctattgattcttagctatatatagtgtgtctcttaggggacacatataccttctaacctacttctatggagacccagcatggcgtat

SEQ ID NO: 10721 - DNA, 140 bp, Artificial Sequence
  Synthetic
aggccctggctgctgatatgacggaagagatgtaggtacttaagcttcctaaaagcagccgaactcactttgagaagtaggcatagcataccgaactcttccacgatttcgaaaccacacgaccttttgggacagcggtg

SEQ ID NO: 10722 - DNA, 140 bp, Artificial Sequence
  Synthetic
caccgctgtcccaaaaggtcgtgtggtttcgaaatcgtggaagagttcggtatgctatgcctacttctcaaagtgagttcggctgcttttaggaagcttaagtacctacatctcttccgtcatatcagcagccagggcct

SEQ ID NO: 10723 - DNA, 140 bp, Artificial Sequence
  Synthetic
atacgccatgctgggtctcctaaaactaataaaaaccaaacgaataccataattggcaattggaagagatgtaggtacttaagcttcctaaaagcagccgaactcgctttgagatgtaggcgtacttgggagtcggccat

SEQ ID NO: 10724 - DNA, 140 bp, Artificial Sequence
  Synthetic
atggccgactcccaagtacgcctacatctcaaagcgagttcggctgcttttaggaagcttaagtacctacatctcttccaattgccaattatggtattcgtttggtttttattagttttaggagacccagcatggcgtat

SEQ ID NO: 10725 - DNA, 140 bp, Artificial Sequence
  Synthetic
aggccctggctgctgatatggtaggtacttaagcttcctaaaagcagccgaactcgctttgagatgtaggcgtagcacaccgaactcttccataattctccgaacccatagggacgtagggaccttttgggacagcggtg

SEQ ID NO: 10726 - DNA, 140 bp, Artificial Sequence
  Synthetic
caccgctgtcccaaaaggtccctacgtccctatgggttcggagaattatggaagagttcggtgtgctacgcctacatctcaaagcgagttcggctgcttttaggaagcttaagtacctaccatatcagcagccagggcct

SEQ ID NO: 10727 - DNA, 140 bp, Artificial Sequence
  Synthetic
atacgccatgctgggtctcctggatgcaacagaccagtcgacgtgttgtacgtagacgaggcgtttgcgtgccactctggaacgctacttgctttgatcgccctggtgagaccaaggcagcgtacttgggagtcggccat

SEQ ID NO: 10728 - DNA, 140 bp, Artificial Sequence
  Synthetic
atggccgactcccaagtacgctgccttggtctcaccagggcgatcaaagcaagtagcgttccagagtggcacgcaaacgcctcgtctacgtacaacacgtcgactggtctgttgcatccaggagacccagcatggcgtat

SEQ ID NO: 10729 - DNA, 140 bp, Artificial Sequence
  Synthetic
aggccctggctgctgatatgagagacgtaggtacttaagcttcctaaaagtagccgaactcactttgagacgtaggcgtagcataccgaactcttccacaattctccgtacccataggacgaccttttgggacagcggtg

SEQ ID NO: 10730 - DNA, 140 bp, Artificial Sequence
  Synthetic
caccgctgtcccaaaaggtcgtcctatgggtacggagaattgtggaagagttcggtatgctacgcctacgtctcaaagtgagttcggctacttttaggaagcttaagtacctacgtctctcatatcagcagccagggcct

SEQ ID NO: 10731 - DNA, 140 bp, Artificial Sequence
  Synthetic
aggccctggctgctgatatgttcttactgctctactctgcaaagcaagagattaataacccatcatggatcctgtgtacgtggacatagacgctgacagcgcctttttgaaggccctgcagaccttttgggacagcggtg

SEQ ID NO: 10732 - DNA, 140 bp, Artificial Sequence
  Synthetic
caccgctgtcccaaaaggtctgcagggccttcaaaaaggcgctgtcagcgtctatgtccacgtacacaggatccatgatgggttattaatctcttgctttgcagagtagagcagtaagaacatatcagcagccagggcct

SEQ ID NO: 10733 - DNA, 140 bp, Artificial Sequence
  Synthetic
atacgccatgctgggtctccgtaggctacgtgtgacacacgtagcctaccagtttcttactgctctactctgcaaagcaagagattaagaacccatcatggatcctgtgtacgtggacatcgtacttgggagtcggccat

SEQ ID NO: 10734 - DNA, 140 bp, Artificial Sequence
  Synthetic
atggccgactcccaagtacgatgtccacgtacacaggatccatgatgggttcttaatctcttgctttgcagagtagagcagtaagaaactggtaggctacgtgtgtcacacgtagcctacggagacccagcatggcgtat

SEQ ID NO: 10735 - DNA, 140 bp, Artificial Sequence
  Synthetic
atacgccatgctgggtctccttgaggtggaacccaggcaggtcacaccgaatgaccatgctaatgctagagcgttctcgcatctagctataaaactaatagagcaggaaattgatcccgacgtacttgggagtcggccat

SEQ ID NO: 10736 - DNA, 140 bp, Artificial Sequence
  Synthetic
atggccgactcccaagtacgtcgggatcaatttcctgctctattagttttatagctagatgcgagaacgctctagcattagcatggtcattcggtgtgacctgcctgggttccacctcaaggagacccagcatggcgtat

SEQ ID NO: 10737 - DNA, 140 bp, Artificial Sequence
  Synthetic
atacgccatgctgggtctccacaagcagtaatggccgtgccagacaaggagacgccaacattctgcttacacacagacgtctcatgtagacagagagcagacgtcgctatataccaagaccgtacttgggagtcggccat

SEQ ID NO: 10738 - DNA, 140 bp, Artificial Sequence
  Synthetic
atggccgactcccaagtacggtcttggtatatagcgacgtctgctctctgtctacatgagacgtctgtgtgtaagcagaatgttggcgtctccttgtctggcacggccattactgcttgtggagacccagcatggcgtat

SEQ ID NO: 10739 - DNA, 140 bp, Artificial Sequence
  Synthetic
aggccctggctgctgatatgacacagacgtctcatgtagacagagagcagacgtcgctatataccaagacgtctatgctgtacacgcacccacgtcgctataccaccaggcgattaaagggaccttttgggacagcggtg

SEQ ID NO: 10740 - DNA, 140 bp, Artificial Sequence
  Synthetic
caccgctgtcccaaaaggtccctttaatcgcctggtggtatagcgacgtgggtgcgtgtacagcatagacgtcttggtatatagcgacgtctgctctctgtctacatgagacgtctgtgtcatatcagcagccagggcct

SEQ ID NO: 10741 - DNA, 140 bp, Artificial Sequence
  Synthetic
aggccctggctgctgatatgacaggaagtaccactgcgtctgcccgatgcgcagcgcagaagatcccgagagactcgccaattatgcgagaaagctagcatctgctgcaggaaaagtcctgaccttttgggacagcggtg

SEQ ID NO: 10742 - DNA, 140 bp, Artificial Sequence
  Synthetic
caccgctgtcccaaaaggtcaggacttttcctgcagcagatgctagctttctcgcataattggcgagtctctcgggatcttctgcgctgcgcatcgggcagacgcagtggtacttcctgtcatatcagcagccagggcct

SEQ ID NO: 10743 - DNA, 140 bp, Artificial Sequence
  Synthetic
aggccctggctgctgatatggcgttctcgcatctagctataaaactaatagagcaggaaattgatcccgactcaaccatcctggacatcggcagtgcaccagcaaggaggatgatgtcgggaccttttgggacagcggtg

SEQ ID NO: 10744 - DNA, 140 bp, Artificial Sequence
  Synthetic
caccgctgtcccaaaaggtcccgacatcatcctccttgctggtgcactgccgatgtccaggatggttgagtcgggatcaatttcctgctctattagttttatagctagatgcgagaacgccatatcagcagccagggcct

SEQ ID NO: 10745 - DNA, 140 bp, Artificial Sequence
  Synthetic
atacgccatgctgggtctccggacagaaacatctctggaaagatcggggacttacaagcagtaatggccgtgccagacacggagacgccaacattctgcttgcacacagatgtctcatgtcgtacttgggagtcggccat

SEQ ID NO: 10746 - DNA, 140 bp, Artificial Sequence
  Synthetic
atggccgactcccaagtacgacatgagacatctgtgtgcaagcagaatgttggcgtctccgtgtctggcacggccattactgcttgtaagtccccgatctttccagagatgtttctgtccggagacccagcatggcgtat

SEQ ID NO: 10747 - DNA, 140 bp, Artificial Sequence
  Synthetic
atacgccatgctgggtctccgggtagggttcgacacaaccccgttcatgtacaatgccatggcgggtgcctacccctcatattcgacaaactgggcagacgagcaggtactgaaggctaacgtacttgggagtcggccat

SEQ ID NO: 10748 - DNA, 140 bp, Artificial Sequence
  Synthetic
atggccgactcccaagtacgttagccttcagtacctgctcgtctgcccagtttgtcgaatatgaggggtaggcacccgccatggcattgtacatgaacggggttgtgtcgaaccctacccggagacccagcatggcgtat

SEQ ID NO: 10749 - DNA, 140 bp, Artificial Sequence
  Synthetic
aggccctggctgctgatatggcgaccgtgtgctgttctcagtagggtcaacgctctacccggaaagccgcaagctacttaagagctggcacctgccatcggtgttccatttaaagggcaagaccttttgggacagcggtg

SEQ ID NO: 10750 - DNA, 140 bp, Artificial Sequence
  Synthetic
caccgctgtcccaaaaggtcttgccctttaaatggaacaccgatggcaggtgccagctcttaagtagcttgcggctttccgggtagagcgttgaccctactgagaacagcacacggtcgccatatcagcagccagggcct

SEQ ID NO: 10751 - DNA, 140 bp, Artificial Sequence
  Synthetic
atacgccatgctgggtctccgaacataggattatgttcaacagacctgacggaaggtagacgaggtaaattgtctattatgagagggaagaagctaaaaccgtgtgaccgtgtgctgttccgtacttgggagtcggccat

SEQ ID NO: 10752 - DNA, 140 bp, Artificial Sequence
  Synthetic
atggccgactcccaagtacggaacagcacacggtcacacggttttagcttcttccctctcataatagacaatttacctcgtctaccttccgtcaggtctgttgaacataatcctatgttcggagacccagcatggcgtat

SEQ ID NO: 10753 - DNA, 140 bp, Artificial Sequence
  Synthetic
atacgccatgctgggtctcctcagtagggtcaacgctctacccggaaagccgcaagctacttaagagctggcacttaccatcggtgttccatctaaagggcaaactcagcttcacatgcccgtacttgggagtcggccat

SEQ ID NO: 10754 - DNA, 140 bp, Artificial Sequence
  Synthetic
atggccgactcccaagtacgggcatgtgaagctgagtttgccctttagatggaacaccgatggtaagtgccagctcttaagtagcttgcggctttccgggtagagcgttgaccctactgaggagacccagcatggcgtat

SEQ ID NO: 10755 - DNA, 140 bp, Artificial Sequence
  Synthetic
aggccctggctgctgatatgtcgttaagagaataacgatgagcccaggcctttatggaaaaaccacagggtatgcggtaacccaccacgcagacggattcctgatgtgcaagactaccgagaccttttgggacagcggtg

SEQ ID NO: 10756 - DNA, 140 bp, Artificial Sequence
  Synthetic
caccgctgtcccaaaaggtctcggtagtcttgcacatcaggaatccgtctgcgtggtgggttaccgcataccctgtggtttttccataaaggcctgggctcatcgttattctcttaacgacatatcagcagccagggcct

SEQ ID NO: 10757 - DNA, 140 bp, Artificial Sequence
  Synthetic
aggccctggctgctgatatgatacccagtcaattcagaaggttcaggccgagtttgacagctttgtggtaccgagtctgtggtcgtccgggttgtcaatccctttgaggactagaatcaagaccttttgggacagcggtg

SEQ ID NO: 10758 - DNA, 140 bp, Artificial Sequence
  Synthetic
caccgctgtcccaaaaggtcttgattctagtcctcaaagggattgacaacccggacgaccacagactcggtaccacaaagctgtcaaactcggcctgaaccttctgaattgactgggtatcatatcagcagccagggcct

SEQ ID NO: 10759 - DNA, 140 bp, Artificial Sequence
  Synthetic
atacgccatgctgggtctccacgtggaacagcttgaggacagagcgggtgcaggaataatagagactcctagaggagctatcaaagttactgcccaaccaacagaccacgtcgtgggagacgtacttgggagtcggccat

SEQ ID NO: 10760 - DNA, 140 bp, Artificial Sequence
  Synthetic
atggccgactcccaagtacgtctcccacgacgtggtctgttggttgggcagtaactttgatagctcctctaggagtctctattattcctgcacccgctctgtcctcaagctgttccacgtggagacccagcatggcgtat

SEQ ID NO: 10761 - DNA, 140 bp, Artificial Sequence
  Synthetic
atacgccatgctgggtctcctaattcacgctttggcggagcaagtgaagacgtgcacgcacagcggacgagcagggaggtacgcggtcgaagcgtacgacggccgagtcctagtgccctccgtacttgggagtcggccat

SEQ ID NO: 10762 - DNA, 140 bp, Artificial Sequence
  Synthetic
atggccgactcccaagtacggagggcactaggactcggccgtcgtacgcttcgaccgcgtacctccctgctcgtccgctgtgcgtgcacgtcttcacttgctccgccaaagcgtgaattaggagacccagcatggcgtat

SEQ ID NO: 10763 - DNA, 140 bp, Artificial Sequence
  Synthetic
aggccctggctgctgatatgacgcccgagaagcccgggacgcagaaaaagaagcagaggaagaacgagaagcagaactgactcgcgaagccctaccacctctacaggcagcacaggaagagaccttttgggacagcggtg

SEQ ID NO: 10764 - DNA, 140 bp, Artificial Sequence
  Synthetic
caccgctgtcccaaaaggtctcttcctgtgctgcctgtagaggtggtagggcttcgcgagtcagttctgcttctcgttcttcctctgcttctttttctgcgtcccgggcttctcgggcgtcatatcagcagccagggcct

SEQ ID NO: 10765 - DNA, 140 bp, Artificial Sequence
  Synthetic
atacgccatgctgggtctcccgatggtgtataacgaaagagagttcgtaaacagaaagctacaccacattgcgatgcacggaccagccctgaacaccgacgaagagtcgtatgagctggtcgtacttgggagtcggccat

SEQ ID NO: 10766 - DNA, 140 bp, Artificial Sequence
  Synthetic
atggccgactcccaagtacgaccagctcatacgactcttcgtcggtgttcagggctggtccgtgcatcgcaatgtggtgtagctttctgtttacgaactctctttcgttatacaccatcgggagacccagcatggcgtat

SEQ ID NO: 10767 - DNA, 140 bp, Artificial Sequence
  Synthetic
aggccctggctgctgatatggcacgcacaacggacgagcagggaggtatgcggtcgaagcgtacgacggccgagtcctagtgccctcaggctatgcaatctcgcctgaagacttccagaggaccttttgggacagcggtg

SEQ ID NO: 10768 - DNA, 140 bp, Artificial Sequence
  Synthetic
caccgctgtcccaaaaggtcctctggaagtcttcaggcgagattgcatagcctgagggcactaggactcggccgtcgtacgcttcgaccgcatacctccctgctcgtccgttgtgcgtgccatatcagcagccagggcct

SEQ ID NO: 10769 - DNA, 140 bp, Artificial Sequence
  Synthetic
atacgccatgctgggtctccatggatgcaacaggccagtcgacgtgttgtacgtagacgaggcgtttgcgtgccactctggaacgttacttgctttgatcgccttggttagaccaaggcacgtacttgggagtcggccat

SEQ ID NO: 10770 - DNA, 140 bp, Artificial Sequence
  Synthetic
atggccgactcccaagtacgtgccttggtctaaccaaggcgatcaaagcaagtaacgttccagagtggcacgcaaacgcctcgtctacgtacaacacgtcgactggcctgttgcatccatggagacccagcatggcgtat

SEQ ID NO: 10771 - DNA, 140 bp, Artificial Sequence
  Synthetic
aggccctggctgctgatatgtgccactctggaacgttacttgctttgatcgccttggttagaccaaggcagaaagttgtactctgtggtgacccgaagcagtgcggcttcttcaatatgagaccttttgggacagcggtg

SEQ ID NO: 10772 - DNA, 140 bp, Artificial Sequence
  Synthetic
caccgctgtcccaaaaggtctcatattgaagaagccgcactgcttcgggtcaccacagagtacaactttctgccttggtctaaccaaggcgatcaaagcaagtaacgttccagagtggcacatatcagcagccagggcct

SEQ ID NO: 10773 - DNA, 140 bp, Artificial Sequence
  Synthetic
aggccctggctgctgatatgatacgaggtcatgacagcagccgcatcccaagggttaaccagaaaaggagtttatgcagttaggcaaaaagttaatgaaaacccgctctatgcatcaacggaccttttgggacagcggtg

SEQ ID NO: 10774 - DNA, 140 bp, Artificial Sequence
  Synthetic
caccgctgtcccaaaaggtccgttgatgcatagagcgggttttcattaactttttgcctaactgcataaactccttttctggttaacccttgggatgcggctgctgtcatgacctcgtatcatatcagcagccagggcct

SEQ ID NO: 10775 - DNA, 140 bp, Artificial Sequence
  Synthetic
aggccctggctgctgatatgcttcggagtaccgggatctggcaagtcagctattatcaagaacctagttaccaggcaggacctggtgactagcggaaagaaagaaaactgccaagaaatcgaccttttgggacagcggtg

SEQ ID NO: 10776 - DNA, 140 bp, Artificial Sequence
  Synthetic
caccgctgtcccaaaaggtcgatttcttggcagttttctttctttccgctagtcaccaggtcctgcctggtaactaggttcttgataatagctgacttgccagatcccggtactccgaagcatatcagcagccagggcct

SEQ ID NO: 10777 - DNA, 140 bp, Artificial Sequence
  Synthetic
atacgccatgctgggtctccaaggaaacttcaaagcaactatcaaggagtgggaggtggagcatgcatcaataatggcgggcatctgcagtcaccaaatgacctttgatacattccaaaacgtacttgggagtcggccat

SEQ ID NO: 10778 - DNA, 140 bp, Artificial Sequence
  Synthetic
atggccgactcccaagtacgttttggaatgtatcaaaggtcatttggtgactgcagatgcccgccattattgatgcatgctccacctcccactccttgatagttgctttgaagtttccttggagacccagcatggcgtat

SEQ ID NO: 10779 - DNA, 140 bp, Artificial Sequence
  Synthetic
atacgccatgctgggtctcccaaagccaatgtttgttgggctaagagcttggtccctatcctcgaaacagcggggataaaactaaatgataggcagtggtcccagataattcaagccttccgtacttgggagtcggccat

SEQ ID NO: 10780 - DNA, 140 bp, Artificial Sequence
  Synthetic
atggccgactcccaagtacggaaggcttgaattatctgggaccactgcctatcatttagttttatccccgctgtttcgaggatagggaccaagctcttagcccaacaaacattggctttgggagacccagcatggcgtat

SEQ ID NO: 10781 - DNA, 140 bp, Artificial Sequence
  Synthetic
atacgccatgctgggtctccaaagaagataaagcatactcacctgaagtagccctgaatgaaatatgcacgcgcatgtatggggtggatttagacagtgggctattttctaaaccattggcgtacttgggagtcggccat

SEQ ID NO: 10782 - DNA, 140 bp, Artificial Sequence
  Synthetic
atggccgactcccaagtacgccaatggtttagaaaatagcccactgtctaaatccaccccatacatgcgcgtgcatatttcattcagggctacttcaggtgagtatgctttatcttctttggagacccagcatggcgtat

SEQ ID NO: 10783 - DNA, 140 bp, Artificial Sequence
  Synthetic
aggccctggctgctgatatggcacccaagtgtaccacaaaagtatctccaggcggtgtacactgcctgtgaccgccattgtgtcatcgttgcattacgaaggcaaaatgcgcactacgaagaccttttgggacagcggtg

SEQ ID NO: 10784 - DNA, 140 bp, Artificial Sequence
  Synthetic
caccgctgtcccaaaaggtcttcgtagtgcgcattttgccttcgtaatgcaacgatgacacaatggcggtcacaggcagtgtacaccgcctggagatacttttgtggtacacttgggtgccatatcagcagccagggcct

SEQ ID NO: 10785 - DNA, 140 bp, Artificial Sequence
  Synthetic
aggccctggctgctgatatgtgagtacaacaagccgattgtagtggacactacaggctcaacaaaacctgaccctggagacctcgtgttaacgtgcttcagagggtgggttaaacaactggaccttttgggacagcggtg

SEQ ID NO: 10786 - DNA, 140 bp, Artificial Sequence
  Synthetic
caccgctgtcccaaaaggtccagttgtttaacccaccctctgaagcacgttaacacgaggtctccagggtcaggttttgttgagcctgtagtgtccactacaatcggcttgttgtactcacatatcagcagccagggcct

SEQ ID NO: 10787 - DNA, 140 bp, Artificial Sequence
  Synthetic
aggccctggctgctgatatgattcacaaaagggaagtggaacatcaacaagcagatctgcgtgaccaccaggaggatagaagactttaaccctaccaccaatattataccggccaatagggaccttttgggacagcggtg

SEQ ID NO: 10788 - DNA, 140 bp, Artificial Sequence
  Synthetic
caccgctgtcccaaaaggtccctattggccggtataatattggtggtagggttaaagtcttctatcctcctggtggtcacgcagatctgcttgttgatgttccacttcccttttgtgaatcatatcagcagccagggcct

SEQ ID NO: 10789 - DNA, 140 bp, Artificial Sequence
  Synthetic
aggccctggctgctgatatggttaaccagaaaaggagtttacgcagttagacaaaaagttaatgaaaacccgctctatgcatcaacgtcagagcacgtcaacgtactcctaacgcgtacggaccttttgggacagcggtg

SEQ ID NO: 10790 - DNA, 140 bp, Artificial Sequence
  Synthetic
caccgctgtcccaaaaggtccgtacgcgttaggagtacgttgacgtgctctgacgttgatgcatagagcgggttttcattaactttttgtctaactgcgtaaactccttttctggttaaccatatcagcagccagggcct

SEQ ID NO: 10791 - DNA, 140 bp, Artificial Sequence
  Synthetic
aggccctggctgctgatatgaatggaatggctggttaataagataaacggccaccacgtgctcctggtcagtggctataatcttgtactgcctactaagagagtcacttgggtagcgccagaccttttgggacagcggtg

SEQ ID NO: 10792 - DNA, 140 bp, Artificial Sequence
  Synthetic
caccgctgtcccaaaaggtctggcgctacccaagtgactctcttagtaggcagtacaagattatagccactgaccaggagcacgtggtggccgtttatcttattaaccagccattccattcatatcagcagccagggcct

SEQ ID NO: 10793 - DNA, 140 bp, Artificial Sequence
  Synthetic
atacgccatgctgggtctccctaggtgtccgcggagcggactacacatacaacctagagttgggtctgccagcaacgcttggcaggtatgacctagtggtcataaacatccacacaccttcgtacttgggagtcggccat

SEQ ID NO: 10794 - DNA, 140 bp, Artificial Sequence
  Synthetic
atggccgactcccaagtacgaaggtgtgtggatgtttatgaccactaggtcatacctgccaagcgttgctggcagacccaactctaggttgtatgtgtagtccgctccgcggacacctagggagacccagcatggcgtat

SEQ ID NO: 10795 - DNA, 140 bp, Artificial Sequence
  Synthetic
aggccctggctgctgatatggatcagagcatatggttacgcagatagaaccagtgaacgagtcatctgcgtgttgggacgcaagttcagatcgtctagagcgttgaaaccaccatgtgtcgaccttttgggacagcggtg

SEQ ID NO: 10796 - DNA, 140 bp, Artificial Sequence
  Synthetic
caccgctgtcccaaaaggtcgacacatggtggtttcaacgctctagacgatctgaacttgcgtcccaacacgcagatgactcgttcactggttctatctgcgtaaccatatgctctgatccatatcagcagccagggcct

SEQ ID NO: 10797 - DNA, 140 bp, Artificial Sequence
  Synthetic
aggccctggctgctgatatgttcgatacattccaaaataaagccaacgtttgttgggctaagagcttggtccctatcctcgaaacagcggggataaaactaaatgataggcagtggtctcgaccttttgggacagcggtg

SEQ ID NO: 10798 - DNA, 140 bp, Artificial Sequence
  Synthetic
caccgctgtcccaaaaggtcgagaccactgcctatcatttagttttatccccgctgtttcgaggatagggaccaagctcttagcccaacaaacgttggctttattttggaatgtatcgaacatatcagcagccagggcct

SEQ ID NO: 10799 - DNA, 140 bp, Artificial Sequence
  Synthetic
aggccctggctgctgatatgagataattcaagccttcaaagaagacaaagcatactcacctgaagtagccctgaatgaaatatgtacgcgcatgtatggggtggatctagacagcgggctgaccttttgggacagcggtg

SEQ ID NO: 10800 - DNA, 140 bp, Artificial Sequence
  Synthetic
caccgctgtcccaaaaggtcagcccgctgtctagatccaccccatacatgcgcgtacatatttcattcagggctacttcaggtgagtatgctttgtcttctttgaaggcttgaattatctcatatcagcagccagggcct

SEQ ID NO: 10801 - DNA, 140 bp, Artificial Sequence
  Synthetic
aggccctggctgctgatatgtaggacaggccacccgagcaggatgtgcaccgtcgtaccgggtaaaacgcatggacatcgcgaagaacgatgaagagtgcgtagttaacgccgctaacccgaccttttgggacagcggtg

SEQ ID NO: 10802 - DNA, 140 bp, Artificial Sequence
  Synthetic
caccgctgtcccaaaaggtcgggttagcggcgttaactacgcactcttcatcgttcttcgcgatgtccatgcgttttacccggtacgacggtgcacatcctgctcgggtggcctgtcctacatatcagcagccagggcct

SEQ ID NO: 10803 - DNA, 140 bp, Artificial Sequence
  Synthetic
atacgccatgctgggtctcctcgcgggttaccgggtgacggtgtttgcaaggcagtatacaaaaaatggccggagtcctttaagaatagtgcaacaccagtgggaaccgcaaaaacagtccgtacttgggagtcggccat

SEQ ID NO: 10804 - DNA, 140 bp, Artificial Sequence
  Synthetic
atggccgactcccaagtacggactgtttttgcggttcccactggtgttgcactattcttaaaggactccggccattttttgtatactgccttgcaaacaccgtcacccggtaacccgcgaggagacccagcatggcgtat

SEQ ID NO: 10805 - DNA, 140 bp, Artificial Sequence
  Synthetic
atacgccatgctgggtctccatgtgcggtacgtatccagtaatccacgccgttggaccgaacttctctaattatttggaatctgaaggggaccgggaattggcagctgcctatcgagaagcgtacttgggagtcggccat

SEQ ID NO: 10806 - DNA, 140 bp, Artificial Sequence
  Synthetic
atggccgactcccaagtacgcttctcgataggcagctgccaattcccggtccccttcagattccaaataattagagaagttcggtccaacggcgtggattactggatacgtaccgcacatggagacccagcatggcgtat

SEQ ID NO: 10807 - DNA, 140 bp, Artificial Sequence
  Synthetic
aggccctggctgctgatatggatctgcgtgactaccaggaggatagaagactttaaccctaccaccaacatcataccgcccaacaggagactaccacactcattagtggccgaacaccgcgaccttttgggacagcggtg

SEQ ID NO: 10808 - DNA, 140 bp, Artificial Sequence
  Synthetic
caccgctgtcccaaaaggtcgcggtgttcggccactaatgagtgtggtagtctcctgttgggcggtatgatgttggtggtagggttaaagtcttctatcctcctggtagtcacgcagatccatatcagcagccagggcct

SEQ ID NO: 10809 - DNA, 140 bp, Artificial Sequence
  Synthetic
atacgccatgctgggtctcctcgcaaaggaagtaactagactgggagtaaatagtgtagctatacctctcctctccacaggtgtatactcaggagggaaagataggctgacccagtcactcgtacttgggagtcggccat

SEQ ID NO: 10810 - DNA, 140 bp, Artificial Sequence
  Synthetic
atggccgactcccaagtacgagtgactgggtcagcctatctttccctcctgagtatacacctgtggagaggagaggtatagctacactatttactcccagtctagttacttcctttgcgaggagacccagcatggcgtat

SEQ ID NO: 10811 - DNA, 140 bp, Artificial Sequence
  Synthetic
atacgccatgctgggtctccccacgtgctcctggtcagtggctataaccttgcactgcctactaagagagtcacttgggtagcgccgttaggtgtccgcggagcggactacacatacaaccgtacttgggagtcggccat

SEQ ID NO: 10812 - DNA, 140 bp, Artificial Sequence
  Synthetic
atggccgactcccaagtacggttgtatgtgtagtccgctccgcggacacctaacggcgctacccaagtgactctcttagtaggcagtgcaaggttatagccactgaccaggagcacgtggggagacccagcatggcgtat

SEQ ID NO: 10813 - DNA, 140 bp, Artificial Sequence
  Synthetic
atacgccatgctgggtctccgaaccacctcttcacagccatggactcgacggatgcagacgtggtcatctactgtcgcgacaaagaatgggagaagaaaatatccgaggccatacagatgcgtacttgggagtcggccat

SEQ ID NO: 10814 - DNA, 140 bp, Artificial Sequence
  Synthetic
atggccgactcccaagtacgcatctgtatggcctcggatattttcttctcccattctttgtcgcgacagtagatgaccacgtctgcatccgtcgagtccatggctgtgaagaggtggttcggagacccagcatggcgtat

SEQ ID NO: 10815 - DNA, 140 bp, Artificial Sequence
  Synthetic
atacgccatgctgggtctcctcacttgggtagcgccgttaggtgtccgcggagcggactacacatacaacctagagctgggtctgccagcaacgcttggtaggcatgaccttgtggtcatcgtacttgggagtcggccat

SEQ ID NO: 10816 - DNA, 140 bp, Artificial Sequence
  Synthetic
atggccgactcccaagtacgatgaccacaaggtcatgcctaccaagcgttgctggcagacccagctctaggttgtatgtgtagtccgctccgcggacacctaacggcgctacccaagtgaggagacccagcatggcgtat

SEQ ID NO: 10817 - DNA, 140 bp, Artificial Sequence
  Synthetic
aggccctggctgctgatatgactgtcgcgacaaagaatgggagaagaaaatatccgaggccatacagatgcggactcaagtggagttgctggatgagcacatctccatagactgcgatatgaccttttgggacagcggtg

SEQ ID NO: 10818 - DNA, 140 bp, Artificial Sequence
  Synthetic
caccgctgtcccaaaaggtcatatcgcagtctatggagatgtgctcatccagcaactccacttgagtccgcatctgtatggcctcggatattttcttctcccattctttgtcgcgacagtcatatcagcagccagggcct

SEQ ID NO: 10819 - DNA, 140 bp, Artificial Sequence
  Synthetic
aggccctggctgctgatatgacgcaatgaaactgcaaatgctcgggggtgactcattgagactgctcaaaccgggcggctctctattgatcagagcatatggttacgcagatagaaccaggaccttttgggacagcggtg

SEQ ID NO: 10820 - DNA, 140 bp, Artificial Sequence
  Synthetic
caccgctgtcccaaaaggtcctggttctatctgcgtaaccatatgctctgatcaatagagagccgcccggtttgagcagtctcaatgagtcacccccgagcatttgcagtttcattgcgtcatatcagcagccagggcct

SEQ ID NO: 10821 - DNA, 140 bp, Artificial Sequence
  Synthetic
aggccctggctgctgatatgccacggaaggcgcactgtactcatatctagaagggactcgttttcaccagacggcagtggacatggcagagatatatactatgtggccaaagcaaacagagaccttttgggacagcggtg

SEQ ID NO: 10822 - DNA, 140 bp, Artificial Sequence
  Synthetic
caccgctgtcccaaaaggtctctgtttgctttggccacatagtatatatctctgccatgtccactgccgtctggtgaaaacgagtcccttctagatatgagtacagtgcgccttccgtggcatatcagcagccagggcct

SEQ ID NO: 10823 - DNA, 140 bp, Artificial Sequence
  Synthetic
aggccctggctgctgatatgggccaacgagcaagtctgcctatatgccctgggggaaagtattgaatcgatcaggcagaaatgcccggtggatgatgcagatgcatcgtctcctccaaaagaccttttgggacagcggtg

SEQ ID NO: 10824 - DNA, 140 bp, Artificial Sequence
  Synthetic
caccgctgtcccaaaaggtcttttggaggagacgatgcatctgcatcatccaccgggcatttctgcctgatcgattcaatactttcccccagggcatataggcagacttgctcgttggcccatatcagcagccagggcct

SEQ ID NO: 10825 - DNA, 140 bp, Artificial Sequence
  Synthetic
atacgccatgctgggtctccactgtcccgtgcctttgccgttacgccatgactccggaacgcgtcacccgacttcgcatgaaccacgtcacaagtataattgtgtgttcctcgtttcccccgtacttgggagtcggccat

SEQ ID NO: 10826 - DNA, 140 bp, Artificial Sequence
  Synthetic
atggccgactcccaagtacgggggaaacgaggaacacacaattatacttgtgacgtggttcatgcgaagtcgggtgacgcgttccggagtcatggcgtaacggcaaaggcacgggacagtggagacccagcatggcgtat

SEQ ID NO: 10827 - DNA, 140 bp, Artificial Sequence
  Synthetic
atacgccatgctgggtctccttccaaagtacaaaatagaaggagtgcaaaaagtcaaatgctctaaggtaatgctatttgaccacaacgtgccatcacgcgtaagtccaagggaatatagcgtacttgggagtcggccat

SEQ ID NO: 10828 - DNA, 140 bp, Artificial Sequence
  Synthetic
atggccgactcccaagtacgctatattcccttggacttacgcgtgatggcacgttgtggtcaaatagcattaccttagagcatttgactttttgcactccttctattttgtactttggaaggagacccagcatggcgtat

SEQ ID NO: 10829 - DNA, 140 bp, Artificial Sequence
  Synthetic
aggccctggctgctgatatgatgctatttgaccacaacgtgccatcacgcgtaagtccaagggaatatagatcttccccggaggctgcacaggaagcgagtacaaccacgtcactgacgcgaccttttgggacagcggtg

SEQ ID NO: 10830 - DNA, 140 bp, Artificial Sequence
  Synthetic
caccgctgtcccaaaaggtcgcgtcagtgacgtggttgtactcgcttcctgtgcagcctccggggaagatctatattcccttggacttacgcgtgatggcacgttgtggtcaaatagcatcatatcagcagccagggcct

SEQ ID NO: 10831 - DNA, 140 bp, Artificial Sequence
  Synthetic
aggccctggctgctgatatgggaccaaacttctctaattattcggagtctgaaggggaccgggaattggcagctgcctatcgagaagtcgcaaaggaagtaactaggctgggagtaaatagaccttttgggacagcggtg

SEQ ID NO: 10832 - DNA, 140 bp, Artificial Sequence
  Synthetic
caccgctgtcccaaaaggtctatttactcccagcctagttacttcctttgcgacttctcgataggcagctgccaattcccggtccccttcagactccgaataattagagaagtttggtcccatatcagcagccagggcct

SEQ ID NO: 10833 - DNA, 140 bp, Artificial Sequence
  Synthetic
aggccctggctgctgatatggatctggatgctgacgccccagccctagaaccagctctagacgacagggcgacacacacgttgccatccacaaccggaaaccttgcggccgtgtctgactgaccttttgggacagcggtg

SEQ ID NO: 10834 - DNA, 140 bp, Artificial Sequence
  Synthetic
caccgctgtcccaaaaggtcagtcagacacggccgcaaggtttccggttgtggatggcaacgtgtgtgtcgccctgtcgtctagagctggttctagggctggggcgtcagcatccagatccatatcagcagccagggcct

SEQ ID NO: 10835 - DNA, 140 bp, Artificial Sequence
  Synthetic
aggccctggctgctgatatgaggctgacccagtcactgaaccacctctttacagccatggactcgacggatgcagacgtggtcatctactgccgcgacaaagaatgggagaagaaaatatgaccttttgggacagcggtg

SEQ ID NO: 10836 - DNA, 140 bp, Artificial Sequence
  Synthetic
caccgctgtcccaaaaggtcatattttcttctcccattctttgtcgcggcagtagatgaccacgtctgcatccgtcgagtccatggctgtaaagaggtggttcagtgactgggtcagcctcatatcagcagccagggcct

SEQ ID NO: 10837 - DNA, 140 bp, Artificial Sequence
  Synthetic
atacgccatgctgggtctccacggaactgaatcatccgccgatctccttcggagcaccaagcgagacgttccccattacatttggggacttcaacgaaggagaaatcgaaagcttgtcttcgtacttgggagtcggccat

SEQ ID NO: 10838 - DNA, 140 bp, Artificial Sequence
  Synthetic
atggccgactcccaagtacgaagacaagctttcgatttctccttcgttgaagtccccaaatgtaatggggaacgtctcgcttggtgctccgaaggagatcggcggatgattcagttccgtggagacccagcatggcgtat

SEQ ID NO: 10839 - DNA, 140 bp, Artificial Sequence
  Synthetic
aggccctggctgctgatatgcagaaaaggatacagcaccacggaaggcgcactgtactcatatctagaagggacccgttttcatcagacggctgtggatatggcggagatacatactatggaccttttgggacagcggtg

SEQ ID NO: 10840 - DNA, 140 bp, Artificial Sequence
  Synthetic
caccgctgtcccaaaaggtccatagtatgtatctccgccatatccacagccgtctgatgaaaacgggtcccttctagatatgagtacagtgcgccttccgtggtgctgtatccttttctgcatatcagcagccagggcct

SEQ ID NO: 10841 - DNA, 140 bp, Artificial Sequence
  Synthetic
aggccctggctgctgatatgggacccgttttcatcagacggctgtggatatggcggagatacatactatgtggccaaagcaaacagaggccaatgagcaagtctgcctatatgccctggggaccttttgggacagcggtg

SEQ ID NO: 10842 - DNA, 140 bp, Artificial Sequence
  Synthetic
caccgctgtcccaaaaggtccccagggcatataggcagacttgctcattggcctctgtttgctttggccacatagtatgtatctccgccatatccacagccgtctgatgaaaacgggtcccatatcagcagccagggcct

SEQ ID NO: 10843 - DNA, 140 bp, Artificial Sequence
  Synthetic
aggccctggctgctgatatggaagtccacgaggagaagtgttacccacctaagttggatgaagtaaaggagcaactattacttaagaaactccaggagagtgcatccatggccaacagaagaccttttgggacagcggtg

SEQ ID NO: 10844 - DNA, 140 bp, Artificial Sequence
  Synthetic
caccgctgtcccaaaaggtcttctgttggccatggatgcactctcctggagtttcttaagtaatagttgctcctttacttcatccaacttaggtgggtaacacttctcctcgtggacttccatatcagcagccagggcct

SEQ ID NO: 10845 - DNA, 140 bp, Artificial Sequence
  Synthetic
aggccctggctgctgatatgagactaaagagaggctgtagactatacttaatgtcagagacctcaaaagtccctacttaccggaccacatatccggcgcatgtgtactcgcctccgatcagaccttttgggacagcggtg

SEQ ID NO: 10846 - DNA, 140 bp, Artificial Sequence
  Synthetic
caccgctgtcccaaaaggtctgatcggaggcgagtacacatgcgccggatatgtggtccggtaagtagggacttttgaggtctctgacattaagtatagtctacagcctctctttagtctcatatcagcagccagggcct

SEQ ID NO: 10847 - DNA, 140 bp, Artificial Sequence
  Synthetic
aggccctggctgctgatatgagactaaagagaggctgtagactatacttaatgtcagagacctcaaaagtccctacttaccggaccacatatccggcgcttgtgtactcgcctccgatcagaccttttgggacagcggtg

SEQ ID NO: 10848 - DNA, 140 bp, Artificial Sequence
  Synthetic
caccgctgtcccaaaaggtctgatcggaggcgagtacacaagcgccggatatgtggtccggtaagtagggacttttgaggtctctgacattaagtatagtctacagcctctctttagtctcatatcagcagccagggcct

SEQ ID NO: 10849 - DNA, 140 bp, Artificial Sequence; identical to SEQ ID NO: 6145
  Synthetic

SEQ ID NO: 10850 - DNA, 140 bp, Artificial Sequence; identical to SEQ ID NO: 6146
  Synthetic

SEQ ID NO: 10851 - DNA, 140 bp, Artificial Sequence
  Synthetic
aggccctggctgctgatatgagactaaagagaggctgtagactatacttaatgtcagagacctcaaaagtccctacttaccggaccacatatccggcgcgtgtgtactcgcctccgatcagaccttttgggacagcggtg

SEQ ID NO: 10852 - DNA, 140 bp, Artificial Sequence
  Synthetic
caccgctgtcccaaaaggtctgatcggaggcgagtacacacgcgccggatatgtggtccggtaagtagggacttttgaggtctctgacattaagtatagtctacagcctctctttagtctcatatcagcagccagggcct

SEQ ID NO: 10853 - DNA, 140 bp, Artificial Sequence
  Synthetic
atacgccatgctgggtctccacgtccgactgtccaaccccgagtccgcagtggcagcatgcaatgagttcctagctagaaactatccaactgtctcatcataccaaattaccgacgagtacgtacttgggagtcggccat

SEQ ID NO: 10854 - DNA, 140 bp, Artificial Sequence
  Synthetic
atggccgactcccaagtacgtactcgtcggtaatttggtatgatgagacagttggatagtttctagctaggaactcattgcatgctgccactgcggactcggggttggacagtcggacgtggagacccagcatggcgtat

SEQ ID NO: 10855 - DNA, 140 bp, Artificial Sequence
  Synthetic
atacgccatgctgggtctcctgatgcatatttagacatggtggacgggtcggagagttgcctggatcgagcgacattcaatccgtcaaaacttaggagctacccgaaacagcacgcttaccgtacttgggagtcggccat

SEQ ID NO: 10856 - DNA, 140 bp, Artificial Sequence
  Synthetic
atggccgactcccaagtacggtaagcgtgctgtttcgggtagctcctaagttttgacggattgaatgtcgctcgatccaggcaactctccgacccgtccaccatgtctaaatatgcatcaggagacccagcatggcgtat

SEQ ID NO: 10857 - DNA, 140 bp, Artificial Sequence
  Synthetic
aggccctggctgctgatatgtgagggaattacccactttggactcagcagtattcaacgtggagtgttttaaaaaattcgcatgcaaccaagaatactgggaagaatttgctgccagcccgaccttttgggacagcggtg

SEQ ID NO: 10858 - DNA, 140 bp, Artificial Sequence
  Synthetic
caccgctgtcccaaaaggtcgggctggcagcaaattcttcccagtattcttggttgcatgcgaattttttaaaacactccacgttgaatactgctgagtccaaagtgggtaattccctcacatatcagcagccagggcct

SEQ ID NO: 10859 - DNA, 140 bp, Artificial Sequence
  Synthetic
aggccctggctgctgatatgtattaggataacaactgagaatttaacaacctatgttactaaactaaaagggccaaaagcagcagcgctatttgcaaaaacccacaatctgctgccactggaccttttgggacagcggtg

SEQ ID NO: 10860 - DNA, 140 bp, Artificial Sequence
  Synthetic
caccgctgtcccaaaaggtccagtggcagcagattgtgggtttttgcaaatagcgctgctgcttttggcccttttagtttagtaacataggttgttaaattctcagttgttatcctaatacatatcagcagccagggcct

SEQ ID NO: 10861 - DNA, 140 bp, Artificial Sequence
  Synthetic
atacgccatgctgggtctcccaggaagtaccaatggataggttcacagtagatatgaaaagggacgtgaaggtgactcctggtacaaagcacacagaggaaagacctaaggtgcaggttacgtacttgggagtcggccat

SEQ ID NO: 10862 - DNA, 140 bp, Artificial Sequence
  Synthetic
atggccgactcccaagtacgtaacctgcaccttaggtctttcctctgtgtgctttgtaccaggagtcaccttcacgtcccttttcatatctactgtgaacctatccattggtacttcctgggagacccagcatggcgtat

SEQ ID NO: 10863 - DNA, 140 bp, Artificial Sequence
  Synthetic
atacgccatgctgggtctccgagctggttaggaggctgaacgccgtcctcctacccaatgtacatacactatttgatatgtctgccgaggatttcgatgccatcatagccgcacactttacgtacttgggagtcggccat

SEQ ID NO: 10864 - DNA, 140 bp, Artificial Sequence
  Synthetic
atggccgactcccaagtacgtaaagtgtgcggctatgatggcatcgaaatcctcggcagacatatcaaatagtgtatgtacattgggtaggaggacggcgttcagcctcctaaccagctcggagacccagcatggcgtat

SEQ ID NO: 10865 - DNA, 140 bp, Artificial Sequence
  Synthetic
aggccctggctgctgatatgatttgatatgtctgccgaggatttcgatgccatcatagccgcacactttaagccaggagacactgttttagaaacggacatagcctcctttgacaagagcgaccttttgggacagcggtg

SEQ ID NO: 10866 - DNA, 140 bp, Artificial Sequence
  Synthetic
caccgctgtcccaaaaggtcgctcttgtcaaaggaggctatgtccgtttctaaaacagtgtctcctggcttaaagtgtgcggctatgatggcatcgaaatcctcggcagacatatcaaatcatatcagcagccagggcct

SEQ ID NO: 10867 - DNA, 140 bp, Artificial Sequence
  Synthetic
atacgccatgctgggtctcccaagatgattcacttgcgcttactgccttgatgttgttagaagatttaggggtggatcactccctgttggacttgatagaggccgcttttggagagatttcgtacttgggagtcggccat

SEQ ID NO: 10868 - DNA, 140 bp, Artificial Sequence
  Synthetic
atggccgactcccaagtacgaaatctctccaaaagcggcctctatcaagtccaacagggagtgatccacccctaaatcttctaacaacatcaaggcagtaagcgcaagtgaatcatcttgggagacccagcatggcgtat

SEQ ID NO: 10869 - DNA, 140 bp, Artificial Sequence
  Synthetic
aggccctggctgctgatatgaaatctggtatgttcctaactctgttcgtcaacacattgctaaacatcaccatcgctagccgcgtgctggaagatcgtctgacaaaatccgcgtgcgcgggaccttttgggacagcggtg

SEQ ID NO: 10870 - DNA, 140 bp, Artificial Sequence
  Synthetic
caccgctgtcccaaaaggtcccgcgcacgcggattttgtcagacgatcttccagcacgcggctagcgatggtgatgtttagcaatgtgttgacgaacagagttaggaacataccagatttcatatcagcagccagggcct

SEQ ID NO: 10871 - DNA, 140 bp, Artificial Sequence
  Synthetic
atacgccatgctgggtctcctgcagttgtatccttgaaagccccttacttttgtggagggtttatactgcacgatactgtgacgggaacagcctgcagagtggcagacccgctaaaaaggcgtacttgggagtcggccat

SEQ ID NO: 10872 - DNA, 140 bp, Artificial Sequence
  Synthetic
atggccgactcccaagtacgcctttttagcgggtctgccactctgcaggctgttcccgtcacagtatcgtgcagtataaaccctccacaaaagtaaggggctttcaaggatacaactgcaggagacccagcatggcgtat

SEQ ID NO: 10873 - DNA, 140 bp, Artificial Sequence
  Synthetic
atacgccatgctgggtctccaatactaattagctacaatggagtacatcccaacccaaactttttacaataggaggtaccagcctcgaccctggactccgcgccccactatccaagtaatcgtacttgggagtcggccat

SEQ ID NO: 10874 - DNA, 140 bp, Artificial Sequence
  Synthetic
atggccgactcccaagtacgattacttggatagtggggcgcggagtccagggtcgaggctggtacctcctattgtaaaaagtttgggttgggatgtactccattgtagctaattagtattggagacccagcatggcgtat

SEQ ID NO: 10875 - DNA, 140 bp, Artificial Sequence
  Synthetic
aggccctggctgctgatatgaggaggtaccagcctcgaccctggactccgcgccccactatccaagtaatcaggcccagaccgcgccctcagaggcaagccgggcaacttgcccagctgagaccttttgggacagcggtg

SEQ ID NO: 10876 - DNA, 140 bp, Artificial Sequence
  Synthetic
caccgctgtcccaaaaggtctcagctgggcaagttgcccggcttgcctctgagggcgcggtctgggcctgattacttggatagtggggcgcggagtccagggtcgaggctggtacctcctcatatcagcagccagggcct

SEQ ID NO: 10877 - DNA, 140 bp, Artificial Sequence
  Synthetic
aggccctggctgctgatatgtctcagcagttaataaactgacaatgcgcgcggtaccccaacagaagccacgcaggaatcggaagaataagaagcaaaagcaaaagcgacaggcgccacagaccttttgggacagcggtg

SEQ ID NO: 10878 - DNA, 140 bp, Artificial Sequence
  Synthetic
caccgctgtcccaaaaggtctgtggcgcctgtcgcttttgcttttgcttcttattcttccgattcctgcgtggcttctgttggggtaccgcgcgcattgtcagtttattaactgctgagacatatcagcagccagggcct

SEQ ID NO: 10879 - DNA, 140 bp, Artificial Sequence
  Synthetic
aggccctggctgctgatatgagaaaaagaagccgggccgcagagagaggatgtgcatgaaaatcgaaaatgattgtatttttgaagtcaagtatgaaggtaaggtaacaggttacgcgtggaccttttgggacagcggtg

SEQ ID NO: 10880 - DNA, 140 bp, Artificial Sequence
  Synthetic
caccgctgtcccaaaaggtccacgcgtaacctgttaccttaccttcatacttgacttcaaaaatacaatcattttcgattttcatgcacatcctctctctgcggcccggcttctttttctcatatcagcagccagggcct

SEQ ID NO: 10881 - DNA, 140 bp, Artificial Sequence
  Synthetic
aggccctggctgctgatatgagtcttgccatcccagtcatgtgcctgctggcaaataccacgttcccctgctcccagcccccttgcactccctgctgctatgaaagggaaccagaggaaagaccttttgggacagcggtg

SEQ ID NO: 10882 - DNA, 140 bp, Artificial Sequence
  Synthetic
caccgctgtcccaaaaggtctttcctctggttccctttcatagcagcagggagtgcaagggggctgggagcaggggaacgtggtatttgccagcaggcacatgactgggatggcaagactcatatcagcagccagggcct

SEQ ID NO: 10883 - DNA, 140 bp, Artificial Sequence
  Synthetic
atacgccatgctgggtctccccctacgcatgcttgaggacaacgtcatgagacctgggtactatcagctgctacaagcatccttaacatgttctccccaccgtcagcgacgcagtaccaacgtacttgggagtcggccat

SEQ ID NO: 10884 - DNA, 140 bp, Artificial Sequence
  Synthetic
atggccgactcccaagtacgttggtactgcgtcgctgacggtggggagaacatgttaaggatgcttgtagcagctgatagtacccaggtctcatgacgttgtcctcaagcatgcgtagggggagacccagcatggcgtat

SEQ ID NO: 10885 - DNA, 140 bp, Artificial Sequence
  Synthetic
aggccctggctgctgatatgctacaagcatccttaacatgttctccccaccgtcagcgacgcagtaccaaggacaacttcaatgtctataaagccacaagaccgtacttagctcactgtcgaccttttgggacagcggtg

SEQ ID NO: 10886 - DNA, 140 bp, Artificial Sequence
  Synthetic
caccgctgtcccaaaaggtcgacagtgagctaagtacggtcttgtggctttatagacattgaagttgtccttggtactgcgtcgctgacggtggggagaacatgttaaggatgcttgtagcatatcagcagccagggcct

SEQ ID NO: 10887 - DNA, 140 bp, Artificial Sequence
  Synthetic
atacgccatgctgggtctccggacaacttcaatgtctataaagccacaagaccgtacttagctcactgtcccgactgtggagaagggcactcgtgccatagtcccgtagcattagaacgccgtacttgggagtcggccat

SEQ ID NO: 10888 - DNA, 140 bp, Artificial Sequence
  Synthetic
atggccgactcccaagtacggcgttctaatgctacgggactatggcacgagtgcccttctccacagtcgggacagtgagctaagtacggtcttgtggctttatagacattgaagttgtccggagacccagcatggcgtat

SEQ ID NO: 10889 - DNA, 140 bp, Artificial Sequence
  Synthetic
aggccctggctgctgatatgccgactgtggagaagggcactcgtgccatagtcccgtagcattagaacgcatcagaaatgaagcgacagacgggacgctgaaaatccaggtctccttgcagaccttttgggacagcggtg

SEQ ID NO: 10890 - DNA, 140 bp, Artificial Sequence
  Synthetic
caccgctgtcccaaaaggtctgcaaggagacctggattttcagcgtcccgtctgtcgcttcatttctgatgcgttctaatgctacgggactatggcacgagtgcccttctccacagtcggcatatcagcagccagggcct

SEQ ID NO: 10891 - DNA, 140 bp, Artificial Sequence
  Synthetic
atacgccatgctgggtctcctggacaaccacacgccagcggacgcagagagggcggggctatttgtaagaacatcagcaccgtgcacgattactggaacaatgggacacttcatcctgaccgtacttgggagtcggccat

SEQ ID NO: 10892 - DNA, 140 bp, Artificial Sequence
  Synthetic
atggccgactcccaagtacggtcaggatgaagtgtcccattgttccagtaatcgtgcacggtgctgatgttcttacaaatagccccgccctctctgcgtccgctggcgtgtggttgtccaggagacccagcatggcgtat

SEQ ID NO: 10893 - DNA, 140 bp, Artificial Sequence
  Synthetic
aggccctggctgctgatatgagatcagtcactcatgtacgcacccatttcaccacgaccctcctgtgataggccgggagaaattccattcccgaccgcagcacggtaaagagctgccttggaccttttgggacagcggtg

SEQ ID NO: 10894 - DNA, 140 bp, Artificial Sequence
  Synthetic
caccgctgtcccaaaaggtccaaggcagctctttaccgtgctgcggtcgggaatggaatttctcccggcctatcacaggagggtcgtggtgaaatgggtgcgtacatgagtgactgatctcatatcagcagccagggcct

SEQ ID NO: 10895 - DNA, 140 bp, Artificial Sequence
  Synthetic
aggccctggctgctgatatgcagcacgtacgtgcagagcaccgccgcaactaccgaggagatagaggtacacatgcccccagacacccctgatcgcacattgatgtcacaacagtccggcgaccttttgggacagcggtg

SEQ ID NO: 10896 - DNA, 140 bp, Artificial Sequence
  Synthetic
caccgctgtcccaaaaggtcgccggactgttgtgacatcaatgtgcgatcaggggtgtctgggggcatgtgtacctctatctcctcggtagttgcggcggtgctctgcacgtacgtgctgcatatcagcagccagggcct

SEQ ID NO: 10897 - DNA, 140 bp, Artificial Sequence
  Synthetic
atacgccatgctgggtctccgcaaagttgatcaatgtcatgccgcggtcaccaatcacaaaaagtggcagtacaactcccctctggtcccgcgtaatgctgaacttggggaccgaaaaggcgtacttgggagtcggccat

SEQ ID NO: 10898 - DNA, 140 bp, Artificial Sequence
  Synthetic
atggccgactcccaagtacgccttttcggtccccaagttcagcattacgcgggaccagaggggagttgtactgccactttttgtgattggtgaccgcggcatgacattgatcaactttgcggagacccagcatggcgtat

SEQ ID NO: 10899 - DNA, 140 bp, Artificial Sequence
  Synthetic
aggccctggctgctgatatgtacaactcccctctggtcccgcgtaatgctgaacttggggaccgaaaaggaaaaatccacatcccgtttccgctggcaaatgtaacatgcagggtgcctagaccttttgggacagcggtg

SEQ ID NO: 10900 - DNA, 140 bp, Artificial Sequence
  Synthetic
caccgctgtcccaaaaggtctaggcaccctgcatgttacatttgccagcggaaacgggatgtggatttttccttttcggtccccaagttcagcattacgcgggaccagaggggagttgtacatatcagcagccagggcct

SEQ ID NO: 10901 - DNA, 140 bp, Artificial Sequence
  Synthetic
atacgccatgctgggtctccaagcaaggaaccccaccgtgacgtacgggaaaaaccaagtcatcatgctactgtatcccgaccacccaacactcctgtcctaccggaacatgggagaagacgtacttgggagtcggccat

SEQ ID NO: 10902 - DNA, 140 bp, Artificial Sequence
  Synthetic
atggccgactcccaagtacgtcttctcccatgttccggtaggacaggagtgttgggtggtcgggatacagtagcatgatgacttggtttttcccgtacgtcacggtggggttccttgcttggagacccagcatggcgtat

SEQ ID NO: 10903 - DNA, 140 bp, Artificial Sequence
  Synthetic
atacgccatgctgggtctccaccaaactaccaagaagagtgggtgacgcataagaaggaagtcgtgctaaccgtgccgactgaagggctcgaggtcacgtggggtaacaacgagccgtatcgtacttgggagtcggccat

SEQ ID NO: 10904 - DNA, 140 bp, Artificial Sequence
  Synthetic
atggccgactcccaagtacgatacggctcgttgttaccccacgtgacctcgagcccttcagtcggcacggttagcacgacttccttcttatgcgtcacccactcttcttggtagtttggtggagacccagcatggcgtat

SEQ ID NO: 10905 - DNA, 140 bp, Artificial Sequence
  Synthetic
aggccctggctgctgatatggcaacttgcccagctgatctcagcagttaataaactgacaatgcgcgcggtaccccaacagaagccacgcaggaatcggaagaataagaagcaaaagcaagaccttttgggacagcggtg

SEQ ID NO: 10906 - DNA, 140 bp, Artificial Sequence
  Synthetic
caccgctgtcccaaaaggtcttgcttttgcttcttattcttccgattcctgcgtggcttctgttggggtaccgcgcgcattgtcagtttattaactgctgagatcagctgggcaagttgccatatcagcagccagggcct

SEQ ID NO: 10907 - DNA, 140 bp, Artificial Sequence
  Synthetic
aggccctggctgctgatatgttgtgtcagtggcctcgttcgtactcctgtcgatggtgggtgtggcagtggggatgtgcatgtgtgcacgacgcagatgcatcacaccgtacgaactgacgaccttttgggacagcggtg

SEQ ID NO: 10908 - DNA, 140 bp, Artificial Sequence
  Synthetic
caccgctgtcccaaaaggtcgtcagttcgtacggtgtgatgcatctgcgtcgtgcacacatgcacatccccactgccacacccaccatcgacaggagtacgaacgaggccactgacacaacatatcagcagccagggcct

SEQ ID NO: 10909 - DNA, 140 bp, Artificial Sequence
  Synthetic
atacgccatgctgggtctccgggatgtgcatgtgtgcacgacgcagatgcatcacaccgtacgaactgacaccaggagctaccgtccctttcctgcttagcctaatatgctgcatcagaacgtacttgggagtcggccat

SEQ ID NO: 10910 - DNA, 140 bp, Artificial Sequence
  Synthetic
atggccgactcccaagtacgttctgatgcagcatattaggctaagcaggaaagggacggtagctcctggtgtcagttcgtacggtgtgatgcatctgcgtcgtgcacacatgcacatcccggagacccagcatggcgtat

SEQ ID NO: 10911 - DNA, 140 bp, Artificial Sequence
  Synthetic
aggccctggctgctgatatgtgtcccctaagagacacattgtatgtaggtgataagtatagatcaaagggccgaacaacccctgaatagtaacaaaatataaaaattaataaaatcataagaccttttgggacagcggtg

SEQ ID NO: 10912 - DNA, 140 bp, Artificial Sequence
  Synthetic
caccgctgtcccaaaaggtcttatgattttattaatttttatattttgttactattcaggggttgttcggccctttgatctatacttatcacctacatacaatgtgtctcttaggggacacatatcagcagccagggcct

SEQ ID NO: 10913 - DNA, 140 bp, Artificial Sequence
  Synthetic
aggccctggctgctgatatgcatttatgtggggcggagcctactgcttctgcgacgctgaaaacacgcaattgagcgaagcacacgtggagaagtccgaatcatgcaaaacagaatttgcgaccttttgggacagcggtg

SEQ ID NO: 10914 - DNA, 140 bp, Artificial Sequence
  Synthetic
caccgctgtcccaaaaggtcgcaaattctgttttgcatgattcggacttctccacgtgtgcttcgctcaattgcgtgttttcagcgtcgcagaagcagtaggctccgccccacataaatgcatatcagcagccagggcct

SEQ ID NO: 10915 - DNA, 140 bp, Artificial Sequence
  Synthetic
aggccctggctgctgatatgagggggccgaagagtggagtcttgccatcccagttatgtgcctgttggcaaacaccacgttcccctgctcccagcccccttgcacgccctgctgctacgagaccttttgggacagcggtg

SEQ ID NO: 10916 - DNA, 140 bp, Artificial Sequence
  Synthetic
caccgctgtcccaaaaggtctcgtagcagcagggcgtgcaagggggctgggagcaggggaacgtggtgtttgccaacaggcacataactgggatggcaagactccactcttcggccccctcatatcagcagccagggcct

SEQ ID NO: 10917 - DNA, 140 bp, Artificial Sequence
  Synthetic
atacgccatgctgggtctcccacacagcaccatttggctgccaaatagcaacaaacccggtaagagcggtgaattgcgccgtagggaacatgcccatctccatcgacataccggatgcggcgtacttgggagtcggccat

SEQ ID NO: 10918 - DNA, 140 bp, Artificial Sequence
  Synthetic
atggccgactcccaagtacgccgcatccggtatgtcgatggagatgggcatgttccctacggcgcaattcaccgctcttaccgggtttgttgctatttggcagccaaatggtgctgtgtgggagacccagcatggcgtat

SEQ ID NO: 10919 - DNA, 140 bp, Artificial Sequence
  Synthetic
aggccctggctgctgatatggaattgcgccgtagggaacatgcccatctccatcgacataccggatgcggccttcattagggtcatcgacgcgccctctttaacggacatgtcgtgcgaggaccttttgggacagcggtg

SEQ ID NO: 10920 - DNA, 140 bp, Artificial Sequence
  Synthetic
caccgctgtcccaaaaggtcctcgcacgacatgtccgttaaagagggcgcgtcgatgaccctaatgaaggccgcatccggtatgtcgatggagatgggcatgttccctacggcgcaattccatatcagcagccagggcct

SEQ ID NO: 10921 - DNA, 140 bp, Artificial Sequence
  Synthetic
aggccctggctgctgatatggaattgcgccgtagggaacatgcccatctccatcgacataccggatgcggccttcattagggtcttcgacgcgccctctttaacggacatgtcgtgcgaggaccttttgggacagcggtg

SEQ ID NO: 10922 - DNA, 140 bp, Artificial Sequence
  Synthetic
caccgctgtcccaaaaggtcctcgcacgacatgtccgttaaagagggcgcgtcgaagaccctaatgaaggccgcatccggtatgtcgatggagatgggcatgttccctacggcgcaattccatatcagcagccagggcct

SEQ ID NO: 10923 - DNA, 140 bp, Artificial Sequence
  Synthetic
aggccctggctgctgatatggaattgcgccgtagggaacatgcccatctccatcgacataccggatgcggccttcattagggtcctcgacgcgccctctttaacggacatgtcgtgcgaggaccttttgggacagcggtg

SEQ ID NO: 10924 - DNA, 140 bp, Artificial Sequence
  Synthetic
caccgctgtcccaaaaggtcctcgcacgacatgtccgttaaagagggcgcgtcgaggaccctaatgaaggccgcatccggtatgtcgatggagatgggcatgttccctacggcgcaattccatatcagcagccagggcct

SEQ ID NO: 10925 - DNA, 140 bp, Artificial Sequence; identical to SEQ ID NO: 6159
  Synthetic

SEQ ID NO: 10926 - DNA, 140 bp, Artificial Sequence; identical to SEQ ID NO: 6160
  Synthetic

SEQ ID NO: 10927 - DNA, 140 bp, Artificial Sequence
  Synthetic
aggccctggctgctgatatgcagcgacgcagcaccaaggacaacttcaatgtctataaagccacaagaccatacttagctcactgtcccgactgtggagaagggcactcgtgccatagtcgaccttttgggacagcggtg

SEQ ID NO: 10928 - DNA, 140 bp, Artificial Sequence
  Synthetic
caccgctgtcccaaaaggtcgactatggcacgagtgcccttctccacagtcgggacagtgagctaagtatggtcttgtggctttatagacattgaagttgtccttggtgctgcgtcgctgcatatcagcagccagggcct

SEQ ID NO: 10929 - DNA, 140 bp, Artificial Sequence
  Synthetic
aggccctggctgctgatatgatatgcagccagcaagaaaggcaagtgtgcggtgcattcgatgaccaacgccgtcacaattcgggaagctgagatagaagttgaagggaattctcagctggaccttttgggacagcggtg

SEQ ID NO: 10930 - DNA, 140 bp, Artificial Sequence
  Synthetic
caccgctgtcccaaaaggtccagctgagaattcccttcaacttctatctcagcttcccgaattgtgacggcgttggtcatcgaatgcaccgcacacttgcctttcttgctggctgcatatcatatcagcagccagggcct

SEQ ID NO: 10931 - DNA, 140 bp, Artificial Sequence
  Synthetic
aggccctggctgctgatatgctgggtactatcagctgctacaagcatccttaacatgttctccccaccgccagcgacgcagcaccaaggacaacttcaatgtctataaagccacaagaccgaccttttgggacagcggtg

SEQ ID NO: 10932 - DNA, 140 bp, Artificial Sequence
  Synthetic
caccgctgtcccaaaaggtcggtcttgtggctttatagacattgaagttgtccttggtgctgcgtcgctggcggtggggagaacatgttaaggatgcttgtagcagctgatagtacccagcatatcagcagccagggcct

SEQ ID NO: 10933 - DNA, 140 bp, Artificial Sequence
  Synthetic
aggccctggctgctgatatgcaaatctctttctcgacggccttggccagcgccgaattccgcgtacaagtctgttctacacaagtacactgtgtagccgagtgccaccctccgaaggaccgaccttttgggacagcggtg

SEQ ID NO: 10934 - DNA, 140 bp, Artificial Sequence
  Synthetic
caccgctgtcccaaaaggtcggtccttcggagggtggcactcggctacacagtgtacttgtgtagaacagacttgtacgcggaattcggcgctggccaaggccgtcgagaaagagatttgcatatcagcagccagggcct

SEQ ID NO: 10935 - DNA, 140 bp, Artificial Sequence
  Synthetic
atacgccatgctgggtctccacatagtcaattacccggcgtcacataccaccctcggggtccaggacatttccgctacggcgctgtcatgggtgcagaagatcacgggaggcgtgggactcgtacttgggagtcggccat

SEQ ID NO: 10936 - DNA, 140 bp, Artificial Sequence
  Synthetic
atggccgactcccaagtacgagtcccacgcctcccgtgatcttctgcacccatgacagcgccgtagcggaaatgtcctggaccccgagggtggtatgtgacgccgggtaattgactatgtggagacccagcatggcgtat

SEQ ID NO: 10937 - DNA, 140 bp, Artificial Sequence
  Synthetic
atacgccatgctgggtctccggttgtcgctgttgcagcactgattctaatcgtggtgctatgcgtgtcgttcagcaggcactaacttgacaactaagtatgaaggtatatgtgtcccctacgtacttgggagtcggccat

SEQ ID NO: 10938 - DNA, 140 bp, Artificial Sequence
  Synthetic
atggccgactcccaagtacgtaggggacacatataccttcatacttagttgtcaagttagtgcctgctgaacgacacgcatagcaccacgattagaatcagtgctgcaacagcgacaaccggagacccagcatggcgtat

SEQ ID NO: 10939 - DNA, 140 bp, Artificial Sequence
  Synthetic
aggccctggctgctgatatgtcagcaggcactaacttgacaactaagtatgaaggtatatgtgtcccctaagagacacactgtaaatagctaataatctatagatcaaagggctatacaagaccttttgggacagcggtg

SEQ ID NO: 10940 - DNA, 140 bp, Artificial Sequence
  Synthetic
caccgctgtcccaaaaggtcttgtatagccctttgatctatagattattagctatttacagtgtgtctcttaggggacacatataccttcatacttagttgtcaagttagtgcctgctgacatatcagcagccagggcct

SEQ ID NO: 10941 - DNA, 140 bp, Artificial Sequence
  Synthetic
aggccctggctgctgatatgattcactgacagtaggaagattagtcattcatgtacgcacccatttcaccacgaccctcctgtgataggtcgggaaaaattccattcccgaccgcagcacgaccttttgggacagcggtg

SEQ ID NO: 10942 - DNA, 140 bp, Artificial Sequence
  Synthetic
caccgctgtcccaaaaggtcgtgctgcggtcgggaatggaatttttcccgacctatcacaggagggtcgtggtgaaatgggtgcgtacatgaatgactaatcttcctactgtcagtgaatcatatcagcagccagggcct

SEQ ID NO: 10943 - DNA, 140 bp, Artificial Sequence
  Synthetic
aggccctggctgctgatatgaaatacataaataggtatacgtgtcccctaagagacacattgtatgtaggtgataagtatagatcaaagggccgaacaacccctgaatagtaacaaaacagaccttttgggacagcggtg

SEQ ID NO: 10944 - DNA, 140 bp, Artificial Sequence
  Synthetic
caccgctgtcccaaaaggtctgttttgttactattcaggggttgttcggccctttgatctatacttatcacctacatacaatgtgtctcttaggggacacgtatacctatttatgtatttcatatcagcagccagggcct

SEQ ID NO: 10945 - DNA, 140 bp, Artificial Sequence
  Synthetic
atacgccatgctgggtctcctgaaaatcaataaaaatcataaaatagaaaaaccataaacagaagtagttcaaagggctatacaacccctgaatagtaacaaaacacaaaactaataaaacgtacttgggagtcggccat

SEQ ID NO: 10946 - DNA, 140 bp, Artificial Sequence
  Synthetic
atggccgactcccaagtacgttttattagttttgtgttttgttactattcaggggttgtatagccctttgaactacttctgtttatggtttttctattttatgatttttattgattttcaggagacccagcatggcgtat

SEQ ID NO: 10947 - DNA, 140 bp, Artificial Sequence
  Synthetic
aggccctggctgctgatatgcaaagtgattaataactgcaaggttgatcaatgtcatgccgcggtcaccaatcacaaaaagtggcagtataactcccctctggtcccgcgtaatgctgaagaccttttgggacagcggtg

SEQ ID NO: 10948 - DNA, 140 bp, Artificial Sequence
  Synthetic
caccgctgtcccaaaaggtcttcagcattacgcgggaccagaggggagttatactgccactttttgtgattggtgaccgcggcatgacattgatcaaccttgcagttattaatcactttgcatatcagcagccagggcct

SEQ ID NO: 10949 - DNA, 140 bp, Artificial Sequence
  Synthetic
aggccctggctgctgatatgaaaaccataaacagaagtagttcaaagggctatacaacccctgaatagtaacaaaacacaaaactaataaaaattaaatgaataccataattggcaaacggaccttttgggacagcggtg

SEQ ID NO: 10950 - DNA, 140 bp, Artificial Sequence
  Synthetic
caccgctgtcccaaaaggtccgtttgccaattatggtattcatttaatttttattagttttgtgttttgttactattcaggggttgtatagccctttgaactacttctgtttatggttttcatatcagcagccagggcct

SEQ ID NO: 10951 - DNA, 140 bp, Artificial Sequence
  Synthetic
aggccctggctgctgatatgcggaatatgggagaagaaccaaactatcaagaagagtgggtgatgcataagaaggaagtcgtgctaaccgtgccgactgaagggctcgaggtcacgtggggaccttttgggacagcggtg

SEQ ID NO: 10952 - DNA, 140 bp, Artificial Sequence
  Synthetic
caccgctgtcccaaaaggtccccacgtgacctcgagcccttcagtcggcacggttagcacgacttccttcttatgcatcacccactcttcttgatagtttggttcttctcccatattccgcatatcagcagccagggcct

SEQ ID NO: 10953 - DNA, 140 bp, Artificial Sequence
  Synthetic
atacgccatgctgggtctcctcctaaaagcagccgaactcacttgagaagtaggcatagcataccgaactcttccacgattctccgaacccacagggacgtaggagatgttattttgtttcgtacttgggagtcggccat

SEQ ID NO: 10954 - DNA, 140 bp, Artificial Sequence
  Synthetic
atggccgactcccaagtacgaaacaaaataacatctcctacgtccctgtgggttcggagaatcgtggaagagttcggtatgctatgcctacttctcaagtgagttcggctgcttttaggaggagacccagcatggcgtat

SEQ ID NO: 10955 - DNA, 140 bp, Artificial Sequence
  Synthetic
aggccctggctgctgatatggcaacaacgagccgtataagtattggccgcagttatctacaaacggtacagcccatggccacccgcatgagataattctgtattattatgagctgtacccgaccttttgggacagcggtg

SEQ ID NO: 10956 - DNA, 140 bp, Artificial Sequence
  Synthetic
caccgctgtcccaaaaggtcgggtacagctcataataatacagaattatctcatgcgggtggccatgggctgtaccgtttgtagataactgcggccaatacttatacggctcgttgttgccatatcagcagccagggcct

SEQ ID NO: 10957 - DNA, 140 bp, Artificial Sequence
  Synthetic
aggccctggctgctgatatgagccgaactcacttgagaagtaggcatagcataccgaactcttccacgattctccgaacccacagggacgtaggagatgttattttgtttttaatatttcgaccttttgggacagcggtg

SEQ ID NO: 10958 - DNA, 140 bp, Artificial Sequence
  Synthetic
caccgctgtcccaaaaggtcgaaatattaaaaacaaaataacatctcctacgtccctgtgggttcggagaatcgtggaagagttcggtatgctatgcctacttctcaagtgagttcggctcatatcagcagccagggcct

SEQ ID NO: 10959 - DNA, 140 bp, Artificial Sequence
  Synthetic
aggccctggctgctgatatgctgctgtaaaacgttggcttttttagccgtaatgagcgtcggtgcccacactgtgagcgcgtacgaacacgtaacagtgatcccgaacacggtgggagtagaccttttgggacagcggtg

SEQ ID NO: 10960 - DNA, 140 bp, Artificial Sequence
  Synthetic
caccgctgtcccaaaaggtctactcccaccgtgttcgggatcactgttacgtgttcgtacgcgctcacagtgtgggcaccgacgctcattacggctaaaaaagccaacgttttacagcagcatatcagcagccagggcct

SEQ ID NO: 10961 - DNA, 140 bp, Artificial Sequence
  Synthetic
atacgccatgctgggtctccgtaccacaaaagtatctccaggcggtgtacactgcctgtgaccgccattgtgtcatcgttgcactacgaaggcaaaatgcgcactacgaatgagtacaaccgtacttgggagtcggccat

SEQ ID NO: 10962 - DNA, 140 bp, Artificial Sequence
  Synthetic
atggccgactcccaagtacggttgtactcattcgtagtgcgcattttgccttcgtagtgcaacgatgacacaatggcggtcacaggcagtgtacaccgcctggagatacttttgtggtacggagacccagcatggcgtat

SEQ ID NO: 10963 - DNA, 140 bp, Artificial Sequence; identical to SEQ ID NO: 8323
  Synthetic

SEQ ID NO: 10964 - DNA, 140 bp, Artificial Sequence; identical to SEQ ID NO: 8324
  Synthetic

SEQ ID NO: 10965 - DNA, 140 bp, Artificial Sequence
  Synthetic
aggccctggctgctgatatgatgcaaacggcgaccatgccgtcacagttaaggacgccaaattcattgtggggccaatgtcttcagcctggacacctttcgacaacaaaattgtggtgtagaccttttgggacagcggtg

SEQ ID NO: 10966 - DNA, 140 bp, Artificial Sequence
  Synthetic
caccgctgtcccaaaaggtctacaccacaattttgttgtcgaaaggtgtccaggctgaagacattggccccacaatgaatttggcgtccttaactgtgacggcatggtcgccgtttgcatcatatcagcagccagggcct

SEQ ID NO: 10967 - DNA, 140 bp, Artificial Sequence
  Synthetic
atacgccatgctgggtctccgcggggcgtcactgcagcacacagcaccgtttggctgccaaatagcaacaaacccggtaagagcggtgaactgcgccgtagggaacatgcccatctccatcgtacttgggagtcggccat

SEQ ID NO: 10968 - DNA, 140 bp, Artificial Sequence
  Synthetic
atggccgactcccaagtacgatggagatgggcatgttccctacggcgcagttcaccgctcttaccgggtttgttgctatttggcagccaaacggtgctgtgtgctgcagtgacgccccgcggagacccagcatggcgtat

SEQ ID NO: 10969 - DNA, 140 bp, Artificial Sequence
  Synthetic
aggccctggctgctgatatgaagggaattctcagctgcaaatctctttctcgacggccctagccagcgccgaattccgcgtacaagtctgttctacacaagtacactgtgcagccgagtggaccttttgggacagcggtg

SEQ ID NO: 10970 - DNA, 140 bp, Artificial Sequence
  Synthetic
caccgctgtcccaaaaggtccactcggctgcacagtgtacttgtgtagaacagacttgtacgcggaattcggcgctggctagggccgtcgagaaagagatttgcagctgagaattcccttcatatcagcagccagggcct

SEQ ID NO: 10971 - DNA, 140 bp, Artificial Sequence
  Synthetic
aggccctggctgctgatatgccaccccccgaaggaccacatagtcaactacccggcgtcacataccaccctcggggtccaggacatctccgctacggcgatgtcatgggtgcagaagatcgaccttttgggacagcggtg

SEQ ID NO: 10972 - DNA, 140 bp, Artificial Sequence
  Synthetic
caccgctgtcccaaaaggtcgatcttctgcacccatgacatcgccgtagcggagatgtcctggaccccgagggtggtatgtgacgccgggtagttgactatgtggtccttcggggggtggcatatcagcagccagggcct

SEQ ID NO: 10973 - DNA, 140 bp, Artificial Sequence
  Synthetic
aggccctggctgctgatatgtcggggtccaggacatctccgctacggcgatgtcatgggtgcagaagatcacgggaggtgtgggactggttgttgctgttgccgcactgattctaatcgtgaccttttgggacagcggtg

SEQ ID NO: 10974 - DNA, 140 bp, Artificial Sequence
  Synthetic
caccgctgtcccaaaaggtcacgattagaatcagtgcggcaacagcaacaaccagtcccacacctcccgtgatcttctgcacccatgacatcgccgtagcggagatgtcctggaccccgacatatcagcagccagggcct

SEQ ID NO: 10975 - DNA, 140 bp, Artificial Sequence
  Synthetic
atacgccatgctgggtctccggtgctatgcgtgtcgttcagcaggcactaacttgacaattagtatgaaggtatatgtgtcccctaagagacacactgtacatggcaaataatctatagacgtacttgggagtcggccat

SEQ ID NO: 10976 - DNA, 140 bp, Artificial Sequence
  Synthetic
atggccgactcccaagtacgtctatagattatttgccatgtacagtgtgtctcttaggggacacatataccttcatactaattgtcaagttagtgcctgctgaacgacacgcatagcaccggagacccagcatggcgtat

SEQ ID NO: 10977 - DNA, 140 bp, Artificial Sequence
  Synthetic
aggccctggctgctgatatgcaaatgaataccataattggcaaacggaagagatgtaggtacttaagcttcctaaaagcagccgaactcactttgagaagtaggcatagcataccgatttgaccttttgggacagcggtg

SEQ ID NO: 10978 - DNA, 140 bp, Artificial Sequence
  Synthetic
caccgctgtcccaaaaggtcaaatcggtatgctatgcctacttctcaaagtgagttcggctgcttttaggaagcttaagtacctacatctcttccgtttgccaattatggtattcatttgcatatcagcagccagggcct

SEQ ID NO: 10979 - DNA, 140 bp, Artificial Sequence
  Synthetic
aggccctggctgctgatatgtttgaaggacctgcaacgtgcgtaccccatgtttgaggtggaacctaggcaggtcacatcgaatgaccatgctaatgctagagcattctcgcatctagccgaccttttgggacagcggtg

SEQ ID NO: 10980 - DNA, 140 bp, Artificial Sequence
  Synthetic
caccgctgtcccaaaaggtcggctagatgcgagaatgctctagcattagcatggtcattcgatgtgacctgcctaggttccacctcaaacatggggtacgcacgttgcaggtccttcaaacatatcagcagccagggcct

SEQ ID NO: 10981 - DNA, 140 bp, Artificial Sequence
  Synthetic
aggccctggctgctgatatgtttgaaggtcctgcaacgtgcgtaccccatgtttgaggtggaacctaggcaggtcacatcgaatgaccatgctaatgctagagcattctcgcatctagccgaccttttgggacagcggtg

SEQ ID NO: 10982 - DNA, 140 bp, Artificial Sequence
  Synthetic
caccgctgtcccaaaaggtcggctagatgcgagaatgctctagcattagcatggtcattcgatgtgacctgcctaggttccacctcaaacatggggtacgcacgttgcaggaccttcaaacatatcagcagccagggcct

SEQ ID NO: 10983 - DNA, 140 bp, Artificial Sequence; identical to SEQ ID NO: 10585
  Synthetic

SEQ ID NO: 10984 - DNA, 140 bp, Artificial Sequence; identical to SEQ ID NO: 10586
  Synthetic

SEQ ID NO: 10985 - DNA, 140 bp, Artificial Sequence
  Synthetic
aggccctggctgctgatatgtttgaagggcctgcaacgtgcgtaccccatgtttgaggtggaacctaggcaggtcacatcgaatgaccatgctaatgctagagcattctcgcatctagccgaccttttgggacagcggtg

SEQ ID NO: 10986 - DNA, 140 bp, Artificial Sequence
  Synthetic
caccgctgtcccaaaaggtcggctagatgcgagaatgctctagcattagcatggtcattcgatgtgacctgcctaggttccacctcaaacatggggtacgcacgttgcaggcccttcaaacatatcagcagccagggcct

SEQ ID NO: 10987 - DNA, 140 bp, Artificial Sequence
  Synthetic
aggccctggctgctgatatgccaggcgattaaaggagttcgagtggcgtactgggtagggttcgacacaaccccgttcatgtacaacgctatggcgggtgcttacccctcatactcaacagaccttttgggacagcggtg

SEQ ID NO: 10988 - DNA, 140 bp, Artificial Sequence
  Synthetic
caccgctgtcccaaaaggtctgttgagtatgaggggtaagcacccgccatagcgttgtacatgaacggggttgtgtcgaaccctacccagtacgccactcgaactcctttaatcgcctggcatatcagcagccagggcct

SEQ ID NO: 10989 - DNA, 140 bp, Artificial Sequence
  Synthetic
aggccctggctgctgatatggaatagtaacaaaatatgaaaatcaataaaaatcataaaatagaaaaaccataaacagaagtagtttaaagggctataaaacccctgaatagtaacaaaagaccttttgggacagcggtg

SEQ ID NO: 10990 - DNA, 140 bp, Artificial Sequence
  Synthetic
caccgctgtcccaaaaggtcttttgttactattcaggggttttatagccctttaaactacttctgtttatggtttttctattttatgatttttattgattttcatattttgttactattccatatcagcagccagggcct

SEQ ID NO: 10991 - DNA, 140 bp, Artificial Sequence
  Synthetic
atacgccatgctgggtctcctcaagaacctagttaccaggcaagacctggtgactagtggaaagaaagaaaactgccaagaaatcagtaccgacgtgatgagacagagaggtctagaaatcgtacttgggagtcggccat

SEQ ID NO: 10992 - DNA, 140 bp, Artificial Sequence
  Synthetic
atggccgactcccaagtacgatttctagacctctctgtctcatcacgtcggtactgatttcttggcagttttctttctttccactagtcaccaggtcttgcctggtaactaggttcttgaggagacccagcatggcgtat

SEQ ID NO: 10993 - DNA, 140 bp, Artificial Sequence
  Synthetic
aggccctggctgctgatatgcataaagttaataaaaatcaaatgaataccataattggcaaacggaagagatgtaggtacttaagcttcctaaaagcagccgaactcactttgagaagtagaccttttgggacagcggtg

SEQ ID NO: 10994 - DNA, 140 bp, Artificial Sequence
  Synthetic
caccgctgtcccaaaaggtctacttctcaaagtgagttcggctgcttttaggaagcttaagtacctacatctcttccgtttgccaattatggtattcatttgatttttattaactttatgcatatcagcagccagggcct

SEQ ID NO: 10995 - DNA, 140 bp, Artificial Sequence
  Synthetic
atacgccatgctgggtctcccccgtggataaagacgctgcagaacccaccgaaaggaaacttcaaggcaactattaaggagtgggaggtggagcacgcgtcgataatggcgggcatccgccgtacttgggagtcggccat

SEQ ID NO: 10996 - DNA, 140 bp, Artificial Sequence
  Synthetic
atggccgactcccaagtacggcggatgcccgccattatcgacgcgtgctccacctcccactccttaatagttgccttgaagtttcctttcggtgggttctgcagcgtctttatccacgggggagacccagcatggcgtat

SEQ ID NO: 10997 - DNA, 140 bp, Artificial Sequence
  Synthetic
atacgccatgctgggtctcctctagacagcgggctattctctaaaccgttggtatctgtgtattacgcggataaccattgggataataggccgggaggaaagatgttcggattcaacccccgtacttgggagtcggccat

SEQ ID NO: 10998 - DNA, 140 bp, Artificial Sequence
  Synthetic
atggccgactcccaagtacgggggttgaatccgaacatctttcctcccggcctattatcccaatggttatccgcgtaatacacagataccaacggtttagagaatagcccgctgtctagaggagacccagcatggcgtat

SEQ ID NO: 10999 - DNA, 140 bp, Artificial Sequence
  Synthetic
aggccctggctgctgatatggtggccgaacaccgcccagtaaaaggggaaaggatggaatggctggttaacaagataaacggacatcatgtgctcttggttagcggctataaccttgcacgaccttttgggacagcggtg

SEQ ID NO: 11000 - DNA, 140 bp, Artificial Sequence
  Synthetic
caccgctgtcccaaaaggtcgtgcaaggttatagccgctaaccaagagcacatgatgtccgtttatcttgttaaccagccattccatcctttccccttttactgggcggtgttcggccaccatatcagcagccagggcct

SEQ ID NO: 11001 - DNA, 140 bp, Artificial Sequence
  Synthetic
aggccctggctgctgatatgtagagcaggaaattgaccccgactcaaccatcctggatatcggcagtgcgccagcaaggaggatgatgtcggacaggaagtaccactgcgtctgcccgatgaccttttgggacagcggtg

SEQ ID NO: 11002 - DNA, 140 bp, Artificial Sequence
  Synthetic
caccgctgtcccaaaaggtcatcgggcagacgcagtggtacttcctgtccgacatcatcctccttgctggcgcactgccgatatccaggatggttgagtcggggtcaatttcctgctctacatatcagcagccagggcct

SEQ ID NO: 11003 - DNA, 140 bp, Artificial Sequence
  Synthetic
atacgccatgctgggtctcctttttcctattcagcaattttgacaatggcagaaggaattttacaacgcatgtcatgaacaaccaattgaatgcagcctttgtaggacaggccacccgagcgtacttgggagtcggccat

SEQ ID NO: 11004 - DNA, 140 bp, Artificial Sequence
  Synthetic
atggccgactcccaagtacgctcgggtggcctgtcctacaaaggctgcattcaattggttgttcatgacatgcgttgtaaaattccttctgccattgtcaaaattgctgaataggaaaaaggagacccagcatggcgtat

SEQ ID NO: 11005 - DNA, 140 bp, Artificial Sequence
  Synthetic
atacgccatgctgggtctcccctatatgccctgggggaaagtattgaatcaatcaggcagaaatgcccggtggatgatgcagacgcttcatctcccccgaaaaccgtcccatgcctttgccgtacttgggagtcggccat

SEQ ID NO: 11006 - DNA, 140 bp, Artificial Sequence
  Synthetic
atggccgactcccaagtacggcaaaggcatgggacggttttcgggggagatgaagcgtctgcatcatccaccgggcatttctgcctgattgattcaatactttcccccagggcatataggggagacccagcatggcgtat

SEQ ID NO: 11007 - DNA, 140 bp, Artificial Sequence
  Synthetic
aggccctggctgctgatatgaacgccgtcctcctacccaatgtgcatacattatttgacatgtctgccgaggacttcgatgccattatagcagcacactttaagccaggagacgctgtttgaccttttgggacagcggtg

SEQ ID NO: 11008 - DNA, 140 bp, Artificial Sequence
  Synthetic
caccgctgtcccaaaaggtcaaacagcgtctcctggcttaaagtgtgctgctataatggcatcgaagtcctcggcagacatgtcaaataatgtatgcacattgggtaggaggacggcgttcatatcagcagccagggcct

SEQ ID NO: 11009 - DNA, 140 bp, Artificial Sequence
  Synthetic
aggccctggctgctgatatgaaaggggtccgagtggcgtactgggttgggttcgacacaaccccgttcatgtacaatgccatggcgggtgcctacccctcatactcgacaaactgggcaggaccttttgggacagcggtg

SEQ ID NO: 11010 - DNA, 140 bp, Artificial Sequence
  Synthetic
caccgctgtcccaaaaggtcctgcccagtttgtcgagtatgaggggtaggcacccgccatggcattgtacatgaacggggttgtgtcgaacccaacccagtacgccactcggacccctttcatatcagcagccagggcct

SEQ ID NO: 11011 - DNA, 140 bp, Artificial Sequence
  Synthetic
aggccctggctgctgatatggtacaatgccatggcgggtgcctacccctcatactcgacaaactgggcagatgagcaggtactgaaggctaagaacataggattatgttcaacagacctggaccttttgggacagcggtg

SEQ ID NO: 11012 - DNA, 140 bp, Artificial Sequence
  Synthetic
caccgctgtcccaaaaggtccaggtctgttgaacataatcctatgttcttagccttcagtacctgctcatctgcccagtttgtcgagtatgaggggtaggcacccgccatggcattgtaccatatcagcagccagggcct

SEQ ID NO: 11013 - DNA, 140 bp, Artificial Sequence
  Synthetic
aggccctggctgctgatatgacccgtcataactttgtacggcggtcctaaataggtacgcactacagctacctattctgcagaagccgacagcaggtacccaaataccaatcagccataagaccttttgggacagcggtg

SEQ ID NO: 11014 - DNA, 140 bp, Artificial Sequence
  Synthetic
caccgctgtcccaaaaggtcttatggctgattggtatttgggtacctgctgtcggcttctgcagaataggtagctgtagtgcgtacctatttaggaccgccgtacaaagttatgacgggtcatatcagcagccagggcct

SEQ ID NO: 11015 - DNA, 140 bp, Artificial Sequence
  Synthetic
atacgccatgctgggtctccacgctcctgtcctaccggaatatgggagaagaaccaaactatcaagaagagtgggtgacgcacaagaaggagatcaggctaaccgtgccgactgaagggccgtacttgggagtcggccat

SEQ ID NO: 11016 - DNA, 140 bp, Artificial Sequence
  Synthetic
atggccgactcccaagtacggcccttcagtcggcacggttagcctgatctccttcttgtgcgtcacccactcttcttgatagtttggttcttctcccatattccggtaggacaggagcgtggagacccagcatggcgtat

SEQ ID NO: 11017 - DNA, 140 bp, Artificial Sequence
  Synthetic
atacgccatgctgggtctccaccgtgcgaccgtgtgctgttctcagtagggtcaacgctctacccggaaaaccgcaagctacttaagagctggcacctgccatcggtgttccatttaaagcgtacttgggagtcggccat

SEQ ID NO: 11018 - DNA, 140 bp, Artificial Sequence
  Synthetic
atggccgactcccaagtacgctttaaatggaacaccgatggcaggtgccagctcttaagtagcttgcggttttccgggtagagcgttgaccctactgagaacagcacacggtcgcacggtggagacccagcatggcgtat

SEQ ID NO: 11019 - DNA, 140 bp, Artificial Sequence
  Synthetic
atacgccatgctgggtctcctttcctgcttagcctaatatgctgcattagaacagctaaagcggccacataccgggaggccgcggtatacctgtggaacgagcagcagcctttgttttggcgtacttgggagtcggccat

SEQ ID NO: 11020 - DNA, 140 bp, Artificial Sequence
  Synthetic
atggccgactcccaagtacgccaaaacaaaggctgctgctcgttccacaggtataccgcggcctcccggtatgtggccgctttagctgttctaatgcagcatattaggctaagcaggaaaggagacccagcatggcgtat

SEQ ID NO: 11021 - DNA, 140 bp, Artificial Sequence
  Synthetic
aggccctggctgctgatatgggcaaactcagcttcacatgccgctgtgatacagtggtttcgtgtgagggctacgtcgttaagagaataacgatgagcccaggcctttatggaaaaaccagaccttttgggacagcggtg

SEQ ID NO: 11022 - DNA, 140 bp, Artificial Sequence
  Synthetic
caccgctgtcccaaaaggtctggtttttccataaaggcctgggctcatcgttattctcttaacgacgtagccctcacacgaaaccactgtatcacagcggcatgtgaagctgagtttgcccatatcagcagccagggcct

SEQ ID NO: 11023 - DNA, 140 bp, Artificial Sequence
  Synthetic
aggccctggctgctgatatgcgcgggtacggtgcacgtgccgtactctcaggcaccatctggcttcaagtattggctaaaagaacgaggggcgtccctgcaacacacagcaccatttggcgaccttttgggacagcggtg

SEQ ID NO: 11024 - DNA, 140 bp, Artificial Sequence
  Synthetic
caccgctgtcccaaaaggtcgccaaatggtgctgtgtgttgcagggacgcccctcgttcttttagccaatacttgaagccagatggtgcctgagagtacggcacgtgcaccgtacccgcgcatatcagcagccagggcct

SEQ ID NO: 11025 - DNA, 140 bp, Artificial Sequence
  Synthetic
aggccctggctgctgatatgatgagcaggtactgaaggctaagaacataggattatgttcaacagacctgacggaaggtagacgaggcaagttgtctattatgagaaggaaaaagctaaagaccttttgggacagcggtg

SEQ ID NO: 11026 - DNA, 140 bp, Artificial Sequence
  Synthetic
caccgctgtcccaaaaggtctttagctttttccttctcataatagacaacttgcctcgtctaccttccgtcaggtctgttgaacataatcctatgttcttagccttcagtacctgctcatcatatcagcagccagggcct

SEQ ID NO: 11027 - DNA, 140 bp, Artificial Sequence
  Synthetic
aggccctggctgctgatatgcatgcctatctccatcgacataccggacgcggccttcactagggtcgtcgacgcgccatctttaacggacatgtcgtgtgaggtaccagcctgcactcatgaccttttgggacagcggtg

SEQ ID NO: 11028 - DNA, 140 bp, Artificial Sequence
  Synthetic
caccgctgtcccaaaaggtcatgagtgcaggctggtacctcacacgacatgtccgttaaagatggcgcgtcgacgaccctagtgaaggccgcgtccggtatgtcgatggagataggcatgcatatcagcagccagggcct

SEQ ID NO: 11029 - DNA, 140 bp, Artificial Sequence
  Synthetic
aggccctggctgctgatatgcgccggaggatgcacagaagctgttggtggggctgaaccagagaatagtggttaacggcagaacgcaacggaatatgaacaccatgaaaaattatctgctgaccttttgggacagcggtg

SEQ ID NO: 11030 - DNA, 140 bp, Artificial Sequence
  Synthetic
caccgctgtcccaaaaggtcagcagataatttttcatggtgttcatattccgttgcgttctgccgttaaccactattctctggttcagccccaccaacagcttctgtgcatcctccggcgcatatcagcagccagggcct

SEQ ID NO: 11031 - DNA, 140 bp, Artificial Sequence
  Synthetic
aggccctggctgctgatatgcggaagagacgtaggtacttaagcttcctaaaagtagccgaactcactttgagacgtaggcatagtataccgaactcttccacaattctccgtacccatagaccttttgggacagcggtg

SEQ ID NO: 11032 - DNA, 140 bp, Artificial Sequence
  Synthetic
caccgctgtcccaaaaggtctatgggtacggagaattgtggaagagttcggtatactatgcctacgtctcaaagtgagttcggctacttttaggaagcttaagtacctacgtctcttccgcatatcagcagccagggcct

SEQ ID NO: 11033 - DNA, 140 bp, Artificial Sequence
  Synthetic
aggccctggctgctgatatgacatggaagatgaaaaactcctgggggtcagagaaagaacactgacctgctgctgtctatgggcattcaagaagcagaaaacacacacggtctacaagaggaccttttgggacagcggtg

SEQ ID NO: 11034 - DNA, 140 bp, Artificial Sequence
  Synthetic
caccgctgtcccaaaaggtcctcttgtagaccgtgtgtgttttctgcttcttgaatgcccatagacagcagcaggtcagtgttctttctctgacccccaggagtttttcatcttccatgtcatatcagcagccagggcct

SEQ ID NO: 11035 - DNA, 140 bp, Artificial Sequence
  Synthetic
atacgccatgctgggtctcctggctataaccttgcactgcctactaagagagtcacttgggtagcgccgttaggtgcccgcggagcggactacacatacaacctagagttgggtctgccacgtacttgggagtcggccat

SEQ ID NO: 11036 - DNA, 140 bp, Artificial Sequence
  Synthetic
atggccgactcccaagtacgtggcagacccaactctaggttgtatgtgtagtccgctccgcgggcacctaacggcgctacccaagtgactctcttagtaggcagtgcaaggttatagccaggagacccagcatggcgtat

SEQ ID NO: 11037 - DNA, 140 bp, Artificial Sequence
  Synthetic
atacgccatgctgggtctcctgtgtcagtggccacgttcatactcctgtcgatggtgggtatggcagtggggatgtgcatgtgtgcacgacgcagatgcatcacaccgtatgaactgacacgtacttgggagtcggccat

SEQ ID NO: 11038 - DNA, 140 bp, Artificial Sequence
  Synthetic
atggccgactcccaagtacgtgtcagttcatacggtgtgatgcatctgcgtcgtgcacacatgcacatccccactgccatacccaccatcgacaggagtatgaacgtggccactgacacaggagacccagcatggcgtat

SEQ ID NO: 11039 - DNA, 140 bp, Artificial Sequence
  Synthetic
atacgccatgctgggtctcccttcactagggtcgtcgacgcgccctctttaacggacatgtcgtgcgaggtactagcctgcacccattcctcagactttgggggcgtcgccattattaaacgtacttgggagtcggccat

SEQ ID NO: 11040 - DNA, 140 bp, Artificial Sequence
  Synthetic
atggccgactcccaagtacgtttaataatggcgacgcccccaaagtctgaggaatgggtgcaggctagtacctcgcacgacatgtccgttaaagagggcgcgtcgacgaccctagtgaagggagacccagcatggcgtat

SEQ ID NO: 11041 - DNA, 140 bp, Artificial Sequence
  Synthetic
aggccctggctgctgatatgactggtactggtgggcgacttgactaatccgccctaccacgaattcgcatatgaagggctaaaaatccgccctgcctgcccatacaaaattgcagtcatagaccttttgggacagcggtg

SEQ ID NO: 11042 - DNA, 140 bp, Artificial Sequence
  Synthetic
caccgctgtcccaaaaggtctatgactgcaattttgtatgggcaggcagggcggatttttagcccttcatatgcgaattcgtggtagggcggattagtcaagtcgcccaccagtaccagtcatatcagcagccagggcct

SEQ ID NO: 11043 - DNA, 140 bp, Artificial Sequence
  Synthetic
atacgccatgctgggtctccttcttatctgctctactctgcaaagcaagagattaataacccatcatggatcctgtgtacgtggacatagacgctgacagcgcctttttgaaggccctgccgtacttgggagtcggccat

SEQ ID NO: 11044 - DNA, 140 bp, Artificial Sequence
  Synthetic
atggccgactcccaagtacggcagggccttcaaaaaggcgctgtcagcgtctatgtccacgtacacaggatccatgatgggttattaatctcttgctttgcagagtagagcagataagaaggagacccagcatggcgtat

SEQ ID NO: 11045 - DNA, 140 bp, Artificial Sequence
  Synthetic
aggccctggctgctgatatgatgaagggctaaaaatccgccctgcctgcccatacaaaattgcagtcataggagtcttcggagtaccgggatctggcaagtcagctattatcaagaacctgaccttttgggacagcggtg

SEQ ID NO: 11046 - DNA, 140 bp, Artificial Sequence
  Synthetic
caccgctgtcccaaaaggtcaggttcttgataatagctgacttgccagatcccggtactccgaagactcctatgactgcaattttgtatgggcaggcagggcggatttttagcccttcatcatatcagcagccagggcct

SEQ ID NO: 11047 - DNA, 140 bp, Artificial Sequence
  Synthetic
aggccctggctgctgatatggtctatgggcattcaagaagcagaaaacacacacggtctacaagaggcctgatacccagtcaattcagaaggttcaggccgagtttgacagctttgtggtgaccttttgggacagcggtg

SEQ ID NO: 11048 - DNA, 140 bp, Artificial Sequence
  Synthetic
caccgctgtcccaaaaggtcaccacaaagctgtcaaactcggcctgaaccttctgaattgactgggtatcaggcctcttgtagaccgtgtgtgttttctgcttcttgaatgcccatagaccatatcagcagccagggcct

SEQ ID NO: 11049 - DNA, 140 bp, Artificial Sequence
  Synthetic
aggccctggctgctgatatggtctcagataattcaagccttcaaagaagacaaagcatactcacctgaagtagccctgaatgaaatatgtacgcgcatgtatggggtggatctagacagcgaccttttgggacagcggtg

SEQ ID NO: 11050 - DNA, 140 bp, Artificial Sequence
  Synthetic
caccgctgtcccaaaaggtcgctgtctagatccaccccatacatgcgcgtacatatttcattcagggctacttcaggtgagtatgctttgtcttctttgaaggcttgaattatctgagaccatatcagcagccagggcct

SEQ ID NO: 11051 - DNA, 140 bp, Artificial Sequence
  Synthetic
aggccctggctgctgatatgggaataatagagactccgagaggagctatcaaagttactgcccaaccaacagaccacgtcgtgggagagtacctggtactctccccgcagaccgtactacgaccttttgggacagcggtg

SEQ ID NO: 11052 - DNA, 140 bp, Artificial Sequence
  Synthetic
caccgctgtcccaaaaggtcgtagtacggtctgcggggagagtaccaggtactctcccacgacgtggtctgttggttgggcagtaactttgatagctcctctcggagtctctattattcccatatcagcagccagggcct

SEQ ID NO: 11053 - DNA, 140 bp, Artificial Sequence
  Synthetic
aggccctggctgctgatatggtcataaacatccacacaccttttcgcatacaccattaccaacagtgcgtcgaccacgcaatgaaactgcaaatgctcgggggtgactcattgagactgcgaccttttgggacagcggtg

SEQ ID NO: 11054 - DNA, 140 bp, Artificial Sequence
  Synthetic
caccgctgtcccaaaaggtcgcagtctcaatgagtcacccccgagcatttgcagtttcattgcgtggtcgacgcactgttggtaatggtgtatgcgaaaaggtgtgtggatgtttatgaccatatcagcagccagggcct

SEQ ID NO: 11055 - DNA, 140 bp, Artificial Sequence
  Synthetic
aggccctggctgctgatatggcggcttcttcaatatgatgcagatgaaagtcaactataatcacaacatctgcacccaagtgtaccacaaaagtatctccaggcggtgtacactgcctgtgaccttttgggacagcggtg

SEQ ID NO: 11056 - DNA, 140 bp, Artificial Sequence
  Synthetic
caccgctgtcccaaaaggtcacaggcagtgtacaccgcctggagatacttttgtggtacacttgggtgcagatgttgtgattatagttgactttcatctgcatcatattgaagaagccgccatatcagcagccagggcct

SEQ ID NO: 11057 - DNA, 140 bp, Artificial Sequence
  Synthetic
aggccctggctgctgatatgaaggcagtatacaaaaaatggccggagtcctttaagaacagtgcaacaccagtgggaaccgcaaaaacagttatgtgcggtacgtatccagtaatccacggaccttttgggacagcggtg

SEQ ID NO: 11058 - DNA, 140 bp, Artificial Sequence
  Synthetic
caccgctgtcccaaaaggtccgtggattactggatacgtaccgcacataactgtttttgcggttcccactggtgttgcactgttcttaaaggactccggccattttttgtatactgccttcatatcagcagccagggcct

SEQ ID NO: 11059 - DNA, 140 bp, Artificial Sequence
  Synthetic
aggccctggctgctgatatggaccctggagacctcgtgttaacgtgcttcagagggtgggttaaacaactgcaaattgactatcgtggatacgaggtcatgacagcagccgcatcccaaggaccttttgggacagcggtg

SEQ ID NO: 11060 - DNA, 140 bp, Artificial Sequence
  Synthetic
caccgctgtcccaaaaggtccttgggatgcggctgctgtcatgacctcgtatccacgatagtcaatttgcagttgtttaacccaccctctgaagcacgttaacacgaggtctccagggtccatatcagcagccagggcct

SEQ ID NO: 11061 - DNA, 140 bp, Artificial Sequence
  Synthetic
aggccctggctgctgatatgctgggggaaagtattgaatcgatcaggcagaaatgcccggtggatgatgcagacgcatcatctccccccaaaactgttccgtgcctttgccgttacgctagaccttttgggacagcggtg

SEQ ID NO: 11062 - DNA, 140 bp, Artificial Sequence
  Synthetic
caccgctgtcccaaaaggtctagcgtaacggcaaaggcacggaacagttttggggggagatgatgcgtctgcatcatccaccgggcatttctgcctgatcgattcaatactttcccccagcatatcagcagccagggcct

SEQ ID NO: 11063 - DNA, 140 bp, Artificial Sequence
  Synthetic
aggccctggctgctgatatgatcataccggccaacaggagactaccacactcattagtggccgaacaccgcccagtaaaaggggaaagaatggaatggctggttaacaagataaacggccgaccttttgggacagcggtg

SEQ ID NO: 11064 - DNA, 140 bp, Artificial Sequence
  Synthetic
caccgctgtcccaaaaggtcggccgtttatcttgttaaccagccattccattctttccccttttactgggcggtgttcggccactaatgagtgtggtagtctcctgttggccggtatgatcatatcagcagccagggcct

SEQ ID NO: 11065 - DNA, 140 bp, Artificial Sequence
  Synthetic
aggccctggctgctgatatgaaccttgcggccgtgtctgactgggtaatgagcaccgtacctgtcgcgccgcccagaagaaggcgagggagaaacctgactgtgacatgtgacgagagaggaccttttgggacagcggtg

SEQ ID NO: 11066 - DNA, 140 bp, Artificial Sequence
  Synthetic
caccgctgtcccaaaaggtcctctctcgtcacatgtcacagtcaggtttctccctcgccttcttctgggcggcgcgacaggtacggtgctcattacccagtcagacacggccgcaaggttcatatcagcagccagggcct

SEQ ID NO: 11067 - DNA, 140 bp, Artificial Sequence
  Synthetic
aggccctggctgctgatatgttgaaaccaccatgtgtcaccagcaacactgagatgtttttcctattcagcaactttgacaatggcagaaggaatttcacaactcatgtcatgaacaatcgaccttttgggacagcggtg

SEQ ID NO: 11068 - DNA, 140 bp, Artificial Sequence
  Synthetic
caccgctgtcccaaaaggtcgattgttcatgacatgagttgtgaaattccttctgccattgtcaaagttgctgaataggaaaaacatctcagtgttgctggtgacacatggtggtttcaacatatcagcagccagggcct

SEQ ID NO: 11069 - DNA, 140 bp, Artificial Sequence
  Synthetic
aggccctggctgctgatatgaccaggagaagtggatgacttgacagacagcgactggtccacgtgctcagacacggacgacgagttatgactagacagggcaggtgggtatatattctcggaccttttgggacagcggtg

SEQ ID NO: 11070 - DNA, 140 bp, Artificial Sequence
  Synthetic
caccgctgtcccaaaaggtccgagaatatatacccacctgccctgtctagtcataactcgtcgtccgtgtctgagcacgtggaccagtcgctgtctgtcaagtcatccacttctcctggtcatatcagcagccagggcct

SEQ ID NO: 11071 - DNA, 140 bp, Artificial Sequence
  Synthetic
aggccctggctgctgatatgcatgaaagcagcaatcatccagagactaaagagaggctgtagactatacttaatgtcagagaccccaaaagtccctacttaccggactacatatccggcggaccttttgggacagcggtg

SEQ ID NO: 11072 - DNA, 140 bp, Artificial Sequence
  Synthetic
caccgctgtcccaaaaggtccgccggatatgtagtccggtaagtagggacttttggggtctctgacattaagtatagtctacagcctctctttagtctctggatgattgctgctttcatgcatatcagcagccagggcct

SEQ ID NO: 11073 - DNA, 140 bp, Artificial Sequence
  Synthetic
aggccctggctgctgatatgtccagaacgcgtcacccggcttcgcatgaaccacgtcacaagcataattgtgtgttcttcgtttcccctcccaaagtacaaaatagaaggagtgcaaaaagaccttttgggacagcggtg

SEQ ID NO: 11074 - DNA, 140 bp, Artificial Sequence
  Synthetic
caccgctgtcccaaaaggtctttttgcactccttctattttgtactttgggaggggaaacgaagaacacacaattatgcttgtgacgtggttcatgcgaagccgggtgacgcgttctggacatatcagcagccagggcct

SEQ ID NO: 11075 - DNA, 140 bp, Artificial Sequence
  Synthetic
atacgccatgctgggtctcctagatatgaaaagggacgtgaaggtgactcctggtacaaagcatacagaggaaagacctaaggtgcaggttatacaggcggctgaacccttggcgacagccgtacttgggagtcggccat

SEQ ID NO: 11076 - DNA, 140 bp, Artificial Sequence
  Synthetic
atggccgactcccaagtacggctgtcgccaagggttcagccgcctgtataacctgcaccttaggtctttcctctgtatgctttgtaccaggagtcaccttcacgtcccttttcatatctaggagacccagcatggcgtat

SEQ ID NO: 11077 - DNA, 140 bp, Artificial Sequence
  Synthetic
aggccctggctgctgatatgtgatgctgttagaggatttaggggtggatcactccctgctggacttgatagaggctgctttcggagagatttccagctgtcacctaccgacaggtacgcggaccttttgggacagcggtg

SEQ ID NO: 11078 - DNA, 140 bp, Artificial Sequence
  Synthetic
caccgctgtcccaaaaggtccgcgtacctgtcggtaggtgacagctggaaatctctccgaaagcagcctctatcaagtccagcagggagtgatccacccctaaatcctctaacagcatcacatatcagcagccagggcct

SEQ ID NO: 11079 - DNA, 140 bp, Artificial Sequence
  Synthetic
aggccctggctgctgatatgacaccggtccaggtcatttacaacagaagtcagtacgccagtcagtgctgccggtgaacaccctggaggaagtccacgaggagaagtgttacccacctaagaccttttgggacagcggtg

SEQ ID NO: 11080 - DNA, 140 bp, Artificial Sequence
  Synthetic
caccgctgtcccaaaaggtcttaggtgggtaacacttctcctcgtggacttcctccagggtgttcaccggcagcactgactggcgtactgacttctgttgtaaatgacctggaccggtgtcatatcagcagccagggcct

SEQ ID NO: 11081 - DNA, 140 bp, Artificial Sequence
  Synthetic
aggccctggctgctgatatggtcagagaccccaaaagtccctacttaccggactacatatccggcgcctgtgtactcgcctccgatcaacgtccgattgtccaatcccgagtccgcagtggaccttttgggacagcggtg

SEQ ID NO: 11082 - DNA, 140 bp, Artificial Sequence
  Synthetic
caccgctgtcccaaaaggtccactgcggactcgggattggacaatcggacgttgatcggaggcgagtacacaggcgccggatatgtagtccggtaagtagggacttttggggtctctgaccatatcagcagccagggcct

SEQ ID NO: 11083 - DNA, 140 bp, Artificial Sequence
  Synthetic
aggccctggctgctgatatgcctaaaaagaaaccggctcaaaagaaaaagaagccgggccgcagagagaggatgtgcatgaaaatcgaaaatgattgtattttcgaagtcaagcacgaaggaccttttgggacagcggtg

SEQ ID NO: 11084 - DNA, 140 bp, Artificial Sequence
  Synthetic
caccgctgtcccaaaaggtccttcgtgcttgacttcgaaaatacaatcattttcgattttcatgcacatcctctctctgcggcccggcttctttttcttttgagccggtttctttttaggcatatcagcagccagggcct

SEQ ID NO: 11085 - DNA, 140 bp, Artificial Sequence
  Synthetic
aggccctggctgctgatatgaactggcaccacggagcagtacagtactcaggaggccggttcaccatccctacaggtgctggcaaaccaggggacagcggcagaccgatcttcgacaacagaccttttgggacagcggtg

SEQ ID NO: 11086 - DNA, 140 bp, Artificial Sequence
  Synthetic
caccgctgtcccaaaaggtctgttgtcgaagatcggtctgccgctgtcccctggtttgccagcacctgtagggatggtgaaccggcctcctgagtactgtactgctccgtggtgccagttcatatcagcagccagggcct

SEQ ID NO: 11087 - DNA, 140 bp, Artificial Sequence
  Synthetic
aggccctggctgctgatatgacagccctctcggtggtgacctggaataaagacattgtcactaaaatcacccccgaaggggccgaagagtggagtcttgccatcccagttatgtgcctgtgaccttttgggacagcggtg

SEQ ID NO: 11088 - DNA, 140 bp, Artificial Sequence
  Synthetic
caccgctgtcccaaaaggtcacaggcacataactgggatggcaagactccactcttcggccccttcgggggtgattttagtgacaatgtctttattccaggtcaccaccgagagggctgtcatatcagcagccagggcct

SEQ ID NO: 11089 - DNA, 140 bp, Artificial Sequence
  Synthetic
aggccctggctgctgatatgtggcaaacaccacgttcccctgctcccagcccccttgcacgccctgctgctacgaaaaggaaccggaggaaaccctacgcatgcttgaggacaacgtcatgaccttttgggacagcggtg

SEQ ID NO: 11090 - DNA, 140 bp, Artificial Sequence
  Synthetic
caccgctgtcccaaaaggtcatgacgttgtcctcaagcatgcgtagggtttcctccggttccttttcgtagcagcagggcgtgcaagggggctgggagcaggggaacgtggtgtttgccacatatcagcagccagggcct

SEQ ID NO: 11091 - DNA, 140 bp, Artificial Sequence
  Synthetic
aggccctggctgctgatatggccgacagcaagtatctaaacactaatcagctacaatggagttcatcccaacccaaactttttacaataggaggtaccagcctcgaccctggactccgcggaccttttgggacagcggtg

SEQ ID NO: 11092 - DNA, 140 bp, Artificial Sequence
  Synthetic
caccgctgtcccaaaaggtccgcggagtccagggtcgaggctggtacctcctattgtaaaaagtttgggttgggatgaactccattgtagctgattagtgtttagatacttgctgtcggccatatcagcagccagggcct

SEQ ID NO: 11093 - DNA, 140 bp, Artificial Sequence
  Synthetic
atacgccatgctgggtctccacagacaaagtgattaataactgcaaggttgatcaatgtcatgccgcggtcaccaatcacgaaaaatggcagtataactcccctctggtcccgcgtaatgcgtacttgggagtcggccat

SEQ ID NO: 11094 - DNA, 140 bp, Artificial Sequence
  Synthetic
atggccgactcccaagtacgcattacgcgggaccagaggggagttatactgccatttttcgtgattggtgaccgcggcatgacattgatcaaccttgcagttattaatcactttgtctgtggagacccagcatggcgtat

SEQ ID NO: 11095 - DNA, 140 bp, Artificial Sequence
  Synthetic
aggccctggctgctgatatgaatgtaacatgcagggtgcctaaagcaaggaaccccaccgtgacgtacgggaaaaaccaagtcatcatgctactgtatcctgaccacccaacactcctgtgaccttttgggacagcggtg

SEQ ID NO: 11096 - DNA, 140 bp, Artificial Sequence
  Synthetic
caccgctgtcccaaaaggtcacaggagtgttgggtggtcaggatacagtagcatgatgacttggtttttcccgtacgtcacggtggggttccttgctttaggcaccctgcatgttacattcatatcagcagccagggcct

SEQ ID NO: 11097 - DNA, 140 bp, Artificial Sequence
  Synthetic
aggccctggctgctgatatgtgcatgaaaatcgaaaatgattgtattttcgaagtcaagcacgaaggtaaggtaacaggttacgcgtgcctggtgggggacaaagtaatgaaaccagcacgaccttttgggacagcggtg

SEQ ID NO: 11098 - DNA, 140 bp, Artificial Sequence
  Synthetic
caccgctgtcccaaaaggtcgtgctggtttcattactttgtcccccaccaggcacgcgtaacctgttaccttaccttcgtgcttgacttcgaaaatacaatcattttcgattttcatgcacatatcagcagccagggcct

SEQ ID NO: 11099 - DNA, 140 bp, Artificial Sequence
  Synthetic
aggccctggctgctgatatggtacagcccatggccacccgcatgagataattctgtattattatgagctgtaccctactatgactgtagtagttgtgtcagtggccacgttcatactcctgaccttttgggacagcggtg

SEQ ID NO: 11100 - DNA, 140 bp, Artificial Sequence
  Synthetic
caccgctgtcccaaaaggtcaggagtatgaacgtggccactgacacaactactacagtcatagtagggtacagctcataataatacagaattatctcatgcgggtggccatgggctgtaccatatcagcagccagggcct

SEQ ID NO: 11101 - DNA, 140 bp, Artificial Sequence
  Synthetic
aggccctggctgctgatatgctgcgacgctgaaaacacgcagttgagcgaagcacatgtggagaagtccgaatcatgcaaaacggaatttgcatcagcatacagggctcataccgcatctgaccttttgggacagcggtg

SEQ ID NO: 11102 - DNA, 140 bp, Artificial Sequence
  Synthetic
caccgctgtcccaaaaggtcagatgcggtatgagccctgtatgctgatgcaaattccgttttgcatgattcggacttctccacatgtgcttcgctcaactgcgtgttttcagcgtcgcagcatatcagcagccagggcct

SEQ ID NO: 11103 - DNA, 140 bp, Artificial Sequence
  Synthetic
aggccctggctgctgatatgccgaggagatagaggtacacatgcccccagacacccctgatcgcacattaatgtcacaacagtccggcaacgtaaagatcacagtcaatggccagacggtgaccttttgggacagcggtg

SEQ ID NO: 11104 - DNA, 140 bp, Artificial Sequence
  Synthetic
caccgctgtcccaaaaggtcaccgtctggccattgactgtgatctttacgttgccggactgttgtgacattaatgtgcgatcaggggtgtctgggggcatgtgtacctctatctcctcggcatatcagcagccagggcct

SEQ ID NO: 11105 - DNA, 140 bp, Artificial Sequence
  Synthetic
atacgccatgctgggtctccacgtctatgctaatacacaactggtactgcagagaccggctgcgggtacggtacacgtgccatactctcaggcaccatctggctttaagtattggctaaacgtacttgggagtcggccat

SEQ ID NO: 11106 - DNA, 140 bp, Artificial Sequence
  Synthetic
atggccgactcccaagtacgtttagccaatacttaaagccagatggtgcctgagagtatggcacgtgtaccgtacccgcagccggtctctgcagtaccagttgtgtattagcatagacgtggagacccagcatggcgtat

SEQ ID NO: 11107 - DNA, 140 bp, Artificial Sequence
  Synthetic
aggccctggctgctgatatggtacacgtgccatactctcaggcaccatctggctttaagtattggctaaaagaacgcggggcgtcactgcagcacacagcaccatttggctgccaaataggaccttttgggacagcggtg

SEQ ID NO: 11108 - DNA, 140 bp, Artificial Sequence
  Synthetic
caccgctgtcccaaaaggtcctatttggcagccaaatggtgctgtgtgctgcagtgacgccccgcgttcttttagccaatacttaaagccagatggtgcctgagagtatggcacgtgtaccatatcagcagccagggcct

SEQ ID NO: 11109 - DNA, 140 bp, Artificial Sequence
  Synthetic
aggccctggctgctgatatggcggtgcattcgatgactaacgccgtcactattcgggaagctgagatagaagttgaagggaattctcagctgcaaatctctttctcgacggccttagccagaccttttgggacagcggtg

SEQ ID NO: 11110 - DNA, 140 bp, Artificial Sequence
  Synthetic
caccgctgtcccaaaaggtctggctaaggccgtcgagaaagagatttgcagctgagaattcccttcaacttctatctcagcttcccgaatagtgacggcgttagtcatcgaatgcaccgccatatcagcagccagggcct

SEQ ID NO: 11111 - DNA, 140 bp, Artificial Sequence
  Synthetic
atacgccatgctgggtctccgagtgccaccccccgaaggaccacatagtcaactacccggcgtcacataccaccctcggggtccaggacatctccgctacggcgatgtcatgggtgcagacgtacttgggagtcggccat

SEQ ID NO: 11112 - DNA, 140 bp, Artificial Sequence
  Synthetic
atggccgactcccaagtacgtctgcacccatgacatcgccgtagcggagatgtcctggaccccgagggtggtatgtgacgccgggtagttgactatgtggtccttcggggggtggcactcggagacccagcatggcgtat

SEQ ID NO: 11113 - DNA, 140 bp, Artificial Sequence
  Synthetic
aggccctggctgctgatatgatatacctgtggaacgagcagcaacctttgttttggctacaagcccttattccgctggcagccctgattgttctatgcaactgtctgagactcttaccatgaccttttgggacagcggtg

SEQ ID NO: 11114 - DNA, 140 bp, Artificial Sequence
  Synthetic
caccgctgtcccaaaaggtcatggtaagagtctcagacagttgcatagaacaatcagggctgccagcggaataagggcttgtagccaaaacaaaggttgctgctcgttccacaggtatatcatatcagcagccagggcct

SEQ ID NO: 11115 - DNA, 140 bp, Artificial Sequence
  Synthetic
aggccctggctgctgatatgtccgctggcagccctgattgttctatgcaactgtctgagactcttaccatgctgctgtaaaacgttggcttttttagccgtaatgagcgtcggtgcccacgaccttttgggacagcggtg

SEQ ID NO: 11116 - DNA, 140 bp, Artificial Sequence
  Synthetic
caccgctgtcccaaaaggtcgtgggcaccgacgctcattacggctaaaaaagccaacgttttacagcagcatggtaagagtctcagacagttgcatagaacaatcagggctgccagcggacatatcagcagccagggcct

SEQ ID NO: 11117 - DNA, 140 bp, Artificial Sequence
  Synthetic
aggccctggctgctgatatgaaaaaccataaacagaagtagttcaaagggctataaaacccctgaatagtaacaaaacataaaattaataaaaatcaaatgaataccataattggcaaacgaccttttgggacagcggtg

SEQ ID NO: 11118 - DNA, 140 bp, Artificial Sequence
  Synthetic
caccgctgtcccaaaaggtcgtttgccaattatggtattcatttgatttttattaattttatgttttgttactattcaggggttttatagccctttgaactacttctgtttatggtttttcatatcagcagccagggcct

SEQ ID NO: 11119 - DNA, 140 bp, Artificial Sequence
  Synthetic
atacgccatgctgggtctccatggctgcgtgagatacacgtagcctatcagtttcttactgctctactctgcaaagcaagagatcaataacccatcatggattctgtgtacgtggatatacgtacttgggagtcggccat

SEQ ID NO: 11120 - DNA, 140 bp, Artificial Sequence
  Synthetic
atggccgactcccaagtacgtatatccacgtacacagaatccatgatgggttattgatctcttgctttgcagagtagagcagtaagaaactgataggctacgtgtatctcacgcagccatggagacccagcatggcgtat

SEQ ID NO: 11121 - DNA, 140 bp, Artificial Sequence
  Synthetic
aggccctggctgctgatatggactcgctaattatgcgagaaagctcgcatctgccgcaggaaaagtcctggacagaaacatttctggaaagatcggggacttacaagcggtgatggccgtgaccttttgggacagcggtg

SEQ ID NO: 11122 - DNA, 140 bp, Artificial Sequence
  Synthetic
caccgctgtcccaaaaggtcacggccatcaccgcttgtaagtccccgatctttccagaaatgtttctgtccaggacttttcctgcggcagatgcgagctttctcgcataattagcgagtccatatcagcagccagggcct

SEQ ID NO: 11123 - DNA, 140 bp, Artificial Sequence
  Synthetic
atacgccatgctgggtctccgcagacggattcttgatgtgcaagactaccgatacggttgacggcgaaagagtgtcattctcggtgtgcacgtacgtgccggcgaccatttgtgatcaaacgtacttgggagtcggccat

SEQ ID NO: 11124 - DNA, 140 bp, Artificial Sequence
  Synthetic
atggccgactcccaagtacgtttgatcacaaatggtcgccggcacgtacgtgcacaccgagaatgacactctttcgccgtcaaccgtatcggtagtcttgcacatcaagaatccgtctgcggagacccagcatggcgtat

SEQ ID NO: 11125 - DNA, 140 bp, Artificial Sequence
  Synthetic
atacgccatgctgggtctccgtaagtgggcgaaggagtgccggaaggacatggaagatgagaagcttctgggggtcagagaaagaacactaacctgctgctgtctgtgggcatttaagaacgtacttgggagtcggccat

SEQ ID NO: 11126 - DNA, 140 bp, Artificial Sequence
  Synthetic
atggccgactcccaagtacgttcttaaatgcccacagacagcagcaggttagtgttctttctctgacccccagaagcttctcatcttccatgtccttccggcactccttcgcccacttacggagacccagcatggcgtat

SEQ ID NO: 11127 - DNA, 140 bp, Artificial Sequence
  Synthetic
aggccctggctgctgatatggaagggaattctcagctgcaaatctctttctcgacggccttagccagcgccgaattccgcgtacaagtctgttctacacaagtacactgtgcagctgagtgaccttttgggacagcggtg

SEQ ID NO: 11128 - DNA, 140 bp, Artificial Sequence
  Synthetic
caccgctgtcccaaaaggtcactcagctgcacagtgtacttgtgtagaacagacttgtacgcggaattcggcgctggctaaggccgtcgagaaagagatttgcagctgagaattcccttccatatcagcagccagggcct

SEQ ID NO: 11129 - DNA, 140 bp, Artificial Sequence
  Synthetic
aggccctggctgctgatatgcagggaggtatgcggtcgaagcgtacgatgcccgagtcctagtgccctcaggctatgcaatttcgcctgaagacttccagagtctaagcgaaagcgcaacgaccttttgggacagcggtg

SEQ ID NO: 11130 - DNA, 140 bp, Artificial Sequence
  Synthetic
caccgctgtcccaaaaggtcgttgcgctttcgcttagactctggaagtcttcaggcgaaattgcatagcctgagggcactaggactcgggcatcgtacgcttcgaccgcatacctccctgcatatcagcagccagggcct

SEQ ID NO: 11131 - DNA, 140 bp, Artificial Sequence
  Synthetic
aggccctggctgctgatatgagacacattgtatgtaggtgataagtatagatcaaagggccgaataacccctgaatagtaacaaaatatgaaaatcaataaaaatcataaaatagaaaaagaccttttgggacagcggtg

SEQ ID NO: 11132 - DNA, 140 bp, Artificial Sequence
  Synthetic
caccgctgtcccaaaaggtctttttctattttatgatttttattgattttcatattttgttactattcaggggttattcggccctttgatctatacttatcacctacatacaatgtgtctcatatcagcagccagggcct

SEQ ID NO: 11133 - DNA, 140 bp, Artificial Sequence
  Synthetic
atacgccatgctgggtctccaaagtatctccaggcggtgtacactgcctgtgactgccattgtgtcgtcgttgcattacgaaggcaaaatgcgcactacgaatgagtacaacatgccgatcgtacttgggagtcggccat

SEQ ID NO: 11134 - DNA, 140 bp, Artificial Sequence
  Synthetic
atggccgactcccaagtacgatcggcatgttgtactcattcgtagtgcgcattttgccttcgtaatgcaacgacgacacaatggcagtcacaggcagtgtacaccgcctggagatactttggagacccagcatggcgtat

SEQ ID NO: 11135 - DNA, 140 bp, Artificial Sequence
  Synthetic
aggccctggctgctgatatgaccataattggcaaacggaagagatgtaggtacttaagcttcctaaaagcagccgaactcactttgagaagtaggcatagcataccgaactcttccacgtgaccttttgggacagcggtg

SEQ ID NO: 11136 - DNA, 140 bp, Artificial Sequence
  Synthetic
caccgctgtcccaaaaggtcacgtggaagagttcggtatgctatgcctacttctcaaagtgagttcggctgcttttaggaagcttaagtacctacatctcttccgtttgccaattatggtcatatcagcagccagggcct

SEQ ID NO: 11137 - DNA, 140 bp, Artificial Sequence
  Synthetic
aggccctggctgctgatatggcccgatgcgcagcgcagaagatcccgagagactcgccaattatgcgagaaagctagcatctgccgcaggaaaagtcctggacagaaacatctctggaaagaccttttgggacagcggtg

SEQ ID NO: 11138 - DNA, 140 bp, Artificial Sequence
  Synthetic
caccgctgtcccaaaaggtctttccagagatgtttctgtccaggacttttcctgcggcagatgctagctttctcgcataattggcgagtctctcgggatcttctgcgctgcgcatcgggccatatcagcagccagggcct

SEQ ID NO: 11139 - DNA, 140 bp, Artificial Sequence
  Synthetic
atacgccatgctgggtctccatggaatggctggttaacaagataaacggacatcatgtgctcctggttagcggctataaccttgcactgcctactaagagagtcacctgggtagcgccaccgtacttgggagtcggccat

SEQ ID NO: 11140 - DNA, 140 bp, Artificial Sequence
  Synthetic
atggccgactcccaagtacggtggcgctacccaggtgactctcttagtaggcagtgcaaggttatagccgctaaccaggagcacatgatgtccgtttatcttgttaaccagccattccatggagacccagcatggcgtat

SEQ ID NO: 11141 - DNA, 140 bp, Artificial Sequence
  Synthetic
aggccctggctgctgatatgcattctgcttacacacagatgtctcatgtagacagagagcagacgtcgcgatataccaagacgtctatgctatacacgcacccacgtcgctataccaccagaccttttgggacagcggtg

SEQ ID NO: 11142 - DNA, 140 bp, Artificial Sequence
  Synthetic
caccgctgtcccaaaaggtctggtggtatagcgacgtgggtgcgtgtatagcatagacgtcttggtatatcgcgacgtctgctctctgtctacatgagacatctgtgtgtaagcagaatgcatatcagcagccagggcct

SEQ ID NO: 11143 - DNA, 140 bp, Artificial Sequence
  Synthetic
aggccctggctgctgatatgcgttcatgtacaatgccatggcgggtgcctacccctcatattcgacaaactgggccgatgagcaggtactgaaggctaagaacataggattatgttcaacgaccttttgggacagcggtg

SEQ ID NO: 11144 - DNA, 140 bp, Artificial Sequence
  Synthetic
caccgctgtcccaaaaggtcgttgaacataatcctatgttcttagccttcagtacctgctcatcggcccagtttgtcgaatatgaggggtaggcacccgccatggcattgtacatgaacgcatatcagcagccagggcct

SEQ ID NO: 11145 - DNA, 140 bp, Artificial Sequence
  Synthetic
atacgccatgctgggtctccactgggacgtaagtttagatcgtccagagcattgaaaccaccttgtatcaccagtaatactgagatgtttttcctatttagcagttttgacaatggcagacgtacttgggagtcggccat

SEQ ID NO: 11146 - DNA, 140 bp, Artificial Sequence
  Synthetic
atggccgactcccaagtacgtctgccattgtcaaaactgctaaataggaaaaacatctcagtattactggtgatacaaggtggtttcaatgctctggacgatctaaacttacgtcccagtggagacccagcatggcgtat

SEQ ID NO: 11147 - DNA, 140 bp, Artificial Sequence
  Synthetic
atacgccatgctgggtctccaggaattttacaacgcatgtcatgaacaatcaactgaacgcagcctttgtaggacaggccacccgagcaggatgtgcaccatcgtaccgggtaaaacgcacgtacttgggagtcggccat

SEQ ID NO: 11148 - DNA, 140 bp, Artificial Sequence
  Synthetic
atggccgactcccaagtacgtgcgttttacccggtacgatggtgcacatcctgctcgggtggcctgtcctacaaaggctgcgttcagttgattgttcatgacatgcgttgtaaaattcctggagacccagcatggcgtat

SEQ ID NO: 11149 - DNA, 140 bp, Artificial Sequence
  Synthetic
aggccctggctgctgatatgaggacaggccacccgagcaggatgtgcaccatcgtaccgggtaaaacgcatggacatcgcgaagaacgatgaagagtgcgtggtcaacgccgccaaccctgaccttttgggacagcggtg

SEQ ID NO: 11150 - DNA, 140 bp, Artificial Sequence
  Synthetic
caccgctgtcccaaaaggtcagggttggcggcgttgaccacgcactcttcatcgttcttcgcgatgtccatgcgttttacccggtacgatggtgcacatcctgctcgggtggcctgtcctcatatcagcagccagggcct

SEQ ID NO: 11151 - DNA, 140 bp, Artificial Sequence
  Synthetic
atacgccatgctgggtctccgagcgggtgcaggaataatagagactccgagaggagctatcaaagttactgcccaaccaacagaccacgtcgtgggagaatacctggtactttccccgcacgtacttgggagtcggccat

SEQ ID NO: 11152 - DNA, 140 bp, Artificial Sequence
  Synthetic
atggccgactcccaagtacgtgcggggaaagtaccaggtattctcccacgacgtggtctgttggttgggcagtaactttgatagctcctctcggagtctctattattcctgcacccgctcggagacccagcatggcgtat

SEQ ID NO: 11153 - DNA, 140 bp, Artificial Sequence
  Synthetic
atacgccatgctgggtctccagtcataggagtcttcggagtaccgggatctggcaagtcagctattatcaagaacctagttaccaggcaagacttggtgactagcggaaagaaagaaaaccgtacttgggagtcggccat

SEQ ID NO: 11154 - DNA, 140 bp, Artificial Sequence
  Synthetic
atggccgactcccaagtacggttttctttctttccgctagtcaccaagtcttgcctggtaactaggttcttgataatagctgacttgccagatcccggtactccgaagactcctatgactggagacccagcatggcgtat

SEQ ID NO: 11155 - DNA, 140 bp, Artificial Sequence
  Synthetic
atacgccatgctgggtctccgtggataaagacgctgcagaacccaccgaaaggaaacttcaaagcaactattaaggagtgggaggtggagcatgcatcatcaatggcgggcatttgtagtcgtacttgggagtcggccat

SEQ ID NO: 11156 - DNA, 140 bp, Artificial Sequence
  Synthetic
atggccgactcccaagtacgactacaaatgcccgccattgatgatgcatgctccacctcccactccttaatagttgctttgaagtttcctttcggtgggttctgcagcgtctttatccacggagacccagcatggcgtat

SEQ ID NO: 11157 - DNA, 140 bp, Artificial Sequence
  Synthetic
aggccctggctgctgatatggccaatgagcaagtctgcctatatgccctgggggaaagtattgaatcaatcaggcagaaatgcccggtggatgatgcagatgcatcatctcccccgaaaagaccttttgggacagcggtg

SEQ ID NO: 11158 - DNA, 140 bp, Artificial Sequence
  Synthetic
caccgctgtcccaaaaggtcttttcgggggagatgatgcatctgcatcatccaccgggcatttctgcctgattgattcaatactttcccccagggcatataggcagacttgctcattggccatatcagcagccagggcct

SEQ ID NO: 11159 - DNA, 140 bp, Artificial Sequence
  Synthetic
atacgccatgctgggtctccagacagcgggctattttctaaaccgttggtgtctgtgtattacgcggacaaccactgggataataggcctggagggaagatgttcggatttaaccctgagcgtacttgggagtcggccat

SEQ ID NO: 11160 - DNA, 140 bp, Artificial Sequence
  Synthetic
atggccgactcccaagtacgctcagggttaaatccgaacatcttccctccaggcctattatcccagtggttgtccgcgtaatacacagacaccaacggtttagaaaatagcccgctgtctggagacccagcatggcgtat

SEQ ID NO: 11161 - DNA, 140 bp, Artificial Sequence
  Synthetic
atacgccatgctgggtctccagaagaaaataactgaggccatacagatgcggacccaagtggagctgctggatgagcacatctccatagattgcgatattgttcgcgtgcaccctgacagcgtacttgggagtcggccat

SEQ ID NO: 11162 - DNA, 140 bp, Artificial Sequence
  Synthetic
atggccgactcccaagtacgctgtcagggtgcacgcgaacaatatcgcaatctatggagatgtgctcatccagcagctccacttgggtccgcatctgtatggcctcagttattttcttctggagacccagcatggcgtat

SEQ ID NO: 11163 - DNA, 140 bp, Artificial Sequence
  Synthetic
aggccctggctgctgatatgtgagctactaactttcggagacttcctacccggtgaagtggatgatttgacagatagcgactggtccacgtgctcagacacggacgacgagttatgactagaccttttgggacagcggtg

SEQ ID NO: 11164 - DNA, 140 bp, Artificial Sequence
  Synthetic
caccgctgtcccaaaaggtctagtcataactcgtcgtccgtgtctgagcacgtggaccagtcgctatctgtcaaatcatccacttcaccgggtaggaagtctccgaaagttagtagctcacatatcagcagccagggcct

SEQ ID NO: 11165 - DNA, 140 bp, Artificial Sequence
  Synthetic
aggccctggctgctgatatgccatcgcgcgtaagtccaagggaatatagatcttcccaggagtctgcacaggaggcgagtacggctatgtcgctgacgcatagtcgattcgacctaagcggaccttttgggacagcggtg

SEQ ID NO: 11166 - DNA, 140 bp, Artificial Sequence
  Synthetic
caccgctgtcccaaaaggtccgcttaggtcgaatcgactatgcgtcagcgacatagccgtactcgcctcctgtgcagactcctgggaagatctatattcccttggacttacgcgcgatggcatatcagcagccagggcct

SEQ ID NO: 11167 - DNA, 140 bp, Artificial Sequence
  Synthetic
atacgccatgctgggtctccaagttcacgaggagaagtgttacccacctaagctggatgaattaaaggagcaactactacttaagaaactccaggaaagtgcgtccatggccaatagaagcgtacttgggagtcggccat

SEQ ID NO: 11168 - DNA, 140 bp, Artificial Sequence
  Synthetic
atggccgactcccaagtacgcttctattggccatggacgcactttcctggagtttcttaagtagtagttgctcctttaattcatccagcttaggtgggtaacacttctcctcgtgaacttggagacccagcatggcgtat

SEQ ID NO: 11169 - DNA, 140 bp, Artificial Sequence
  Synthetic
aggccctggctgctgatatgcaggtatcaatcacgcaaagtggaaaatatgaaagcaacaatcattcagagattaaagagaggctgtaaactgtatttaatggcagagaccccgaaagtcgaccttttgggacagcggtg

SEQ ID NO: 11170 - DNA, 140 bp, Artificial Sequence
  Synthetic
caccgctgtcccaaaaggtcgactttcggggtctctgccattaaatacagtttacagcctctctttaatctctgaatgattgttgctttcatattttccactttgcgtgattgatacctgcatatcagcagccagggcct

SEQ ID NO: 11171 - DNA, 140 bp, Artificial Sequence
  Synthetic
atacgccatgctgggtctccaactggaaaccttgcggccgtgtctgactgggtaatgagcaccgtacctatcgcgccgcccagaagaaggcgagggagaaacctaactgtgacatgcgaccgtacttgggagtcggccat

SEQ ID NO: 11172 - DNA, 140 bp, Artificial Sequence
  Synthetic
atggccgactcccaagtacggtcgcatgtcacagttaggtttctccctcgccttcttctgggcggcgcgataggtacggtgctcattacccagtcagacacggccgcaaggtttccagttggagacccagcatggcgtat

SEQ ID NO: 11173 - DNA, 140 bp, Artificial Sequence
  Synthetic
atacgccatgctgggtctcccagcgaaggagaaatcgaaagcttgtcttctgagctgctaactttcggagacttcctgcccggagaagtggatgacttgacagatagcgactggtccacgcgtacttgggagtcggccat

SEQ ID NO: 11174 - DNA, 140 bp, Artificial Sequence
  Synthetic
atggccgactcccaagtacgcgtggaccagtcgctatctgtcaagtcatccacttctccgggcaggaagtctccgaaagttagcagctcagaagacaagctttcgatttctccttcgctgggagacccagcatggcgtat

SEQ ID NO: 11175 - DNA, 140 bp, Artificial Sequence
  Synthetic
atacgccatgctgggtctccggacgggtcggagagttgcctggatcgagcgacattcaatccgtcaaaactgaggagctacccgaaacagcacgcctaccacgcgccctccatcagaagccgtacttgggagtcggccat

SEQ ID NO: 11176 - DNA, 140 bp, Artificial Sequence
  Synthetic
atggccgactcccaagtacggcttctgatggagggcgcgtggtaggcgtgctgtttcgggtagctcctcagttttgacggattgaatgtcgctcgatccaggcaactctccgacccgtccggagacccagcatggcgtat

SEQ ID NO: 11177 - DNA, 140 bp, Artificial Sequence
  Synthetic
atacgccatgctgggtctcctggatgaacatggaagtgaagatcatagatgcagttgtctccttgaaagccccttacttttgcggagggtttatactgcatgatactgtgacgggaacagcgtacttgggagtcggccat

SEQ ID NO: 11178 - DNA, 140 bp, Artificial Sequence
  Synthetic
atggccgactcccaagtacgctgttcccgtcacagtatcatgcagtataaaccctccgcaaaagtaaggggctttcaaggagacaactgcatctatgatcttcacttccatgttcatccaggagacccagcatggcgtat

SEQ ID NO: 11179 - DNA, 140 bp, Artificial Sequence
  Synthetic
atacgccatgctgggtctccattttgcggaagccgacagcaagtacctaaacactaatcagctacaatggagttcatcccaacccaaactttttacaacagggggtaccagcctcgaccccgtacttgggagtcggccat

SEQ ID NO: 11180 - DNA, 140 bp, Artificial Sequence
  Synthetic
atggccgactcccaagtacggggtcgaggctggtaccccctgttgtaaaaagtttgggttgggatgaactccattgtagctgattagtgtttaggtacttgctgtcggcttccgcaaaatggagacccagcatggcgtat

SEQ ID NO: 11181 - DNA, 140 bp, Artificial Sequence
  Synthetic
atacgccatgctgggtctccgacaacaagggacgcgtggtggccatagtcttaggaggagctaatgaaggagcccgtacggccctctcggtggtgacctggaataaagacattgtcactacgtacttgggagtcggccat

SEQ ID NO: 11182 - DNA, 140 bp, Artificial Sequence
  Synthetic
atggccgactcccaagtacgtagtgacaatgtctttattccaggtcaccaccgagagggccgtacgggctccttcattagctcctcctaagactatggccaccacgcgtcccttgttgtcggagacccagcatggcgtat

SEQ ID NO: 11183 - DNA, 140 bp, Artificial Sequence
  Synthetic
aggccctggctgctgatatggccaggagacgccgttttagaaacggacatagcctcctttgataagagccaggatgattcacttgcgcttaccgccttaatgctgttagaagatttgggagaccttttgggacagcggtg

SEQ ID NO: 11184 - DNA, 140 bp, Artificial Sequence
  Synthetic
caccgctgtcccaaaaggtctcccaaatcttctaacagcattaaggcggtaagcgcaagtgaatcatcctggctcttatcaaaggaggctatgtccgtttctaaaacggcgtctcctggccatatcagcagccagggcct

SEQ ID NO: 11185 - DNA, 140 bp, Artificial Sequence
  Synthetic
aggccctggctgctgatatgatcgcacattgatgtcacaacagtccggcaacgtaaagatcacagttaatggccagacggtgcggtacaagtgtaattgcggtggatcaaatgaaggactgaccttttgggacagcggtg

SEQ ID NO: 11186 - DNA, 140 bp, Artificial Sequence
  Synthetic
caccgctgtcccaaaaggtcagtccttcatttgatccaccgcaattacacttgtaccgcaccgtctggccattaactgtgatctttacgttgccggactgttgtgacatcaatgtgcgatcatatcagcagccagggcct

SEQ ID NO: 11187 - DNA, 140 bp, Artificial Sequence
  Synthetic
aggccctggctgctgatatgatcgctagccgggtgttggaagatcgtctgacaaaatctgcatgcgcggccttcatcggcgacgacaacataatacatggtgtcgtctccgatgaattgagaccttttgggacagcggtg

SEQ ID NO: 11188 - DNA, 140 bp, Artificial Sequence
  Synthetic
caccgctgtcccaaaaggtctcaattcatcggagacgacaccatgtattatgttgtcgtcgccgatgaaggccgcgcatgcagattttgtcagacgatcttccaacacccggctagcgatcatatcagcagccagggcct

SEQ ID NO: 11189 - DNA, 140 bp, Artificial Sequence
  Synthetic
atacgccatgctgggtctcctgatactgtgacaggaacagcttgcagggtggcggacccgctaaaaaggttatttaaactgggcaaaccgttagcggcaggtgacgaacaagacgaagaccgtacttgggagtcggccat

SEQ ID NO: 11190 - DNA, 140 bp, Artificial Sequence
  Synthetic
atggccgactcccaagtacggtcttcgtcttgttcgtcacctgccgctaacggtttgcccagtttaaataacctttttagcgggtccgccaccctgcaagctgttcctgtcacagtatcaggagacccagcatggcgtat

SEQ ID NO: 11191 - DNA, 140 bp, Artificial Sequence
  Synthetic
atacgccatgctgggtctcccgcagatgcatcacaccgtacgaactgacaccaggagctaccgtccctttcctgcttagcctactatgctgcatcagaacagctaaagcggccacatacccgtacttgggagtcggccat

SEQ ID NO: 11192 - DNA, 140 bp, Artificial Sequence
  Synthetic
atggccgactcccaagtacgggtatgtggccgctttagctgttctgatgcagcatagtaggctaagcaggaaagggacggtagctcctggtgtcagttcgtacggtgtgatgcatctgcgggagacccagcatggcgtat

SEQ ID NO: 11193 - DNA, 140 bp, Artificial Sequence
  Synthetic
atacgccatgctgggtctccagaagacgggcgctggccgatgaagtaatcagatggcaacgaacagggctaatagatgagctggagaaagcggtgtactctaggtacgaagtgcagggtacgtacttgggagtcggccat

SEQ ID NO: 11194 - DNA, 140 bp, Artificial Sequence
  Synthetic
atggccgactcccaagtacgtaccctgcacttcgtacctagagtacaccgctttctccagctcatctattagccctgttcgttgccatctgattacttcatcggccagcgcccgtcttctggagacccagcatggcgtat

SEQ ID NO: 11195 - DNA, 140 bp, Artificial Sequence
  Synthetic
aggccctggctgctgatatgcctgcttagcctactatgctgcatcagaacagctaaagcggccacataccaagaggctgcggtgtacctgtggaacgagcagcagcctttgttttggctagaccttttgggacagcggtg

SEQ ID NO: 11196 - DNA, 140 bp, Artificial Sequence
  Synthetic
caccgctgtcccaaaaggtctagccaaaacaaaggctgctgctcgttccacaggtacaccgcagcctcttggtatgtggccgctttagctgttctgatgcagcatagtaggctaagcaggcatatcagcagccagggcct

SEQ ID NO: 11197 - DNA, 140 bp, Artificial Sequence
  Synthetic
atacgccatgctgggtctcccgccctctctaacggacatgtcgtgcgaagtaccagcctgcacacattcctcagacttcgggggcgtcgccattattaaatatgcagccagcaagaaaggcgtacttgggagtcggccat

SEQ ID NO: 11198 - DNA, 140 bp, Artificial Sequence
  Synthetic
atggccgactcccaagtacgcctttcttgctggctgcatatttaataatggcgacgcccccgaagtctgaggaatgtgtgcaggctggtacttcgcacgacatgtccgttagagagggcgggagacccagcatggcgtat

SEQ ID NO: 11199 - DNA, 140 bp, Artificial Sequence
  Synthetic
atacgccatgctgggtctccctaagtatgaaggtatatgtgtcccctaagagacacactgtacataactaataatctatagatcaaagggctacataacccctgaataggaacaaaataccgtacttgggagtcggccat

SEQ ID NO: 11200 - DNA, 140 bp, Artificial Sequence
  Synthetic
atggccgactcccaagtacggtattttgttcctattcaggggttatgtagccctttgatctatagattattagttatgtacagtgtgtctcttaggggacacatataccttcatacttagggagacccagcatggcgtat

SEQ ID NO: 11201 - DNA, 140 bp, Artificial Sequence
  Synthetic
atacgccatgctgggtctccgaaaaagaagccgggccgcagagagagaatgtgcatgaaaatcgaaaatgattgcatctttgaagtcaagcatgaaggtaaggtaacaggttacgcgtgccgtacttgggagtcggccat

SEQ ID NO: 11202 - DNA, 140 bp, Artificial Sequence
  Synthetic
atggccgactcccaagtacggcacgcgtaacctgttaccttaccttcatgcttgacttcaaagatgcaatcattttcgattttcatgcacattctctctctgcggcccggcttctttttcggagacccagcatggcgtat

SEQ ID NO: 11203 - DNA, 140 bp, Artificial Sequence
  Synthetic
aggccctggctgctgatatgataatctatagatcaaagggctacataacccctgaataggaacaaaatacaaaatcactaaaaattataaaaacagaaaaacacataaataggtatacgtgaccttttgggacagcggtg

SEQ ID NO: 11204 - DNA, 140 bp, Artificial Sequence
  Synthetic
caccgctgtcccaaaaggtcacgtatacctatttatgtgtttttctgtttttataatttttagtgattttgtattttgttcctattcaggggttatgtagccctttgatctatagattatcatatcagcagccagggcct

SEQ ID NO: 11205 - DNA, 140 bp, Artificial Sequence
  Synthetic
aggccctggctgctgatatgtaacgcggacctggccaaattggccttcaagcggtcatctaagtacgaccttgaatgcgcgcagatacccgtgcacatgaagtccgacgctttgaagttcgaccttttgggacagcggtg

SEQ ID NO: 11206 - DNA, 140 bp, Artificial Sequence
  Synthetic
caccgctgtcccaaaaggtcgaacttcaaagcgtcggacttcatgtgcacgggtatctgcgcgcattcaaggtcgtacttagatgaccgcttgaaggccaatttggccaggtccgcgttacatatcagcagccagggcct

SEQ ID NO: 11207 - DNA, 140 bp, Artificial Sequence
  Synthetic
atacgccatgctgggtctccacccatgagaaaccggaggggtactacaactggcaccacggagcagtacagtactcaggaggccgattcaccatccctacaggtgcgggcaaaccaggggcgtacttgggagtcggccat

SEQ ID NO: 11208 - DNA, 140 bp, Artificial Sequence
  Synthetic
atggccgactcccaagtacgcccctggtttgcccgcacctgtagggatggtgaatcggcctcctgagtactgtactgctccgtggtgccagttgtagtacccctccggtttctcatgggtggagacccagcatggcgtat

SEQ ID NO: 11209 - DNA, 140 bp, Artificial Sequence
  Synthetic
atacgccatgctgggtctcctacccggaaagccgcaagctacttaggagctggcacctaccatcggtgttccatttaaagggcaagctcagcttcacatgtcgctgtgatacagtggtttcgtacttgggagtcggccat

SEQ ID NO: 11210 - DNA, 140 bp, Artificial Sequence
  Synthetic
atggccgactcccaagtacgaaaccactgtatcacagcgacatgtgaagctgagcttgccctttaaatggaacaccgatggtaggtgccagctcctaagtagcttgcggctttccgggtaggagacccagcatggcgtat

SEQ ID NO: 11211 - DNA, 140 bp, Artificial Sequence
  Synthetic
aggccctggctgctgatatgccatttaaagggcaagctcagcttcacatgtcgctgtgatacagtggtttcgtgcgaaggctacgtcgttaagagaataacgatgaacccaggcctttacgaccttttgggacagcggtg

SEQ ID NO: 11212 - DNA, 140 bp, Artificial Sequence
  Synthetic
caccgctgtcccaaaaggtcgtaaaggcctgggttcatcgttattctcttaacgacgtagccttcgcacgaaaccactgtatcacagcgacatgtgaagctgagcttgccctttaaatggcatatcagcagccagggcct

SEQ ID NO: 11213 - DNA, 140 bp, Artificial Sequence
  Synthetic
aggccctggctgctgatatggaacaaagacatcgtcacgaaaatcacccctgagggggccgaagagtggagtctggccattccagttatgtgcctgctggcaaataccacgttcccctgcgaccttttgggacagcggtg

SEQ ID NO: 11214 - DNA, 140 bp, Artificial Sequence
  Synthetic
caccgctgtcccaaaaggtcgcaggggaacgtggtatttgccagcaggcacataactggaatggccagactccactcttcggccccctcaggggtgattttcgtgacgatgtctttgttccatatcagcagccagggcct

SEQ ID NO: 11215 - DNA, 140 bp, Artificial Sequence
  Synthetic
atacgccatgctgggtctccgagagttcgtaaatagaaagctacaccatattgcgatgcacggaccagccctgaacaccgacgaggagtcgtatgagctggtgagggcagagaggacagacgtacttgggagtcggccat

SEQ ID NO: 11216 - DNA, 140 bp, Artificial Sequence
  Synthetic
atggccgactcccaagtacgtctgtcctctctgccctcaccagctcatacgactcctcgtcggtgttcagggctggtccgtgcatcgcaatatggtgtagctttctatttacgaactctcggagacccagcatggcgtat

SEQ ID NO: 11217 - DNA, 140 bp, Artificial Sequence
  Synthetic
atacgccatgctgggtctcctcgacgtgctgtacgtagacgaggcgtttgcgtgccactctggaacgttacttgcattgatcgccttggtgagaccaagacagaaagttgtactttgtggcgtacttgggagtcggccat

SEQ ID NO: 11218 - DNA, 140 bp, Artificial Sequence
  Synthetic
atggccgactcccaagtacgccacaaagtacaactttctgtcttggtctcaccaaggcgatcaatgcaagtaacgttccagagtggcacgcaaacgcctcgtctacgtacagcacgtcgaggagacccagcatggcgtat

SEQ ID NO: 11219 - DNA, 140 bp, Artificial Sequence
  Synthetic
aggccctggctgctgatatgagtcaccaaatgacctttgatacattccaaaacaaagccaacgtttgttgggctaagagtttggtccctatcctcgaaacagcgaggataaaactaaacggaccttttgggacagcggtg

SEQ ID NO: 11220 - DNA, 140 bp, Artificial Sequence
  Synthetic
caccgctgtcccaaaaggtccgtttagttttatcctcgctgtttcgaggatagggaccaaactcttagcccaacaaacgttggctttgttttggaatgtatcaaaggtcatttggtgactcatatcagcagccagggcct

SEQ ID NO: 11221 - DNA, 140 bp, Artificial Sequence
  Synthetic
atacgccatgctgggtctccgatcagtcactcatgtacgcacccatttcaccacgaccctcctgtgataggccgggaaaaattccattcccgaccgcagcacggtagggaactaccttgccgtacttgggagtcggccat

SEQ ID NO: 11222 - DNA, 140 bp, Artificial Sequence
  Synthetic
atggccgactcccaagtacggcaaggtagttccctaccgtgctgcggtcgggaatggaatttttcccggcctatcacaggagggtcgtggtgaaatgggtgcgtacatgagtgactgatcggagacccagcatggcgtat

SEQ ID NO: 11223 - DNA, 140 bp, Artificial Sequence
  Synthetic
aggccctggctgctgatatggccgggaaaaattccattcccgaccgcagcacggtagggaactaccttgcagcacgtacgcgcagagcaccgctgcaactgccgaggagatagaggtacagaccttttgggacagcggtg

SEQ ID NO: 11224 - DNA, 140 bp, Artificial Sequence
  Synthetic
caccgctgtcccaaaaggtctgtacctctatctcctcggcagttgcagcggtgctctgcgcgtacgtgctgcaaggtagttccctaccgtgctgcggtcgggaatggaatttttcccggccatatcagcagccagggcct

SEQ ID NO: 11225 - DNA, 140 bp, Artificial Sequence
  Synthetic
aggccctggctgctgatatgttgagactgctcaaaccgggcggctctctattgatcagagcatatggttacgcagatagaaccagtgaacgagtcatctgcgtactgggacgcaagtttagaccttttgggacagcggtg

SEQ ID NO: 11226 - DNA, 140 bp, Artificial Sequence
  Synthetic
caccgctgtcccaaaaggtctaaacttgcgtcccagtacgcagatgactcgttcactggttctatctgcgtaaccatatgctctgatcaatagagagccgcccggtttgagcagtctcaacatatcagcagccagggcct

SEQ ID NO: 11227 - DNA, 140 bp, Artificial Sequence
  Synthetic
aggccctggctgctgatatgctatgtctcttcaggcaccgccgagtaccgccacggaactgagtcacccgccgatctccttcggtgtaccaagcgagacgttccccatcacattcggggagaccttttgggacagcggtg

SEQ ID NO: 11228 - DNA, 140 bp, Artificial Sequence
  Synthetic
caccgctgtcccaaaaggtctccccgaatgtgatggggaacgtctcgcttggtacaccgaaggagatcggcgggtgactcagttccgtggcggtactcggcggtgcctgaagagacatagcatatcagcagccagggcct

SEQ ID NO: 11229 - DNA, 140 bp, Artificial Sequence
  Synthetic
aggccctggctgctgatatgcaaggttgatcaatgccatgccgcggtcaccaatcacaaaaaatggcagtataattcccctctggtcccgcgcaatgctgaatccggggaccggaaaggagaccttttgggacagcggtg

SEQ ID NO: 11230 - DNA, 140 bp, Artificial Sequence
  Synthetic
caccgctgtcccaaaaggtctcctttccggtccccggattcagcattgcgcgggaccagaggggaattatactgccattttttgtgattggtgaccgcggcatggcattgatcaaccttgcatatcagcagccagggcct

SEQ ID NO: 11231 - DNA, 140 bp, Artificial Sequence
  Synthetic
atacgccatgctgggtctccaacttaggagctacccaaaacagcacgcttaccacgcgccctccatcagaagcgctgtaccgtccccattccagaacactctacagaatgtactggcagccgtacttgggagtcggccat

SEQ ID NO: 11232 - DNA, 140 bp, Artificial Sequence
  Synthetic
atggccgactcccaagtacggctgccagtacattctgtagagtgttctggaatggggacggtacagcgcttctgatggagggcgcgtggtaagcgtgctgttttgggtagctcctaagttggagacccagcatggcgtat

SEQ ID NO: 11233 - DNA, 140 bp, Artificial Sequence
  Synthetic
atacgccatgctgggtctccgaatttaacaacctacgttactaaactaaaggggccaaaagcagcagcgctatttgcaagaacccataatctgctgccactgcaggaagtgccaatggatcgtacttgggagtcggccat

SEQ ID NO: 11234 - DNA, 140 bp, Artificial Sequence
  Synthetic
atggccgactcccaagtacgatccattggcacttcctgcagtggcagcagattatgggttcttgcaaatagcgctgctgcttttggcccctttagtttagtaacgtaggttgttaaattcggagacccagcatggcgtat

SEQ ID NO: 11235 - DNA, 140 bp, Artificial Sequence
  Synthetic
aggccctggctgctgatatgcgtgccgactgaagggctcgaggtcacgtggggtaacaatgagccgtacaagtattggccgcagttatccacaaacggtacagcccacggccacccgcatgaccttttgggacagcggtg

SEQ ID NO: 11236 - DNA, 140 bp, Artificial Sequence
  Synthetic
caccgctgtcccaaaaggtcatgcgggtggccgtgggctgtaccgtttgtggataactgcggccaatacttgtacggctcattgttaccccacgtgacctcgagcccttcagtcggcacgcatatcagcagccagggcct

SEQ ID NO: 11237 - DNA, 140 bp, Artificial Sequence
  Synthetic
aggccctggctgctgatatgggacttgatagaggctgctttcggagagatttccagctgtcatctaccgacaggtacgcgcttcaagtttggcgccatgatgaaatctggtatgttcctagaccttttgggacagcggtg

SEQ ID NO: 11238 - DNA, 140 bp, Artificial Sequence
  Synthetic
caccgctgtcccaaaaggtctaggaacataccagatttcatcatggcgccaaacttgaagcgcgtacctgtcggtagatgacagctggaaatctctccgaaagcagcctctatcaagtcccatatcagcagccagggcct

SEQ ID NO: 11239 - DNA, 140 bp, Artificial Sequence
  Synthetic
aggccctggctgctgatatgtgacaatgcgcgcggtaccccaacagaagccacgcaggaatcggaagaacaagaagcaaaagcaaaagcaacaggcgccacaaaacaacacaaaccaaaagaccttttgggacagcggtg

SEQ ID NO: 11240 - DNA, 140 bp, Artificial Sequence
  Synthetic
caccgctgtcccaaaaggtcttttggtttgtgttgttttgtggcgcctgttgcttttgcttttgcttcttgttcttccgattcctgcgtggcttctgttggggtaccgcgcgcattgtcacatatcagcagccagggcct

SEQ ID NO: 11241 - DNA, 140 bp, Artificial Sequence
  Synthetic
aggccctggctgctgatatgttttttagccgtactgagcgtcggtgcccacactgtgagcgcgtacgaacacgtaacagtgatcccgaacacggtgggagtaccgtataagactctagtcgaccttttgggacagcggtg

SEQ ID NO: 11242 - DNA, 140 bp, Artificial Sequence
  Synthetic
caccgctgtcccaaaaggtcgactagagtcttatacggtactcccaccgtgttcgggatcactgttacgtgttcgtacgcgctcacagtgtgggcaccgacgctcagtacggctaaaaaacatatcagcagccagggcct

SEQ ID NO: 11243 - DNA, 140 bp, Artificial Sequence
  Synthetic
aggccctggctgctgatatgacgtaacagtgatcccgaacacggtgggagtaccgtataagactctagtcaacagaccgggctacagccccatggtactggagatggagcttctgtctgtgaccttttgggacagcggtg

SEQ ID NO: 11244 - DNA, 140 bp, Artificial Sequence
  Synthetic
caccgctgtcccaaaaggtcacagacagaagctccatctccagtaccatggggctgtagcccggtctgttgactagagtcttatacggtactcccaccgtgttcgggatcactgttacgtcatatcagcagccagggcct

SEQ ID NO: 11245 - DNA, 140 bp, Artificial Sequence
  Synthetic
atacgccatgctgggtctccgacgggacgctgaaaatccaggtctccttgcaaattggaataaagacggatggtagccatgattggaccaagctgcgttacatggacagtcacatgccagcgtacttgggagtcggccat

SEQ ID NO: 11246 - DNA, 140 bp, Artificial Sequence
  Synthetic
atggccgactcccaagtacgctggcatgtgactgtccatgtaacgcagcttggtccaatcatggctaccatccgtctttattccaatttgcaaggagacctggattttcagcgtcccgtcggagacccagcatggcgtat

SEQ ID NO: 11247 - DNA, 140 bp, Artificial Sequence
  Synthetic
aggccctggctgctgatatgtcccgaccgcagcacggtaaagagctaccttgcagcacgtacgtgcagagcaccgccgtaactgccgaggagatagaggtacacatgcccccagacacccgaccttttgggacagcggtg

SEQ ID NO: 11248 - DNA, 140 bp, Artificial Sequence
  Synthetic
caccgctgtcccaaaaggtcgggtgtctgggggcatgtgtacctctatctcctcggcagttacggcggtgctctgcacgtacgtgctgcaaggtagctctttaccgtgctgcggtcgggacatatcagcagccagggcct

SEQ ID NO: 11249 - DNA, 140 bp, Artificial Sequence
  Synthetic
atacgccatgctgggtctccctgatcgcacattgatgtcacaacagtccggcaacgtaaagatcacagtcaacggccagacggtgcggtataagtgtaattgtggtggctcaaatgaaggcgtacttgggagtcggccat

SEQ ID NO: 11250 - DNA, 140 bp, Artificial Sequence
  Synthetic
atggccgactcccaagtacgccttcatttgagccaccacaattacacttataccgcaccgtctggccgttgactgtgatctttacgttgccggactgttgtgacatcaatgtgcgatcagggagacccagcatggcgtat

SEQ ID NO: 11251 - DNA, 140 bp, Artificial Sequence
  Synthetic
aggccctggctgctgatatgtgagcgaagcacatgtggagaagtccgaatcatgcaaaacagaatttgcatcagcatacagggctcataccgcatccgcatcagctaagctccgcgtcctgaccttttgggacagcggtg

SEQ ID NO: 11252 - DNA, 140 bp, Artificial Sequence
  Synthetic
caccgctgtcccaaaaggtcaggacgcggagcttagctgatgcggatgcggtatgagccctgtatgctgatgcaaattctgttttgcatgattcggacttctccacatgtgcttcgctcacatatcagcagccagggcct

SEQ ID NO: 11253 - DNA, 140 bp, Artificial Sequence
  Synthetic
aggccctggctgctgatatgatgccgcggtcaccaatcacaaaaagtggcagtataactcccctctggtcccgcgtaacgctgaactcggggaccgaaagggaaaaattcacatcccgttgaccttttgggacagcggtg

SEQ ID NO: 11254 - DNA, 140 bp, Artificial Sequence
  Synthetic
caccgctgtcccaaaaggtcaacgggatgtgaatttttccctttcggtccccgagttcagcgttacgcgggaccagaggggagttatactgccactttttgtgattggtgaccgcggcatcatatcagcagccagggcct

SEQ ID NO: 11255 - DNA, 140 bp, Artificial Sequence
  Synthetic
atacgccatgctgggtctccacactcctgtcctaccggaatatgggagaagaaccaaactatcaagaagagtgggtgacgcataagaaggaggtcgtgctaaccgtgccgactgaagggccgtacttgggagtcggccat

SEQ ID NO: 11256 - DNA, 140 bp, Artificial Sequence
  Synthetic
atggccgactcccaagtacggcccttcagtcggcacggttagcacgacctccttcttatgcgtcacccactcttcttgatagtttggttcttctcccatattccggtaggacaggagtgtggagacccagcatggcgtat

SEQ ID NO: 11257 - DNA, 140 bp, Artificial Sequence
  Synthetic
aggccctggctgctgatatgccccatggtactggagatggagctactgtcagtcactttggagccaacgctatcgcttgactacatcacgtgcgagtacaaaaccgtcatcccgtctccggaccttttgggacagcggtg

SEQ ID NO: 11258 - DNA, 140 bp, Artificial Sequence
  Synthetic
caccgctgtcccaaaaggtccggagacgggatgacggttttgtactcgcacgtgatgtagtcaagcgatagcgttggctccaaagtgactgacagtagctccatctccagtaccatggggcatatcagcagccagggcct

SEQ ID NO: 11259 - DNA, 140 bp, Artificial Sequence
  Synthetic
atacgccatgctgggtctcctccaaagtcgcacgcctgagagcgaagacgtctatgctaatacacaactggtactgcatagaccgtccgcgggtacggtgcacgtgccgtactctcaggccgtacttgggagtcggccat

SEQ ID NO: 11260 - DNA, 140 bp, Artificial Sequence
  Synthetic
atggccgactcccaagtacggcctgagagtacggcacgtgcaccgtacccgcggacggtctatgcagtaccagttgtgtattagcatagacgtcttcgctctcaggcgtgcgactttggaggagacccagcatggcgtat

SEQ ID NO: 11261 - DNA, 140 bp, Artificial Sequence
  Synthetic
atacgccatgctgggtctccgagaagtccgaatcatgcaaaatagaatttgcatcagcatacagggctcataccgcatccacatcagctaagctccgcgtcctttaccaaggaaataacacgtacttgggagtcggccat

SEQ ID NO: 11262 - DNA, 140 bp, Artificial Sequence
  Synthetic
atggccgactcccaagtacgtgttatttccttggtaaaggacgcggagcttagctgatgtggatgcggtatgagccctgtatgctgatgcaaattctattttgcatgattcggacttctcggagacccagcatggcgtat

SEQ ID NO: 11263 - DNA, 140 bp, Artificial Sequence
  Synthetic
atacgccatgctgggtctccaccatctggcttcaagtattggctaaaagaacgaggggcgtcgctacagcacacagcaccatttggctgtcaaatagcaacaaacccggtaagagcgatacgtacttgggagtcggccat

SEQ ID NO: 11264 - DNA, 140 bp, Artificial Sequence
  Synthetic
atggccgactcccaagtacgtatcgctcttaccgggtttgttgctatttgacagccaaatggtgctgtgtgctgtagcgacgcccctcgttcttttagccaatacttgaagccagatggtggagacccagcatggcgtat

SEQ ID NO: 11265 - DNA, 140 bp, Artificial Sequence
  Synthetic
aggccctggctgctgatatgattggttaaaagaacgaggggcgtcgctacagcacacagcaccatttggctgccaaatagcaacaaacccggtaagagcgatgaactgcgccgtggggaagaccttttgggacagcggtg

SEQ ID NO: 11266 - DNA, 140 bp, Artificial Sequence
  Synthetic
caccgctgtcccaaaaggtcttccccacggcgcagttcatcgctcttaccgggtttgttgctatttggcagccaaatggtgctgtgtgctgtagcgacgcccctcgttcttttaaccaatcatatcagcagccagggcct

SEQ ID NO: 11267 - DNA, 140 bp, Artificial Sequence
  Synthetic
aggccctggctgctgatatgaactgcgccgtagggaacatgcctatctccatcgacataccggacgcggcctttaccagggtcgtcgacgcgccatctttaacggacatgtcgtgtgagggaccttttgggacagcggtg

SEQ ID NO: 11268 - DNA, 140 bp, Artificial Sequence
  Synthetic
caccgctgtcccaaaaggtccctcacacgacatgtccgttaaagatggcgcgtcgacgaccctggtaaaggccgcgtccggtatgtcgatggagataggcatgttccctacggcgcagttcatatcagcagccagggcct

SEQ ID NO: 11269 - DNA, 140 bp, Artificial Sequence
  Synthetic
aggccctggctgctgatatgtatcagcctgcacccattcctcagactttgggggcgtagccatcattaaatatgcagccagtaagaaaggcaagtgtgcagtgcactcgatgactaacgcgaccttttgggacagcggtg

SEQ ID NO: 11270 - DNA, 140 bp, Artificial Sequence
  Synthetic
caccgctgtcccaaaaggtcgcgttagtcatcgagtgcactgcacacttgcctttcttactggctgcatatttaatgatggctacgcccccaaagtctgaggaatgggtgcaggctgatacatatcagcagccagggcct

SEQ ID NO: 11271 - DNA, 140 bp, Artificial Sequence
  Synthetic
aggccctggctgctgatatgtatgcagccagtaagaaaggcaagtgtgcagtgcactcgatgactaacgccgtcactattcgggaagctgaaatagaagtggaagggaactctcagttgcgaccttttgggacagcggtg

SEQ ID NO: 11272 - DNA, 140 bp, Artificial Sequence
  Synthetic
caccgctgtcccaaaaggtcgcaactgagagttcccttccacttctatttcagcttcccgaatagtgacggcgttagtcatcgagtgcactgcacacttgcctttcttactggctgcatacatatcagcagccagggcct

SEQ ID NO: 11273 - DNA, 140 bp, Artificial Sequence
  Synthetic
atacgccatgctgggtctcccgtcactattcgggaagctgaaatagaagtggaagggaactctcagttgcaaatctcttttttgacggccctagccagcgccgaattccgcgtacaagtccgtacttgggagtcggccat

SEQ ID NO: 11274 - DNA, 140 bp, Artificial Sequence
  Synthetic
atggccgactcccaagtacggacttgtacgcggaattcggcgctggctagggccgtcaaaaaagagatttgcaactgagagttcccttccacttctatttcagcttcccgaatagtgacgggagacccagcatggcgtat

SEQ ID NO: 11275 - DNA, 140 bp, Artificial Sequence
  Synthetic
atacgccatgctgggtctccggggcgaacaacccctgaatagtaacaaaatatgaaaaattaaaaaaaaaaaaaaaaaaaaaaaaaaaaaaaaaaaaaaaaaaaaaaaaaaaaaaaaaaacgtacttgggagtcggccat

SEQ ID NO: 11276 - DNA, 140 bp, Artificial Sequence
  Synthetic
atggccgactcccaagtacgtttttttttttttttttttttttttttttttttttttttttttttttttttttttttttaatttttcatattttgttactattcaggggttgttcgccccggagacccagcatggcgtat

SEQ ID NO: 11277 - DNA, 140 bp, Artificial Sequence
  Synthetic
atacgccatgctgggtctccacgactaagcatgaaggtatatgtgtcccctaagagacacaccgtatatagctaataatctatagatcaaagggctacataacccctgaatagtaacaaacgtacttgggagtcggccat

SEQ ID NO: 11278 - DNA, 140 bp, Artificial Sequence
  Synthetic
atggccgactcccaagtacgtttgttactattcaggggttatgtagccctttgatctatagattattagctatatacggtgtgtctcttaggggacacatataccttcatgcttagtcgtggagacccagcatggcgtat

SEQ ID NO: 11279 - DNA, 140 bp, Artificial Sequence
  Synthetic
atacgccatgctgggtctcctatagtcaattacccggcgtcacacaccacccccggggtccaagacatttccgctacggcgatgtcatgggtgcagaagatcacgggaggtgtgggactgcgtacttgggagtcggccat

SEQ ID NO: 11280 - DNA, 140 bp, Artificial Sequence
  Synthetic
atggccgactcccaagtacgcagtcccacacctcccgtgatcttctgcacccatgacatcgccgtagcggaaatgtcttggaccccgggggtggtgtgtgacgccgggtaattgactataggagacccagcatggcgtat

SEQ ID NO: 11281 - DNA, 140 bp, Artificial Sequence
  Synthetic
aggccctggctgctgatatgaaaaaaaaaaaaaaaaaaaaaaaaaaaaaaaaaaaaaaaaaaaaaaaaaaaaaaaaaaaaaaaaaatcataaaatagaaaaaccataaacagaagtagttgaccttttgggacagcggtg

SEQ ID NO: 11282 - DNA, 140 bp, Artificial Sequence
  Synthetic
caccgctgtcccaaaaggtcaactacttctgtttatggtttttctattttatgattttttttttttttttttttttttttttttttttttttttttttttttttttttttttttttttttcatatcagcagccagggcct

SEQ ID NO: 11283 - DNA, 140 bp, Artificial Sequence
  Synthetic
atacgccatgctgggtctccgttgtcgctgttgcagcactgatcctaatcgtggtgctatgcgtgtcgtttagcaggcactaacttgacaactaggtatgaaggcatacgcgtccctaaacgtacttgggagtcggccat

SEQ ID NO: 11284 - DNA, 140 bp, Artificial Sequence
  Synthetic
atggccgactcccaagtacgtttagggacgcgtatgccttcatacctagttgtcaagttagtgcctgctaaacgacacgcatagcaccacgattaggatcagtgctgcaacagcgacaacggagacccagcatggcgtat

SEQ ID NO: 11285 - DNA, 140 bp, Artificial Sequence
  Synthetic
aggccctggctgctgatatgaaaatagaaaactagaaatagaagtaggtaagaaggtatatgtgtcccctaagagacacaccatatatagctaagaatcaatagataagcatagatcaaagaccttttgggacagcggtg

SEQ ID NO: 11286 - DNA, 140 bp, Artificial Sequence
  Synthetic
caccgctgtcccaaaaggtctttgatctatgcttatctattgattcttagctatatatggtgtgtctcttaggggacacatataccttcttacctacttctatttctagttttctattttcatatcagcagccagggcct

SEQ ID NO: 11287 - DNA, 140 bp, Artificial Sequence
  Synthetic
aggccctggctgctgatatgctgtatcctgaccacccaacactcctgtcctaccggaatatgggagaagaaccaaactatctagaagagtgggtgatgcctaagaaggaagtcgtgctaagaccttttgggacagcggtg

SEQ ID NO: 11288 - DNA, 140 bp, Artificial Sequence
  Synthetic
caccgctgtcccaaaaggtcttagcacgacttccttcttaggcatcacccactcttctagatagtttggttcttctcccatattccggtaggacaggagtgttgggtggtcaggatacagcatatcagcagccagggcct

SEQ ID NO: 11289 - DNA, 140 bp, Artificial Sequence
  Synthetic
aggccctggctgctgatatgtgaatagtaacaaaatataaaactaataaaaatcaaacgaataccataattggcaatcggaagagatgtaggtacttaagcttcctaaaagcagccgaacgaccttttgggacagcggtg

SEQ ID NO: 11290 - DNA, 140 bp, Artificial Sequence
  Synthetic
caccgctgtcccaaaaggtcgttcggctgcttttaggaagcttaagtacctacatctcttccgattgccaattatggtattcgtttgatttttattagttttatattttgttactattcacatatcagcagccagggcct

SEQ ID NO: 11291 - DNA, 140 bp, Artificial Sequence
  Synthetic
atacgccatgctgggtctcctcgctttgagatgtaggcgtagcacaccgaactcttccacgattctccgaacccacagggacgtaggagaagttcaaagtgactataaaaaccctgaacacgtacttgggagtcggccat

SEQ ID NO: 11292 - DNA, 140 bp, Artificial Sequence
  Synthetic
atggccgactcccaagtacgtgttcagggtttttatagtcactttgaacttctcctacgtccctgtgggttcggagaatcgtggaagagttcggtgtgctacgcctacatctcaaagcgaggagacccagcatggcgtat

SEQ ID NO: 11293 - DNA, 140 bp, Artificial Sequence
  Synthetic
atacgccatgctgggtctcctccccggagggacccccccatttcttactgctctactctgcaaagcaagagattaataacccatcatggatcctgtgtacgtggacatagacgctgacagcgtacttgggagtcggccat

SEQ ID NO: 11294 - DNA, 140 bp, Artificial Sequence
  Synthetic
atggccgactcccaagtacgctgtcagcgtctatgtccacgtacacaggatccatgatgggttattaatctcttgctttgcagagtagagcagtaagaaatgggggggtccctccggggaggagacccagcatggcgtat

SEQ ID NO: 11295 - DNA, 140 bp, Artificial Sequence
  Synthetic
aggccctggctgctgatatggattaataacccatcatggatcctgtgtacgtggacatagacgctgacagcgcctttttgaaggtcctgcaacgtgcgtaccccatgtttgaggtggaacgaccttttgggacagcggtg

SEQ ID NO: 11296 - DNA, 140 bp, Artificial Sequence
  Synthetic
caccgctgtcccaaaaggtcgttccacctcaaacatggggtacgcacgttgcaggaccttcaaaaaggcgctgtcagcgtctatgtccacgtacacaggatccatgatgggttattaatccatatcagcagccagggcct

SEQ ID NO: 11297 - DNA, 140 bp, Artificial Sequence
  Synthetic
aggccctggctgctgatatggaatagtaacaaaacataaagttaataaaaatcaaatgaataccataattggcaaacggaagagatgtaggtacttaagcttcctaaaagcagccgaactgaccttttgggacagcggtg

SEQ ID NO: 11298 - DNA, 140 bp, Artificial Sequence
  Synthetic
caccgctgtcccaaaaggtcagttcggctgcttttaggaagcttaagtacctacatctcttccgtttgccaattatggtattcatttgatttttattaactttatgttttgttactattccatatcagcagccagggcct

SEQ ID NO: 11299 - DNA, 140 bp, Artificial Sequence
  Synthetic
aggccctggctgctgatatggtaggtacttaagcttcctaaaagcagccgaactcactttgagaagtaggcatagcataccgaactcttccacgattctccgaacccaccaggacgtagagaccttttgggacagcggtg

SEQ ID NO: 11300 - DNA, 140 bp, Artificial Sequence
  Synthetic
caccgctgtcccaaaaggtctctacgtcctggtgggttcggagaatcgtggaagagttcggtatgctatgcctacttctcaaagtgagttcggctgcttttaggaagcttaagtacctaccatatcagcagccagggcct

SEQ ID NO: 11301 - DNA, 140 bp, Artificial Sequence
  Synthetic
atacgccatgctgggtctccatggctgcgtgtgacacacgtagcctaccagtttcttactgctctactctgcaaagcaagagattaataacccatcatggatcctgtgtacgtggacatacgtacttgggagtcggccat

SEQ ID NO: 11302 - DNA, 140 bp, Artificial Sequence
  Synthetic
atggccgactcccaagtacgtatgtccacgtacacaggatccatgatgggttattaatctcttgctttgcagagtagagcagtaagaaactggtaggctacgtgtgtcacacgcagccatggagacccagcatggcgtat

SEQ ID NO: 11303 - DNA, 140 bp, Artificial Sequence
  Synthetic
aggccctggctgctgatatgttggtggggctgaaccagagaatagtggttaacggcagaacgcaacggaatacgaacaccatgaaaaattatctgcttcccgtggtcgcccaagccctcagaccttttgggacagcggtg

SEQ ID NO: 11304 - DNA, 140 bp, Artificial Sequence
  Synthetic
caccgctgtcccaaaaggtctgagggcttgggcgaccacgggaagcagataatttttcatggtgttcgtattccgttgcgttctgccgttaaccactattctctggttcagccccaccaacatatcagcagccagggcct

SEQ ID NO: 11305 - DNA, 140 bp, Artificial Sequence
  Synthetic
atacgccatgctgggtctcctggacatcgcgaagaacgatgaagagtgcgtagtcaacgccgctaaccctcgcggattaccgggtgacggtgtttgcaaggcagtatacaaaaaatggcccgtacttgggagtcggccat

SEQ ID NO: 11306 - DNA, 140 bp, Artificial Sequence
  Synthetic
atggccgactcccaagtacgggccattttttgtatactgccttgcaaacaccgtcacccggtaatccgcgagggttagcggcgttgactacgcactcttcatcgttcttcgcgatgtccaggagacccagcatggcgtat

SEQ ID NO: 11307 - DNA, 140 bp, Artificial Sequence
  Synthetic
atacgccatgctgggtctccacccatgagaaactggaggggtactacaactggcaccacggagcagtacagtactcaggaggccggttcaccatccctacaggtgctggcaaaccaggggcgtacttgggagtcggccat

SEQ ID NO: 11308 - DNA, 140 bp, Artificial Sequence
  Synthetic
atggccgactcccaagtacgcccctggtttgccagcacctgtagggatggtgaaccggcctcctgagtactgtactgctccgtggtgccagttgtagtacccctccagtttctcatgggtggagacccagcatggcgtat

SEQ ID NO: 11309 - DNA, 140 bp, Artificial Sequence
  Synthetic
aggccctggctgctgatatggtactcaggaggccggttcaccatccctacaggtgctggcaaaccaggggacagtggcagaccgatcttcgacaacaagggacgcgtggtggccatagtcgaccttttgggacagcggtg

SEQ ID NO: 11310 - DNA, 140 bp, Artificial Sequence
  Synthetic
caccgctgtcccaaaaggtcgactatggccaccacgcgtcccttgttgtcgaagatcggtctgccactgtcccctggtttgccagcacctgtagggatggtgaaccggcctcctgagtaccatatcagcagccagggcct

SEQ ID NO: 11311 - DNA, 140 bp, Artificial Sequence
  Synthetic
aggccctggctgctgatatggcggtcgaagcgtacgacggccgagtcctagtgccctcaggctatgcaatctcgcctgaagacttccagagtctaagcgaaagcgcaacgatggtgtatagaccttttgggacagcggtg

SEQ ID NO: 11312 - DNA, 140 bp, Artificial Sequence
  Synthetic
caccgctgtcccaaaaggtctatacaccatcgttgcgctttcgcttagactctggaagtcttcaggcgagattgcatagcctgagggcactaggactcggccgtcgtacgcttcgaccgccatatcagcagccagggcct

SEQ ID NO: 11313 - DNA, 140 bp, Artificial Sequence
  Synthetic
aggccctggctgctgatatgtaccagtttcttactgctctactctgcaaagcaagagattaataacccatcatggatcctgtgtacgtggacatagacgctgacagcgcctttttgaagggaccttttgggacagcggtg

SEQ ID NO: 11314 - DNA, 140 bp, Artificial Sequence
  Synthetic
caccgctgtcccaaaaggtcccttcaaaaaggcgctgtcagcgtctatgtccacgtacacaggatccatgatgggttattaatctcttgctttgcagagtagagcagtaagaaactggtacatatcagcagccagggcct

SEQ ID NO: 11315 - DNA, 140 bp, Artificial Sequence
  Synthetic
aggccctggctgctgatatgaaagaaaactgccaagaaatcaccaccgacgtgatgagacagagaggtctagagatatctgcacgtacggttgactcgctgctcttgaatggatgcaacagaccttttgggacagcggtg

SEQ ID NO: 11316 - DNA, 140 bp, Artificial Sequence
  Synthetic
caccgctgtcccaaaaggtctgttgcatccattcaagagcagcgagtcaaccgtacgtgcagatatctctagacctctctgtctcatcacgtcggtggtgatttcttggcagttttctttcatatcagcagccagggcct

SEQ ID NO: 11317 - DNA, 140 bp, Artificial Sequence
  Synthetic
aggccctggctgctgatatgttgtggtgacccgaagcagtgcggcttcttcaatatgatgcagatgaaagtcaactataatcacaacatctgcacccaagtgtaccacaaaagtatctccgaccttttgggacagcggtg

SEQ ID NO: 11318 - DNA, 140 bp, Artificial Sequence
  Synthetic
caccgctgtcccaaaaggtcggagatacttttgtggtacacttgggtgcagatgttgtgattatagttgactttcatctgcatcatattgaagaagccgcactgcttcgggtcaccacaacatatcagcagccagggcct

SEQ ID NO: 11319 - DNA, 140 bp, Artificial Sequence
  Synthetic
atacgccatgctgggtctccgacagcagccgcatcccaagggttaaccagaaaaggagtttacgcagttagacaaaaagttaatgaaaacccgctctatgcatcaacgtcagagcacgtccgtacttgggagtcggccat

SEQ ID NO: 11320 - DNA, 140 bp, Artificial Sequence
  Synthetic
atggccgactcccaagtacggacgtgctctgacgttgatgcatagagcgggttttcattaactttttgtctaactgcgtaaactccttttctggttaacccttgggatgcggctgctgtcggagacccagcatggcgtat

SEQ ID NO: 11321 - DNA, 140 bp, Artificial Sequence
  Synthetic
aggccctggctgctgatatgggctacgtcgttaagagaataacgatgagcccaggcctttatggaaaaaccacagggtatgcggtaacccaccacgcagacggattcctgatgtgcaagagaccttttgggacagcggtg

SEQ ID NO: 11322 - DNA, 140 bp, Artificial Sequence
  Synthetic
caccgctgtcccaaaaggtctcttgcacatcaggaatccgtctgcgtggtgggttaccgcataccctgtggtttttccataaaggcctgggctcatcgttattctcttaacgacgtagcccatatcagcagccagggcct

SEQ ID NO: 11323 - DNA, 140 bp, Artificial Sequence
  Synthetic
aggccctggctgctgatatgtaaatgataggcagtggtctcagataattcaagccttcaaagaagacaaagcatactcacctgaagtagccctgaatgaaatatgtacgcgcatgtatgggaccttttgggacagcggtg

SEQ ID NO: 11324 - DNA, 140 bp, Artificial Sequence
  Synthetic
caccgctgtcccaaaaggtcccatacatgcgcgtacatatttcattcagggctacttcaggtgagtatgctttgtcttctttgaaggcttgaattatctgagaccactgcctatcatttacatatcagcagccagggcct

SEQ ID NO: 11325 - DNA, 140 bp, Artificial Sequence
  Synthetic
aggccctggctgctgatatgattaccaacagtgcgtcgaccacgcaatgaaactgcaaatgctcgggggtgactcattgagactgctcaaaccgggcggctctctattgatcagagcatagaccttttgggacagcggtg

SEQ ID NO: 11326 - DNA, 140 bp, Artificial Sequence
  Synthetic
caccgctgtcccaaaaggtctatgctctgatcaatagagagccgcccggtttgagcagtctcaatgagtcacccccgagcatttgcagtttcattgcgtggtcgacgcactgttggtaatcatatcagcagccagggcct

SEQ ID NO: 11327 - DNA, 140 bp, Artificial Sequence
  Synthetic
aggccctggctgctgatatgaacatctgcacccaagtgtaccacaaaagtatctccaggcggtgtacactgcctgtgaccgccattgtgtcatcgttgcattacgaaggcaaaatgcgcagaccttttgggacagcggtg

SEQ ID NO: 11328 - DNA, 140 bp, Artificial Sequence
  Synthetic
caccgctgtcccaaaaggtctgcgcattttgccttcgtaatgcaacgatgacacaatggcggtcacaggcagtgtacaccgcctggagatacttttgtggtacacttgggtgcagatgttcatatcagcagccagggcct

SEQ ID NO: 11329 - DNA, 140 bp, Artificial Sequence
  Synthetic
aggccctggctgctgatatgatggcggagatacatactatgtggccaaagcaaacagaggccaatgagcaagtctgcctatatgccctgggggaaagtattgaatcgatcaggcagaaatgaccttttgggacagcggtg

SEQ ID NO: 11330 - DNA, 140 bp, Artificial Sequence
  Synthetic
caccgctgtcccaaaaggtcatttctgcctgatcgattcaatactttcccccagggcatataggcagacttgctcattggcctctgtttgctttggccacatagtatgtatctccgccatcatatcagcagccagggcct

SEQ ID NO: 11331 - DNA, 140 bp, Artificial Sequence
  Synthetic
aggccctggctgctgatatgacctaagcgttgatggcgagatactgcccgtcccgtcagacctggatgctgacgccccagccctagaaccagcactagacgacggggcgacacacacgctgaccttttgggacagcggtg

SEQ ID NO: 11332 - DNA, 140 bp, Artificial Sequence
  Synthetic
caccgctgtcccaaaaggtcagcgtgtgtgtcgccccgtcgtctagtgctggttctagggctggggcgtcagcatccaggtctgacgggacgggcagtatctcgccatcaacgcttaggtcatatcagcagccagggcct

SEQ ID NO: 11333 - DNA, 140 bp, Artificial Sequence
  Synthetic
atacgccatgctgggtctccgccatccacaaccggaaaccttgcggccgtgtctgactgggtaatgagcaccgtacctgtcgcgccgcccagaagaaggcgagggagaaacctgactgtgcgtacttgggagtcggccat

SEQ ID NO: 11334 - DNA, 140 bp, Artificial Sequence
  Synthetic
atggccgactcccaagtacgcacagtcaggtttctccctcgccttcttctgggcggcgcgacaggtacggtgctcattacccagtcagacacggccgcaaggtttccggttgtggatggcggagacccagcatggcgtat

SEQ ID NO: 11335 - DNA, 140 bp, Artificial Sequence
  Synthetic
aggccctggctgctgatatgtgggataataggcctggagggaaaatgttcggatttaaccccgaggcagcatccattctagaaagaaagtacccattcacaaaagggaagtggaacatcagaccttttgggacagcggtg

SEQ ID NO: 11336 - DNA, 140 bp, Artificial Sequence
  Synthetic
caccgctgtcccaaaaggtctgatgttccacttcccttttgtgaatgggtactttctttctagaatggatgctgcctcggggttaaatccgaacattttccctccaggcctattatcccacatatcagcagccagggcct

SEQ ID NO: 11337 - DNA, 140 bp, Artificial Sequence
  Synthetic
aggccctggctgctgatatgatacaacctagagttgggtctgccagcaacgcttggtaggtatgaccttgtggtcataaacatccacacaccttttcgcatacaccattaccaacagtgcgaccttttgggacagcggtg

SEQ ID NO: 11338 - DNA, 140 bp, Artificial Sequence
  Synthetic
caccgctgtcccaaaaggtcgcactgttggtaatggtgtatgcgaaaaggtgtgtggatgtttatgaccacaaggtcatacctaccaagcgttgctggcagacccaactctaggttgtatcatatcagcagccagggcct

SEQ ID NO: 11339 - DNA, 140 bp, Artificial Sequence
  Synthetic
aggccctggctgctgatatgagagcgttgaaaccaccatgtgtcaccagcaacactgagatgtttttcctattcagcaactttgacaatggcagaaggaatttcacaactcatgtcatgagaccttttgggacagcggtg

SEQ ID NO: 11340 - DNA, 140 bp, Artificial Sequence
  Synthetic
caccgctgtcccaaaaggtctcatgacatgagttgtgaaattccttctgccattgtcaaagttgctgaataggaaaaacatctcagtgttgctggtgacacatggtggtttcaacgctctcatatcagcagccagggcct

SEQ ID NO: 11341 - DNA, 140 bp, Artificial Sequence
  Synthetic
aggccctggctgctgatatgaaaatatctgaggccatacagatgcggacccaagtagagctgctggatgagcacatctccatagactgcgatattgttcgcgtgcaccctgacagcagctgaccttttgggacagcggtg

SEQ ID NO: 11342 - DNA, 140 bp, Artificial Sequence
  Synthetic
caccgctgtcccaaaaggtcagctgctgtcagggtgcacgcgaacaatatcgcagtctatggagatgtgctcatccagcagctctacttgggtccgcatctgtatggcctcagatattttcatatcagcagccagggcct

SEQ ID NO: 11343 - DNA, 140 bp, Artificial Sequence
  Synthetic
aggccctggctgctgatatggcagacgcatcatctccccccaaaactgtcccgtgcctttgccgttacgctatgactccagaacgcgtcacccggcttcgcatgaaccacgtcacaagcagaccttttgggacagcggtg

SEQ ID NO: 11344 - DNA, 140 bp, Artificial Sequence
  Synthetic
caccgctgtcccaaaaggtctgcttgtgacgtggttcatgcgaagccgggtgacgcgttctggagtcatagcgtaacggcaaaggcacgggacagttttggggggagatgatgcgtctgccatatcagcagccagggcct

SEQ ID NO: 11345 - DNA, 140 bp, Artificial Sequence
  Synthetic
atacgccatgctgggtctcctggagaaagcggtatactctaggtacgaagtgcagggtatatcagttgtggtaatgtccatggccacctttgcaagctccagatccaatttcgagaagctcgtacttgggagtcggccat

SEQ ID NO: 11346 - DNA, 140 bp, Artificial Sequence
  Synthetic
atggccgactcccaagtacgagcttctcgaaattggatctggagcttgcaaaggtggccatggacattaccacaactgatataccctgcacttcgtacctagagtataccgctttctccaggagacccagcatggcgtat

SEQ ID NO: 11347 - DNA, 140 bp, Artificial Sequence
  Synthetic
aggccctggctgctgatatgcttcggagcatcaagcgagacgttccccattacatttggggacttcaacgaaggagaaatcgaaagcttgtcttctgagctactaactttcggagacttcgaccttttgggacagcggtg

SEQ ID NO: 11348 - DNA, 140 bp, Artificial Sequence
  Synthetic
caccgctgtcccaaaaggtcgaagtctccgaaagttagtagctcagaagacaagctttcgatttctccttcgttgaagtccccaaatgtaatggggaacgtctcgcttgatgctccgaagcatatcagcagccagggcct

SEQ ID NO: 11349 - DNA, 140 bp, Artificial Sequence
  Synthetic
aggccctggctgctgatatggcgccctcagaggcaagctgggcaacttgcccagctgatctcagcagttaataaactgacaatgcgcgcggtaccccaacagaagccacgcaggaatcgggaccttttgggacagcggtg

SEQ ID NO: 11350 - DNA, 140 bp, Artificial Sequence
  Synthetic
caccgctgtcccaaaaggtcccgattcctgcgtggcttctgttggggtaccgcgcgcattgtcagtttattaactgctgagatcagctgggcaagttgcccagcttgcctctgagggcgccatatcagcagccagggcct

SEQ ID NO: 11351 - DNA, 140 bp, Artificial Sequence
  Synthetic
aggccctggctgctgatatggtgctgccggtgaacaccctggaggaagtccacgaggagaagtgttacccacctaagctggatgaagcaaaggagcaactattacttaagaaactccagggaccttttgggacagcggtg

SEQ ID NO: 11352 - DNA, 140 bp, Artificial Sequence
  Synthetic
caccgctgtcccaaaaggtccctggagtttcttaagtaatagttgctcctttgcttcatccagcttaggtgggtaacacttctcctcgtggacttcctccagggtgttcaccggcagcaccatatcagcagccagggcct

SEQ ID NO: 11353 - DNA, 140 bp, Artificial Sequence
  Synthetic
aggccctggctgctgatatgataaactgacaatgcgcgcggtaccccaacagaagccacgcaggaatcggaagaataagaagcaaaagcaaaaacaacaggcgccacaaaacaacacaaagaccttttgggacagcggtg

SEQ ID NO: 11354 - DNA, 140 bp, Artificial Sequence
  Synthetic
caccgctgtcccaaaaggtctttgtgttgttttgtggcgcctgttgtttttgcttttgcttcttattcttccgattcctgcgtggcttctgttggggtaccgcgcgcattgtcagtttatcatatcagcagccagggcct

SEQ ID NO: 11355 - DNA, 140 bp, Artificial Sequence
  Synthetic
aggccctggctgctgatatgggtggacgggtcggagagttgcttggaccgagcgacattcaatccgtcaaaacttaggagctacccgaaacaacatgcttatcatgcgccttctatcagagaccttttgggacagcggtg

SEQ ID NO: 11356 - DNA, 140 bp, Artificial Sequence
  Synthetic
caccgctgtcccaaaaggtctctgatagaaggcgcatgataagcatgttgtttcgggtagctcctaagttttgacggattgaatgtcgctcggtccaagcaactctccgacccgtccacccatatcagcagccagggcct

SEQ ID NO: 11357 - DNA, 140 bp, Artificial Sequence
  Synthetic
aggccctggctgctgatatgagctacccgaaacagcacgcttaccacgcgccctccatcagaagcgctgtaccgtccccattccagaacacactacagaatgtactggcagcagccacgagaccttttgggacagcggtg

SEQ ID NO: 11358 - DNA, 140 bp, Artificial Sequence
  Synthetic
caccgctgtcccaaaaggtctcgtggctgctgccagtacattctgtagtgtgttctggaatggggacggtacagcgcttctgatggagggcgcgtggtaagcgtgctgtttcgggtagctcatatcagcagccagggcct

SEQ ID NO: 11359 - DNA, 140 bp, Artificial Sequence
  Synthetic
aggccctggctgctgatatggcagagcaccgccgcaactaccgaggagatagaggtacacatgcccccagacacccctgatcgcacattaatgtcacaacagtccggcaacgtaaagatcgaccttttgggacagcggtg

SEQ ID NO: 11360 - DNA, 140 bp, Artificial Sequence
  Synthetic
caccgctgtcccaaaaggtcgatctttacgttgccggactgttgtgacattaatgtgcgatcaggggtgtctgggggcatgtgtacctctatctcctcggtagttgcggcggtgctctgccatatcagcagccagggcct

SEQ ID NO: 11361 - DNA, 140 bp, Artificial Sequence
  Synthetic
aggccctggctgctgatatgcccgtttccgctggcaaatgtaacatgcagggtgcctaaagcaaggaaccccaccgtgacgtacgggaaaaaccaagtcatcatgctactgtatcctgacgaccttttgggacagcggtg

SEQ ID NO: 11362 - DNA, 140 bp, Artificial Sequence
  Synthetic
caccgctgtcccaaaaggtcgtcaggatacagtagcatgatgacttggtttttcccgtacgtcacggtggggttccttgctttaggcaccctgcatgttacatttgccagcggaaacgggcatatcagcagccagggcct

SEQ ID NO: 11363 - DNA, 140 bp, Artificial Sequence
  Synthetic
aggccctggctgctgatatgcaactcatgtcatgaacaatcaactgaatgcagccttcgtaggacaggtcacccgagcaggatgtgcaccgtcgtaccgggtaaaacgcatggacatcgcgaccttttgggacagcggtg

SEQ ID NO: 11364 - DNA, 140 bp, Artificial Sequence
  Synthetic
caccgctgtcccaaaaggtcgcgatgtccatgcgttttacccggtacgacggtgcacatcctgctcgggtgacctgtcctacgaaggctgcattcagttgattgttcatgacatgagttgcatatcagcagccagggcct

SEQ ID NO: 11365 - DNA, 140 bp, Artificial Sequence
  Synthetic
atacgccatgctgggtctccacctgactacagctgtaaggtcttcaccggcgtctacccatttatgtggggcggcgcctactgcttctgcgacgctgaaaatacgcagttgagcgaagcacgtacttgggagtcggccat

SEQ ID NO: 11366 - DNA, 140 bp, Artificial Sequence
  Synthetic
atggccgactcccaagtacgtgcttcgctcaactgcgtattttcagcgtcgcagaagcagtaggcgccgccccacataaatgggtagacgccggtgaagaccttacagctgtagtcaggtggagacccagcatggcgtat

SEQ ID NO: 11367 - DNA, 140 bp, Artificial Sequence
  Synthetic
aggccctggctgctgatatgacgattggaccaagctgcgttatatggacaaccacatgccagcagacgcagagagggcggggctatttgtaagaacatcagcaccgtgtacgattactgggaccttttgggacagcggtg

SEQ ID NO: 11368 - DNA, 140 bp, Artificial Sequence
  Synthetic
caccgctgtcccaaaaggtcccagtaatcgtacacggtgctgatgttcttacaaatagccccgccctctctgcgtctgctggcatgtggttgtccatataacgcagcttggtccaatcgtcatatcagcagccagggcct

SEQ ID NO: 11369 - DNA, 140 bp, Artificial Sequence
  Synthetic
aggccctggctgctgatatgtcgacggccttagccagcgccgaattccgcgtacaagtctgttctacacaagtacactgtgcagctgagtgccaccccccgaaggaccacatagtcaactgaccttttgggacagcggtg

SEQ ID NO: 11370 - DNA, 140 bp, Artificial Sequence
  Synthetic
caccgctgtcccaaaaggtcagttgactatgtggtccttcggggggtggcactcagctgcacagtgtacttgtgtagaacagacttgtacgcggaattcggcgctggctaaggccgtcgacatatcagcagccagggcct

SEQ ID NO: 11371 - DNA, 140 bp, Artificial Sequence
  Synthetic
atacgccatgctgggtctcctacatagcaaataatctatagatcaaagggctacgcaacccctgaatagtaacaaaatacaaaatcactaaaaattataaaaacagaaaaatacataaatcgtacttgggagtcggccat

SEQ ID NO: 11372 - DNA, 140 bp, Artificial Sequence
  Synthetic
atggccgactcccaagtacgatttatgtatttttctgtttttataatttttagtgattttgtattttgttactattcaggggttgcgtagccctttgatctatagattatttgctatgtaggagacccagcatggcgtat

SEQ ID NO: 11373 - DNA, 140 bp, Artificial Sequence
  Synthetic
aggccctggctgctgatatggggaaaaaccaagtcatcatgctactgtatcctgaccacccaacactcctgtcctaccggaatatgggagaagaaccaaactatcaagaagagtgggtgagaccttttgggacagcggtg

SEQ ID NO: 11374 - DNA, 140 bp, Artificial Sequence
  Synthetic
caccgctgtcccaaaaggtctcacccactcttcttgatagtttggttcttctcccatattccggtaggacaggagtgttgggtggtcaggatacagtagcatgatgacttggtttttccccatatcagcagccagggcct

SEQ ID NO: 11375 - DNA, 140 bp, Artificial Sequence
  Synthetic
atacgccatgctgggtctccaggtatacgtgtcccctaagagacacattgtatgtaggtgataagtatagattaaagggccgaataacccctgaatagtaacaaaatatgaaaatcaatacgtacttgggagtcggccat

SEQ ID NO: 11376 - DNA, 140 bp, Artificial Sequence
  Synthetic
atggccgactcccaagtacgtattgattttcatattttgttactattcaggggttattcggccctttaatctatacttatcacctacatacaatgtgtctcttaggggacacgtatacctggagacccagcatggcgtat

SEQ ID NO: 11377 - DNA, 140 bp, Artificial Sequence
  Synthetic
atacgccatgctgggtctcctctccgaacccacagggacgtaggagatgttattttgctttttacacaccccccctcatcctctcccctctatttaaacaactgctccactactacatcccgtacttgggagtcggccat

SEQ ID NO: 11378 - DNA, 140 bp, Artificial Sequence
  Synthetic
atggccgactcccaagtacgggatgtagtagtggagcagttgtttaaatagaggggagaggatgagggggggtgtgtaaaaagcaaaataacatctcctacgtccctgtgggttcggagaggagacccagcatggcgtat

SEQ ID NO: 11379 - DNA, 140 bp, Artificial Sequence
  Synthetic
atacgccatgctgggtctcctctccgaacccacagggacgtaggagatgttattttgctttttactcaccccccctcatcctctcccctctatttaaacaactgctccactactacatcccgtacttgggagtcggccat

SEQ ID NO: 11380 - DNA, 140 bp, Artificial Sequence
  Synthetic
atggccgactcccaagtacgggatgtagtagtggagcagttgtttaaatagaggggagaggatgagggggggtgagtaaaaagcaaaataacatctcctacgtccctgtgggttcggagaggagacccagcatggcgtat

SEQ ID NO: 11381 - DNA, 140 bp, Artificial Sequence
  Synthetic
atacgccatgctgggtctcctctccgaacccacagggacgtaggagatgttattttgctttttacccaccccccctcatcctctcccctctatttaaacaactgctccactactacatcccgtacttgggagtcggccat

SEQ ID NO: 11382 - DNA, 140 bp, Artificial Sequence
  Synthetic
atggccgactcccaagtacgggatgtagtagtggagcagttgtttaaatagaggggagaggatgagggggggtgggtaaaaagcaaaataacatctcctacgtccctgtgggttcggagaggagacccagcatggcgtat

SEQ ID NO: 11383 - DNA, 140 bp, Artificial Sequence
  Synthetic
atacgccatgctgggtctcctctccgaacccacagggacgtaggagatgttattttgctttttacgcaccccccctcatcctctcccctctatttaaacaactgctccactactacatcccgtacttgggagtcggccat

SEQ ID NO: 11384 - DNA, 140 bp, Artificial Sequence
  Synthetic
atggccgactcccaagtacgggatgtagtagtggagcagttgtttaaatagaggggagaggatgagggggggtgcgtaaaaagcaaaataacatctcctacgtccctgtgggttcggagaggagacccagcatggcgtat

SEQ ID NO: 11385 - DNA, 140 bp, Artificial Sequence
  Synthetic
aggccctggctgctgatatgccccctcatcctctcccctctatttaaacaactgctccactactacatccttatctctcacaccccccctctattccgctaagcgatgtctctacccatcgaccttttgggacagcggtg

SEQ ID NO: 11386 - DNA, 140 bp, Artificial Sequence
  Synthetic
caccgctgtcccaaaaggtcgatgggtagagacatcgcttagcggaatagagggggggtgtgagagataaggatgtagtagtggagcagttgtttaaatagaggggagaggatgagggggcatatcagcagccagggcct

SEQ ID NO: 11387 - DNA, 140 bp, Artificial Sequence
  Synthetic
atacgccatgctgggtctcctctcaccaatatacatcaacccctccatcactctcctcactttctattccctacccaccttacatccatccccctcacactgctcttatccttccaaacccgtacttgggagtcggccat

SEQ ID NO: 11388 - DNA, 140 bp, Artificial Sequence
  Synthetic
atggccgactcccaagtacgggtttggaaggataagagcagtgtgagggggatggatgtaaggtgggtagggaatagaaagtgaggagagtgatggaggggttgatgtatattggtgagaggagacccagcatggcgtat

SEQ ID NO: 11389 - DNA, 140 bp, Artificial Sequence
  Synthetic
aggccctggctgctgatatgctacccaccttacatccatccccctcacactgctcttatccttccaaacctacctcattaataccccccttaccatattcctctcatcaacatccctcctgaccttttgggacagcggtg

SEQ ID NO: 11390 - DNA, 140 bp, Artificial Sequence
  Synthetic
caccgctgtcccaaaaggtcaggagggatgttgatgagaggaatatggtaaggggggtattaatgaggtaggtttggaaggataagagcagtgtgagggggatggatgtaaggtgggtagcatatcagcagccagggcct

SEQ ID NO: 11391 - DNA, 140 bp, Artificial Sequence
  Synthetic
atacgccatgctgggtctccccacatttcccttcttctatcttcttatcccttatccttacccacattctcatctatctttcatcatcacatcttatctatctctcttattcttcttccacgtacttgggagtcggccat

SEQ ID NO: 11392 - DNA, 140 bp, Artificial Sequence
  Synthetic
atggccgactcccaagtacgtggaagaagaataagagagatagataagatgtgatgatgaaagatagatgagaatgtgggtaaggataagggataagaagatagaagaagggaaatgtggggagacccagcatggcgtat

SEQ ID NO: 11393 - DNA, 140 bp, Artificial Sequence
  Synthetic
aggccctggctgctgatatgcatctatctttcatcatcacatcttatctatctctcttattcttcttccattattctcctcttttcttttcttttctattatctctttcattgttattcagaccttttgggacagcggtg

SEQ ID NO: 11394 - DNA, 140 bp, Artificial Sequence
  Synthetic
caccgctgtcccaaaaggtctgaataacaatgaaagagataatagaaaagaaaagaaaagaggagaataatggaagaagaataagagagatagataagatgtgatgatgaaagatagatgcatatcagcagccagggcct

SEQ ID NO: 11395 - DNA, 140 bp, Artificial Sequence
  Synthetic
atacgccatgctgggtctccttttttcccttttctctttccccttctcattcccatacctatttgctttcaccttttattctctgccccaaccaccctccctaccctctctgcttccagtcgtacttgggagtcggccat

SEQ ID NO: 11396 - DNA, 140 bp, Artificial Sequence
  Synthetic
atggccgactcccaagtacgactggaagcagagagggtagggagggtggttggggcagagaataaaaggtgaaagcaaataggtatgggaatgagaaggggaaagagaaaagggaaaaaaggagacccagcatggcgtat

SEQ ID NO: 11397 - DNA, 140 bp, Artificial Sequence
  Synthetic
aggccctggctgctgatatgaccttttattctctgccccaaccaccctccctaccctctctgcttccagtctttctcctcaccccctctccaaacttcaattcctaacccctttctaacagaccttttgggacagcggtg

SEQ ID NO: 11398 - DNA, 140 bp, Artificial Sequence
  Synthetic
caccgctgtcccaaaaggtctgttagaaaggggttaggaattgaagtttggagagggggtgaggagaaagactggaagcagagagggtagggagggtggttggggcagagaataaaaggtcatatcagcagccagggcct

SEQ ID NO: 11399 - DNA, 140 bp, Artificial Sequence
  Synthetic
atacgccatgctgggtctccttctaccttccctctacttcctcttctctatacccctactaaccattccccaatctcacactcttaacctcccccatcttccatctacagtctacatccacgtacttgggagtcggccat

SEQ ID NO: 11400 - DNA, 140 bp, Artificial Sequence
  Synthetic
atggccgactcccaagtacgtggatgtagactgtagatggaagatgggggaggttaagagtgtgagattggggaatggttagtaggggtatagagaagaggaagtagagggaaggtagaaggagacccagcatggcgtat

SEQ ID NO: 11401 - DNA, 140 bp, Artificial Sequence
  Synthetic
aggccctggctgctgatatgccatctacagtctacatccactattccacaactcccctgatcctcaatcctctctgtacaatatatcaagcacctgacatagcttctctatttttcccacgaccttttgggacagcggtg

SEQ ID NO: 11402 - DNA, 140 bp, Artificial Sequence
  Synthetic
caccgctgtcccaaaaggtcgtgggaaaaatagagaagctatgtcaggtgcttgatatattgtacagagaggattgaggatcaggggagttgtggaatagtggatgtagactgtagatggcatatcagcagccagggcct

SEQ ID NO: 11403 - DNA, 140 bp, Artificial Sequence
  Synthetic
aggccctggctgctgatatgccatctacagtctacatccactattccacaactcccctgatcctcaatcctctctgtactatatatcaagcacctgacatagcttctctatttttcccacgaccttttgggacagcggtg

SEQ ID NO: 11404 - DNA, 140 bp, Artificial Sequence
  Synthetic
caccgctgtcccaaaaggtcgtgggaaaaatagagaagctatgtcaggtgcttgatatatagtacagagaggattgaggatcaggggagttgtggaatagtggatgtagactgtagatggcatatcagcagccagggcct

SEQ ID NO: 11405 - DNA, 140 bp, Artificial Sequence
  Synthetic
aggccctggctgctgatatgccatctacagtctacatccactattccacaactcccctgatcctcaatcctctctgtaccatatatcaagcacctgacatagcttctctatttttcccacgaccttttgggacagcggtg

SEQ ID NO: 11406 - DNA, 140 bp, Artificial Sequence
  Synthetic
caccgctgtcccaaaaggtcgtgggaaaaatagagaagctatgtcaggtgcttgatatatggtacagagaggattgaggatcaggggagttgtggaatagtggatgtagactgtagatggcatatcagcagccagggcct

SEQ ID NO: 11407 - DNA, 140 bp, Artificial Sequence
  Synthetic
aggccctggctgctgatatgccatctacagtctacatccactattccacaactcccctgatcctcaatcctctctgtacgatatatcaagcacctgacatagcttctctatttttcccacgaccttttgggacagcggtg

SEQ ID NO: 11408 - DNA, 140 bp, Artificial Sequence
  Synthetic
caccgctgtcccaaaaggtcgtgggaaaaatagagaagctatgtcaggtgcttgatatatcgtacagagaggattgaggatcaggggagttgtggaatagtggatgtagactgtagatggcatatcagcagccagggcct

SEQ ID NO: 11409 - DNA, 140 bp, Artificial Sequence
  Synthetic
aggccctggctgctgatatgcattgtggggccaatgtcttcagcctggacacctttcgacaacaaaattgtggtgtacaaaggtgacgtctataacatggactacccgccctttggcgcagaccttttgggacagcggtg

SEQ ID NO: 11410 - DNA, 140 bp, Artificial Sequence
  Synthetic
caccgctgtcccaaaaggtctgcgccaaagggcgggtagtccatgttatagacgtcacctttgtacaccacaattttgttgtcgaaaggtgtccaggctgaagacattggccccacaatgcatatcagcagccagggcct

SEQ ID NO: 11411 - DNA, 140 bp, Artificial Sequence
  Synthetic
aggccctggctgctgatatgcaaacggaagagatgtaggtacttaagcttcctaaaagcagccgaactcactttgagaagtaggcatagcataccgaactcttccacgattctccgaaccgaccttttgggacagcggtg

SEQ ID NO: 11412 - DNA, 140 bp, Artificial Sequence
  Synthetic
caccgctgtcccaaaaggtcggttcggagaatcgtggaagagttcggtatgctatgcctacttctcaaagtgagttcggctgcttttaggaagcttaagtacctacatctcttccgtttgcatatcagcagccagggcct

SEQ ID NO: 11413 - DNA, 140 bp, Artificial Sequence
  Synthetic
atacgccatgctgggtctccattaccagtttctcactgctctactctgcaaagcaagagattaataacccatcatggatcctgtgtacgtggacatagacgctgacagcgcctttttgaacgtacttgggagtcggccat

SEQ ID NO: 11414 - DNA, 140 bp, Artificial Sequence
  Synthetic
atggccgactcccaagtacgttcaaaaaggcgctgtcagcgtctatgtccacgtacacaggatccatgatgggttattaatctcttgctttgcagagtagagcagtgagaaactggtaatggagacccagcatggcgtat

SEQ ID NO: 11415 - DNA, 140 bp, Artificial Sequence
  Synthetic
aggccctggctgctgatatgtgcgccagcaaggaggatgatgtcggacaggaagtaccactgcatctgcccgatgcgcagtgcggaagatcccgagagactcgctaattatgcgagaaaggaccttttgggacagcggtg

SEQ ID NO: 11416 - DNA, 140 bp, Artificial Sequence
  Synthetic
caccgctgtcccaaaaggtcctttctcgcataattagcgagtctctcgggatcttccgcactgcgcatcgggcagatgcagtggtacttcctgtccgacatcatcctccttgctggcgcacatatcagcagccagggcct

SEQ ID NO: 11417 - DNA, 140 bp, Artificial Sequence
  Synthetic
aggccctggctgctgatatggaagttgaagggaattctcagctgcaaatctctttctcgacggccttagccagcgccgaattccgcgtacaagtctgttctacacaagtacactgtgcaggaccttttgggacagcggtg

SEQ ID NO: 11418 - DNA, 140 bp, Artificial Sequence
  Synthetic
caccgctgtcccaaaaggtcctgcacagtgtacttgtgtagaacagacttgtacgcggaattcggcgctggctaaggccgtcgagaaagagatttgcagctgagaattcccttcaacttccatatcagcagccagggcct

SEQ ID NO: 11419 - DNA, 140 bp, Artificial Sequence
  Synthetic
aggccctggctgctgatatgtcactaaaaattataaaaacagaaaaatacataaataggtatacgtgtcccctaagagacacattgtatgtaggtgataagtatagatcaaagggccgaagaccttttgggacagcggtg

SEQ ID NO: 11420 - DNA, 140 bp, Artificial Sequence
  Synthetic
caccgctgtcccaaaaggtcttcggccctttgatctatacttatcacctacatacaatgtgtctcttaggggacacgtatacctatttatgtatttttctgtttttataatttttagtgacatatcagcagccagggcct

SEQ ID NO: 11421 - DNA, 140 bp, Artificial Sequence
  Synthetic
atacgccatgctgggtctccataaaaatcaaatgaataccataattggcaaacggaagagatgtaggtacttaagcttcctaaaagcagccgaactcactttgagaagtaggcatagcatcgtacttgggagtcggccat

SEQ ID NO: 11422 - DNA, 140 bp, Artificial Sequence
  Synthetic
atggccgactcccaagtacgatgctatgcctacttctcaaagtgagttcggctgcttttaggaagcttaagtacctacatctcttccgtttgccaattatggtattcatttgatttttatggagacccagcatggcgtat

SEQ ID NO: 11423 - DNA, 140 bp, Artificial Sequence
  Synthetic
atacgccatgctgggtctccataaaaatcaaatgaataccataattggcaaacggaagtgatgtaggtacttaagcttcctaaaagcagccgaactcactttgagaagtaggcatagcatcgtacttgggagtcggccat

SEQ ID NO: 11424 - DNA, 140 bp, Artificial Sequence
  Synthetic
atggccgactcccaagtacgatgctatgcctacttctcaaagtgagttcggctgcttttaggaagcttaagtacctacatcacttccgtttgccaattatggtattcatttgatttttatggagacccagcatggcgtat

SEQ ID NO: 11425 - DNA, 140 bp, Artificial Sequence
  Synthetic
atacgccatgctgggtctccataaaaatcaaatgaataccataattggcaaacggaagcgatgtaggtacttaagcttcctaaaagcagccgaactcactttgagaagtaggcatagcatcgtacttgggagtcggccat

SEQ ID NO: 11426 - DNA, 140 bp, Artificial Sequence
  Synthetic
atggccgactcccaagtacgatgctatgcctacttctcaaagtgagttcggctgcttttaggaagcttaagtacctacatcgcttccgtttgccaattatggtattcatttgatttttatggagacccagcatggcgtat

SEQ ID NO: 11427 - DNA, 140 bp, Artificial Sequence
  Synthetic
atacgccatgctgggtctccataaaaatcaaatgaataccataattggcaaacggaagggatgtaggtacttaagcttcctaaaagcagccgaactcactttgagaagtaggcatagcatcgtacttgggagtcggccat

SEQ ID NO: 11428 - DNA, 140 bp, Artificial Sequence
  Synthetic
atggccgactcccaagtacgatgctatgcctacttctcaaagtgagttcggctgcttttaggaagcttaagtacctacatcccttccgtttgccaattatggtattcatttgatttttatggagacccagcatggcgtat

SEQ ID NO: 11429 - DNA, 140 bp, Artificial Sequence
  Synthetic
aggccctggctgctgatatgaggtagtgcgccagcaaggaggatgatgtcggacaggaagtaccactgcgtttgcccgatacgcagcgcagaagatcccgagagactcgctaattatgcggaccttttgggacagcggtg

SEQ ID NO: 11430 - DNA, 140 bp, Artificial Sequence
  Synthetic
caccgctgtcccaaaaggtccgcataattagcgagtctctcgggatcttctgcgctgcgtatcgggcaaacgcagtggtacttcctgtccgacatcatcctccttgctggcgcactacctcatatcagcagccagggcct

SEQ ID NO: 11431 - DNA, 140 bp, Artificial Sequence
  Synthetic
aggccctggctgctgatatgagaaagctcgcatctgccgcaggaaaagtcctggacagaaacatttctggaaagatcggggacttacaagcggtgatggccgtgccggacacggagacgcgaccttttgggacagcggtg

SEQ ID NO: 11432 - DNA, 140 bp, Artificial Sequence
  Synthetic
caccgctgtcccaaaaggtcgcgtctccgtgtccggcacggccatcaccgcttgtaagtccccgatctttccagaaatgtttctgtccaggacttttcctgcggcagatgcgagctttctcatatcagcagccagggcct

SEQ ID NO: 11433 - DNA, 140 bp, Artificial Sequence
  Synthetic
aggccctggctgctgatatgaattgggcggatgagcaggtactgaaggctaagaacataggattatgttcaacagacctgacggaaggtagacgtggcaaattgtctatcatgagagggagaccttttgggacagcggtg

SEQ ID NO: 11434 - DNA, 140 bp, Artificial Sequence
  Synthetic
caccgctgtcccaaaaggtctccctctcatgatagacaatttgccacgtctaccttccgtcaggtctgttgaacataatcctatgttcttagccttcagtacctgctcatccgcccaattcatatcagcagccagggcct

SEQ ID NO: 11435 - DNA, 140 bp, Artificial Sequence
  Synthetic
atacgccatgctgggtctcccgtgtgagggctacgtcgttaagaggataacgatgagcccaggcctttatggaaaaaccacagggtatgcggtaacccaccatgcagacggattcttgatcgtacttgggagtcggccat

SEQ ID NO: 11436 - DNA, 140 bp, Artificial Sequence
  Synthetic
atggccgactcccaagtacgatcaagaatccgtctgcatggtgggttaccgcataccctgtggtttttccataaaggcctgggctcatcgttatcctcttaacgacgtagccctcacacgggagacccagcatggcgtat

SEQ ID NO: 11437 - DNA, 140 bp, Artificial Sequence
  Synthetic
aggccctggctgctgatatgactatctacttcccgtggtcgcccaggccttcagtaagtgggcgaaggagtgtcggaaggacatggaagatgagaagcttctgggggtcagagaaagaacgaccttttgggacagcggtg

SEQ ID NO: 11438 - DNA, 140 bp, Artificial Sequence
  Synthetic
caccgctgtcccaaaaggtcgttctttctctgacccccagaagcttctcatcttccatgtccttccgacactccttcgcccacttactgaaggcctgggcgaccacgggaagtagatagtcatatcagcagccagggcct

SEQ ID NO: 11439 - DNA, 140 bp, Artificial Sequence
  Synthetic
aggccctggctgctgatatgcaaccaacagaccacgtcgtgggagagtacctggtactctccccgcagaccgtactacgtagccagaagctcagtctgattcacgctttggcggagcaaggaccttttgggacagcggtg

SEQ ID NO: 11440 - DNA, 140 bp, Artificial Sequence
  Synthetic
caccgctgtcccaaaaggtccttgctccgccaaagcgtgaatcagactgagcttctggctacgtagtacggtctgcggggagagtaccaggtactctcccacgacgtggtctgttggttgcatatcagcagccagggcct

SEQ ID NO: 11441 - DNA, 140 bp, Artificial Sequence
  Synthetic
atacgccatgctgggtctccgaggaagaacgagaagcagaattgactcatgaggctctaccacccctacaggcagcacaggaagatgtccaggtcgaaatcgacgtggaacaacttgaggcgtacttgggagtcggccat

SEQ ID NO: 11442 - DNA, 140 bp, Artificial Sequence
  Synthetic
atggccgactcccaagtacgcctcaagttgttccacgtcgatttcgacctggacatcttcctgtgctgcctgtaggggtggtagagcctcatgagtcaattctgcttctcgttcttcctcggagacccagcatggcgtat

SEQ ID NO: 11443 - DNA, 140 bp, Artificial Sequence
  Synthetic
aggccctggctgctgatatgggcagcacaggaagatgtccaggtcgaaatcgacgtggaacaacttgaggatagagctggtgctggaacaatagagactccgagaggcgccattaaagttgaccttttgggacagcggtg

SEQ ID NO: 11444 - DNA, 140 bp, Artificial Sequence
  Synthetic
caccgctgtcccaaaaggtcaactttaatggcgcctctcggagtctctattgttccagcaccagctctatcctcaagttgttccacgtcgatttcgacctggacatcttcctgtgctgcccatatcagcagccagggcct

SEQ ID NO: 11445 - DNA, 140 bp, Artificial Sequence
  Synthetic
atacgccatgctgggtctcccttgctttgatcgccttggtgagaccaagacagaaagttgtactttgcggtgacccgaagcagtgcggcttcttcaatatgatgcagatgaaagtcaactcgtacttgggagtcggccat

SEQ ID NO: 11446 - DNA, 140 bp, Artificial Sequence
  Synthetic
atggccgactcccaagtacgagttgactttcatctgcatcatattgaagaagccgcactgcttcgggtcaccgcaaagtacaactttctgtcttggtctcaccaaggcgatcaaagcaagggagacccagcatggcgtat

SEQ ID NO: 11447 - DNA, 140 bp, Artificial Sequence
  Synthetic
aggccctggctgctgatatgctcctaacgcgtacggaaggtaagctggtatggaagacactctctggtgacccgtggataaagacgctgcagaatccaccgaaaggaaacttcaaggcaagaccttttgggacagcggtg

SEQ ID NO: 11448 - DNA, 140 bp, Artificial Sequence
  Synthetic
caccgctgtcccaaaaggtcttgccttgaagtttcctttcggtggattctgcagcgtctttatccacgggtcaccagagagtgtcttccataccagcttaccttccgtacgcgttaggagcatatcagcagccagggcct

SEQ ID NO: 11449 - DNA, 140 bp, Artificial Sequence
  Synthetic
aggccctggctgctgatatgctattaaggagtgggaggtggagcacgcatcgataatggcgggcatctgcagtcaccaagtgacctttgacacgttccaaaacaaagccaatgtttgctggaccttttgggacagcggtg

SEQ ID NO: 11450 - DNA, 140 bp, Artificial Sequence
  Synthetic
caccgctgtcccaaaaggtccagcaaacattggctttgttttggaacgtgtcaaaggtcacttggtgactgcagatgcccgccattatcgatgcgtgctccacctcccactccttaatagcatatcagcagccagggcct

SEQ ID NO: 11451 - DNA, 140 bp, Artificial Sequence
  Synthetic
aggccctggctgctgatatggactatacatacaacctagagctgggtctaccggcaacacttggtaggtatgacctagtggtcataaacatccacacaccttttcgcatacaccattatcgaccttttgggacagcggtg

SEQ ID NO: 11452 - DNA, 140 bp, Artificial Sequence
  Synthetic
caccgctgtcccaaaaggtcgataatggtgtatgcgaaaaggtgtgtggatgtttatgaccactaggtcatacctaccaagtgttgccggtagacccagctctaggttgtatgtatagtccatatcagcagccagggcct

SEQ ID NO: 11453 - DNA, 140 bp, Artificial Sequence
  Synthetic
atacgccatgctgggtctccgactgggagtaaatagcgtagctatacctctcctctccacaggtgtatactcaggagggaaagacaggctaacccagtcattgaaccacctctttacagccgtacttgggagtcggccat

SEQ ID NO: 11454 - DNA, 140 bp, Artificial Sequence
  Synthetic
atggccgactcccaagtacggctgtaaagaggtggttcaatgactgggttagcctgtctttccctcctgagtatacacctgtggagaggagaggtatagctacgctatttactcccagtcggagacccagcatggcgtat

SEQ ID NO: 11455 - DNA, 140 bp, Artificial Sequence
  Synthetic
atacgccatgctgggtctcccagcagtttggcaggcagaaaaggatacagcaccacggaaggcgcactgtattcatatctagaagggacacgttttcaccagacggcagtggatatggcacgtacttgggagtcggccat

SEQ ID NO: 11456 - DNA, 140 bp, Artificial Sequence
  Synthetic
atggccgactcccaagtacgtgccatatccactgccgtctggtgaaaacgtgtcccttctagatatgaatacagtgcgccttccgtggtgctgtatccttttctgcctgccaaactgctgggagacccagcatggcgtat

SEQ ID NO: 11457 - DNA, 140 bp, Artificial Sequence
  Synthetic
aggccctggctgctgatatgattcatatctagaagggacacgttttcaccagacggcagtggatatggcagagatctataccatgtggccaaagcaaacagaggccaatgagcaagtctggaccttttgggacagcggtg

SEQ ID NO: 11458 - DNA, 140 bp, Artificial Sequence
  Synthetic
caccgctgtcccaaaaggtccagacttgctcattggcctctgtttgctttggccacatggtatagatctctgccatatccactgccgtctggtgaaaacgtgtcccttctagatatgaatcatatcagcagccagggcct

SEQ ID NO: 11459 - DNA, 140 bp, Artificial Sequence
  Synthetic
aggccctggctgctgatatgcacaaatataattgtgtgttcttcatttccccttccaaagtacaagatagaaggagtgcaaaaagttaaatgctccaaggtaatgttattcgatcacaatgaccttttgggacagcggtg

SEQ ID NO: 11460 - DNA, 140 bp, Artificial Sequence
  Synthetic
caccgctgtcccaaaaggtcattgtgatcgaataacattaccttggagcatttaactttttgcactccttctatcttgtactttggaaggggaaatgaagaacacacaattatatttgtgcatatcagcagccagggcct

SEQ ID NO: 11461 - DNA, 140 bp, Artificial Sequence
  Synthetic
atacgccatgctgggtctccgtgccatcgcgcgtaagtccaagggaatacagaccttcccaggagtctgtacaggaagtgagtacgacaacgtcattgacgcatagccagtttgatctaacgtacttgggagtcggccat

SEQ ID NO: 11462 - DNA, 140 bp, Artificial Sequence
  Synthetic
atggccgactcccaagtacgttagatcaaactggctatgcgtcaatgacgttgtcgtactcacttcctgtacagactcctgggaaggtctgtattcccttggacttacgcgcgatggcacggagacccagcatggcgtat

SEQ ID NO: 11463 - DNA, 140 bp, Artificial Sequence
  Synthetic
atacgccatgctgggtctccgtgccgatggcgagacactgcctgtcccatcagacctggatgctgacgccccagccctagaaccggccctagacgacggggcgatacatacgttaccaaccgtacttgggagtcggccat

SEQ ID NO: 11464 - DNA, 140 bp, Artificial Sequence
  Synthetic
atggccgactcccaagtacggttggtaacgtatgtatcgccccgtcgtctagggccggttctagggctggggcgtcagcatccaggtctgatgggacaggcagtgtctcgccatcggcacggagacccagcatggcgtat

SEQ ID NO: 11465 - DNA, 140 bp, Artificial Sequence
  Synthetic
aggccctggctgctgatatgccagccctagaaccggccctagacgacggggcgatacatacgttaccaaccacgatcggaaaccttgcggccgtgtctgactgggtaacgagcaccgtacgaccttttgggacagcggtg

SEQ ID NO: 11466 - DNA, 140 bp, Artificial Sequence
  Synthetic
caccgctgtcccaaaaggtcgtacggtgctcgttacccagtcagacacggccgcaaggtttccgatcgtggttggtaacgtatgtatcgccccgtcgtctagggccggttctagggctggcatatcagcagccagggcct

SEQ ID NO: 11467 - DNA, 140 bp, Artificial Sequence
  Synthetic
aggccctggctgctgatatggacgagagagaagggaatataacacccatggctagcgtccgattctttagagcagagctgtgtccggccgtgcaagaaacagcggagacgcgtgacacaggaccttttgggacagcggtg

SEQ ID NO: 11468 - DNA, 140 bp, Artificial Sequence
  Synthetic
caccgctgtcccaaaaggtcctgtgtcacgcgtctccgctgtttcttgcacggccggacacagctctgctctaaagaatcggacgctagccatgggtgttatattcccttctctctcgtccatatcagcagccagggcct

SEQ ID NO: 11469 - DNA, 140 bp, Artificial Sequence
  Synthetic
aggccctggctgctgatatggagacttcctacccggtgaagtggatgatttgacagatagcgactggtccacgtgcccagacacggacgacgagttagacagggcaggtgggtatatattgaccttttgggacagcggtg

SEQ ID NO: 11470 - DNA, 140 bp, Artificial Sequence
  Synthetic
caccgctgtcccaaaaggtcaatatatacccacctgccctgtctaactcgtcgtccgtgtctgggcacgtggaccagtcgctatctgtcaaatcatccacttcaccgggtaggaagtctccatatcagcagccagggcct

SEQ ID NO: 11471 - DNA, 140 bp, Artificial Sequence
  Synthetic
aggccctggctgctgatatgaaaatatgaaagcaacaatcatccagagactaaagagaggctgtaaactgtatttaatggcagagaccccgaaagtcccgacttatcggaccgtatacccgaccttttgggacagcggtg

SEQ ID NO: 11472 - DNA, 140 bp, Artificial Sequence
  Synthetic
caccgctgtcccaaaaggtcgggtatacggtccgataagtcgggactttcggggtctctgccattaaatacagtttacagcctctctttagtctctggatgattgttgctttcatattttcatatcagcagccagggcct

SEQ ID NO: 11473 - DNA, 140 bp, Artificial Sequence
  Synthetic
aggccctggctgctgatatgctaagagagtcacttgggtagcgccgttaggtgtccgcggagcggactacacatacaacctagagttgggtctgccagcaacgcttggtaggtatgacctgaccttttgggacagcggtg

SEQ ID NO: 11474 - DNA, 140 bp, Artificial Sequence
  Synthetic
caccgctgtcccaaaaggtcaggtcatacctaccaagcgttgctggcagacccaactctaggttgtatgtgtagtccgctccgcggacacctaacggcgctacccaagtgactctcttagcatatcagcagccagggcct

SEQ ID NO: 11475 - DNA, 140 bp, Artificial Sequence
  Synthetic
aggccctggctgctgatatgggaattggcagctgcctatcgagaagtcgcaaaggaagtaactaggctgggagtaaatagtgtagctatacctctcctctccacaggtgtatactcaggagaccttttgggacagcggtg

SEQ ID NO: 11476 - DNA, 140 bp, Artificial Sequence
  Synthetic
caccgctgtcccaaaaggtctcctgagtatacacctgtggagaggagaggtatagctacactatttactcccagcctagttacttcctttgcgacttctcgataggcagctgccaattcccatatcagcagccagggcct

SEQ ID NO: 11477 - DNA, 140 bp, Artificial Sequence
  Synthetic
aggccctggctgctgatatggatagaggctgcttttggagagatttccagctgtcacctgccgacaggtacgcgcttcaagttcggcgctatgatgaaatccggtatgttcctaactctggaccttttgggacagcggtg

SEQ ID NO: 11478 - DNA, 140 bp, Artificial Sequence
  Synthetic
caccgctgtcccaaaaggtccagagttaggaacataccggatttcatcatagcgccgaacttgaagcgcgtacctgtcggcaggtgacagctggaaatctctccaaaagcagcctctatccatatcagcagccagggcct

SEQ ID NO: 11479 - DNA, 140 bp, Artificial Sequence
  Synthetic
aggccctggctgctgatatgttcgtcaacacattgttaaatatcaccatcgctagccgggtgttggaagatcgtctgacaaaatctgcatgcgcggccttcatcggcgacgacaacataagaccttttgggacagcggtg

SEQ ID NO: 11480 - DNA, 140 bp, Artificial Sequence
  Synthetic
caccgctgtcccaaaaggtcttatgttgtcgtcgccgatgaaggccgcgcatgcagattttgtcagacgatcttccaacacccggctagcgatggtgatatttaacaatgtgttgacgaacatatcagcagccagggcct

SEQ ID NO: 11481 - DNA, 140 bp, Artificial Sequence
  Synthetic
atacgccatgctgggtctcctacatggtgtcgtctccgatgaattgatggcagccagatgcgctacttggatgaatatggaagtgaagatcatagatgcagttgtatcccagaaagctcccgtacttgggagtcggccat

SEQ ID NO: 11482 - DNA, 140 bp, Artificial Sequence
  Synthetic
atggccgactcccaagtacgggagctttctgggatacaactgcatctatgatcttcacttccatattcatccaagtagcgcatctggctgccatcaattcatcggagacgacaccatgtaggagacccagcatggcgtat

SEQ ID NO: 11483 - DNA, 140 bp, Artificial Sequence
  Synthetic
aggccctggctgctgatatgagtaatcagatggcaacgaacagggctaatagatgagctggagaaagcggtgtactccaggtacgaagtgcagggtatatcagttgcggtaatgtccatggaccttttgggacagcggtg

SEQ ID NO: 11484 - DNA, 140 bp, Artificial Sequence
  Synthetic
caccgctgtcccaaaaggtccatggacattaccgcaactgatataccctgcacttcgtacctggagtacaccgctttctccagctcatctattagccctgttcgttgccatctgattactcatatcagcagccagggcct

SEQ ID NO: 11485 - DNA, 140 bp, Artificial Sequence
  Synthetic
aggccctggctgctgatatgcataactttgtacggcggtcctaaataggtacgcactacagctacctattttgcagaagccgacagcaggtacctaaataccaatcagccataatggagtgaccttttgggacagcggtg

SEQ ID NO: 11486 - DNA, 140 bp, Artificial Sequence
  Synthetic
caccgctgtcccaaaaggtcactccattatggctgattggtatttaggtacctgctgtcggcttctgcaaaataggtagctgtagtgcgtacctatttaggaccgccgtacaaagttatgcatatcagcagccagggcct

SEQ ID NO: 11487 - DNA, 140 bp, Artificial Sequence
  Synthetic
aggccctggctgctgatatgttatcccaacccaaactttctacaataggaggtaccagcctcgaccttggactccgcgccctactatccaagttatcagacccagaccgcgtccgcaaaggaccttttgggacagcggtg

SEQ ID NO: 11488 - DNA, 140 bp, Artificial Sequence
  Synthetic
caccgctgtcccaaaaggtcctttgcggacgcggtctgggtctgataacttggatagtagggcgcggagtccaaggtcgaggctggtacctcctattgtagaaagtttgggttgggataacatatcagcagccagggcct

SEQ ID NO: 11489 - DNA, 140 bp, Artificial Sequence
  Synthetic
aggccctggctgctgatatgcggaaaccttgcggccgtgtctgactgggtaatgagcaccgtacctgtcgcgccgcccagaagaaggcgagggagaaacctgactgtgacatgtgacgaggaccttttgggacagcggtg

SEQ ID NO: 11490 - DNA, 140 bp, Artificial Sequence
  Synthetic
caccgctgtcccaaaaggtcctcgtcacatgtcacagtcaggtttctccctcgccttcttctgggcggcgcgacaggtacggtgctcattacccagtcagacacggccgcaaggtttccgcatatcagcagccagggcct

SEQ ID NO: 11491 - DNA, 140 bp, Artificial Sequence
  Synthetic
aggccctggctgctgatatggaaggtaaggtaacaggttacgcgtgcttggtaggggacaaagtaatgaagccagcacacgtaaaggggaccatcgataacgcggacctggccaaattgggaccttttgggacagcggtg

SEQ ID NO: 11492 - DNA, 140 bp, Artificial Sequence
  Synthetic
caccgctgtcccaaaaggtcccaatttggccaggtccgcgttatcgatggtcccctttacgtgtgctggcttcattactttgtcccctaccaagcacgcgtaacctgttaccttaccttccatatcagcagccagggcct

SEQ ID NO: 11493 - DNA, 140 bp, Artificial Sequence
  Synthetic
atacgccatgctgggtctccgccagcacacgtaaaggggaccatcgataacgcggacctggccaaattggccttcaagcggtcatctaagtacgaccttgaatgcgcgcagatacccgtgcgtacttgggagtcggccat

SEQ ID NO: 11494 - DNA, 140 bp, Artificial Sequence
  Synthetic
atggccgactcccaagtacgcacgggtatctgcgcgcattcaaggtcgtacttagatgaccgcttgaaggccaatttggccaggtccgcgttatcgatggtcccctttacgtgtgctggcggagacccagcatggcgtat

SEQ ID NO: 11495 - DNA, 140 bp, Artificial Sequence
  Synthetic
atacgccatgctgggtctccccttcaagcggtcatctaagtacgaccttgaatgcgcgcagatacccgtgcacatgaagtccgacgcctcgaagttcacccatgagaaaccggaggggtacgtacttgggagtcggccat

SEQ ID NO: 11496 - DNA, 140 bp, Artificial Sequence
  Synthetic
atggccgactcccaagtacgtacccctccggtttctcatgggtgaacttcgaggcgtcggacttcatgtgcacgggtatctgcgcgcattcaaggtcgtacttagatgaccgcttgaaggggagacccagcatggcgtat

SEQ ID NO: 11497 - DNA, 140 bp, Artificial Sequence
  Synthetic
aggccctggctgctgatatgcagtgctgccggtgaacaccctggaggaagtccacgaggagaagtgttacccacctaagctggatgaagcaaaggagcaactattacttacgaaactccagaccttttgggacagcggtg

SEQ ID NO: 11498 - DNA, 140 bp, Artificial Sequence
  Synthetic
caccgctgtcccaaaaggtctggagtttcgtaagtaatagttgctcctttgcttcatccagcttaggtgggtaacacttctcctcgtggacttcctccagggtgttcaccggcagcactgcatatcagcagccagggcct

SEQ ID NO: 11499 - DNA, 140 bp, Artificial Sequence
  Synthetic
aggccctggctgctgatatgggagagtgcatccatggccaacagaagcaggtatcagtcgcgcaaagtagaaaacatgaaagcagcaatcatccagagactaaagagtggctgtagactagaccttttgggacagcggtg

SEQ ID NO: 11500 - DNA, 140 bp, Artificial Sequence
  Synthetic
caccgctgtcccaaaaggtctagtctacagccactctttagtctctggatgattgctgctttcatgttttctactttgcgcgactgatacctgcttctgttggccatggatgcactctcccatatcagcagccagggcct

SEQ ID NO: 11501 - DNA, 140 bp, Artificial Sequence
  Synthetic
aggccctggctgctgatatgtactgggaagaatttgctgccagccctattaggataacaactgagaatttagcaacctatgttactaaactaaaagggccaaaagcagcagcgctattcggaccttttgggacagcggtg

SEQ ID NO: 11502 - DNA, 140 bp, Artificial Sequence
  Synthetic
caccgctgtcccaaaaggtccgaatagcgctgctgcttttggcccttttagtttagtaacataggttgctaaattctcagttgttatcctaatagggctggcagcaaattcttcccagtacatatcagcagccagggcct

SEQ ID NO: 11503 - DNA, 140 bp, Artificial Sequence
  Synthetic
atacgccatgctgggtctcccagagcgggccgggctatttgtaagaacgtcagcaccgtgcacgattactggaacaatgggacacttcattctggcccgatgtccgaaaggagaaactctcgtacttgggagtcggccat

SEQ ID NO: 11504 - DNA, 140 bp, Artificial Sequence
  Synthetic
atggccgactcccaagtacgagagtttctcctttcggacatcgggccagaatgaagtgtcccattgttccagtaatcgtgcacggtgctgacgttcttacaaatagcccggcccgctctgggagacccagcatggcgtat

SEQ ID NO: 11505 - DNA, 140 bp, Artificial Sequence
  Synthetic
aggccctggctgctgatatgccgcagcacggtagagaactaccttgcagcacgtacgcgcagagcaccgctgcaactgccgaggagatagaggtacatatgcccccagacaccccagatcgaccttttgggacagcggtg

SEQ ID NO: 11506 - DNA, 140 bp, Artificial Sequence
  Synthetic
caccgctgtcccaaaaggtcgatctggggtgtctgggggcatatgtacctctatctcctcggcagttgcagcggtgctctgcgcgtacgtgctgcaaggtagttctctaccgtgctgcggcatatcagcagccagggcct

SEQ ID NO: 11507 - DNA, 140 bp, Artificial Sequence
  Synthetic
aggccctggctgctgatatgcagcatacctatgtgggattcacagagagctggttaggaggctgaacgccgtcctcctacccaatgtacatacactatttgacatgtctgccgaggatttgaccttttgggacagcggtg

SEQ ID NO: 11508 - DNA, 140 bp, Artificial Sequence
  Synthetic
caccgctgtcccaaaaggtcaaatcctcggcagacatgtcaaatagtgtatgtacattgggtaggaggacggcgttcagcctcctaaccagctctctgtgaatcccacataggtatgctgcatatcagcagccagggcct

SEQ ID NO: 11509 - DNA, 140 bp, Artificial Sequence
  Synthetic
atacgccatgctgggtctcccagacggtgcggtacaagtgtaattgcggtgactcaaatgaaggattaaccactacagacaaagtgattaataactgcaaggttgatcaatgccatgccgcgtacttgggagtcggccat

SEQ ID NO: 11510 - DNA, 140 bp, Artificial Sequence
  Synthetic
atggccgactcccaagtacgcggcatggcattgatcaaccttgcagttattaatcactttgtctgtagtggttaatccttcatttgagtcaccgcaattacacttgtaccgcaccgtctgggagacccagcatggcgtat

SEQ ID NO: 11511 - DNA, 140 bp, Artificial Sequence
  Synthetic
aggccctggctgctgatatgggcaaatgtgacatgcagggtgcctaaagcaaggaaccccaccgtgacgtacggaaaaaaccaagtcatcatgctgctgtatcctgaccacccaacgctcgaccttttgggacagcggtg

SEQ ID NO: 11512 - DNA, 140 bp, Artificial Sequence
  Synthetic
caccgctgtcccaaaaggtcgagcgttgggtggtcaggatacagcagcatgatgacttggttttttccgtacgtcacggtggggttccttgctttaggcaccctgcatgtcacatttgcccatatcagcagccagggcct

SEQ ID NO: 11513 - DNA, 140 bp, Artificial Sequence
  Synthetic
atacgccatgctgggtctccctgtcctaccggaatatgggagaagaaccaaactatcaagaagagtgggtgacgcataagaaggagatcaggttaaccgtgccgactgaagggctcgaggcgtacttgggagtcggccat

SEQ ID NO: 11514 - DNA, 140 bp, Artificial Sequence
  Synthetic
atggccgactcccaagtacgcctcgagcccttcagtcggcacggttaacctgatctccttcttatgcgtcacccactcttcttgatagtttggttcttctcccatattccggtaggacagggagacccagcatggcgtat

SEQ ID NO: 11515 - DNA, 140 bp, Artificial Sequence
  Synthetic
aggccctggctgctgatatgtacatggagtcgtctccgatgaattgatggcagccagatgtgccacttggatgaacatggaagtgaagatcatagatgcagttgtatccttgaaagccccgaccttttgggacagcggtg

SEQ ID NO: 11516 - DNA, 140 bp, Artificial Sequence
  Synthetic
caccgctgtcccaaaaggtcggggctttcaaggatacaactgcatctatgatcttcacttccatgttcatccaagtggcacatctggctgccatcaattcatcggagacgactccatgtacatatcagcagccagggcct

SEQ ID NO: 11517 - DNA, 140 bp, Artificial Sequence
  Synthetic
atacgccatgctgggtctccgctgtaccctactatgactgtggtagttgtgtcagtggcctcgttcgtgctcctgtcgatggtgggtgtggcagtggggatgtgcatgtgtgcacgacgccgtacttgggagtcggccat

SEQ ID NO: 11518 - DNA, 140 bp, Artificial Sequence
  Synthetic
atggccgactcccaagtacggcgtcgtgcacacatgcacatccccactgccacacccaccatcgacaggagcacgaacgaggccactgacacaactaccacagtcatagtagggtacagcggagacccagcatggcgtat

SEQ ID NO: 11519 - DNA, 140 bp, Artificial Sequence
  Synthetic
atacgccatgctgggtctcccttaccatgctgttgtaaaacgttgacttttttagccgtactgagcgtcggtgcccgcactgtgagcgcgtacgaacacgtaacagtgatcccgaacacgcgtacttgggagtcggccat

SEQ ID NO: 11520 - DNA, 140 bp, Artificial Sequence
  Synthetic
atggccgactcccaagtacgcgtgttcgggatcactgttacgtgttcgtacgcgctcacagtgcgggcaccgacgctcagtacggctaaaaaagtcaacgttttacaacagcatggtaagggagacccagcatggcgtat

SEQ ID NO: 11521 - DNA, 140 bp, Artificial Sequence
  Synthetic
atacgccatgctgggtctccgcttctgcgacactgaaaatacgcaattgagcgaagcacatgtggagaagtccgaatcatgcaaaacggaatttgcatcagcatacagggcccataccgccgtacttgggagtcggccat

SEQ ID NO: 11522 - DNA, 140 bp, Artificial Sequence
  Synthetic
atggccgactcccaagtacggcggtatgggccctgtatgctgatgcaaattccgttttgcatgattcggacttctccacatgtgcttcgctcaattgcgtattttcagtgtcgcagaagcggagacccagcatggcgtat

SEQ ID NO: 11523 - DNA, 140 bp, Artificial Sequence
  Synthetic
aggccctggctgctgatatgtccctacaggtgctggcaaaccaggggacagcggcagaccgatcttcgacaacaagggacgcgtggtggccatagtcttaggaggagctaatgaaggagcgaccttttgggacagcggtg

SEQ ID NO: 11524 - DNA, 140 bp, Artificial Sequence
  Synthetic
caccgctgtcccaaaaggtcgctccttcattagctcctcctaagactatggccaccacgcgtcccttgttgtcgaagatcggtctgccgctgtcccctggtttgccagcacctgtagggacatatcagcagccagggcct

SEQ ID NO: 11525 - DNA, 140 bp, Artificial Sequence
  Synthetic
aggccctggctgctgatatgcgtggtgtacaaaggcgacgtctacaacatggactacccgcccttcggcgcaggaagaccaggacaatttggcgacatccaaagtcgcacgcctgagagcgaccttttgggacagcggtg

SEQ ID NO: 11526 - DNA, 140 bp, Artificial Sequence
  Synthetic
caccgctgtcccaaaaggtcgctctcaggcgtgcgactttggatgtcgccaaattgtcctggtcttcctgcgccgaagggcgggtagtccatgttgtagacgtcgcctttgtacaccacgcatatcagcagccagggcct

SEQ ID NO: 11527 - DNA, 140 bp, Artificial Sequence
  Synthetic
aggccctggctgctgatatggaagacgtctatgctaacacacaactggtactgcagagaccgtccgcgggtacggtgcacgtgccgtactctcaggcaccatctggcttcaagtattggcgaccttttgggacagcggtg

SEQ ID NO: 11528 - DNA, 140 bp, Artificial Sequence
  Synthetic
caccgctgtcccaaaaggtcgccaatacttgaagccagatggtgcctgagagtacggcacgtgcaccgtacccgcggacggtctctgcagtaccagttgtgtgttagcatagacgtcttccatatcagcagccagggcct

SEQ ID NO: 11529 - DNA, 140 bp, Artificial Sequence
  Synthetic
atacgccatgctgggtctcctaaaagaacgaggggcgtcgctgcagcacacagcaccatttggctgtcaaatagcaacaaacccggtaagagcgatgaactgcgccgtagggaacatgcccgtacttgggagtcggccat

SEQ ID NO: 11530 - DNA, 140 bp, Artificial Sequence
  Synthetic
atggccgactcccaagtacgggcatgttccctacggcgcagttcatcgctcttaccgggtttgttgctatttgacagccaaatggtgctgtgtgctgcagcgacgcccctcgttcttttaggagacccagcatggcgtat

SEQ ID NO: 11531 - DNA, 140 bp, Artificial Sequence
  Synthetic
atacgccatgctgggtctcccatctttaacggacatgtcgtgtgaggtaccagcctgcacccattcctcagactttgggggcgtagccatcattaaatatgcagccagcaagaaaggcaacgtacttgggagtcggccat

SEQ ID NO: 11532 - DNA, 140 bp, Artificial Sequence
  Synthetic
atggccgactcccaagtacgttgcctttcttgctggctgcatatttaatgatggctacgcccccaaagtctgaggaatgggtgcaggctggtacctcacacgacatgtccgttaaagatgggagacccagcatggcgtat

SEQ ID NO: 11533 - DNA, 140 bp, Artificial Sequence
  Synthetic
aggccctggctgctgatatggactttgggggcgtagccatcattaaatatgcagccagcaagaaaggcaagtgtgcggtgcattcgatgactaacgccgtcactattcgggaagctgaaagaccttttgggacagcggtg

SEQ ID NO: 11534 - DNA, 140 bp, Artificial Sequence
  Synthetic
caccgctgtcccaaaaggtctttcagcttcccgaatagtgacggcgttagtcatcgaatgcaccgcacacttgcctttcttgctggctgcatatttaatgatggctacgcccccaaagtccatatcagcagccagggcct

SEQ ID NO: 11535 - DNA, 140 bp, Artificial Sequence
  Synthetic
atacgccatgctgggtctcctagaagtagaagggagctctcagctgcaaatctctttttcgacggccctagccagcgccgaattccgcgtacaagtctgctctacacaagtacactgtgccgtacttgggagtcggccat

SEQ ID NO: 11536 - DNA, 140 bp, Artificial Sequence
  Synthetic
atggccgactcccaagtacggcacagtgtacttgtgtagagcagacttgtacgcggaattcggcgctggctagggccgtcgaaaaagagatttgcagctgagagctcccttctacttctaggagacccagcatggcgtat

SEQ ID NO: 11537 - DNA, 140 bp, Artificial Sequence
  Synthetic
atacgccatgctgggtctcccctaatcgtggtgctatgcgtgtcgtttagcaggcactaacttgacatctaggtatgaaggcatatgcgtccctaaagagacacaccatatatagctaagcgtacttgggagtcggccat

SEQ ID NO: 11538 - DNA, 140 bp, Artificial Sequence
  Synthetic
atggccgactcccaagtacgcttagctatatatggtgtgtctctttagggacgcatatgccttcatacctagatgtcaagttagtgcctgctaaacgacacgcatagcaccacgattaggggagacccagcatggcgtat

SEQ ID NO: 11539 - DNA, 140 bp, Artificial Sequence
  Synthetic
atacgccatgctgggtctccaatcaatagataagtatagatcaaagggctgaacaacccctgaatagtaacaaaatataaaaatcaacaaaaatcataaaatagaaaactagaaatagaacgtacttgggagtcggccat

SEQ ID NO: 11540 - DNA, 140 bp, Artificial Sequence
  Synthetic
atggccgactcccaagtacgttctatttctagttttctattttatgatttttgttgatttttatattttgttactattcaggggttgttcagccctttgatctatacttatctattgattggagacccagcatggcgtat

SEQ ID NO: 11541 - DNA, 140 bp, Artificial Sequence
  Synthetic
aggccctggctgctgatatgcagacggtgcggtataagtgtaattgcggtggctcaaatgaaggactaacaactacagacaaagtgattaataactgcaaggttgatcaatgtcatgccggaccttttgggacagcggtg

SEQ ID NO: 11542 - DNA, 140 bp, Artificial Sequence
  Synthetic
caccgctgtcccaaaaggtccggcatgacattgatcaaccttgcagttattaatcactttgtctgtagttgttagtccttcatttgagccaccgcaattacacttataccgcaccgtctgcatatcagcagccagggcct

SEQ ID NO: 11543 - DNA, 140 bp, Artificial Sequence
  Synthetic
atacgccatgctgggtctcctaataaaaatcaaatgaataccataattggcaatcggaagagatgtaggtacttaagcttcctaaaagcagccgaactcgctttgagatgtaggcgtagccgtacttgggagtcggccat

SEQ ID NO: 11544 - DNA, 140 bp, Artificial Sequence
  Synthetic
atggccgactcccaagtacggctacgcctacatctcaaagcgagttcggctgcttttaggaagcttaagtacctacatctcttccgattgccaattatggtattcatttgatttttattaggagacccagcatggcgtat

SEQ ID NO: 11545 - DNA, 140 bp, Artificial Sequence
  Synthetic
atacgccatgctgggtctccgaactcttccataactctccgaacccacagggacgtaggagatgttcaaagtgactataaaaccctgaacagtaataaaacataaaattaataaggagtacgtacttgggagtcggccat

SEQ ID NO: 11546 - DNA, 140 bp, Artificial Sequence
  Synthetic
atggccgactcccaagtacgtactccttattaattttatgttttattactgttcagggttttatagtcactttgaacatctcctacgtccctgtgggttcggagagttatggaagagttcggagacccagcatggcgtat

SEQ ID NO: 11547 - DNA, 140 bp, Artificial Sequence
  Synthetic
aggccctggctgctgatatggctgtaccctactatgactgtagtagttgtatcagtggccacgttcatactcctgtcaatggtgggtatggcagcggggatgtgcatgtgtgcacgacgcgaccttttgggacagcggtg

SEQ ID NO: 11548 - DNA, 140 bp, Artificial Sequence
  Synthetic
caccgctgtcccaaaaggtcgcgtcgtgcacacatgcacatccccgctgccatacccaccattgacaggagtatgaacgtggccactgatacaactactacagtcatagtagggtacagccatatcagcagccagggcct

SEQ ID NO: 11549 - DNA, 140 bp, Artificial Sequence
  Synthetic
atacgccatgctgggtctccaaggagaaatcgaaagcttgtcttctgagctactaactttcggagacttcttaccaggagaagtggatgacttgacagacagcgaccggtccacgtgctccgtacttgggagtcggccat

SEQ ID NO: 11550 - DNA, 140 bp, Artificial Sequence
  Synthetic
atggccgactcccaagtacggagcacgtggaccggtcgctgtctgtcaagtcatccacttctcctggtaagaagtctccgaaagttagtagctcagaagacaagctttcgatttctccttggagacccagcatggcgtat

SEQ ID NO: 11551 - DNA, 140 bp, Artificial Sequence
  Synthetic
atacgccatgctgggtctcccttaccatgctgctgtaaaacgttggcttttttagccgtactgagcgtcggtgcccacactgtgagcgcgtacgagcacgtaacagtgatcccgaacacgcgtacttgggagtcggccat

SEQ ID NO: 11552 - DNA, 140 bp, Artificial Sequence
  Synthetic
atggccgactcccaagtacgcgtgttcgggatcactgttacgtgctcgtacgcgctcacagtgtgggcaccgacgctcagtacggctaaaaaagccaacgttttacagcagcatggtaagggagacccagcatggcgtat

SEQ ID NO: 11553 - DNA, 140 bp, Artificial Sequence
  Synthetic
aggccctggctgctgatatgaaagacgtctatgctaatacacaactggtactgcagagaccggctgtgggtacagtacacgtgccatactctcaggcaccatctggctttaagtattggcgaccttttgggacagcggtg

SEQ ID NO: 11554 - DNA, 140 bp, Artificial Sequence
  Synthetic
caccgctgtcccaaaaggtcgccaatacttaaagccagatggtgcctgagagtatggcacgtgtactgtacccacagccggtctctgcagtaccagttgtgtattagcatagacgtctttcatatcagcagccagggcct

SEQ ID NO: 11555 - DNA, 140 bp, Artificial Sequence
  Synthetic
atacgccatgctgggtctccgactttggtggcgtcgccattattaaatatgcagccagcaagaaaggcaagtgtgcggtgcattcgatgactaacgccgtcactattcgggaagctgagacgtacttgggagtcggccat

SEQ ID NO: 11556 - DNA, 140 bp, Artificial Sequence
  Synthetic
atggccgactcccaagtacgtctcagcttcccgaatagtgacggcgttagtcatcgaatgcaccgcacacttgcctttcttgctggctgcatatttaataatggcgacgccaccaaagtcggagacccagcatggcgtat

SEQ ID NO: 11557 - DNA, 140 bp, Artificial Sequence
  Synthetic
aggccctggctgctgatatgaatcactaaaaattataaaaacagaaaaatacataaataggtatacgtgtcccctaagagacacattgtatgtaggtgataagtatagattaaagggccggaccttttgggacagcggtg

SEQ ID NO: 11558 - DNA, 140 bp, Artificial Sequence
  Synthetic
caccgctgtcccaaaaggtccggccctttaatctatacttatcacctacatacaatgtgtctcttaggggacacgtatacctatttatgtatttttctgtttttataatttttagtgattcatatcagcagccagggcct

SEQ ID NO: 11559 - DNA, 140 bp, Artificial Sequence
  Synthetic
aggccctggctgctgatatgagaaagctagcatctgccgcaggaaaagtcctggacagaaacatctctggaaagatcggggacttacaagcagtaatggccgtgccagacaaggagacgcgaccttttgggacagcggtg

SEQ ID NO: 11560 - DNA, 140 bp, Artificial Sequence
  Synthetic
caccgctgtcccaaaaggtcgcgtctccttgtctggcacggccattactgcttgtaagtccccgatctttccagagatgtttctgtccaggacttttcctgcggcagatgctagctttctcatatcagcagccagggcct

SEQ ID NO: 11561 - DNA, 140 bp, Artificial Sequence
  Synthetic
atacgccatgctgggtctccgaaagttgtactttgtggtgacccgaagcagtgcggcttcttcaatatgatgcagatgaaagtcaactataatcacaacatctgcacccaagtgtaccaccgtacttgggagtcggccat

SEQ ID NO: 11562 - DNA, 140 bp, Artificial Sequence
  Synthetic
atggccgactcccaagtacggtggtacacttgggtgcagatgttgtgattatagttgactttcatctgcatcatattgaagaagccgcactgcttcgggtcaccacaaagtacaactttcggagacccagcatggcgtat

SEQ ID NO: 11563 - DNA, 140 bp, Artificial Sequence
  Synthetic
aggccctggctgctgatatgactgtcccgtgcctttgccgttacgctatgactccagaacgcgtcacccggcttcgcatgaaccacgtcacaagcataattgtgtgttcttcgtttccccgaccttttgggacagcggtg

SEQ ID NO: 11564 - DNA, 140 bp, Artificial Sequence
  Synthetic
caccgctgtcccaaaaggtcggggaaacgaagaacacacaattatgcttgtgacgtggttcatgcgaagccgggtgacgcgttctggagtcatagcgtaacggcaaaggcacgggacagtcatatcagcagccagggcct

SEQ ID NO: 11565 - DNA, 140 bp, Artificial Sequence
  Synthetic
aggccctggctgctgatatgacaggaggcgagtacaatcacgtcactgacgcatagtcaattcgacctaagcgttgatggcgagatactgcccgtcccgtcagacctggatgctgacgccgaccttttgggacagcggtg

SEQ ID NO: 11566 - DNA, 140 bp, Artificial Sequence
  Synthetic
caccgctgtcccaaaaggtcggcgtcagcatccaggtctgacgggacgggcagtatctcgccatcaacgcttaggtcgaattgactatgcgtcagtgacgtgattgtactcgcctcctgtcatatcagcagccagggcct

SEQ ID NO: 11567 - DNA, 140 bp, Artificial Sequence
  Synthetic
aggccctggctgctgatatgagacagggcaggtgggtatatattctcgtcggacaccggtccaggtcatttacaacagaagtcagtacgccagtcagtgctgccggtgaacaccctggaggaccttttgggacagcggtg

SEQ ID NO: 11568 - DNA, 140 bp, Artificial Sequence
  Synthetic
caccgctgtcccaaaaggtcctccagggtgttcaccggcagcactgactggcgtactgacttctgttgtaaatgacctggaccggtgtccgacgagaatatatacccacctgccctgtctcatatcagcagccagggcct

SEQ ID NO: 11569 - DNA, 140 bp, Artificial Sequence
  Synthetic
aggccctggctgctgatatgggatttcgatgccatcatagccgcacactttaagccaggagacactgttttggaaacggacatagcctcctttgataagagccaagatgattcacttgcggaccttttgggacagcggtg

SEQ ID NO: 11570 - DNA, 140 bp, Artificial Sequence
  Synthetic
caccgctgtcccaaaaggtccgcaagtgaatcatcttggctcttatcaaaggaggctatgtccgtttccaaaacagtgtctcctggcttaaagtgtgcggctatgatggcatcgaaatcccatatcagcagccagggcct

SEQ ID NO: 11571 - DNA, 140 bp, Artificial Sequence
  Synthetic
aggccctggctgctgatatgacgatactgtgacaggaacagcttgcagagtggcagacccgctaaaaaggctttttaaactgggcaaaccgctagcggcaggtgacgaacaagatgaagagaccttttgggacagcggtg

SEQ ID NO: 11572 - DNA, 140 bp, Artificial Sequence
  Synthetic
caccgctgtcccaaaaggtctcttcatcttgttcgtcacctgccgctagcggtttgcccagtttaaaaagcctttttagcgggtctgccactctgcaagctgttcctgtcacagtatcgtcatatcagcagccagggcct

SEQ ID NO: 11573 - DNA, 140 bp, Artificial Sequence
  Synthetic
aggccctggctgctgatatgccgtgccgactgaagggctcgaggtcacgtggggcaacaacgagccgtataagtattggccgcagttatctacaaacggtacagcccatggccacccgcagaccttttgggacagcggtg

SEQ ID NO: 11574 - DNA, 140 bp, Artificial Sequence
  Synthetic
caccgctgtcccaaaaggtctgcgggtggccatgggctgtaccgtttgtagataactgcggccaatacttatacggctcgttgttgccccacgtgacctcgagcccttcagtcggcacggcatatcagcagccagggcct

SEQ ID NO: 11575 - DNA, 140 bp, Artificial Sequence
  Synthetic
atacgccatgctgggtctccacgcgccctctttaacggacatgtcgtgcgaggtaccagcctgcacccattcctcagactttgggggcgtcgccattattaaatatgcagccagcaagaacgtacttgggagtcggccat

SEQ ID NO: 11576 - DNA, 140 bp, Artificial Sequence
  Synthetic
atggccgactcccaagtacgttcttgctggctgcatatttaataatggcgacgcccccaaagtctgaggaatgggtgcaggctggtacctcgcacgacatgtccgttaaagagggcgcgtggagacccagcatggcgtat

SEQ ID NO: 11577 - DNA, 140 bp, Artificial Sequence
  Synthetic
atacgccatgctgggtctcccagcaacctttgttttggctacaagcccttattccgctggcagccctgattgttctatgcaactgtctgagactcttaccatgctgctgtaaaacgttggcgtacttgggagtcggccat

SEQ ID NO: 11578 - DNA, 140 bp, Artificial Sequence
  Synthetic
atggccgactcccaagtacgccaacgttttacagcagcatggtaagagtctcagacagttgcatagaacaatcagggctgccagcggaataagggcttgtagccaaaacaaaggttgctgggagacccagcatggcgtat

SEQ ID NO: 11579 - DNA, 140 bp, Artificial Sequence
  Synthetic
aggccctggctgctgatatgacaattaagtatgaaggtatatgtgtcccctaagagacacactgtacatagcaaataatctatagatcaaagggctacgcaacccctgaatagtaacaaagaccttttgggacagcggtg

SEQ ID NO: 11580 - DNA, 140 bp, Artificial Sequence
  Synthetic
caccgctgtcccaaaaggtctttgttactattcaggggttgcgtagccctttgatctatagattatttgctatgtacagtgtgtctcttaggggacacatataccttcatacttaattgtcatatcagcagccagggcct

SEQ ID NO: 11581 - DNA, 140 bp, Artificial Sequence
  Synthetic
aggccctggctgctgatatgcgctatataccaggacgtctacgccgtgcatgcaccaacatcgctataccaccaggcgattaaaggagtcagtgtagcatactggatagggtttgacacagaccttttgggacagcggtg

SEQ ID NO: 11582 - DNA, 140 bp, Artificial Sequence
  Synthetic
caccgctgtcccaaaaggtctgtgtcaaaccctatccagtatgctacactgactcctttaatcgcctggtggtatagcgatgttggtgcatgcacggcgtagacgtcctggtatatagcgcatatcagcagccagggcct

SEQ ID NO: 11583 - DNA, 140 bp, Artificial Sequence
  Synthetic
atacgccatgctgggtctcccaacagacctgacggaaggtagacgaggtaaattgtctatcatgagaggagaaaagatgaagccatgtgaccgcgtactgttctcagtcgggtcaacgctcgtacttgggagtcggccat

SEQ ID NO: 11584 - DNA, 140 bp, Artificial Sequence
  Synthetic
atggccgactcccaagtacgagcgttgacccgactgagaacagtacgcggtcacatggcttcatcttttctcctctcatgatagacaatttacctcgtctaccttccgtcaggtctgttgggagacccagcatggcgtat

SEQ ID NO: 11585 - DNA, 140 bp, Artificial Sequence
  Synthetic
aggccctggctgctgatatgtgacagctttgtggtaccaagtttgtggtcatctggactgtcgatcccgctacggaccagaatcaagtggctgctaagcaaaatgccaaagactgatttggaccttttgggacagcggtg

SEQ ID NO: 11586 - DNA, 140 bp, Artificial Sequence
  Synthetic
caccgctgtcccaaaaggtccaaatcagtctttggcattttgcttagcagccacttgattctggtccgtagcgggatcgacagtccagatgaccacaaacttggtaccacaaagctgtcacatatcagcagccagggcct

SEQ ID NO: 11587 - DNA, 140 bp, Artificial Sequence
  Synthetic
aggccctggctgctgatatgtggaggaccgcttgacaaagtctgcgtgcgcggccttcatcggcgacgacaatataatacatggggttgtctctgacaaactgatggcagcaagatgtgcgaccttttgggacagcggtg

SEQ ID NO: 11588 - DNA, 140 bp, Artificial Sequence
  Synthetic
caccgctgtcccaaaaggtcgcacatcttgctgccatcagtttgtcagagacaaccccatgtattatattgtcgtcgccgatgaaggccgcgcacgcagactttgtcaagcggtcctccacatatcagcagccagggcct

SEQ ID NO: 11589 - DNA, 140 bp, Artificial Sequence
  Synthetic
atacgccatgctgggtctccttaatgggcggacggtgcggtacaagtgcaactgcggtggctcaaacgagggactgacaaccacagacaaagtgatcaacaactgcaaaattgatcagtgcgtacttgggagtcggccat

SEQ ID NO: 11590 - DNA, 140 bp, Artificial Sequence
  Synthetic
atggccgactcccaagtacgcactgatcaattttgcagttgttgatcactttgtctgtggttgtcagtccctcgtttgagccaccgcagttgcacttgtaccgcaccgtccgcccattaaggagacccagcatggcgtat

SEQ ID NO: 11591 - DNA, 140 bp, Artificial Sequence
  Synthetic
aggccctggctgctgatatgcgatgcaccctctgtaacggacatgtcatgcgaagtaccagcctgcactcactcctccgactttgggggcgttgccatcatcaaatacgcagctagcaaggaccttttgggacagcggtg

SEQ ID NO: 11592 - DNA, 140 bp, Artificial Sequence
  Synthetic
caccgctgtcccaaaaggtccttgctagctgcgtatttgatgatggcaacgcccccaaagtcggaggagtgagtgcaggctggtacttcgcatgacatgtccgttacagagggtgcatcgcatatcagcagccagggcct

SEQ ID NO: 11593 - DNA, 140 bp, Artificial Sequence
  Synthetic
atacgccatgctgggtctcctgaagagtgcgtagtcaacgccgctaaccctcgcgggttaccgggtgacggggtttgcaaggcagtatacaaaaaatggccggagtcctttaagaacagtcgtacttgggagtcggccat

SEQ ID NO: 11594 - DNA, 140 bp, Artificial Sequence
  Synthetic
atggccgactcccaagtacgactgttcttaaaggactccggccattttttgtatactgccttgcaaaccccgtcacccggtaacccgcgagggttagcggcgttgactacgcactcttcaggagacccagcatggcgtat

SEQ ID NO: 11595 - DNA, 140 bp, Artificial Sequence
  Synthetic
aggccctggctgctgatatgtgataagtatagatcaaagggccgaataacccctgaatagtaacaaaatatgaaaatcaataaaaatcataaaatagaaaaaccataaacagaagtagttgaccttttgggacagcggtg

SEQ ID NO: 11596 - DNA, 140 bp, Artificial Sequence
  Synthetic
caccgctgtcccaaaaggtcaactacttctgtttatggtttttctattttatgatttttattgattttcatattttgttactattcaggggttattcggccctttgatctatacttatcacatatcagcagccagggcct

SEQ ID NO: 11597 - DNA, 140 bp, Artificial Sequence
  Synthetic
aggccctggctgctgatatgaatccacgctgttggaccaaacttctctaattattcggagtctgaaggggaccgggaattggcagcagcctatcgagaagtcgcaaaggaagtaactagggaccttttgggacagcggtg

SEQ ID NO: 11598 - DNA, 140 bp, Artificial Sequence
  Synthetic
caccgctgtcccaaaaggtccctagttacttcctttgcgacttctcgataggctgctgccaattcccggtccccttcagactccgaataattagagaagtttggtccaacagcgtggattcatatcagcagccagggcct

SEQ ID NO: 11599 - DNA, 140 bp, Artificial Sequence
  Synthetic
atacgccatgctgggtctcctaagagagtcacttgggtagcgccgttaggtgtccgcggagcggactacacatacaacttagagttgggtctgccagcaacgcttggtaggtatgaccttcgtacttgggagtcggccat

SEQ ID NO: 11600 - DNA, 140 bp, Artificial Sequence
  Synthetic
atggccgactcccaagtacgaaggtcatacctaccaagcgttgctggcagacccaactctaagttgtatgtgtagtccgctccgcggacacctaacggcgctacccaagtgactctcttaggagacccagcatggcgtat

SEQ ID NO: 11601 - DNA, 140 bp, Artificial Sequence
  Synthetic
aggccctggctgctgatatgaatgaataccataattggcaaacggaagagatgtaggtacttaagcttcctaaaagcagccgaactcactttgagaagtaggcatagcataccgaactctgaccttttgggacagcggtg

SEQ ID NO: 11602 - DNA, 140 bp, Artificial Sequence
  Synthetic
caccgctgtcccaaaaggtcagagttcggtatgctatgcctacttctcaaagtgagttcggctgcttttaggaagcttaagtacctacatctcttccgtttgccaattatggtattcattcatatcagcagccagggcct

SEQ ID NO: 11603 - DNA, 140 bp, Artificial Sequence
  Synthetic
atacgccatgctgggtctccccgtcataactttgtacggcggtcctaaataggtacgcactacagctacctattttgcagaagccgacagcaagtatctaaacattaatcagctacaatgcgtacttgggagtcggccat

SEQ ID NO: 11604 - DNA, 140 bp, Artificial Sequence
  Synthetic
atggccgactcccaagtacgcattgtagctgattaatgtttagatacttgctgtcggcttctgcaaaataggtagctgtagtgcgtacctatttaggaccgccgtacaaagttatgacggggagacccagcatggcgtat

SEQ ID NO: 11605 - DNA, 140 bp, Artificial Sequence
  Synthetic
aggccctggctgctgatatgactcctgtcctaccggaatatgggagaagaaccaaactatcaagaagagtgggtgatgcataagaaggaagtcgtgctaaccgtgccaactgaagggctcgaccttttgggacagcggtg

SEQ ID NO: 11606 - DNA, 140 bp, Artificial Sequence
  Synthetic
caccgctgtcccaaaaggtcgagcccttcagttggcacggttagcacgacttccttcttatgcatcacccactcttcttgatagtttggttcttctcccatattccggtaggacaggagtcatatcagcagccagggcct

SEQ ID NO: 11607 - DNA, 140 bp, Artificial Sequence
  Synthetic
aggccctggctgctgatatgagctttgtggtaccgagtctgtggtcgtccgggttgtcaatccctttgaggactagaatcaaatggttgttaagcaaggtgcaaaaaaccgacctgatccgaccttttgggacagcggtg

SEQ ID NO: 11608 - DNA, 140 bp, Artificial Sequence
  Synthetic
caccgctgtcccaaaaggtcggatcaggtcggttttttgcaccttgcttaacaaccatttgattctagtcctcaaagggattgacaacccggacgaccacagactcggtaccacaaagctcatatcagcagccagggcct

SEQ ID NO: 11609 - DNA, 140 bp, Artificial Sequence
  Synthetic
atacgccatgctgggtctccgtgcacatgaagtccgacgcttcgaagttcacccatgagaaaccggaggggtactacaactggcaccacggagcagtacagtactcagggggccggttcacgtacttgggagtcggccat

SEQ ID NO: 11610 - DNA, 140 bp, Artificial Sequence
  Synthetic
atggccgactcccaagtacgtgaaccggccccctgagtactgtactgctccgtggtgccagttgtagtacccctccggtttctcatgggtgaacttcgaagcgtcggacttcatgtgcacggagacccagcatggcgtat

SEQ ID NO: 11611 - DNA, 140 bp, Artificial Sequence
  Synthetic
atacgccatgctgggtctccgttttcttaactgctctactctgcaaagcaagagattaagaacccatcatggatcctgtgtacgtggacatagacgctgacagcgcctttttgaaggccccgtacttgggagtcggccat

SEQ ID NO: 11612 - DNA, 140 bp, Artificial Sequence
  Synthetic
atggccgactcccaagtacggggccttcaaaaaggcgctgtcagcgtctatgtccacgtacacaggatccatgatgggttcttaatctcttgctttgcagagtagagcagttaagaaaacggagacccagcatggcgtat

SEQ ID NO: 11613 - DNA, 140 bp, Artificial Sequence
  Synthetic
atacgccatgctgggtctcctgcaacgtgcgtaccccatgtttgaggtggaacctaggcaggtcacaccgaatgaccatgctaacgctagagcgttctcgcatctagctataaaactaatcgtacttgggagtcggccat

SEQ ID NO: 11614 - DNA, 140 bp, Artificial Sequence
  Synthetic
atggccgactcccaagtacgattagttttatagctagatgcgagaacgctctagcgttagcatggtcattcggtgtgacctgcctaggttccacctcaaacatggggtacgcacgttgcaggagacccagcatggcgtat

SEQ ID NO: 11615 - DNA, 140 bp, Artificial Sequence
  Synthetic
atacgccatgctgggtctcccagcaaggaggatgatgtcggacaggaagtaccactgcgtctgcccgatgcgcagcgcagaagatcccgagagactcgccaattacgcgagaaagctagccgtacttgggagtcggccat

SEQ ID NO: 11616 - DNA, 140 bp, Artificial Sequence
  Synthetic
atggccgactcccaagtacggctagctttctcgcgtaattggcgagtctctcgggatcttctgcgctgcgcatcgggcagacgcagtggtacttcctgtccgacatcatcctccttgctgggagacccagcatggcgtat

SEQ ID NO: 11617 - DNA, 140 bp, Artificial Sequence
  Synthetic
aggccctggctgctgatatgacttacaagcagtaatggccgtgccagacacggagacgccgacattctgcttacacacagatgtctcatgtagacagagagcagacgtcgcgatataccagaccttttgggacagcggtg

SEQ ID NO: 11618 - DNA, 140 bp, Artificial Sequence
  Synthetic
caccgctgtcccaaaaggtctggtatatcgcgacgtctgctctctgtctacatgagacatctgtgtgtaagcagaatgtcggcgtctccgtgtctggcacggccattactgcttgtaagtcatatcagcagccagggcct

SEQ ID NO: 11619 - DNA, 140 bp, Artificial Sequence
  Synthetic
atacgccatgctgggtctccttacacacagatgtctcatgtagacagagagcagacgtcgcgatataccaagacgtctatgctgtacacgcacccacgtcgctataccaccaggcgattacgtacttgggagtcggccat

SEQ ID NO: 11620 - DNA, 140 bp, Artificial Sequence
  Synthetic
atggccgactcccaagtacgtaatcgcctggtggtatagcgacgtgggtgcgtgtacagcatagacgtcttggtatatcgcgacgtctgctctctgtctacatgagacatctgtgtgtaaggagacccagcatggcgtat

SEQ ID NO: 11621 - DNA, 140 bp, Artificial Sequence
  Synthetic
atacgccatgctgggtctccacgtaaagatcacggtcaatggccagacggtgcggtacaagtgtaattgcggtggctctaatgaaggactaacaactacagacaaagtgattaataactgcgtacttgggagtcggccat

SEQ ID NO: 11622 - DNA, 140 bp, Artificial Sequence
  Synthetic
atggccgactcccaagtacgcagttattaatcactttgtctgtagttgttagtccttcattagagccaccgcaattacacttgtaccgcaccgtctggccattgaccgtgatctttacgtggagacccagcatggcgtat

SEQ ID NO: 11623 - DNA, 140 bp, Artificial Sequence
  Synthetic
atacgccatgctgggtctccaaggggtccaagtggcgtactgggtagggttcgacacaaccccgttcatgtacaatgccatggcgggtgcctacccctcatattcgacaaactgggcagacgtacttgggagtcggccat

SEQ ID NO: 11624 - DNA, 140 bp, Artificial Sequence
  Synthetic
atggccgactcccaagtacgtctgcccagtttgtcgaatatgaggggtaggcacccgccatggcattgtacatgaacggggttgtgtcgaaccctacccagtacgccacttggaccccttggagacccagcatggcgtat

SEQ ID NO: 11625 - DNA, 140 bp, Artificial Sequence
  Synthetic
atacgccatgctgggtctcccggaaggtagacgaggcaaattgtctattatgagaaggaaaaagctaaaaccatgcgaccgtgtgctgttctcagtagggtcaacgctctacccggaaagcgtacttgggagtcggccat

SEQ ID NO: 11626 - DNA, 140 bp, Artificial Sequence
  Synthetic
atggccgactcccaagtacgctttccgggtagagcgttgaccctactgagaacagcacacggtcgcatggttttagctttttccttctcataatagacaatttgcctcgtctaccttccgggagacccagcatggcgtat

SEQ ID NO: 11627 - DNA, 140 bp, Artificial Sequence
  Synthetic
atacgccatgctgggtctccttttttagccgtaatgagcgtcggtgcccacactgtgagcgcgtacgaacacgcaacagtgatcccgaacacggtgggagtaccgtataagactctagtccgtacttgggagtcggccat

SEQ ID NO: 11628 - DNA, 140 bp, Artificial Sequence
  Synthetic
atggccgactcccaagtacggactagagtcttatacggtactcccaccgtgttcgggatcactgttgcgtgttcgtacgcgctcacagtgtgggcaccgacgctcattacggctaaaaaaggagacccagcatggcgtat

SEQ ID NO: 11629 - DNA, 140 bp, Artificial Sequence
  Synthetic
aggccctggctgctgatatgccatgcgaccgtgtgctgttctcagtagggtcaacgctctacccggaaagtcgcaagctacttaagagctggcacctaccatcggtgttccatctaaagggaccttttgggacagcggtg

SEQ ID NO: 11630 - DNA, 140 bp, Artificial Sequence
  Synthetic
caccgctgtcccaaaaggtccctttagatggaacaccgatggtaggtgccagctcttaagtagcttgcgactttccgggtagagcgttgaccctactgagaacagcacacggtcgcatggcatatcagcagccagggcct

SEQ ID NO: 11631 - DNA, 140 bp, Artificial Sequence
  Synthetic
atacgccatgctgggtctcccgtcactattcgggaagctgagatagaagttgaaggggattctcagctgcaaatctctttctcgacggccttagccagcgccgaattccgcgtacaagtccgtacttgggagtcggccat

SEQ ID NO: 11632 - DNA, 140 bp, Artificial Sequence
  Synthetic
atggccgactcccaagtacggacttgtacgcggaattcggcgctggctaaggccgtcgagaaagagatttgcagctgagaatccccttcaacttctatctcagcttcccgaatagtgacgggagacccagcatggcgtat

SEQ ID NO: 11633 - DNA, 140 bp, Artificial Sequence
  Synthetic
aggccctggctgctgatatgaaatctctttctcgacggccttagccagcgccgaattccgcgtacaagtctgctcaacacaagtacactgtgcagctgagtgccaccccccgaaggaccagaccttttgggacagcggtg

SEQ ID NO: 11634 - DNA, 140 bp, Artificial Sequence
  Synthetic
caccgctgtcccaaaaggtctggtccttcggggggtggcactcagctgcacagtgtacttgtgttgagcagacttgtacgcggaattcggcgctggctaaggccgtcgagaaagagatttcatatcagcagccagggcct

SEQ ID NO: 11635 - DNA, 140 bp, Artificial Sequence
  Synthetic
aggccctggctgctgatatgcagcaggcactaacttgacaattaagtatgaaggtatatgtgtcccctaagagacacaccgtacatagcaaataatctatagatcaaagggctacgcaacgaccttttgggacagcggtg

SEQ ID NO: 11636 - DNA, 140 bp, Artificial Sequence
  Synthetic
caccgctgtcccaaaaggtcgttgcgtagccctttgatctatagattatttgctatgtacggtgtgtctcttaggggacacatataccttcatacttaattgtcaagttagtgcctgctgcatatcagcagccagggcct

SEQ ID NO: 11637 - DNA, 140 bp, Artificial Sequence
  Synthetic
aggccctggctgctgatatggccggaggatgcacagaagctgttggtggggctgaaccagagaatagtggttaacggcagaacgcaacggaatacgaacaccatgaaaaactatctgcttgaccttttgggacagcggtg

SEQ ID NO: 11638 - DNA, 140 bp, Artificial Sequence
  Synthetic
caccgctgtcccaaaaggtcaagcagatagtttttcatggtgttcgtattccgttgcgttctgccgttaaccactattctctggttcagccccaccaacagcttctgtgcatcctccggccatatcagcagccagggcct

SEQ ID NO: 11639 - DNA, 140 bp, Artificial Sequence
  Synthetic
atacgccatgctgggtctcctttggctgcgtgagacacacgtagcctaccagtttcttactgctctactctgcaaagcaagagattaagaacccatcatggatcctgtgtacgtggacatcgtacttgggagtcggccat

SEQ ID NO: 11640 - DNA, 140 bp, Artificial Sequence
  Synthetic
atggccgactcccaagtacgatgtccacgtacacaggatccatgatgggttcttaatctcttgctttgcagagtagagcagtaagaaactggtaggctacgtgtgtctcacgcagccaaaggagacccagcatggcgtat

SEQ ID NO: 11641 - DNA, 140 bp, Artificial Sequence
  Synthetic
aggccctggctgctgatatgcatggaagatgaaaaactcctgggggtcagagaaagaacactgacctgctgctgtctatgggcgttcaagaagcaaaaaacacacacggtctacaagagggaccttttgggacagcggtg

SEQ ID NO: 11642 - DNA, 140 bp, Artificial Sequence
  Synthetic
caccgctgtcccaaaaggtccctcttgtagaccgtgtgtgttttttgcttcttgaacgcccatagacagcagcaggtcagtgttctttctctgacccccaggagtttttcatcttccatgcatatcagcagccagggcct

SEQ ID NO: 11643 - DNA, 140 bp, Artificial Sequence
  Synthetic
atacgccatgctgggtctcccctgatacccagtcaattcagaaggttcaggccgagttcgacagctttgtggtaccgagtctgtggtcgtccgggttgtcaatccctttaaggactagaacgtacttgggagtcggccat

SEQ ID NO: 11644 - DNA, 140 bp, Artificial Sequence
  Synthetic
atggccgactcccaagtacgttctagtccttaaagggattgacaacccggacgaccacagactcggtaccacaaagctgtcgaactcggcctgaaccttctgaattgactgggtatcaggggagacccagcatggcgtat

SEQ ID NO: 11645 - DNA, 140 bp, Artificial Sequence
  Synthetic
atacgccatgctgggtctccagactcgccaattatgcgagaaagctagcatctgccgcaggaaaagtcctggacagaaacatctctggaaagatcggggacttacaagcagtaatggccgcgtacttgggagtcggccat

SEQ ID NO: 11646 - DNA, 140 bp, Artificial Sequence
  Synthetic
atggccgactcccaagtacgcggccattactgcttgtaagtccccgatctttccagagatgtttctgtccaggacttttcctgcggcagatgctagctttctcgcataattggcgagtctggagacccagcatggcgtat

SEQ ID NO: 11647 - DNA, 140 bp, Artificial Sequence
  Synthetic
aggccctggctgctgatatggcaggaataatagagactccgagaggagctatcaaagttactgcccaaccaacagaccacgtcgtgggagagtacctggtactttccccacagaccgtacgaccttttgggacagcggtg

SEQ ID NO: 11648 - DNA, 140 bp, Artificial Sequence
  Synthetic
caccgctgtcccaaaaggtcgtacggtctgtggggaaagtaccaggtactctcccacgacgtggtctgttggttgggcagtaactttgatagctcctctcggagtctctattattcctgccatatcagcagccagggcct

SEQ ID NO: 11649 - DNA, 140 bp, Artificial Sequence
  Synthetic
aggccctggctgctgatatgagacagagagcagacgtcgcgatataccaagacgtctatgctgtacacgcacccacgtcgctataccaccaggcgattaaaggggtccgagtggcgtactgaccttttgggacagcggtg

SEQ ID NO: 11650 - DNA, 140 bp, Artificial Sequence
  Synthetic
caccgctgtcccaaaaggtcagtacgccactcggacccctttaatcgcctggtggtatagcgacgtgggtgcgtgtacagcatagacgtcttggtatatcgcgacgtctgctctctgtctcatatcagcagccagggcct

SEQ ID NO: 11651 - DNA, 140 bp, Artificial Sequence
  Synthetic
aggccctggctgctgatatgacccacgtcgctataccaccaggcgattaaaggggtccgagtggcgtactgggtagggttcgacacaaccccgttcatgtacaatgccatggcgggtgccgaccttttgggacagcggtg

SEQ ID NO: 11652 - DNA, 140 bp, Artificial Sequence
  Synthetic
caccgctgtcccaaaaggtcggcacccgccatggcattgtacatgaacggggttgtgtcgaaccctacccagtacgccactcggacccctttaatcgcctggtggtatagcgacgtgggtcatatcagcagccagggcct

SEQ ID NO: 11653 - DNA, 140 bp, Artificial Sequence
  Synthetic
atacgccatgctgggtctcctacgtagccagaagctcagcctaattcacgctttggcggagcaagtgaagacgtgcacgcacagcggacgagcagggaggtattcggtcgaagcgtacgacgtacttgggagtcggccat

SEQ ID NO: 11654 - DNA, 140 bp, Artificial Sequence
  Synthetic
atggccgactcccaagtacgtcgtacgcttcgaccgaatacctccctgctcgtccgctgtgcgtgcacgtcttcacttgctccgccaaagcgtgaattaggctgagcttctggctacgtaggagacccagcatggcgtat

SEQ ID NO: 11655 - DNA, 140 bp, Artificial Sequence
  Synthetic
atacgccatgctgggtctcctacccctcatattcgacaaactgggcagatgagcaggtactgaaggctaagaacataggattatgttcaacagacctgacggaaggtagacgaggcaaatcgtacttgggagtcggccat

SEQ ID NO: 11656 - DNA, 140 bp, Artificial Sequence
  Synthetic
atggccgactcccaagtacgatttgcctcgtctaccttccgtcaggtctgttgaacataatcctatgttcttagccttcagtacctgctcatctgcccagtttgtcgaatatgaggggtaggagacccagcatggcgtat

SEQ ID NO: 11657 - DNA, 140 bp, Artificial Sequence
  Synthetic
aggccctggctgctgatatgagagtctaagcgaaagcgcaacgatggtgtataacgaaagagagttcgtaaacagaaagttacaccacattgcgatgcacggaccagccctgaacaccgagaccttttgggacagcggtg

SEQ ID NO: 11658 - DNA, 140 bp, Artificial Sequence
  Synthetic
caccgctgtcccaaaaggtctcggtgttcagggctggtccgtgcatcgcaatgtggtgtaactttctgtttacgaactctctttcgttatacaccatcgttgcgctttcgcttagactctcatatcagcagccagggcct

SEQ ID NO: 11659 - DNA, 140 bp, Artificial Sequence
  Synthetic
atacgccatgctgggtctcctgtctattatgagagggaagaagctaaaaccgtgcgaccgtgtgctgttctcagtagggtcaacgctctacccggaaagccgcaagctacttaagagctgcgtacttgggagtcggccat

SEQ ID NO: 11660 - DNA, 140 bp, Artificial Sequence
  Synthetic
atggccgactcccaagtacgcagctcttaagtagcttgcggctttccgggtagagcgttgaccctactgagaacagcacacggtcgcacggttttagcttcttccctctcataatagacaggagacccagcatggcgtat

SEQ ID NO: 11661 - DNA, 140 bp, Artificial Sequence
  Synthetic
atacgccatgctgggtctccgcacctaccatcggtgttccatctaaagggcaaactcagcttcacatgccgctgtgatacagtggtttcgtgcgagggctacgtcgttaagagaataacgcgtacttgggagtcggccat

SEQ ID NO: 11662 - DNA, 140 bp, Artificial Sequence
  Synthetic
atggccgactcccaagtacgcgttattctcttaacgacgtagccctcgcacgaaaccactgtatcacagcggcatgtgaagctgagtttgccctttagatggaacaccgatggtaggtgcggagacccagcatggcgtat

SEQ ID NO: 11663 - DNA, 140 bp, Artificial Sequence
  Synthetic
atacgccatgctgggtctccatgagcccaggcctttatggaaaaaccacagggtatgcggtaacccaccacgcagacggattcttgatgtgtaagactaccgacacggttgacggcgaaacgtacttgggagtcggccat

SEQ ID NO: 11664 - DNA, 140 bp, Artificial Sequence
  Synthetic
atggccgactcccaagtacgtttcgccgtcaaccgtgtcggtagtcttacacatcaagaatccgtctgcgtggtgggttaccgcataccctgtggtttttccataaaggcctgggctcatggagacccagcatggcgtat

SEQ ID NO: 11665 - DNA, 140 bp, Artificial Sequence
  Synthetic
aggccctggctgctgatatggagtcttcggagtaccgggatctggcaagtcagctattatcaagaacctagttaccaggcaagacctggtgactagcggaaaaaaagaaaattgtcaggagaccttttgggacagcggtg

SEQ ID NO: 11666 - DNA, 140 bp, Artificial Sequence
  Synthetic
caccgctgtcccaaaaggtctcctgacaattttctttttttccgctagtcaccaggtcttgcctggtaactaggttcttgataatagctgacttgccagatcccggtactccgaagactccatatcagcagccagggcct

SEQ ID NO: 11667 - DNA, 140 bp, Artificial Sequence
  Synthetic
atacgccatgctgggtctccaatcaccaccgacgtgatgagacagagaggtctagagatatctgcacgtacggttgactcgctgctcttgaatggatgcaacagaccggtcgacgtgttgcgtacttgggagtcggccat

SEQ ID NO: 11668 - DNA, 140 bp, Artificial Sequence
  Synthetic
atggccgactcccaagtacgcaacacgtcgaccggtctgttgcatccattcaagagcagcgagtcaaccgtacgtgcagatatctctagacctctctgtctcatcacgtcggtggtgattggagacccagcatggcgtat

SEQ ID NO: 11669 - DNA, 140 bp, Artificial Sequence
  Synthetic
aggccctggctgctgatatggttggtggggctgaaccagagaatagtggttaacggcagaacgcaacggaatacgaacaccatgaaaaactatctgcttcccgtggttgcccaagccttcgaccttttgggacagcggtg

SEQ ID NO: 11670 - DNA, 140 bp, Artificial Sequence
  Synthetic
caccgctgtcccaaaaggtcgaaggcttgggcaaccacgggaagcagatagtttttcatggtgttcgtattccgttgcgttctgccgttaaccactattctctggttcagccccaccaaccatatcagcagccagggcct

SEQ ID NO: 11671 - DNA, 140 bp, Artificial Sequence
  Synthetic
atacgccatgctgggtctcctacgtagacgaggcgtttgcgtgccactccggaacgttacttgctttgatcgccttggttagaccaaggcagaaagttgtactttgtggtgacccgaagccgtacttgggagtcggccat

SEQ ID NO: 11672 - DNA, 140 bp, Artificial Sequence
  Synthetic
atggccgactcccaagtacggcttcgggtcaccacaaagtacaactttctgccttggtctaaccaaggcgatcaaagcaagtaacgttccggagtggcacgcaaacgcctcgtctacgtaggagacccagcatggcgtat

SEQ ID NO: 11673 - DNA, 140 bp, Artificial Sequence
  Synthetic
atacgccatgctgggtctccagcagaaaacacacacggtctacaagaggcctgatacccagtcaattcagaaggttcaggccgagtttgacagctttgtggtaccgagcctgtggtcgtccgtacttgggagtcggccat

SEQ ID NO: 11674 - DNA, 140 bp, Artificial Sequence
  Synthetic
atggccgactcccaagtacggacgaccacaggctcggtaccacaaagctgtcaaactcggcctgaaccttctgaattgactgggtatcaggcctcttgtagaccgtgtgtgttttctgctggagacccagcatggcgtat

SEQ ID NO: 11675 - DNA, 140 bp, Artificial Sequence
  Synthetic
aggccctggctgctgatatggacgcagaaaaagaagcagaggaagaacgagaagcagaactgactcgtgaagccctaccacctctacaggcagcacaggaagatgttcaggtcgaaatcggaccttttgggacagcggtg

SEQ ID NO: 11676 - DNA, 140 bp, Artificial Sequence
  Synthetic
caccgctgtcccaaaaggtccgatttcgacctgaacatcttcctgtgctgcctgtagaggtggtagggcttcacgagtcagttctgcttctcgttcttcctctgcttctttttctgcgtccatatcagcagccagggcct

SEQ ID NO: 11677 - DNA, 140 bp, Artificial Sequence
  Synthetic
atacgccatgctgggtctccaacccgctctatgcatcaacgtcagagcacgtcaacgtactcctaacacgtacggaaggtaaactggtatggaagacactttccggtgacccatggataacgtacttgggagtcggccat

SEQ ID NO: 11678 - DNA, 140 bp, Artificial Sequence
  Synthetic
atggccgactcccaagtacgttatccatgggtcaccggaaagtgtcttccataccagtttaccttccgtacgtgttaggagtacgttgacgtgctctgacgttgatgcatagagcgggttggagacccagcatggcgtat

SEQ ID NO: 11679 - DNA, 140 bp, Artificial Sequence
  Synthetic
aggccctggctgctgatatggcgatgcacggaccagccctgaacaccgacgaagagtcgtatgagctggtgagggcagagaggacagaacatgagtacgtttacgatgtggaccagagaagaccttttgggacagcggtg

SEQ ID NO: 11680 - DNA, 140 bp, Artificial Sequence
  Synthetic
caccgctgtcccaaaaggtcttctctggtccacatcgtaaacgtactcatgttctgtcctctctgccctcaccagctcatacgactcttcgtcggtgttcagggctggtccgtgcatcgccatatcagcagccagggcct

SEQ ID NO: 11681 - DNA, 140 bp, Artificial Sequence
  Synthetic
aggccctggctgctgatatggatgctgtaagaaggaagaagctgcaggactggtactggtgggcgacttgactaatccgccctaccacgaattcgcatatgaagggctaaaaatccgcccgaccttttgggacagcggtg

SEQ ID NO: 11682 - DNA, 140 bp, Artificial Sequence
  Synthetic
caccgctgtcccaaaaggtcgggcggatttttagcccttcatatgcgaattcgtggtagggcggattagtcaagtcgcccaccagtaccagtcctgcagcttcttccttcttacagcatccatatcagcagccagggcct

SEQ ID NO: 11683 - DNA, 140 bp, Artificial Sequence
  Synthetic
aggccctggctgctgatatgtgcctgcccatacaaaattgcagtcataggagtcttcggagtaccgggatctggcaagtcagctattatcaagaacctagttaccaggcaagacctggtggaccttttgggacagcggtg

SEQ ID NO: 11684 - DNA, 140 bp, Artificial Sequence
  Synthetic
caccgctgtcccaaaaggtccaccaggtcttgcctggtaactaggttcttgataatagctgacttgccagatcccggtactccgaagactcctatgactgcaattttgtatgggcaggcacatatcagcagccagggcct

SEQ ID NO: 11685 - DNA, 140 bp, Artificial Sequence
  Synthetic
aggccctggctgctgatatgctggcaagtcagctattatcaagaacctagttaccaggcaagacctggtgactagcggaaagaaagaaaactgccaagaaatcaccaccgacgtgatgaggaccttttgggacagcggtg

SEQ ID NO: 11686 - DNA, 140 bp, Artificial Sequence
  Synthetic
caccgctgtcccaaaaggtcctcatcacgtcggtggtgatttcttggcagttttctttctttccgctagtcaccaggtcttgcctggtaactaggttcttgataatagctgacttgccagcatatcagcagccagggcct

SEQ ID NO: 11687 - DNA, 140 bp, Artificial Sequence
  Synthetic
aggccctggctgctgatatgagccctgaatgaaatatgcacgcgcatgtatggggtggatctagacagcgggctattttctaaaccgttggtgtctgtgtattacgcagataaccactgggaccttttgggacagcggtg

SEQ ID NO: 11688 - DNA, 140 bp, Artificial Sequence
  Synthetic
caccgctgtcccaaaaggtcccagtggttatctgcgtaatacacagacaccaacggtttagaaaatagcccgctgtctagatccaccccatacatgcgcgtgcatatttcattcagggctcatatcagcagccagggcct

SEQ ID NO: 11689 - DNA, 140 bp, Artificial Sequence
  Synthetic
atacgccatgctgggtctccgataataggcctggagggaagatgttcggatttaaccccgaggcagcatccattctagagagaaagtatccattcacaaaagggaagtggaacatcaacacgtacttgggagtcggccat

SEQ ID NO: 11690 - DNA, 140 bp, Artificial Sequence
  Synthetic
atggccgactcccaagtacgtgttgatgttccacttcccttttgtgaatggatactttctctctagaatggatgctgcctcggggttaaatccgaacatcttccctccaggcctattatcggagacccagcatggcgtat

SEQ ID NO: 11691 - DNA, 140 bp, Artificial Sequence
  Synthetic
aggccctggctgctgatatgcattctagagagaaagtatccattcacaaaagggaagtggaacatcaacaagcagatctgcgtgactaccaggaggatagaagactttaaccctaccatcgaccttttgggacagcggtg

SEQ ID NO: 11692 - DNA, 140 bp, Artificial Sequence
  Synthetic
caccgctgtcccaaaaggtcgatggtagggttaaagtcttctatcctcctggtagtcacgcagatctgcttgttgatgttccacttcccttttgtgaatggatactttctctctagaatgcatatcagcagccagggcct

SEQ ID NO: 11693 - DNA, 140 bp, Artificial Sequence
  Synthetic
aggccctggctgctgatatgatacgaggtcatgacagcagccgcatcccaagggttaaccagaaaaggagtttacgcagttaggcaaaaagttaatgaaaacccgctctatgcatcaacggaccttttgggacagcggtg

SEQ ID NO: 11694 - DNA, 140 bp, Artificial Sequence
  Synthetic
caccgctgtcccaaaaggtccgttgatgcatagagcgggttttcattaactttttgcctaactgcgtaaactccttttctggttaacccttgggatgcggctgctgtcatgacctcgtatcatatcagcagccagggcct

SEQ ID NO: 11695 - DNA, 140 bp, Artificial Sequence
  Synthetic
aggccctggctgctgatatgtttacgcagttaggcaaaaagttaatgaaaacccgctctatgcatcaacgtcagagcacgtcaacgtactcctaacacgtacggaaggtaaactggtatggaccttttgggacagcggtg

SEQ ID NO: 11696 - DNA, 140 bp, Artificial Sequence
  Synthetic
caccgctgtcccaaaaggtccataccagtttaccttccgtacgtgttaggagtacgttgacgtgctctgacgttgatgcatagagcgggttttcattaactttttgcctaactgcgtaaacatatcagcagccagggcct

SEQ ID NO: 11697 - DNA, 140 bp, Artificial Sequence
  Synthetic
aggccctggctgctgatatgtcagagcacgtcaacgtactcctaacacgtacggaaggtaaactggtatggaagacactttccggtgacccgtggataaagacgctgcagaacccaccgagaccttttgggacagcggtg

SEQ ID NO: 11698 - DNA, 140 bp, Artificial Sequence
  Synthetic
caccgctgtcccaaaaggtctcggtgggttctgcagcgtctttatccacgggtcaccggaaagtgtcttccataccagtttaccttccgtacgtgttaggagtacgttgacgtgctctgacatatcagcagccagggcct

SEQ ID NO: 11699 - DNA, 140 bp, Artificial Sequence
  Synthetic
aggccctggctgctgatatggccaccacgtgctcctggtcagtggctataaccttgcactgcctactaagagagtcacttgggtagcgccactaggtgttcgcggagcggactacacatagaccttttgggacagcggtg

SEQ ID NO: 11700 - DNA, 140 bp, Artificial Sequence
  Synthetic
caccgctgtcccaaaaggtctatgtgtagtccgctccgcgaacacctagtggcgctacccaagtgactctcttagtaggcagtgcaaggttatagccactgaccaggagcacgtggtggccatatcagcagccagggcct

SEQ ID NO: 11701 - DNA, 140 bp, Artificial Sequence
  Synthetic
aggccctggctgctgatatgtcataaacatccacacaccttttcgcatacaccattaccaacagtgcgtagaccacgcaatgaaactgcaaatgctcgggggtgactcattgagactgctgaccttttgggacagcggtg

SEQ ID NO: 11702 - DNA, 140 bp, Artificial Sequence
  Synthetic
caccgctgtcccaaaaggtcagcagtctcaatgagtcacccccgagcatttgcagtttcattgcgtggtctacgcactgttggtaatggtgtatgcgaaaaggtgtgtggatgtttatgacatatcagcagccagggcct

SEQ ID NO: 11703 - DNA, 140 bp, Artificial Sequence
  Synthetic
aggccctggctgctgatatgcggggataaaactaaatgataggcagtggtcccagataattcaagccttcaaagaagacaaagcatactcacctgaagtagccttgaatgaaatatgcacgaccttttgggacagcggtg

SEQ ID NO: 11704 - DNA, 140 bp, Artificial Sequence
  Synthetic
caccgctgtcccaaaaggtcgtgcatatttcattcaaggctacttcaggtgagtatgctttgtcttctttgaaggcttgaattatctgggaccactgcctatcatttagttttatccccgcatatcagcagccagggcct

SEQ ID NO: 11705 - DNA, 140 bp, Artificial Sequence
  Synthetic
aggccctggctgctgatatgatcaactgaatgcagcctttgtaggacaggccacccgagcaggatgtgcaccgtcgtaccgggtaaaacgcatggacatcgcgaagaacgatgaagagtggaccttttgggacagcggtg

SEQ ID NO: 11706 - DNA, 140 bp, Artificial Sequence
  Synthetic
caccgctgtcccaaaaggtccactcttcatcgttcttcgcgatgtccatgcgttttacccggtacgacggtgcacatcctgctcgggtggcctgtcctacaaaggctgcattcagttgatcatatcagcagccagggcct

SEQ ID NO: 11707 - DNA, 140 bp, Artificial Sequence
  Synthetic
aggccctggctgctgatatgagactaccacactcattagtggccgaacaccgcccagtaaaaggggaaagaatggaatggctggttaataagataaacggccaccacgtgctcctggtcagaccttttgggacagcggtg

SEQ ID NO: 11708 - DNA, 140 bp, Artificial Sequence
  Synthetic
caccgctgtcccaaaaggtctgaccaggagcacgtggtggccgtttatcttattaaccagccattccattctttccccttttactgggcggtgttcggccactaatgagtgtggtagtctcatatcagcagccagggcct

SEQ ID NO: 11709 - DNA, 140 bp, Artificial Sequence
  Synthetic
aggccctggctgctgatatgaatggaatggctggttaataagataaacggccaccacgtgctcctggtcagtggctataaccttgcactgcctactaagagagtcacttgggtagcgccagaccttttgggacagcggtg

SEQ ID NO: 11710 - DNA, 140 bp, Artificial Sequence
  Synthetic
caccgctgtcccaaaaggtctggcgctacccaagtgactctcttagtaggcagtgcaaggttatagccactgaccaggagcacgtggtggccgtttatcttattaaccagccattccattcatatcagcagccagggcct

SEQ ID NO: 11711 - DNA, 140 bp, Artificial Sequence
  Synthetic
atacgccatgctgggtctccgtggctataaccttgcactgcctactaagagagtcacttgggtagcgccactaggcgtccgcggagcggactacacatacaacctagagttgggtctgcccgtacttgggagtcggccat

SEQ ID NO: 11712 - DNA, 140 bp, Artificial Sequence
  Synthetic
atggccgactcccaagtacgggcagacccaactctaggttgtatgtgtagtccgctccgcggacgcctagtggcgctacccaagtgactctcttagtaggcagtgcaaggttatagccacggagacccagcatggcgtat

SEQ ID NO: 11713 - DNA, 140 bp, Artificial Sequence
  Synthetic
aggccctggctgctgatatgtggcagctgcctatcgagaagtcgcaaaggaagtaactagactgggagtaaacagtgtggctatacctctcctctccacaggtgtatactcaggagggaagaccttttgggacagcggtg

SEQ ID NO: 11714 - DNA, 140 bp, Artificial Sequence
  Synthetic
caccgctgtcccaaaaggtcttccctcctgagtatacacctgtggagaggagaggtatagccacactgtttactcccagtctagttacttcctttgcgacttctcgataggcagctgccacatatcagcagccagggcct

SEQ ID NO: 11715 - DNA, 140 bp, Artificial Sequence
  Synthetic
atacgccatgctgggtctccaacagtgtggctatacctctcctctccacaggtgtatactcaggagggaaggacaggctgacccagtcactgaaccacctttttacagccatggattcgacgtacttgggagtcggccat

SEQ ID NO: 11716 - DNA, 140 bp, Artificial Sequence
  Synthetic
atggccgactcccaagtacgtcgaatccatggctgtaaaaaggtggttcagtgactgggtcagcctgtccttccctcctgagtatacacctgtggagaggagaggtatagccacactgttggagacccagcatggcgtat

SEQ ID NO: 11717 - DNA, 140 bp, Artificial Sequence
  Synthetic
atacgccatgctgggtctcccggatgcagacgtggtcatctactgccgcgacaaagaatgggagaagaaaatatctgaagccatacagatgcggacccaggtggagctgctggatgagcacgtacttgggagtcggccat

SEQ ID NO: 11718 - DNA, 140 bp, Artificial Sequence
  Synthetic
atggccgactcccaagtacgtgctcatccagcagctccacctgggtccgcatctgtatggcttcagatattttcttctcccattctttgtcgcggcagtagatgaccacgtctgcatccgggagacccagcatggcgtat

SEQ ID NO: 11719 - DNA, 140 bp, Artificial Sequence
  Synthetic
aggccctggctgctgatatgtattgggacgcaagtttagatcgtctagagcgttgaaaccaccatgtgtcaccagcaacactgagatgtttttcctattcagcaactttgataatggcaggaccttttgggacagcggtg

SEQ ID NO: 11720 - DNA, 140 bp, Artificial Sequence
  Synthetic
caccgctgtcccaaaaggtcctgccattatcaaagttgctgaataggaaaaacatctcagtgttgctggtgacacatggtggtttcaacgctctagacgatctaaacttgcgtcccaatacatatcagcagccagggcct

SEQ ID NO: 11721 - DNA, 140 bp, Artificial Sequence
  Synthetic
atacgccatgctgggtctccaaggaatttcacaactcatgtcatgaacaatcaactgaatgcagcctttgtaggacaggccacccgagcaggatgtgcaccgtcgtaccgggtaaaacgccgtacttgggagtcggccat

SEQ ID NO: 11722 - DNA, 140 bp, Artificial Sequence
  Synthetic
atggccgactcccaagtacggcgttttacccggtacgacggtgcacatcctgctcgggtggcctgtcctacaaaggctgcattcagttgattgttcatgacatgagttgtgaaattccttggagacccagcatggcgtat

SEQ ID NO: 11723 - DNA, 140 bp, Artificial Sequence
  Synthetic
aggccctggctgctgatatgcaggcagaaaaggatacagcaccacggaaggcgcactgtactcatatctagaagggacccgtttccaccagacggcagtggatatggcggagatatatacgaccttttgggacagcggtg

SEQ ID NO: 11724 - DNA, 140 bp, Artificial Sequence
  Synthetic
caccgctgtcccaaaaggtcgtatatatctccgccatatccactgccgtctggtggaaacgggtcccttctagatatgagtacagtgcgccttccgtggtgctgtatccttttctgcctgcatatcagcagccagggcct

SEQ ID NO: 11725 - DNA, 140 bp, Artificial Sequence
  Synthetic
atacgccatgctgggtctcctcgcgggttaccgggtgacggcgtttgcaaggcagtatacaaaaaatggccggagtcctttaagaatagtgcaacaccagtgggaaccgcaaaaacagttcgtacttgggagtcggccat

SEQ ID NO: 11726 - DNA, 140 bp, Artificial Sequence
  Synthetic
atggccgactcccaagtacgaactgtttttgcggttcccactggtgttgcactattcttaaaggactccggccattttttgtatactgccttgcaaacgccgtcacccggtaacccgcgaggagacccagcatggcgtat

SEQ ID NO: 11727 - DNA, 140 bp, Artificial Sequence
  Synthetic
aggccctggctgctgatatgtgggggaaagtattgaatcgatcaggcagaaatgcccggtggacgatgcagatgcatcgtctccccccaaaactgtcccgtgcctttgccgttacgccatgaccttttgggacagcggtg

SEQ ID NO: 11728 - DNA, 140 bp, Artificial Sequence
  Synthetic
caccgctgtcccaaaaggtcatggcgtaacggcaaaggcacgggacagttttggggggagacgatgcatctgcatcgtccaccgggcatttctgcctgatcgattcaatactttcccccacatatcagcagccagggcct

SEQ ID NO: 11729 - DNA, 140 bp, Artificial Sequence
  Synthetic
aggccctggctgctgatatggactccagaacgcgtcacccgacttcgcatgaaccacgtcacaagcataattgtgtgttcttcgtttccccttccaaagtataaaatagaaggagtgcaagaccttttgggacagcggtg

SEQ ID NO: 11730 - DNA, 140 bp, Artificial Sequence
  Synthetic
caccgctgtcccaaaaggtcttgcactccttctattttatactttggaaggggaaacgaagaacacacaattatgcttgtgacgtggttcatgcgaagtcgggtgacgcgttctggagtccatatcagcagccagggcct

SEQ ID NO: 11731 - DNA, 140 bp, Artificial Sequence
  Synthetic
atacgccatgctgggtctccaaagtcaaatgctctaaggtaatgctatttgaccacaacgtgccatcgcgcgtaagtccaagggaatatagatcttccccggagtccgcacaggaagcgacgtacttgggagtcggccat

SEQ ID NO: 11732 - DNA, 140 bp, Artificial Sequence
  Synthetic
atggccgactcccaagtacgtcgcttcctgtgcggactccggggaagatctatattcccttggacttacgcgcgatggcacgttgtggtcaaatagcattaccttagagcatttgactttggagacccagcatggcgtat

SEQ ID NO: 11733 - DNA, 140 bp, Artificial Sequence
  Synthetic
aggccctggctgctgatatgcgtaagtccaagggaatatagatcttccccggagtccgcacaggaagcgagtacaatcacgtcactgacgcatagccaattcgacctaagcgttgacggcgaccttttgggacagcggtg

SEQ ID NO: 11734 - DNA, 140 bp, Artificial Sequence
  Synthetic
caccgctgtcccaaaaggtcgccgtcaacgcttaggtcgaattggctatgcgtcagtgacgtgattgtactcgcttcctgtgcggactccggggaagatctatattcccttggacttacgcatatcagcagccagggcct

SEQ ID NO: 11735 - DNA, 140 bp, Artificial Sequence
  Synthetic
atacgccatgctgggtctccgagatactgcccgtcccgtcagacctggatgttgacgccccagccctagaaccagccctagacgacggggcgacacacacgttgccatccacaactggaacgtacttgggagtcggccat

SEQ ID NO: 11736 - DNA, 140 bp, Artificial Sequence
  Synthetic
atggccgactcccaagtacgttccagttgtggatggcaacgtgtgtgtcgccccgtcgtctagggctggttctagggctggggcgtcaacatccaggtctgacgggacgggcagtatctcggagacccagcatggcgtat

SEQ ID NO: 11737 - DNA, 140 bp, Artificial Sequence
  Synthetic
atacgccatgctgggtctccacggcagtggatatggcggagatatatactatgtggccaaagcaaacagaggccaacgagcaagtctgcctatatgccctgggggaaagtattgaatcgacgtacttgggagtcggccat

SEQ ID NO: 11738 - DNA, 140 bp, Artificial Sequence
  Synthetic
atggccgactcccaagtacgtcgattcaatactttcccccagggcatataggcagacttgctcgttggcctctgtttgctttggccacatagtatatatctccgccatatccactgccgtggagacccagcatggcgtat

SEQ ID NO: 11739 - DNA, 140 bp, Artificial Sequence
  Synthetic
atacgccatgctgggtctccaccttgcggccgtgtctgactgggtaatgagcactgtacctgtcgcgccgcccagaagaaggcgagggagaaacctgactgtgacatgcgacgagagagacgtacttgggagtcggccat

SEQ ID NO: 11740 - DNA, 140 bp, Artificial Sequence
  Synthetic
atggccgactcccaagtacgtctctctcgtcgcatgtcacagtcaggtttctccctcgccttcttctgggcggcgcgacaggtacagtgctcattacccagtcagacacggccgcaaggtggagacccagcatggcgtat

SEQ ID NO: 11741 - DNA, 140 bp, Artificial Sequence
  Synthetic
atacgccatgctgggtctcctcaggcagaaatgcccggtggatgatgcagatgcatcatctccccccaaaactgtcccgtgcctttgccgttacgccatgactccagaacgcgtcacccgcgtacttgggagtcggccat

SEQ ID NO: 11742 - DNA, 140 bp, Artificial Sequence
  Synthetic
atggccgactcccaagtacgcgggtgacgcgttctggagtcatggcgtaacggcaaaggcacgggacagttttggggggagatgatgcatctgcatcatccaccgggcatttctgcctgaggagacccagcatggcgtat

SEQ ID NO: 11743 - DNA, 140 bp, Artificial Sequence
  Synthetic
aggccctggctgctgatatgactgtcccgtgcctttgccgttacgccatgactccagaacgcgtcacccgacttcgcatgaaccacgtcacaagcataattgtgtgttcttcgtttccccgaccttttgggacagcggtg

SEQ ID NO: 11744 - DNA, 140 bp, Artificial Sequence
  Synthetic
caccgctgtcccaaaaggtcggggaaacgaagaacacacaattatgcttgtgacgtggttcatgcgaagtcgggtgacgcgttctggagtcatggcgtaacggcaaaggcacgggacagtcatatcagcagccagggcct

SEQ ID NO: 11745 - DNA, 140 bp, Artificial Sequence
  Synthetic
aggccctggctgctgatatggtccggtcgtacaagaaacagcggagacgcgtgacacagcaatgtctcttcaggcaccgccgagtaccgccacggaactgaatcatccgccgatctccttgaccttttgggacagcggtg

SEQ ID NO: 11746 - DNA, 140 bp, Artificial Sequence
  Synthetic
caccgctgtcccaaaaggtcaaggagatcggcggatgattcagttccgtggcggtactcggcggtgcctgaagagacattgctgtgtcacgcgtctccgctgtttcttgtacgaccggaccatatcagcagccagggcct

SEQ ID NO: 11747 - DNA, 140 bp, Artificial Sequence
  Synthetic
atacgccatgctgggtctcccggagcaccaagcgagacgttccccattacattcggggacttcaacgaaggagaaatcgaaagcttgtcttctgagctactaactttcggagacttcctacgtacttgggagtcggccat

SEQ ID NO: 11748 - DNA, 140 bp, Artificial Sequence
  Synthetic
atggccgactcccaagtacgtaggaagtctccgaaagttagtagctcagaagacaagctttcgatttctccttcgttgaagtccccgaatgtaatggggaacgtctcgcttggtgctccgggagacccagcatggcgtat

SEQ ID NO: 11749 - DNA, 140 bp, Artificial Sequence
  Synthetic
aggccctggctgctgatatgcccagaagaaggcgagggagaaacctgactgtgacatgcgacgagagagaagggaatataatacccatggctagcgtcagattctttagggcagagctgtgaccttttgggacagcggtg

SEQ ID NO: 11750 - DNA, 140 bp, Artificial Sequence
  Synthetic
caccgctgtcccaaaaggtcacagctctgccctaaagaatctgacgctagccatgggtattatattcccttctctctcgtcgcatgtcacagtcaggtttctccctcgccttcttctgggcatatcagcagccagggcct

SEQ ID NO: 11751 - DNA, 140 bp, Artificial Sequence
  Synthetic
atacgccatgctgggtctccatcttccccggagtctgcacaggaagcgagtacaaccacgtcactgacgcatagccaattcgacctaagcgttgacggcgagatactgcccgtcccgccacgtacttgggagtcggccat

SEQ ID NO: 11752 - DNA, 140 bp, Artificial Sequence
  Synthetic
atggccgactcccaagtacgtggcgggacgggcagtatctcgccgtcaacgcttaggtcgaattggctatgcgtcagtgacgtggttgtactcgcttcctgtgcagactccggggaagatggagacccagcatggcgtat

SEQ ID NO: 11753 - DNA, 140 bp, Artificial Sequence
  Synthetic
aggccctggctgctgatatggagaaatcgaaagcttgtcttctgagctactaactttcggagacttcctacccggagaagtggatgacttgacagatagcgactggtccacgtgctcagagaccttttgggacagcggtg

SEQ ID NO: 11754 - DNA, 140 bp, Artificial Sequence
  Synthetic
caccgctgtcccaaaaggtctctgagcacgtggaccagtcgctatctgtcaagtcatccacttctccgggtaggaagtctccgaaagttagtagctcagaagacaagctttcgatttctccatatcagcagccagggcct

SEQ ID NO: 11755 - DNA, 140 bp, Artificial Sequence
  Synthetic
atacgccatgctgggtctccgatctggatgctgacgccccagccctagaaccagccctagacgacggggcgacacacacgttgccatccacaactggaaaccttgcggccgtgtctgactcgtacttgggagtcggccat

SEQ ID NO: 11756 - DNA, 140 bp, Artificial Sequence
  Synthetic
atggccgactcccaagtacgagtcagacacggccgcaaggtttccagttgtggatggcaacgtgtgtgtcgccccgtcgtctagggctggttctagggctggggcgtcagcatccagatcggagacccagcatggcgtat

SEQ ID NO: 11757 - DNA, 140 bp, Artificial Sequence
  Synthetic
atacgccatgctgggtctccgtgcatccatggccaacagaagcaggtatcagtcgcgcaaagtagaaaacatgaaagcaacaatcattcagagactaaagagaggctgtagactatacttcgtacttgggagtcggccat

SEQ ID NO: 11758 - DNA, 140 bp, Artificial Sequence
  Synthetic
atggccgactcccaagtacgaagtatagtctacagcctctctttagtctctgaatgattgttgctttcatgttttctactttgcgcgactgatacctgcttctgttggccatggatgcacggagacccagcatggcgtat

SEQ ID NO: 11759 - DNA, 140 bp, Artificial Sequence
  Synthetic
atacgccatgctgggtctccaatgtcagagaccccgaaagtccctacttaccggaccacatatccggcgcctgtgtactcgcctccgatcaacgtccgattgtccaaccccgagtccgcacgtacttgggagtcggccat

SEQ ID NO: 11760 - DNA, 140 bp, Artificial Sequence
  Synthetic
atggccgactcccaagtacgtgcggactcggggttggacaatcggacgttgatcggaggcgagtacacaggcgccggatatgtggtccggtaagtagggactttcggggtctctgacattggagacccagcatggcgtat

SEQ ID NO: 11761 - DNA, 140 bp, Artificial Sequence
  Synthetic
aggccctggctgctgatatgcggagacgcgtgacacagcaacgtctcttcaggcaccgccgagtaccgccacggaactgaatcatccgccgatctccttcggtgcaccaagcgagacgttgaccttttgggacagcggtg

SEQ ID NO: 11762 - DNA, 140 bp, Artificial Sequence
  Synthetic
caccgctgtcccaaaaggtcaacgtctcgcttggtgcaccgaaggagatcggcggatgattcagttccgtggcggtactcggcggtgcctgaagagacgttgctgtgtcacgcgtctccgcatatcagcagccagggcct

SEQ ID NO: 11763 - DNA, 140 bp, Artificial Sequence
  Synthetic
atacgccatgctgggtctccccccattacatttggggacttcaacgaaggagaaatcgaaagcttgtcttctgagctgctgactttcggagacttcctacccggagaagtggatgacttgcgtacttgggagtcggccat

SEQ ID NO: 11764 - DNA, 140 bp, Artificial Sequence
  Synthetic
atggccgactcccaagtacgcaagtcatccacttctccgggtaggaagtctccgaaagtcagcagctcagaagacaagctttcgatttctccttcgttgaagtccccaaatgtaatggggggagacccagcatggcgtat

SEQ ID NO: 11765 - DNA, 140 bp, Artificial Sequence
  Synthetic
atacgccatgctgggtctccataccaaattaccgacgagtatgatgcatatttagacatggtggacgggtcggagagttgcctggatcgagcgacattcaacccgtcaaaacttaggagccgtacttgggagtcggccat

SEQ ID NO: 11766 - DNA, 140 bp, Artificial Sequence
  Synthetic
atggccgactcccaagtacggctcctaagttttgacgggttgaatgtcgctcgatccaggcaactctccgacccgtccaccatgtctaaatatgcatcatactcgtcggtaatttggtatggagacccagcatggcgtat

SEQ ID NO: 11767 - DNA, 140 bp, Artificial Sequence
  Synthetic
atacgccatgctgggtctccacagatagcgactggtccacgtgctcagacacggacgacgagttacgactagacagggcaggtgggtatatattctcgtcggacaccggtccaggtcattcgtacttgggagtcggccat

SEQ ID NO: 11768 - DNA, 140 bp, Artificial Sequence
  Synthetic
atggccgactcccaagtacgaatgacctggaccggtgtccgacgagaatatatacccacctgccctgtctagtcgtaactcgtcgtccgtgtctgagcacgtggaccagtcgctatctgtggagacccagcatggcgtat

SEQ ID NO: 11769 - DNA, 140 bp, Artificial Sequence
  Synthetic
aggccctggctgctgatatgctgtgtactcgcctccgatcaacgtccgattgtccaaccccgagtccgcagtggcagcatgtaatgagttcttagctagaaactatccaactgtctcatcgaccttttgggacagcggtg

SEQ ID NO: 11770 - DNA, 140 bp, Artificial Sequence
  Synthetic
caccgctgtcccaaaaggtcgatgagacagttggatagtttctagctaagaactcattacatgctgccactgcggactcggggttggacaatcggacgttgatcggaggcgagtacacagcatatcagcagccagggcct

SEQ ID NO: 11771 - DNA, 140 bp, Artificial Sequence
  Synthetic
aggccctggctgctgatatgagactaaagagaggctgtagactatacttaatgtcagagaccccaaaagtccctacttaccggaccacatatccggcgcctgtgtactcgcctccgatcagaccttttgggacagcggtg

SEQ ID NO: 11772 - DNA, 140 bp, Artificial Sequence
  Synthetic
caccgctgtcccaaaaggtctgatcggaggcgagtacacaggcgccggatatgtggtccggtaagtagggacttttggggtctctgacattaagtatagtctacagcctctctttagtctcatatcagcagccagggcct

SEQ ID NO: 11773 - DNA, 140 bp, Artificial Sequence
  Synthetic
atacgccatgctgggtctccccctacttaccggaccacatatccggcgcctgtgtactcgcctccgatcaacgtccgactgtccaaccccgagtcagcagtggcagcatgcaatgagttccgtacttgggagtcggccat

SEQ ID NO: 11774 - DNA, 140 bp, Artificial Sequence
  Synthetic
atggccgactcccaagtacggaactcattgcatgctgccactgctgactcggggttggacagtcggacgttgatcggaggcgagtacacaggcgccggatatgtggtccggtaagtagggggagacccagcatggcgtat

SEQ ID NO: 11775 - DNA, 140 bp, Artificial Sequence
  Synthetic
aggccctggctgctgatatgacgtccgactgtccaaccccgagtcagcagtggcagcatgcaatgagttcctagctagaaactatccaactgtctcatcataccaaattaccgacgagtagaccttttgggacagcggtg

SEQ ID NO: 11776 - DNA, 140 bp, Artificial Sequence
  Synthetic
caccgctgtcccaaaaggtctactcgtcggtaatttggtatgatgagacagttggatagtttctagctaggaactcattgcatgctgccactgctgactcggggttggacagtcggacgtcatatcagcagccagggcct

SEQ ID NO: 11777 - DNA, 140 bp, Artificial Sequence
  Synthetic
aggccctggctgctgatatgggaagaatttgctgccagccctattaggataacaactgagaatttaacaacctatgttactaaactaaaagggccaaaagcagcagcgctattcgcaaaagaccttttgggacagcggtg

SEQ ID NO: 11778 - DNA, 140 bp, Artificial Sequence
  Synthetic
caccgctgtcccaaaaggtcttttgcgaatagcgctgctgcttttggcccttttagtttagtaacataggttgttaaattctcagttgttatcctaatagggctggcagcaaattcttcccatatcagcagccagggcct

SEQ ID NO: 11779 - DNA, 140 bp, Artificial Sequence
  Synthetic
atacgccatgctgggtctccacccacaatctgctgccactgcaggaagtaccaatggataggttcacagtagatatgaaaagggacgtgaaggtgactcctggcacaaagcacacagaggcgtacttgggagtcggccat

SEQ ID NO: 11780 - DNA, 140 bp, Artificial Sequence
  Synthetic
atggccgactcccaagtacgcctctgtgtgctttgtgccaggagtcaccttcacgtcccttttcatatctactgtgaacctatccattggtacttcctgcagtggcagcagattgtgggtggagacccagcatggcgtat

SEQ ID NO: 11781 - DNA, 140 bp, Artificial Sequence
  Synthetic
atacgccatgctgggtctcctgagggaattacccactttggactcagcagtgttcaacgtggagtgttttaaaaaatttgcatgcaaccaagaatactgggaagaatttgctgccagccccgtacttgggagtcggccat

SEQ ID NO: 11782 - DNA, 140 bp, Artificial Sequence
  Synthetic
atggccgactcccaagtacggggctggcagcaaattcttcccagtattcttggttgcatgcaaattttttaaaacactccacgttgaacactgctgagtccaaagtgggtaattccctcaggagacccagcatggcgtat

SEQ ID NO: 11783 - DNA, 140 bp, Artificial Sequence
  Synthetic
atacgccatgctgggtctccccatcatagccgcacactttaagccaggagacgctgttttagaaacggacatagcctccttcgataagagccaagacgattcacttgcgcttactgctttcgtacttgggagtcggccat

SEQ ID NO: 11784 - DNA, 140 bp, Artificial Sequence
  Synthetic
atggccgactcccaagtacgaaagcagtaagcgcaagtgaatcgtcttggctcttatcgaaggaggctatgtccgtttctaaaacagcgtctcctggcttaaagtgtgcggctatgatggggagacccagcatggcgtat

SEQ ID NO: 11785 - DNA, 140 bp, Artificial Sequence
  Synthetic
aggccctggctgctgatatgcaggaagtaccaatggataggttcacagtagatatgaaaagggacgtgaaggtgactcctggtacaaagcacacagaggaaagacctaaagtgcaggttagaccttttgggacagcggtg

SEQ ID NO: 11786 - DNA, 140 bp, Artificial Sequence
  Synthetic
caccgctgtcccaaaaggtctaacctgcactttaggtctttcctctgtgtgctttgtaccaggagtcaccttcacgtcccttttcatatctactgtgaacctatccattggtacttcctgcatatcagcagccagggcct

SEQ ID NO: 11787 - DNA, 140 bp, Artificial Sequence
  Synthetic
aggccctggctgctgatatgccagctgtcatctaccgacaggtacgcgcttcaagttcggcgccatgatgaaatctggtatgttcctaactctgttcgtcaacacattgctaaacatcacgaccttttgggacagcggtg

SEQ ID NO: 11788 - DNA, 140 bp, Artificial Sequence
  Synthetic
caccgctgtcccaaaaggtcgtgatgtttagcaatgtgttgacgaacagagttaggaacataccagatttcatcatggcgccgaacttgaagcgcgtacctgtcggtagatgacagctggcatatcagcagccagggcct

SEQ ID NO: 11789 - DNA, 140 bp, Artificial Sequence
  Synthetic
aggccctggctgctgatatgtttgtggagggtttatactgcacgatactgtgacgggaacagcttgcagagtggcagacccgctaaaaaggctatttaaattgggcaaaccgttagcggcgaccttttgggacagcggtg

SEQ ID NO: 11790 - DNA, 140 bp, Artificial Sequence
  Synthetic
caccgctgtcccaaaaggtcgccgctaacggtttgcccaatttaaatagcctttttagcgggtctgccactctgcaagctgttcccgtcacagtatcgtgcagtataaaccctccacaaacatatcagcagccagggcct

SEQ ID NO: 11791 - DNA, 140 bp, Artificial Sequence
  Synthetic
atacgccatgctgggtctcccatcgctagccgagtgctggaagatcgtctgacaaaatccgcgtgcgcggccttcatcggcgacgacaacataatacatggagtcgtctccgatgaattgcgtacttgggagtcggccat

SEQ ID NO: 11792 - DNA, 140 bp, Artificial Sequence
  Synthetic
atggccgactcccaagtacgcaattcatcggagacgactccatgtattatgttgtcgtcgccgatgaaggccgcgcacgcggattttgtcagacgatcttccagcactcggctagcgatgggagacccagcatggcgtat

SEQ ID NO: 11793 - DNA, 140 bp, Artificial Sequence
  Synthetic
atacgccatgctgggtctccaggtgacgaacaagatgaagatagaagacgagcgctggctgacgaagtggtcagatggcaacgaacagggctaattgacgagttggagaaagcggtataccgtacttgggagtcggccat

SEQ ID NO: 11794 - DNA, 140 bp, Artificial Sequence
  Synthetic
atggccgactcccaagtacggtataccgctttctccaactcgtcaattagccctgttcgttgccatctgaccacttcgtcagccagcgctcgtcttctatcttcatcttgttcgtcacctggagacccagcatggcgtat

SEQ ID NO: 11795 - DNA, 140 bp, Artificial Sequence
  Synthetic
atacgccatgctgggtctcctgcagttgtatccttgaaagccccttacttttgtggagggtttatactgcacgatactgtgacgggaacagcttgcagagtggcagacccgctaaaaaggcgtacttgggagtcggccat

SEQ ID NO: 11796 - DNA, 140 bp, Artificial Sequence
  Synthetic
atggccgactcccaagtacgcctttttagcgggtctgccactctgcaagctgttcccgtcacagtatcgtgcagtataaaccctccacaaaagtaaggggctttcaaggatacaactgcaggagacccagcatggcgtat

SEQ ID NO: 11797 - DNA, 140 bp, Artificial Sequence
  Synthetic
aggccctggctgctgatatgcgtcagcaccgtgcacgattactggaacaatgggacacttcatcctggcccgatgtccgaaaggagaaactctgacggtgggattcactgacggtaggaagaccttttgggacagcggtg

SEQ ID NO: 11798 - DNA, 140 bp, Artificial Sequence
  Synthetic
caccgctgtcccaaaaggtcttcctaccgtcagtgaatcccaccgtcagagtttctcctttcggacatcgggccaggatgaagtgtcccattgttccagtaatcgtgcacggtgctgacgcatatcagcagccagggcct

SEQ ID NO: 11799 - DNA, 140 bp, Artificial Sequence
  Synthetic
atacgccatgctgggtctccctattcaaactgggcaaaccgctagcggcaggtgacgaacaagatgaagatagaagacgagcgctggctgacgaagtgatcagatggcaacgaacagggccgtacttgggagtcggccat

SEQ ID NO: 11800 - DNA, 140 bp, Artificial Sequence
  Synthetic
atggccgactcccaagtacggccctgttcgttgccatctgatcacttcgtcagccagcgctcgtcttctatcttcatcttgttcgtcacctgccgctagcggtttgcccagtttgaatagggagacccagcatggcgtat

SEQ ID NO: 11801 - DNA, 140 bp, Artificial Sequence
  Synthetic
aggccctggctgctgatatgtagaagacgagcgctggctgacgaagtgatcagatggcaacgaacagggctaattgatgagttggagaaagcggtatactctaggtatgaagtgcagggtgaccttttgggacagcggtg

SEQ ID NO: 11802 - DNA, 140 bp, Artificial Sequence
  Synthetic
caccgctgtcccaaaaggtcaccctgcacttcatacctagagtataccgctttctccaactcatcaattagccctgttcgttgccatctgatcacttcgtcagccagcgctcgtcttctacatatcagcagccagggcct

SEQ ID NO: 11803 - DNA, 140 bp, Artificial Sequence
  Synthetic
aggccctggctgctgatatggcgccctactatccaagtcatcaggcccagaccgcgccctcagaggcaagctgggcaacttgcccagctgatctcagcagttaacaaactgacaatgcgcgaccttttgggacagcggtg

SEQ ID NO: 11804 - DNA, 140 bp, Artificial Sequence
  Synthetic
caccgctgtcccaaaaggtcgcgcattgtcagtttgttaactgctgagatcagctgggcaagttgcccagcttgcctctgagggcgcggtctgggcctgatgacttggatagtagggcgccatatcagcagccagggcct

SEQ ID NO: 11805 - DNA, 140 bp, Artificial Sequence
  Synthetic
aggccctggctgctgatatgcttcgagaagctcagaggacccgtcataactttgtacggcggtcctaaataggtacgcactacagctacctattttgcagaagccgacagcaagtacctagaccttttgggacagcggtg

SEQ ID NO: 11806 - DNA, 140 bp, Artificial Sequence
  Synthetic
caccgctgtcccaaaaggtctaggtacttgctgtcggcttctgcaaaataggtagctgtagtgcgtacctatttaggaccgccgtacaaagttatgacgggtcctctgagcttctcgaagcatatcagcagccagggcct

SEQ ID NO: 11807 - DNA, 140 bp, Artificial Sequence
  Synthetic
atacgccatgctgggtctccaacactaatcagctataatggagttcatcccaacccaaactttctacaacaggaggtaccagcctcgaccctggactccgcgccctactatccaagtcatcgtacttgggagtcggccat

SEQ ID NO: 11808 - DNA, 140 bp, Artificial Sequence
  Synthetic
atggccgactcccaagtacgatgacttggatagtagggcgcggagtccagggtcgaggctggtacctcctgttgtagaaagtttgggttgggatgaactccattatagctgattagtgttggagacccagcatggcgtat

SEQ ID NO: 11809 - DNA, 140 bp, Artificial Sequence
  Synthetic
aggccctggctgctgatatggcaaaagcaacaggcgccacaaaacaacacaaaccaaaagaaacaaccacctaaaaagaaaccggctccaaagaaaaagaagccgggccgcagagagagggaccttttgggacagcggtg

SEQ ID NO: 11810 - DNA, 140 bp, Artificial Sequence
  Synthetic
caccgctgtcccaaaaggtccctctctctgcggcccggcttctttttctttggagccggtttctttttaggtggttgtttcttttggtttgtgttgttttgtggcgcctgttgcttttgccatatcagcagccagggcct

SEQ ID NO: 11811 - DNA, 140 bp, Artificial Sequence
  Synthetic
aggccctggctgctgatatgatgtgcatgaaaatcgaaaatgattgtattttcgaagtcaagcatgaaggtaaggtaacaggttacgcgtgtctggtgggggacaaagtaatgaaaccaggaccttttgggacagcggtg

SEQ ID NO: 11812 - DNA, 140 bp, Artificial Sequence
  Synthetic
caccgctgtcccaaaaggtcctggtttcattactttgtcccccaccagacacgcgtaacctgttaccttaccttcatgcttgacttcgaaaatacaatcattttcgattttcatgcacatcatatcagcagccagggcct

SEQ ID NO: 11813 - DNA, 140 bp, Artificial Sequence
  Synthetic
atacgccatgctgggtctcccacacgtaaaggggaccatcgataacgcggacctagccaaactggcttttaagcggtcatctaagtatgaccttgaatgtgcgcagatacccgtgcacatcgtacttgggagtcggccat

SEQ ID NO: 11814 - DNA, 140 bp, Artificial Sequence
  Synthetic
atggccgactcccaagtacgatgtgcacgggtatctgcgcacattcaaggtcatacttagatgaccgcttaaaagccagtttggctaggtccgcgttatcgatggtcccctttacgtgtgggagacccagcatggcgtat

SEQ ID NO: 11815 - DNA, 140 bp, Artificial Sequence
  Synthetic
atacgccatgctgggtctccaaacaacacaaaccaaaagaagcagccgcctaaaaagaaaccagctcaaaagaaaaagaagccgggccgcagagagaggatgtgcatgaaaatcgaaaatcgtacttgggagtcggccat

SEQ ID NO: 11816 - DNA, 140 bp, Artificial Sequence
  Synthetic
atggccgactcccaagtacgattttcgattttcatgcacatcctctctctgcggcccggcttctttttcttttgagctggtttctttttaggcggctgcttcttttggtttgtgttgtttggagacccagcatggcgtat

SEQ ID NO: 11817 - DNA, 140 bp, Artificial Sequence
  Synthetic
aggccctggctgctgatatgagaaaaagaagccgggccgcagagagaggatgtgcatgaaaatcgaaaatgattgtattttcgaagtcaagcatgaaggtaaggtaacaggttacgcgtggaccttttgggacagcggtg

SEQ ID NO: 11818 - DNA, 140 bp, Artificial Sequence
  Synthetic
caccgctgtcccaaaaggtccacgcgtaacctgttaccttaccttcatgcttgacttcgaaaatacaatcattttcgattttcatgcacatcctctctctgcggcccggcttctttttctcatatcagcagccagggcct

SEQ ID NO: 11819 - DNA, 140 bp, Artificial Sequence
  Synthetic
atacgccatgctgggtctcccttggtgggggacaaagtaatgaaaccagcacacgtaaaggggaccatcgataacgcggacctggccaaactggcctttaagcggtcatctaagtatgaccgtacttgggagtcggccat

SEQ ID NO: 11820 - DNA, 140 bp, Artificial Sequence
  Synthetic
atggccgactcccaagtacggtcatacttagatgaccgcttaaaggccagtttggccaggtccgcgttatcgatggtcccctttacgtgtgctggtttcattactttgtcccccaccaagggagacccagcatggcgtat

SEQ ID NO: 11821 - DNA, 140 bp, Artificial Sequence
  Synthetic
aggccctggctgctgatatggggacgcgtggtggccatagtcttaggaggagctaatgaaggagcccgtacagccctctcagtggtgacctggaataaagacattgtcactaaaatcaccgaccttttgggacagcggtg

SEQ ID NO: 11822 - DNA, 140 bp, Artificial Sequence
  Synthetic
caccgctgtcccaaaaggtcggtgattttagtgacaatgtctttattccaggtcaccactgagagggctgtacgggctccttcattagctcctcctaagactatggccaccacgcgtccccatatcagcagccagggcct

SEQ ID NO: 11823 - DNA, 140 bp, Artificial Sequence
  Synthetic
atacgccatgctgggtctccccagagggggccgaagagtggagtcttgctatcccagtcatgtgcctgttggcaaacactacgttcccctgctcccagcccccttgcacaccctgctgctcgtacttgggagtcggccat

SEQ ID NO: 11824 - DNA, 140 bp, Artificial Sequence
  Synthetic
atggccgactcccaagtacgagcagcagggtgtgcaagggggctgggagcaggggaacgtagtgtttgccaacaggcacatgactgggatagcaagactccactcttcggccccctctggggagacccagcatggcgtat

SEQ ID NO: 11825 - DNA, 140 bp, Artificial Sequence
  Synthetic
atacgccatgctgggtctccatcagaaatgaagcgacagacgggacgctgaaaatccaggtctccttgcaaatcggaataaagacggatgatagccacgattggaccaagctgcgttacacgtacttgggagtcggccat

SEQ ID NO: 11826 - DNA, 140 bp, Artificial Sequence
  Synthetic
atggccgactcccaagtacgtgtaacgcagcttggtccaatcgtggctatcatccgtctttattccgatttgcaaggagacctggattttcagcgtcccgtctgtcgcttcatttctgatggagacccagcatggcgtat

SEQ ID NO: 11827 - DNA, 140 bp, Artificial Sequence
  Synthetic
atacgccatgctgggtctcctggacaaccacatgccagcagacgcagagagggcggggctgtttgtaagaacatcagcaccgtgcacgattactggaacaatgggacacttcatcctggccgtacttgggagtcggccat

SEQ ID NO: 11828 - DNA, 140 bp, Artificial Sequence
  Synthetic
atggccgactcccaagtacggccaggatgaagtgtcccattgttccagtaatcgtgcacggtgctgatgttcttacaaacagccccgccctctctgcgtctgctggcatgtggttgtccaggagacccagcatggcgtat

SEQ ID NO: 11829 - DNA, 140 bp, Artificial Sequence
  Synthetic
atacgccatgctgggtctccattggaccaagctgcgttacatggacaaccacatgccagcagacgcagagagggcggggctatttgtaagaacatcagcaccgtgcacgattactggaaccgtacttgggagtcggccat

SEQ ID NO: 11830 - DNA, 140 bp, Artificial Sequence
  Synthetic
atggccgactcccaagtacggttccagtaatcgtgcacggtgctgatgttcttacaaatagccccgccctctctgcgtctgctggcatgtggttgtccatgtaacgcagcttggtccaatggagacccagcatggcgtat

SEQ ID NO: 11831 - DNA, 140 bp, Artificial Sequence
  Synthetic
atacgccatgctgggtctccccgatgtccgaaaggggaaactctgacggtgggattcactgacagtaggaagatcagtcactcatgtacgcacccatttcaccacgaccctcctgtgatacgtacttgggagtcggccat

SEQ ID NO: 11832 - DNA, 140 bp, Artificial Sequence
  Synthetic
atggccgactcccaagtacgtatcacaggagggtcgtggtgaaatgggtgcgtacatgagtgactgatcttcctactgtcagtgaatcccaccgtcagagtttcccctttcggacatcggggagacccagcatggcgtat

SEQ ID NO: 11833 - DNA, 140 bp, Artificial Sequence
  Synthetic
atacgccatgctgggtctccagggcggggctatttgtaagaacatcagcaccgtgcacgattactggaacaatgggacacttcatcttggcccgatgcccgaaaggggagactctgacggcgtacttgggagtcggccat

SEQ ID NO: 11834 - DNA, 140 bp, Artificial Sequence
  Synthetic
atggccgactcccaagtacgccgtcagagtctcccctttcgggcatcgggccaagatgaagtgtcccattgttccagtaatcgtgcacggtgctgatgttcttacaaatagccccgccctggagacccagcatggcgtat

SEQ ID NO: 11835 - DNA, 140 bp, Artificial Sequence
  Synthetic
atacgccatgctgggtctcctgggattcactgacggtaggaagattagtcactcatgtacgcacccattccaccacgaccctcctgtgataggccgggaaaaattccattcccgaccgcacgtacttgggagtcggccat

SEQ ID NO: 11836 - DNA, 140 bp, Artificial Sequence
  Synthetic
atggccgactcccaagtacgtgcggtcgggaatggaatttttcccggcctatcacaggagggtcgtggtggaatgggtgcgtacatgagtgactaatcttcctaccgtcagtgaatcccaggagacccagcatggcgtat

SEQ ID NO: 11837 - DNA, 140 bp, Artificial Sequence
  Synthetic
atacgccatgctgggtctccggccgggaaaaattccattcccgaccgcagcacggtaaagagctaccttgcagcacgtacgtgcagagcaccgccgtaactaccgaggagatagaggtaccgtacttgggagtcggccat

SEQ ID NO: 11838 - DNA, 140 bp, Artificial Sequence
  Synthetic
atggccgactcccaagtacggtacctctatctcctcggtagttacggcggtgctctgcacgtacgtgctgcaaggtagctctttaccgtgctgcggtcgggaatggaatttttcccggccggagacccagcatggcgtat

SEQ ID NO: 11839 - DNA, 140 bp, Artificial Sequence
  Synthetic
atacgccatgctgggtctccacatgcccccagacacccctgatcgcacattgatgtcacaacagtccggcaacgtaaagatcacagttaatggccagacggtgcggtacaagtgtaattgcgtacttgggagtcggccat

SEQ ID NO: 11840 - DNA, 140 bp, Artificial Sequence
  Synthetic
atggccgactcccaagtacgcaattacacttgtaccgcaccgtctggccattaactgtgatctttacgttgccggactgttgtgacatcaatgtgcgatcaggggtgtctgggggcatgtggagacccagcatggcgtat

SEQ ID NO: 11841 - DNA, 140 bp, Artificial Sequence
  Synthetic
atacgccatgctgggtctccaacgtaaagatcacagttaatggccagacggtgcggtacaagtgtaattgcggtggctcaaatgaaggactaataactacagacaaagtgattaataactcgtacttgggagtcggccat

SEQ ID NO: 11842 - DNA, 140 bp, Artificial Sequence
  Synthetic
atggccgactcccaagtacgagttattaatcactttgtctgtagttattagtccttcatttgagccaccgcaattacacttgtaccgcaccgtctggccattaactgtgatctttacgttggagacccagcatggcgtat

SEQ ID NO: 11843 - DNA, 140 bp, Artificial Sequence
  Synthetic
atacgccatgctgggtctccgcacggtaaagagctaccttgcagcacgtacgtgcagagtaccgccgcaactaccgagatagaggtgcacatgcccccagacacccctgatcgcacattgcgtacttgggagtcggccat

SEQ ID NO: 11844 - DNA, 140 bp, Artificial Sequence
  Synthetic
atggccgactcccaagtacgcaatgtgcgatcaggggtgtctgggggcatgtgcacctctatctcggtagttgcggcggtactctgcacgtacgtgctgcaaggtagctctttaccgtgcggagacccagcatggcgtat

SEQ ID NO: 11845 - DNA, 140 bp, Artificial Sequence
  Synthetic
atacgccatgctgggtctccatgtcacaacagtccggcaacgtaaagatcacagtcaatggccagacggtgcggtacaagtgtaattgcggtggctcaaacgaaggactaataaccacagcgtacttgggagtcggccat

SEQ ID NO: 11846 - DNA, 140 bp, Artificial Sequence
  Synthetic
atggccgactcccaagtacgctgtggttattagtccttcgtttgagccaccgcaattacacttgtaccgcaccgtctggccattgactgtgatctttacgttgccggactgttgtgacatggagacccagcatggcgtat

SEQ ID NO: 11847 - DNA, 140 bp, Artificial Sequence
  Synthetic
aggccctggctgctgatatgacttggggaccgaaaaggaaaaattcacatcccgtttccgctggcaaatgtaacatgcagggtgcctaaagcaaggaaccccactgtgacgtacgggaaagaccttttgggacagcggtg

SEQ ID NO: 11848 - DNA, 140 bp, Artificial Sequence
  Synthetic
caccgctgtcccaaaaggtctttcccgtacgtcacagtggggttccttgctttaggcaccctgcatgttacatttgccagcggaaacgggatgtgaatttttccttttcggtccccaagtcatatcagcagccagggcct

SEQ ID NO: 11849 - DNA, 140 bp, Artificial Sequence
  Synthetic
atacgccatgctgggtctccctgtatcctgaccacccaacactcctgtcctaccggaatatgggagaagaaccaaactatcaagaagagtgggtgacgcataagaaggaagtcatgctaacgtacttgggagtcggccat

SEQ ID NO: 11850 - DNA, 140 bp, Artificial Sequence
  Synthetic
atggccgactcccaagtacgttagcatgacttccttcttatgcgtcacccactcttcttgatagtttggttcttctcccatattccggtaggacaggagtgttgggtggtcaggatacagggagacccagcatggcgtat

SEQ ID NO: 11851 - DNA, 140 bp, Artificial Sequence
  Synthetic
atacgccatgctgggtctccaaccaagtcatcatgctactgtatcctgaccacccaacactcctgtcctaccggaacatgggagaagaaccaaactatcaagaagagtgggtgacgtatacgtacttgggagtcggccat

SEQ ID NO: 11852 - DNA, 140 bp, Artificial Sequence
  Synthetic
atggccgactcccaagtacgtatacgtcacccactcttcttgatagtttggttcttctcccatgttccggtaggacaggagtgttgggtggtcaggatacagtagcatgatgacttggttggagacccagcatggcgtat

SEQ ID NO: 11853 - DNA, 140 bp, Artificial Sequence
  Synthetic
atacgccatgctgggtctccttgtgtcagtggcctcgttcgtactcctgtcgatggtgggtatggcagtgggaatgtgcatgtgtgcacgacgcagatgcatcacaccgtacgaactgaccgtacttgggagtcggccat

SEQ ID NO: 11854 - DNA, 140 bp, Artificial Sequence
  Synthetic
atggccgactcccaagtacggtcagttcgtacggtgtgatgcatctgcgtcgtgcacacatgcacattcccactgccatacccaccatcgacaggagtacgaacgaggccactgacacaaggagacccagcatggcgtat

SEQ ID NO: 11855 - DNA, 140 bp, Artificial Sequence
  Synthetic
atacgccatgctgggtctccagaaggaagtagtgctaaccgtgccgactgaagggctcgaggtcacgtggggcaacaacgagccgtataagtactggccgcagttatctacaaacagtaccgtacttgggagtcggccat

SEQ ID NO: 11856 - DNA, 140 bp, Artificial Sequence
  Synthetic
atggccgactcccaagtacggtactgtttgtagataactgcggccagtacttatacggctcgttgttgccccacgtgacctcgagcccttcagtcggcacggttagcactacttccttctggagacccagcatggcgtat

SEQ ID NO: 11857 - DNA, 140 bp, Artificial Sequence
  Synthetic
atacgccatgctgggtctccagcccatggccacccgcatgagataatcctgtattattatgagctgtaccctactatgactgtagtagttgtgtcagtggcctcgttcgtactcctgtcgcgtacttgggagtcggccat

SEQ ID NO: 11858 - DNA, 140 bp, Artificial Sequence
  Synthetic
atggccgactcccaagtacgcgacaggagtacgaacgaggccactgacacaactactacagtcatagtagggtacagctcataataatacaggattatctcatgcgggtggccatgggctggagacccagcatggcgtat

SEQ ID NO: 11859 - DNA, 140 bp, Artificial Sequence
  Synthetic
atacgccatgctgggtctccatggtaggtatggcagtggggatgtgcatgtgtgcacgacgcagatgtatcacaccgtacgaactgacaccaggagctaccgtccctttcctgcttagcccgtacttgggagtcggccat

SEQ ID NO: 11860 - DNA, 140 bp, Artificial Sequence
  Synthetic
atggccgactcccaagtacgggctaagcaggaaagggacggtagctcctggtgtcagttcgtacggtgtgatacatctgcgtcgtgcacacatgcacatccccactgccatacctaccatggagacccagcatggcgtat

SEQ ID NO: 11861 - DNA, 140 bp, Artificial Sequence
  Synthetic
aggccctggctgctgatatgcacaccgtacgaactgacaccaggagctaccgtccctttcctgcttagcctaatatgctgcatcagaacagcaaaagcggccacataccaagaggctgcggaccttttgggacagcggtg

SEQ ID NO: 11862 - DNA, 140 bp, Artificial Sequence
  Synthetic
caccgctgtcccaaaaggtccgcagcctcttggtatgtggccgcttttgctgttctgatgcagcatattaggctaagcaggaaagggacggtagctcctggtgtcagttcgtacggtgtgcatatcagcagccagggcct

SEQ ID NO: 11863 - DNA, 140 bp, Artificial Sequence
  Synthetic
aggccctggctgctgatatggtatacctgtggaacgagcagcaacctttgttttggctacaagcccttattccgctggcagccctgattgtcctatgcaactgtctgagactcttaccatgaccttttgggacagcggtg

SEQ ID NO: 11864 - DNA, 140 bp, Artificial Sequence
  Synthetic
caccgctgtcccaaaaggtcatggtaagagtctcagacagttgcataggacaatcagggctgccagcggaataagggcttgtagccaaaacaaaggttgctgctcgttccacaggtataccatatcagcagccagggcct

SEQ ID NO: 11865 - DNA, 140 bp, Artificial Sequence
  Synthetic
atacgccatgctgggtctcccaatagaccgggctacagtcccatggtattggagatggaactactgtcagtcactttggagccaacgctatcgcttgattacatcacgtgcgagtacaaacgtacttgggagtcggccat

SEQ ID NO: 11866 - DNA, 140 bp, Artificial Sequence
  Synthetic
atggccgactcccaagtacgtttgtactcgcacgtgatgtaatcaagcgatagcgttggctccaaagtgactgacagtagttccatctccaataccatgggactgtagcccggtctattgggagacccagcatggcgtat

SEQ ID NO: 11867 - DNA, 140 bp, Artificial Sequence
  Synthetic
aggccctggctgctgatatgtcactttggagccaacgctatcgcttgattacatcacgtgcgagtacaaaaccgtcatcccgtctccgtacgtgaaatgctgcggtacagcagagtgcaagaccttttgggacagcggtg

SEQ ID NO: 11868 - DNA, 140 bp, Artificial Sequence
  Synthetic
caccgctgtcccaaaaggtcttgcactctgctgtaccgcagcatttcacgtacggagacgggatgacggttttgtactcgcacgtgatgtaatcaagcgatagcgttggctccaaagtgacatatcagcagccagggcct

SEQ ID NO: 11869 - DNA, 140 bp, Artificial Sequence
  Synthetic
aggccctggctgctgatatgaccgtataagactctagtcaatagaccgggctacagtcccatggtattggagatggaactactgtcggtcactttggagccaacgctatcgcttgattacgaccttttgggacagcggtg

SEQ ID NO: 11870 - DNA, 140 bp, Artificial Sequence
  Synthetic
caccgctgtcccaaaaggtcgtaatcaagcgatagcgttggctccaaagtgaccgacagtagttccatctccaataccatgggactgtagcccggtctattgactagagtcttatacggtcatatcagcagccagggcct

SEQ ID NO: 11871 - DNA, 140 bp, Artificial Sequence
  Synthetic
atacgccatgctgggtctccagatggaactactgtcggtcactttggagccaacgctatcgcttgattacatcacgtgcgagtataaaaccgtcattccgtctccgtacgtgaaatgctgcgtacttgggagtcggccat

SEQ ID NO: 11872 - DNA, 140 bp, Artificial Sequence
  Synthetic
atggccgactcccaagtacgcagcatttcacgtacggagacggaatgacggttttatactcgcacgtgatgtaatcaagcgatagcgttggctccaaagtgaccgacagtagttccatctggagacccagcatggcgtat

SEQ ID NO: 11873 - DNA, 140 bp, Artificial Sequence
  Synthetic
aggccctggctgctgatatgtcttcaccggcgtctacccatttatgtggggcggcgcctactgcttctgcgacgctgaaaacacgcaattgagcgaagcacatgtggagaagtctgaatcgaccttttgggacagcggtg

SEQ ID NO: 11874 - DNA, 140 bp, Artificial Sequence
  Synthetic
caccgctgtcccaaaaggtcgattcagacttctccacatgtgcttcgctcaattgcgtgttttcagcgtcgcagaagcagtaggcgccgccccacataaatgggtagacgccggtgaagacatatcagcagccagggcct

SEQ ID NO: 11875 - DNA, 140 bp, Artificial Sequence
  Synthetic
atacgccatgctgggtctcctttaccaaggaaataacatcactgtaactgcctatgcaaacggcgaccatgccgtcacagtcaaggacgccaaattcattgtggggccaatgtcttcagccgtacttgggagtcggccat

SEQ ID NO: 11876 - DNA, 140 bp, Artificial Sequence
  Synthetic
atggccgactcccaagtacggctgaagacattggccccacaatgaatttggcgtccttgactgtgacggcatggtcgccgtttgcataggcagttacagtgatgttatttccttggtaaaggagacccagcatggcgtat

SEQ ID NO: 11877 - DNA, 140 bp, Artificial Sequence
  Synthetic
aggccctggctgctgatatgatgcaaaacagaatttgcatcagcatacagggctcataccgcatccgcatcagctaagctccgcgtcctttaccaaggaaataacatcactgtaactgccgaccttttgggacagcggtg

SEQ ID NO: 11878 - DNA, 140 bp, Artificial Sequence
  Synthetic
caccgctgtcccaaaaggtcggcagttacagtgatgttatttccttggtaaaggacgcggagcttagctgatgcggatgcggtatgagccctgtatgctgatgcaaattctgttttgcatcatatcagcagccagggcct

SEQ ID NO: 11879 - DNA, 140 bp, Artificial Sequence
  Synthetic
atacgccatgctgggtctccggtactgcagagaccggctgcgggtacggtacatgtgccatactctcaggcaccatctggctttaagtattggctaaaagaacgaggggcgtcgctgcagcgtacttgggagtcggccat

SEQ ID NO: 11880 - DNA, 140 bp, Artificial Sequence
  Synthetic
atggccgactcccaagtacgctgcagcgacgcccctcgttcttttagccaatacttaaagccagatggtgcctgagagtatggcacatgtaccgtacccgcagccggtctctgcagtaccggagacccagcatggcgtat

SEQ ID NO: 11881 - DNA, 140 bp, Artificial Sequence
  Synthetic
aggccctggctgctgatatgccaggacaatttggcgatatccaaagtcgcacacctgagagtaaagacgtctatgctaatacacaactagtactgcagagaccggctgcaggtacggtacgaccttttgggacagcggtg

SEQ ID NO: 11882 - DNA, 140 bp, Artificial Sequence
  Synthetic
caccgctgtcccaaaaggtcgtaccgtacctgcagccggtctctgcagtactagttgtgtattagcatagacgtctttactctcaggtgtgcgactttggatatcgccaaattgtcctggcatatcagcagccagggcct

SEQ ID NO: 11883 - DNA, 140 bp, Artificial Sequence
  Synthetic
aggccctggctgctgatatgatgtgccatactctcaggcaccatctggctttaagtattggctgaaagaacgaggggcgtcgctgcagcacacagcaccatttggctgccaaatagcaacgaccttttgggacagcggtg

SEQ ID NO: 11884 - DNA, 140 bp, Artificial Sequence
  Synthetic
caccgctgtcccaaaaggtcgttgctatttggcagccaaatggtgctgtgtgctgcagcgacgcccctcgttctttcagccaatacttaaagccagatggtgcctgagagtatggcacatcatatcagcagccagggcct

SEQ ID NO: 11885 - DNA, 140 bp, Artificial Sequence
  Synthetic
aggccctggctgctgatatggaactgcgccgtagggaacatgcccatctccatcgacataccggatgcggcctttactagggtcgtcgacgcgccctctttaacggacatgtcgtgcgaggaccttttgggacagcggtg

SEQ ID NO: 11886 - DNA, 140 bp, Artificial Sequence
  Synthetic
caccgctgtcccaaaaggtcctcgcacgacatgtccgttaaagagggcgcgtcgacgaccctagtaaaggccgcatccggtatgtcgatggagatgggcatgttccctacggcgcagttccatatcagcagccagggcct

SEQ ID NO: 11887 - DNA, 140 bp, Artificial Sequence
  Synthetic
aggccctggctgctgatatgcgaggggcgtcgctgcagcacacagcaccatttggctgccaaatagcaacaaatccggtaagagcggtgaactgcgccgtggggaacatgcccatctccagaccttttgggacagcggtg

SEQ ID NO: 11888 - DNA, 140 bp, Artificial Sequence
  Synthetic
caccgctgtcccaaaaggtctggagatgggcatgttccccacggcgcagttcaccgctcttaccggatttgttgctatttggcagccaaatggtgctgtgtgctgcagcgacgcccctcgcatatcagcagccagggcct

SEQ ID NO: 11889 - DNA, 140 bp, Artificial Sequence
  Synthetic
aggccctggctgctgatatggtaccagcctgcacccattcctcagatttcgggggcgtcgccattattaaatatgcagccagcaagaaaggcaagtgtgcggtgcattcgatgaccaacggaccttttgggacagcggtg

SEQ ID NO: 11890 - DNA, 140 bp, Artificial Sequence
  Synthetic
caccgctgtcccaaaaggtccgttggtcatcgaatgcaccgcacacttgcctttcttgctggctgcatatttaataatggcgacgcccccgaaatctgaggaatgggtgcaggctggtaccatatcagcagccagggcct

SEQ ID NO: 11891 - DNA, 140 bp, Artificial Sequence
  Synthetic
atacgccatgctgggtctccacggacatgtcgtgcgaggtaccagcctgcacccattcctcagacttcgggggcgtcgccattattaaatatgcagccagcaagaaaggcaagtgtgcggcgtacttgggagtcggccat

SEQ ID NO: 11892 - DNA, 140 bp, Artificial Sequence
  Synthetic
atggccgactcccaagtacgccgcacacttgcctttcttgctggctgcatatttaataatggcgacgcccccgaagtctgaggaatgggtgcaggctggtacctcgcacgacatgtccgtggagacccagcatggcgtat

SEQ ID NO: 11893 - DNA, 140 bp, Artificial Sequence
  Synthetic
aggccctggctgctgatatgcaaatctctttctcgacggccttagccagcgccgaattccgcgtacaagtctgttctacacaagtacactgtacagccgagtgccaccctccgaaggaccgaccttttgggacagcggtg

SEQ ID NO: 11894 - DNA, 140 bp, Artificial Sequence
  Synthetic
caccgctgtcccaaaaggtcggtccttcggagggtggcactcggctgtacagtgtacttgtgtagaacagacttgtacgcggaattcggcgctggctaaggccgtcgagaaagagatttgcatatcagcagccagggcct

SEQ ID NO: 11895 - DNA, 140 bp, Artificial Sequence
  Synthetic
atacgccatgctgggtctcctgcattcgatgaccaacgccgtcactattcgggaagctgagatagaagttgaagggaattctcagctgcaaatctctttctcgacggccttagccagcgccgtacttgggagtcggccat

SEQ ID NO: 11896 - DNA, 140 bp, Artificial Sequence
  Synthetic
atggccgactcccaagtacggcgctggctaaggccgtcgagaaagagatttgcagctgagaattcccttcaacttctatctcagcttcccgaatagtgacggcgttggtcatcgaatgcaggagacccagcatggcgtat

SEQ ID NO: 11897 - DNA, 140 bp, Artificial Sequence
  Synthetic
aggccctggctgctgatatgcgtcacccggcttcgcatgaaccacgtcacaagcataattgtgtgttcttcgtttcccctcccaaagtacaaaataggaggagtgcaaaaagtcaaatgcgaccttttgggacagcggtg

SEQ ID NO: 11898 - DNA, 140 bp, Artificial Sequence
  Synthetic
caccgctgtcccaaaaggtcgcatttgactttttgcactcctcctattttgtactttgggaggggaaacgaagaacacacaattatgcttgtgacgtggttcatgcgaagccgggtgacgcatatcagcagccagggcct

SEQ ID NO: 11899 - DNA, 140 bp, Artificial Sequence
  Synthetic
atacgccatgctgggtctcccgaattccgcgtacaagtctgttctacacaagtacactgtgcagccgagtgccaccctccgaaggaccacatagtcaactacccggcgtcacataccacccgtacttgggagtcggccat

SEQ ID NO: 11900 - DNA, 140 bp, Artificial Sequence
  Synthetic
atggccgactcccaagtacgggtggtatgtgacgccgggtagttgactatgtggtccttcggagggtggcactcggctgcacagtgtacttgtgtagaacagacttgtacgcggaattcgggagacccagcatggcgtat

SEQ ID NO: 11901 - DNA, 140 bp, Artificial Sequence
  Synthetic
aggccctggctgctgatatggccaccctccgaaggaccacatagtcaactacccggcgtcacataccaccctcggggtccaggacatttccgctacggcgatgtcatgggtgcagaagatgaccttttgggacagcggtg

SEQ ID NO: 11902 - DNA, 140 bp, Artificial Sequence
  Synthetic
caccgctgtcccaaaaggtcatcttctgcacccatgacatcgccgtagcggaaatgtcctggaccccgagggtggtatgtgacgccgggtagttgactatgtggtccttcggagggtggccatatcagcagccagggcct

SEQ ID NO: 11903 - DNA, 140 bp, Artificial Sequence
  Synthetic
atacgccatgctgggtctccctcggggtccaggacatttccgctacggcgatgtcatgggtgcagaagatcacgggaggtgtaggactggttgtcgctgttgcagcactgattctaatcgcgtacttgggagtcggccat

SEQ ID NO: 11904 - DNA, 140 bp, Artificial Sequence
  Synthetic
atggccgactcccaagtacgcgattagaatcagtgctgcaacagcgacaaccagtcctacacctcccgtgatcttctgcacccatgacatcgccgtagcggaaatgtcctggaccccgagggagacccagcatggcgtat

SEQ ID NO: 11905 - DNA, 140 bp, Artificial Sequence
  Synthetic
atacgccatgctgggtctccggttgtcgctgttgcagcactgattctaatcgtggtgctatgcgtgtcgtttagcaggcactagcttgacaactaagtatgaaggtatatgtgtcccctacgtacttgggagtcggccat

SEQ ID NO: 11906 - DNA, 140 bp, Artificial Sequence
  Synthetic
atggccgactcccaagtacgtaggggacacatataccttcatacttagttgtcaagctagtgcctgctaaacgacacgcatagcaccacgattagaatcagtgctgcaacagcgacaaccggagacccagcatggcgtat

SEQ ID NO: 11907 - DNA, 140 bp, Artificial Sequence
  Synthetic
atacgccatgctgggtctcctggtgctatgcgtgtcgttcagcaggcactgactcgacaactaagtatgaaggtatacgtgtcccctaagagacacactgtatatagccaataatctatacgtacttgggagtcggccat

SEQ ID NO: 11908 - DNA, 140 bp, Artificial Sequence
  Synthetic
atggccgactcccaagtacgtatagattattggctatatacagtgtgtctcttaggggacacgtataccttcatacttagttgtcgagtcagtgcctgctgaacgacacgcatagcaccaggagacccagcatggcgtat

SEQ ID NO: 11909 - DNA, 140 bp, Artificial Sequence
  Synthetic
aggccctggctgctgatatgtgaaaatcaataaaaatcataaaatagaaaaaccataaacagaagtagttcaaagggctataaaacccctgaatagtaacaaaacataaaactaataaaagaccttttgggacagcggtg

SEQ ID NO: 11910 - DNA, 140 bp, Artificial Sequence
  Synthetic
caccgctgtcccaaaaggtcttttattagttttatgttttgttactattcaggggttttatagccctttgaactacttctgtttatggtttttctattttatgatttttattgattttcacatatcagcagccagggcct

SEQ ID NO: 11911 - DNA, 140 bp, Artificial Sequence
  Synthetic
aggccctggctgctgatatgcgaactcactttgagatgtaggcatagcataccgaactcttccacgattctccgaacccacagggacgtaggagatgttattttgttttttaatatttcagaccttttgggacagcggtg

SEQ ID NO: 11912 - DNA, 140 bp, Artificial Sequence
  Synthetic
caccgctgtcccaaaaggtctgaaatattaaaaaacaaaataacatctcctacgtccctgtgggttcggagaatcgtggaagagttcggtatgctatgcctacatctcaaagtgagttcgcatatcagcagccagggcct

SEQ ID NO: 11913 - DNA, 140 bp, Artificial Sequence
  Synthetic
atacgccatgctgggtctccatggctgcgtgagacacacgtagcctaccagtttcttactgctctactctgcaaagcaagagatcaataacccatcatggattctgtgtacgtggatatacgtacttgggagtcggccat

SEQ ID NO: 11914 - DNA, 140 bp, Artificial Sequence
  Synthetic
atggccgactcccaagtacgtatatccacgtacacagaatccatgatgggttattgatctcttgctttgcagagtagagcagtaagaaactggtaggctacgtgtgtctcacgcagccatggagacccagcatggcgtat

SEQ ID NO: 11915 - DNA, 140 bp, Artificial Sequence
  Synthetic
atacgccatgctgggtctccctgaatagcaacaaaatatgaaaatcaataaaaatcataaaatagaaaaaccataaacagaagtagttcaaagggctataaaacccctgaatagtaacaacgtacttgggagtcggccat

SEQ ID NO: 11916 - DNA, 140 bp, Artificial Sequence
  Synthetic
atggccgactcccaagtacgttgttactattcaggggttttatagccctttgaactacttctgtttatggtttttctattttatgatttttattgattttcatattttgttgctattcagggagacccagcatggcgtat

SEQ ID NO: 11917 - DNA, 140 bp, Artificial Sequence
  Synthetic
aggccctggctgctgatatgccataaacagaagtagttcaaagggctataaaacccctgaatagtaacaaaacacaaaactaataaaaatcaaatgaataccataattggcaaacggaaggaccttttgggacagcggtg

SEQ ID NO: 11918 - DNA, 140 bp, Artificial Sequence
  Synthetic
caccgctgtcccaaaaggtccttccgtttgccaattatggtattcatttgatttttattagttttgtgttttgttactattcaggggttttatagccctttgaactacttctgtttatggcatatcagcagccagggcct

SEQ ID NO: 11919 - DNA, 140 bp, Artificial Sequence
  Synthetic
aggccctggctgctgatatgctgtcccgtgcctttgccgttatgccatgactcctgaacgcgtcacccgacttcgcatgaatcatgtcacaaatataattgtgtgttcttcatttcccctgaccttttgggacagcggtg

SEQ ID NO: 11920 - DNA, 140 bp, Artificial Sequence
  Synthetic
caccgctgtcccaaaaggtcaggggaaatgaagaacacacaattatatttgtgacatgattcatgcgaagtcgggtgacgcgttcaggagtcatggcataacggcaaaggcacgggacagcatatcagcagccagggcct

SEQ ID NO: 11921 - DNA, 140 bp, Artificial Sequence
  Synthetic
aggccctggctgctgatatgaggtatacgtgtcccctaagagacacactgtatatagccaataatctatagatcaaagggctacacaacccctgaatagtaacaaaatacaaaatcactagaccttttgggacagcggtg

SEQ ID NO: 11922 - DNA, 140 bp, Artificial Sequence
  Synthetic
caccgctgtcccaaaaggtctagtgattttgtattttgttactattcaggggttgtgtagccctttgatctatagattattggctatatacagtgtgtctcttaggggacacgtatacctcatatcagcagccagggcct

SEQ ID NO: 11923 - DNA, 140 bp, Artificial Sequence
  Synthetic
atacgccatgctgggtctcccaactactacttaagaaactccaggagagtgcgtccatggccaatagaagcaggtatcaatcacgcaaagtggaaaatatgaaagcaacaatcattcagacgtacttgggagtcggccat

SEQ ID NO: 11924 - DNA, 140 bp, Artificial Sequence
  Synthetic
atggccgactcccaagtacgtctgaatgattgttgctttcatattttccactttgcgtgattgatacctgcttctattggccatggacgcactctcctggagtttcttaagtagtagttgggagacccagcatggcgtat

SEQ ID NO: 11925 - DNA, 140 bp, Artificial Sequence
  Synthetic
atacgccatgctgggtctcctgatactgtgacaggaacagcttgcagagtggcggacccgctaaaaaggttatttaaactgggcaaaccgttagcggcaggtgacgaacaagacgaagaccgtacttgggagtcggccat

SEQ ID NO: 11926 - DNA, 140 bp, Artificial Sequence
  Synthetic
atggccgactcccaagtacggtcttcgtcttgttcgtcacctgccgctaacggtttgcccagtttaaataacctttttagcgggtccgccactctgcaagctgttcctgtcacagtatcaggagacccagcatggcgtat

SEQ ID NO: 11927 - DNA, 140 bp, Artificial Sequence
  Synthetic
aggccctggctgctgatatgactatctacttcccgtggtcgcccaggccttcagtaagtgggcgaaggagtgccggaaggacatggaagacgagaagcttctgggggtcagagaaagaacgaccttttgggacagcggtg

SEQ ID NO: 11928 - DNA, 140 bp, Artificial Sequence
  Synthetic
caccgctgtcccaaaaggtcgttctttctctgacccccagaagcttctcgtcttccatgtccttccggcactccttcgcccacttactgaaggcctgggcgaccacgggaagtagatagtcatatcagcagccagggcct

SEQ ID NO: 11929 - DNA, 140 bp, Artificial Sequence
  Synthetic
aggccctggctgctgatatgaggtagtgcgccagcaaggaggatgatgtcggacaggaagtaccactgcgtttgcccgatgcgcagcgcagaagaccccgagagactcgctaattatgcggaccttttgggacagcggtg

SEQ ID NO: 11930 - DNA, 140 bp, Artificial Sequence
  Synthetic
caccgctgtcccaaaaggtccgcataattagcgagtctctcggggtcttctgcgctgcgcatcgggcaaacgcagtggtacttcctgtccgacatcatcctccttgctggcgcactacctcatatcagcagccagggcct

SEQ ID NO: 11931 - DNA, 140 bp, Artificial Sequence
  Synthetic
atacgccatgctgggtctccgaggactagaatcaagtggttgttacgcaaggtgccgaaaatagacctgatcccatacagcgggaatgcccaagaagcccaggatgcagaaaaagaagcacgtacttgggagtcggccat

SEQ ID NO: 11932 - DNA, 140 bp, Artificial Sequence
  Synthetic
atggccgactcccaagtacgtgcttctttttctgcatcctgggcttcttgggcattcccgctgtatgggatcaggtctattttcggcaccttgcgtaacaaccacttgattctagtcctcggagacccagcatggcgtat

SEQ ID NO: 11933 - DNA, 140 bp, Artificial Sequence
  Synthetic
atacgccatgctgggtctcctccaaagtcgcacgcctgagagcgaagacgtctatgctaatacacaactggtactgcagagaccgtccgcgggtacggtgcacgtgccgtactctcaggccgtacttgggagtcggccat

SEQ ID NO: 11934 - DNA, 140 bp, Artificial Sequence
  Synthetic
atggccgactcccaagtacggcctgagagtacggcacgtgcaccgtacccgcggacggtctctgcagtaccagttgtgtattagcatagacgtcttcgctctcaggcgtgcgactttggaggagacccagcatggcgtat

SEQ ID NO: 11935 - DNA, 140 bp, Artificial Sequence
  Synthetic
atacgccatgctgggtctccacacgagtacgtttacgacgtggaccagagaagatgctgtaagaaggaagaagctgcaggactggtactggtgggcgacttgactaatccgccctaccaccgtacttgggagtcggccat

SEQ ID NO: 11936 - DNA, 140 bp, Artificial Sequence
  Synthetic
atggccgactcccaagtacggtggtagggcggattagtcaagtcgcccaccagtaccagtcctgcagcttcttccttcttacagcatcttctctggtccacgtcgtaaacgtactcgtgtggagacccagcatggcgtat

SEQ ID NO: 11937 - DNA, 140 bp, Artificial Sequence
  Synthetic
atacgccatgctgggtctccaatgcgcactacgaatgagtacaatatgccgattgtagtggacactacaggctcaacgaaacctgaccctggagacctcgtgttaacgtgcttcagagggcgtacttgggagtcggccat

SEQ ID NO: 11938 - DNA, 140 bp, Artificial Sequence
  Synthetic
atggccgactcccaagtacgccctctgaagcacgttaacacgaggtctccagggtcaggtttcgttgagcctgtagtgtccactacaatcggcatattgtactcattcgtagtgcgcattggagacccagcatggcgtat

SEQ ID NO: 11939 - DNA, 140 bp, Artificial Sequence
  Synthetic
aggccctggctgctgatatgcgcagatagaaccagtgaacgagtcatctgcgtactgggacgcaagtttagatcgtctagagcattgaaaccaccatgagtcaccagtaatactgagatggaccttttgggacagcggtg

SEQ ID NO: 11940 - DNA, 140 bp, Artificial Sequence
  Synthetic
caccgctgtcccaaaaggtccatctcagtattactggtgactcatggtggtttcaatgctctagacgatctaaacttgcgtcccagtacgcagatgactcgttcactggttctatctgcgcatatcagcagccagggcct

SEQ ID NO: 11941 - DNA, 140 bp, Artificial Sequence
  Synthetic
aggccctggctgctgatatgcgcagatagaaccagtgaacgagtcatctgcgtactgggacgcaagtttagatcgtctagagcattgaaaccaccatgtgtcaccagtaatactgagatggaccttttgggacagcggtg

SEQ ID NO: 11942 - DNA, 140 bp, Artificial Sequence
  Synthetic
caccgctgtcccaaaaggtccatctcagtattactggtgacacatggtggtttcaatgctctagacgatctaaacttgcgtcccagtacgcagatgactcgttcactggttctatctgcgcatatcagcagccagggcct

SEQ ID NO: 11943 - DNA, 140 bp, Artificial Sequence
  Synthetic
aggccctggctgctgatatgcgcagatagaaccagtgaacgagtcatctgcgtactgggacgcaagtttagatcgtctagagcattgaaaccaccatgcgtcaccagtaatactgagatggaccttttgggacagcggtg

SEQ ID NO: 11944 - DNA, 140 bp, Artificial Sequence
  Synthetic
caccgctgtcccaaaaggtccatctcagtattactggtgacgcatggtggtttcaatgctctagacgatctaaacttgcgtcccagtacgcagatgactcgttcactggttctatctgcgcatatcagcagccagggcct

SEQ ID NO: 11945 - DNA, 140 bp, Artificial Sequence
  Synthetic
aggccctggctgctgatatgcgcagatagaaccagtgaacgagtcatctgcgtactgggacgcaagtttagatcgtctagagcattgaaaccaccatgggtcaccagtaatactgagatggaccttttgggacagcggtg

SEQ ID NO: 11946 - DNA, 140 bp, Artificial Sequence
  Synthetic
caccgctgtcccaaaaggtccatctcagtattactggtgacccatggtggtttcaatgctctagacgatctaaacttgcgtcccagtacgcagatgactcgttcactggttctatctgcgcatatcagcagccagggcct

SEQ ID NO: 11947 - DNA, 140 bp, Artificial Sequence
  Synthetic
atacgccatgctgggtctccaccttgtggtcataaacatccacacaccttttcgcatacaccattaccaacagtgcgtcgaccacgcaatgaaactgcaaatgcccgggggtgactcattcgtacttgggagtcggccat

SEQ ID NO: 11948 - DNA, 140 bp, Artificial Sequence
  Synthetic
atggccgactcccaagtacgaatgagtcacccccgggcatttgcagtttcattgcgtggtcgacgcactgttggtaatggtgtatgcgaaaaggtgtgtggatgtttatgaccacaaggtggagacccagcatggcgtat

SEQ ID NO: 11949 - DNA, 140 bp, Artificial Sequence
  Synthetic
aggccctggctgctgatatgtcaggagggaaagacaggctaacccagtcactgaaccacctctttacagccatggactcgacggatgaagacgtggtcatctactgccgagacaaggaatgaccttttgggacagcggtg

SEQ ID NO: 11950 - DNA, 140 bp, Artificial Sequence
  Synthetic
caccgctgtcccaaaaggtcattccttgtctcggcagtagatgaccacgtcttcatccgtcgagtccatggctgtaaagaggtggttcagtgactgggttagcctgtctttccctcctgacatatcagcagccagggcct

SEQ ID NO: 11951 - DNA, 140 bp, Artificial Sequence
  Synthetic
aggccctggctgctgatatgtcaggagggaaagacaggctaacccagtcactgaaccacctctttacagccatggactcgacggatgtagacgtggtcatctactgccgagacaaggaatgaccttttgggacagcggtg

SEQ ID NO: 11952 - DNA, 140 bp, Artificial Sequence
  Synthetic
caccgctgtcccaaaaggtcattccttgtctcggcagtagatgaccacgtctacatccgtcgagtccatggctgtaaagaggtggttcagtgactgggttagcctgtctttccctcctgacatatcagcagccagggcct

SEQ ID NO: 11953 - DNA, 140 bp, Artificial Sequence
  Synthetic
aggccctggctgctgatatgtcaggagggaaagacaggctaacccagtcactgaaccacctctttacagccatggactcgacggatgcagacgtggtcatctactgccgagacaaggaatgaccttttgggacagcggtg

SEQ ID NO: 11954 - DNA, 140 bp, Artificial Sequence
  Synthetic
caccgctgtcccaaaaggtcattccttgtctcggcagtagatgaccacgtctgcatccgtcgagtccatggctgtaaagaggtggttcagtgactgggttagcctgtctttccctcctgacatatcagcagccagggcct

SEQ ID NO: 11955 - DNA, 140 bp, Artificial Sequence
  Synthetic
aggccctggctgctgatatgtcaggagggaaagacaggctaacccagtcactgaaccacctctttacagccatggactcgacggatggagacgtggtcatctactgccgagacaaggaatgaccttttgggacagcggtg

SEQ ID NO: 11956 - DNA, 140 bp, Artificial Sequence
  Synthetic
caccgctgtcccaaaaggtcattccttgtctcggcagtagatgaccacgtctccatccgtcgagtccatggctgtaaagaggtggttcagtgactgggttagcctgtctttccctcctgacatatcagcagccagggcct

SEQ ID NO: 11957 - DNA, 140 bp, Artificial Sequence
  Synthetic
atacgccatgctgggtctccactccaggagagtgcgtccatggccaatagaagcaggtatcagtcacgcaaagtggagaatatgaaagcaacaatcatccagagactaaagagaggctgtcgtacttgggagtcggccat

SEQ ID NO: 11958 - DNA, 140 bp, Artificial Sequence
  Synthetic
atggccgactcccaagtacgacagcctctctttagtctctggatgattgttgctttcatattctccactttgcgtgactgatacctgcttctattggccatggacgcactctcctggagtggagacccagcatggcgtat

SEQ ID NO: 11959 - DNA, 140 bp, Artificial Sequence
  Synthetic
aggccctggctgctgatatgcgagagagaagggaatataacacccatggctagcgtccgattctttagggcagagctgtgtccggtcgtacagggaacagcggagacgcgtgacacagcagaccttttgggacagcggtg

SEQ ID NO: 11960 - DNA, 140 bp, Artificial Sequence
  Synthetic
caccgctgtcccaaaaggtctgctgtgtcacgcgtctccgctgttccctgtacgaccggacacagctctgccctaaagaatcggacgctagccatgggtgttatattcccttctctctcgcatatcagcagccagggcct

SEQ ID NO: 11961 - DNA, 140 bp, Artificial Sequence
  Synthetic
aggccctggctgctgatatgcagtcggtgctgccggtgaacaccctggaggaagtccacgaggagaagtgctacccacctaagctggatgaagcaaaggagcaactattacttaagaaacgaccttttgggacagcggtg

SEQ ID NO: 11962 - DNA, 140 bp, Artificial Sequence
  Synthetic
caccgctgtcccaaaaggtcgtttcttaagtaatagttgctcctttgcttcatccagcttaggtgggtagcacttctcctcgtggacttcctccagggtgttcaccggcagcaccgactgcatatcagcagccagggcct

SEQ ID NO: 11963 - DNA, 140 bp, Artificial Sequence
  Synthetic
aggccctggctgctgatatgggaagatcgtctgacaaaatctgcatgcgcggccttcatcggcgacgacaacataatacatggtgtcgtctccgatgatttgatggcagccagatgcgctgaccttttgggacagcggtg

SEQ ID NO: 11964 - DNA, 140 bp, Artificial Sequence
  Synthetic
caccgctgtcccaaaaggtcagcgcatctggctgccatcaaatcatcggagacgacaccatgtattatgttgtcgtcgccgatgaaggccgcgcatgcagattttgtcagacgatcttcccatatcagcagccagggcct

SEQ ID NO: 11965 - DNA, 140 bp, Artificial Sequence
  Synthetic
aggccctggctgctgatatgacccgtcataactttgtacggcggtcctaaataggtacgcactacagctacctattttgcagaagccgacagcaggtacctaaataccaagcagccataagaccttttgggacagcggtg

SEQ ID NO: 11966 - DNA, 140 bp, Artificial Sequence
  Synthetic
caccgctgtcccaaaaggtcttatggctgcttggtatttaggtacctgctgtcggcttctgcaaaataggtagctgtagtgcgtacctatttaggaccgccgtacaaagttatgacgggtcatatcagcagccagggcct

SEQ ID NO: 11967 - DNA, 140 bp, Artificial Sequence
  Synthetic
aggccctggctgctgatatgaagaagcaaaagcaaaagcagcaggcgccacgaaacaacatgaatcaaaagaagcagccccctaaaaagaaaccggttcaaaagaaaaagaagcccggccgaccttttgggacagcggtg

SEQ ID NO: 11968 - DNA, 140 bp, Artificial Sequence
  Synthetic
caccgctgtcccaaaaggtcggccgggcttctttttcttttgaaccggtttctttttagggggctgcttcttttgattcatgttgtttcgtggcgcctgctgcttttgcttttgcttcttcatatcagcagccagggcct

SEQ ID NO: 11969 - DNA, 140 bp, Artificial Sequence
  Synthetic
atacgccatgctgggtctccgacgggacgctgaaaatccaggtttccttgcaaatcggaataaagacggatgatagccatgattggaccaagctgcgttatatggacaatcacatgccggcgtacttgggagtcggccat

SEQ ID NO: 11970 - DNA, 140 bp, Artificial Sequence
  Synthetic
atggccgactcccaagtacgccggcatgtgattgtccatataacgcagcttggtccaatcatggctatcatccgtctttattccgatttgcaaggaaacctggattttcagcgtcccgtcggagacccagcatggcgtat

SEQ ID NO: 11971 - DNA, 140 bp, Artificial Sequence
  Synthetic
aggccctggctgctgatatgaacacggtgggagtaccgtataagactctagtcaacagaccaggctacagccccatggtactggagatggagcttctgtcagtcactttggagccaacgcgaccttttgggacagcggtg

SEQ ID NO: 11972 - DNA, 140 bp, Artificial Sequence
  Synthetic
caccgctgtcccaaaaggtcgcgttggctccaaagtgactgacagaagctccatctccagtaccatggggctgtagcctggtctgttgactagagtcttatacggtactcccaccgtgttcatatcagcagccagggcct

SEQ ID NO: 11973 - DNA, 140 bp, Artificial Sequence
  Synthetic
aggccctggctgctgatatgtgggtacggtacacgtgccatactctcaggcaccatctggctttaagtattggctaaaagaacgcgaggcgtcactgcagcacacagcaccatttggctggaccttttgggacagcggtg

SEQ ID NO: 11974 - DNA, 140 bp, Artificial Sequence
  Synthetic
caccgctgtcccaaaaggtccagccaaatggtgctgtgtgctgcagtgacgcctcgcgttcttttagccaatacttaaagccagatggtgcctgagagtatggcacgtgtaccgtacccacatatcagcagccagggcct

SEQ ID NO: 11975 - DNA, 140 bp, Artificial Sequence
  Synthetic
aggccctggctgctgatatgtcacataccaccctcggggtccaggacatctccgctacggcgatgtcatgggtgcggaagatcacgggaggtgtgggactggttgttgctgttgccgcacgaccttttgggacagcggtg

SEQ ID NO: 11976 - DNA, 140 bp, Artificial Sequence
  Synthetic
caccgctgtcccaaaaggtcgtgcggcaacagcaacaaccagtcccacacctcccgtgatcttccgcacccatgacatcgccgtagcggagatgtcctggaccccgagggtggtatgtgacatatcagcagccagggcct

SEQ ID NO: 11977 - DNA, 140 bp, Artificial Sequence
  Synthetic
atacgccatgctgggtctccaggcaagtgtgcggtgcattcgatgactaacgccgtcactatccgggaagctgaaatagaagtagaagggaactctcagttgcaaatctctttttcgacgcgtacttgggagtcggccat

SEQ ID NO: 11978 - DNA, 140 bp, Artificial Sequence
  Synthetic
atggccgactcccaagtacgcgtcgaaaaagagatttgcaactgagagttcccttctacttctatttcagcttcccggatagtgacggcgttagtcatcgaatgcaccgcacacttgcctggagacccagcatggcgtat

SEQ ID NO: 11979 - DNA, 140 bp, Artificial Sequence
  Synthetic
atacgccatgctgggtctccactgatcctaatcgtggtgctgtgcgtgtcgtttagcaggcactaaattgacaactaggtatgaaggcatatgcgtccctaaagagacacaccacatatacgtacttgggagtcggccat

SEQ ID NO: 11980 - DNA, 140 bp, Artificial Sequence
  Synthetic
atggccgactcccaagtacgtatatgtggtgtgtctctttagggacgcatatgccttcatacctagttgtcaatttagtgcctgctaaacgacacgcacagcaccacgattaggatcagtggagacccagcatggcgtat

SEQ ID NO: 11981 - DNA, 140 bp, Artificial Sequence
  Synthetic
aggccctggctgctgatatgacaactaggtatgaaggcatatgcgtccctaaagagacacaccacatatagctaagaatcaatagatcaaagggctgaacaacccctgaatagtaacaaagaccttttgggacagcggtg

SEQ ID NO: 11982 - DNA, 140 bp, Artificial Sequence
  Synthetic
caccgctgtcccaaaaggtctttgttactattcaggggttgttcagccctttgatctattgattcttagctatatgtggtgtgtctctttagggacgcatatgccttcatacctagttgtcatatcagcagccagggcct

SEQ ID NO: 11983 - DNA, 140 bp, Artificial Sequence
  Synthetic
atacgccatgctgggtctccgacgctgacagcgcctttttgaaggccctgcaacgtgcgtaccccatgtttgaggtggaacctaggcaggttacatcaaatgaccatgctaatgctagagcgtacttgggagtcggccat

SEQ ID NO: 11984 - DNA, 140 bp, Artificial Sequence
  Synthetic
atggccgactcccaagtacgctctagcattagcatggtcatttgatgtaacctgcctaggttccacctcaaacatggggtacgcacgttgcagggccttcaaaaaggcgctgtcagcgtcggagacccagcatggcgtat

SEQ ID NO: 11985 - DNA, 140 bp, Artificial Sequence
  Synthetic
aggccctggctgctgatatggcagacggattcttgatgtgcaagactaccgacacggttgacggcgaaagagtgtcattctcggtgtgcacgtacgtgccggcgaccatttgtgatcaaagaccttttgggacagcggtg

SEQ ID NO: 11986 - DNA, 140 bp, Artificial Sequence
  Synthetic
caccgctgtcccaaaaggtctttgatcacaaatggtcgccggcacgtacgtgcacaccgagaatgacactctttcgccgtcaaccgtgtcggtagtcttgcacatcaagaatccgtctgccatatcagcagccagggcct

SEQ ID NO: 11987 - DNA, 140 bp, Artificial Sequence
  Synthetic
aggccctggctgctgatatggtaagaaggtatatgtgtcccctaagagacacaccatatatagctaagaatcaatagataagcatagatcaaagggctgaataacccctgaataataacagaccttttgggacagcggtg

SEQ ID NO: 11988 - DNA, 140 bp, Artificial Sequence
  Synthetic
caccgctgtcccaaaaggtctgttattattcaggggttattcagccctttgatctatgcttatctattgattcttagctatatatggtgtgtctcttaggggacacatataccttcttaccatatcagcagccagggcct

SEQ ID NO: 11989 - DNA, 140 bp, Artificial Sequence
  Synthetic
atacgccatgctgggtctcctacctggtactttccccgcagaccgtattacgcagccagaagctcagcctgatccacgctttagcggagcaagtgaagacgtgcacgcatagcggacgagcgtacttgggagtcggccat

SEQ ID NO: 11990 - DNA, 140 bp, Artificial Sequence
  Synthetic
atggccgactcccaagtacgctcgtccgctatgcgtgcacgtcttcacttgctccgctaaagcgtggatcaggctgagcttctggctgcgtaatacggtctgcggggaaagtaccaggtaggagacccagcatggcgtat

SEQ ID NO: 11991 - DNA, 140 bp, Artificial Sequence
  Synthetic
aggccctggctgctgatatggatccacgctttagcggagcaagtgaagacgtgcacgcatagcggacgagcagggaggtatgcggtcgaagcgtacgatggccgagtcctagtgccctcagaccttttgggacagcggtg

SEQ ID NO: 11992 - DNA, 140 bp, Artificial Sequence
  Synthetic
caccgctgtcccaaaaggtctgagggcactaggactcggccatcgtacgcttcgaccgcatacctccctgctcgtccgctatgcgtgcacgtcttcacttgctccgctaaagcgtggatccatatcagcagccagggcct

SEQ ID NO: 11993 - DNA, 140 bp, Artificial Sequence
  Synthetic
atacgccatgctgggtctccgatggtgtacaacgaaagagagttcgtaaacaggaagttacaccacattgcgatgcacggaccagccctgaacactgacgaagagtcgtatgagcttgtgcgtacttgggagtcggccat

SEQ ID NO: 11994 - DNA, 140 bp, Artificial Sequence
  Synthetic
atggccgactcccaagtacgcacaagctcatacgactcttcgtcagtgttcagggctggtccgtgcatcgcaatgtggtgtaacttcctgtttacgaactctctttcgttgtacaccatcggagacccagcatggcgtat

SEQ ID NO: 11995 - DNA, 140 bp, Artificial Sequence
  Synthetic
aggccctggctgctgatatgcgatgcacggaccagccctgaacactgacgaagagtcgtatgagcttgtgagggcagagaggacagaacacgagtacgtctacgacgtggaccagagaaggaccttttgggacagcggtg

SEQ ID NO: 11996 - DNA, 140 bp, Artificial Sequence
  Synthetic
caccgctgtcccaaaaggtccttctctggtccacgtcgtagacgtactcgtgttctgtcctctctgccctcacaagctcatacgactcttcgtcagtgttcagggctggtccgtgcatcgcatatcagcagccagggcct

SEQ ID NO: 11997 - DNA, 140 bp, Artificial Sequence
  Synthetic
aggccctggctgctgatatgctgcgtgagacacaagtagcctaccagtttcttactgctctactctgcaaagcaagagattaataacccatcatggatcctgtgtacgtggacatagacggaccttttgggacagcggtg

SEQ ID NO: 11998 - DNA, 140 bp, Artificial Sequence
  Synthetic
caccgctgtcccaaaaggtccgtctatgtccacgtacacaggatccatgatgggttattaatctcttgctttgcagagtagagcagtaagaaactggtaggctacttgtgtctcacgcagcatatcagcagccagggcct

SEQ ID NO: 11999 - DNA, 140 bp, Artificial Sequence
  Synthetic
aggccctggctgctgatatgctaatccgccctaccacgaattcgcatacgaagggctaaaaattcgccccgcttgtccatacaaaattgcagtcataggagtcttcggggtaccaggatcgaccttttgggacagcggtg

SEQ ID NO: 12000 - DNA, 140 bp, Artificial Sequence
  Synthetic
caccgctgtcccaaaaggtcgatcctggtaccccgaagactcctatgactgcaattttgtatggacaagcggggcgaatttttagcccttcgtatgcgaattcgtggtagggcggattagcatatcagcagccagggcct

SEQ ID NO: 12001 - DNA, 140 bp, Artificial Sequence
  Synthetic
aggccctggctgctgatatgagcaagagattaataacccatcatggatcctgtgtacgtggacatagacgctgacagcgcctttttgaaggccctgcaacgtgcgtaccccatgtttgaggaccttttgggacagcggtg

SEQ ID NO: 12002 - DNA, 140 bp, Artificial Sequence
  Synthetic
caccgctgtcccaaaaggtcctcaaacatggggtacgcacgttgcagggccttcaaaaaggcgctgtcagcgtctatgtccacgtacacaggatccatgatgggttattaatctcttgctcatatcagcagccagggcct

SEQ ID NO: 12003 - DNA, 140 bp, Artificial Sequence
  Synthetic
atacgccatgctgggtctccaggacaggccacccgagcaggatgtgcaccatcgtaccgggtaaaacgcatggacatcgcgaataacgatgaagagtgcgtggtcaacgccgccaaccctcgtacttgggagtcggccat

SEQ ID NO: 12004 - DNA, 140 bp, Artificial Sequence
  Synthetic
atggccgactcccaagtacgagggttggcggcgttgaccacgcactcttcatcgttattcgcgatgtccatgcgttttacccggtacgatggtgcacatcctgctcgggtggcctgtcctggagacccagcatggcgtat

SEQ ID NO: 12005 - DNA, 140 bp, Artificial Sequence
  Synthetic
atacgccatgctgggtctcctgtgcggtacatatccagtaatccacgccgtaggaccaagcttctcaaattactcggagtccgaaggggaccgggaattggcggctgcctatcgagaagtcgtacttgggagtcggccat

SEQ ID NO: 12006 - DNA, 140 bp, Artificial Sequence
  Synthetic
atggccgactcccaagtacgacttctcgataggcagccgccaattcccggtccccttcggactccgagtaatttgagaagcttggtcctacggcgtggattactggatatgtaccgcacaggagacccagcatggcgtat

SEQ ID NO: 12007 - DNA, 140 bp, Artificial Sequence
  Synthetic
aggccctggctgctgatatggagagcagacgtcgctatataccaagacgtctatgctgtacacgcacccacgtcgctataccaccaggcgattaaaggggtccgagtggcgtactgggttgaccttttgggacagcggtg

SEQ ID NO: 12008 - DNA, 140 bp, Artificial Sequence
  Synthetic
caccgctgtcccaaaaggtcaacccagtacgccactcggacccctttaatcgcctggtggtatagcgacgtgggtgcgtgtacagcatagacgtcttggtatatagcgacgtctgctctccatatcagcagccagggcct

SEQ ID NO: 12009 - DNA, 140 bp, Artificial Sequence
  Synthetic
aggccctggctgctgatatgtcttcccaggagtctgtacgggaagtgagtatgacaacgtcattgacgcatagccagtttgatctaagcgccgatggcgagacactgcccgtcccgtcaggaccttttgggacagcggtg

SEQ ID NO: 12010 - DNA, 140 bp, Artificial Sequence
  Synthetic
caccgctgtcccaaaaggtcctgacgggacgggcagtgtctcgccatcggcgcttagatcaaactggctatgcgtcaatgacgttgtcatactcacttcccgtacagactcctgggaagacatatcagcagccagggcct

SEQ ID NO: 12011 - DNA, 140 bp, Artificial Sequence
  Synthetic
aggccctggctgctgatatgtgccatcggtgttccatttaaagggcaaactcagcttcacatgccgctgtgatacagtggtttcgtgtgagggctacgtcgttaagagaataacgatgaggaccttttgggacagcggtg

SEQ ID NO: 12012 - DNA, 140 bp, Artificial Sequence
  Synthetic
caccgctgtcccaaaaggtcctcatcgttattctcttaacgacgtagccctcacacgaaaccactgtatcacagcggcatgtgaagctgagtttgccctttaaatggaacaccgatggcacatatcagcagccagggcct

SEQ ID NO: 12013 - DNA, 140 bp, Artificial Sequence
  Synthetic
aggccctggctgctgatatggctgtaaactgtatttaatggcagagaccccgaaagtcccgacttatcggaccgtatacccggcgcctgtgtactcgcctccgatcaacatccgattgtcgaccttttgggacagcggtg

SEQ ID NO: 12014 - DNA, 140 bp, Artificial Sequence
  Synthetic
caccgctgtcccaaaaggtcgacaatcggatgttgatcggaggcgagtacacaggcgccgggtatacggtccgataagtcgggactttcggggtctctgccattaaatacagtttacagccatatcagcagccagggcct

SEQ ID NO: 12015 - DNA, 140 bp, Artificial Sequence
  Synthetic
aggccctggctgctgatatgtcattctcggtgtgcacatacgtgccggcgaccatttgtgatcaaatgaccggcatccttgctacagaagtcacgccggaggatgcacagaagctgttgggaccttttgggacagcggtg

SEQ ID NO: 12016 - DNA, 140 bp, Artificial Sequence
  Synthetic
caccgctgtcccaaaaggtcccaacagcttctgtgcatcctccggcgtgacttctgtagcaaggatgccggtcatttgatcacaaatggtcgccggcacgtatgtgcacaccgagaatgacatatcagcagccagggcct

SEQ ID NO: 12017 - DNA, 140 bp, Artificial Sequence
  Synthetic
aggccctggctgctgatatggcaaccgagaatactgggaagaatttgctgccagccctatcaggataacgactgagaatctaacaacctatgtcactaaactaaaggggccaaaagcagcgaccttttgggacagcggtg

SEQ ID NO: 12018 - DNA, 140 bp, Artificial Sequence
  Synthetic
caccgctgtcccaaaaggtcgctgcttttggcccctttagtttagtgacataggttgttagattctcagtcgttatcctgatagggctggcagcaaattcttcccagtattctcggttgccatatcagcagccagggcct

SEQ ID NO: 12019 - DNA, 140 bp, Artificial Sequence
  Synthetic
aggccctggctgctgatatgaacaccatgaaaaattatctgcttcccgtggtcgcccaagccttcagtaagtgggcaaaggagtgccggaaagacatggaagatgaaaaactcctggggggaccttttgggacagcggtg

SEQ ID NO: 12020 - DNA, 140 bp, Artificial Sequence
  Synthetic
caccgctgtcccaaaaggtccccccaggagtttttcatcttccatgtctttccggcactcctttgcccacttactgaaggcttgggcgaccacgggaagcagataatttttcatggtgttcatatcagcagccagggcct

SEQ ID NO: 12021 - DNA, 140 bp, Artificial Sequence
  Synthetic
atacgccatgctgggtctccagcgttgtttgcaagaacccataatctgctgccgctgcaggatgtaccaatggataggttcacagtagatatgaaaagggacgtgaaggtaactcctggtcgtacttgggagtcggccat

SEQ ID NO: 12022 - DNA, 140 bp, Artificial Sequence
  Synthetic
atggccgactcccaagtacgaccaggagttaccttcacgtcccttttcatatctactgtgaacctatccattggtacatcctgcagcggcagcagattatgggttcttgcaaacaacgctggagacccagcatggcgtat

SEQ ID NO: 12023 - DNA, 140 bp, Artificial Sequence
  Synthetic
aggccctggctgctgatatgtggtactctccccgcagaccgtactacgtagccagaagctcagtctgattcacgctttggcggagcaagtgaagacgtgcacgcacaacggacgagcagggaccttttgggacagcggtg

SEQ ID NO: 12024 - DNA, 140 bp, Artificial Sequence
  Synthetic
caccgctgtcccaaaaggtccctgctcgtccgttgtgcgtgcacgtcttcacttgctccgccaaagcgtgaatcagactgagcttctggctacgtagtacggtctgcggggagagtaccacatatcagcagccagggcct

SEQ ID NO: 12025 - DNA, 140 bp, Artificial Sequence
  Synthetic
atacgccatgctgggtctccctggctgatgaagtaatcagatggcaacgaacagggctaatagatgagctggagaaagcggtgtactctaggtatgaagtgcagggtatatcagttgctgcgtacttgggagtcggccat

SEQ ID NO: 12026 - DNA, 140 bp, Artificial Sequence
  Synthetic
atggccgactcccaagtacgcagcaactgatataccctgcacttcatacctagagtacaccgctttctccagctcatctattagccctgttcgttgccatctgattacttcatcagccagggagacccagcatggcgtat

SEQ ID NO: 12027 - DNA, 140 bp, Artificial Sequence
  Synthetic
aggccctggctgctgatatgagaggacccgtcataactttgtacggcggtcctaaataggtacgcactacagctacctattttgcaaaagccgacggcaggtacctaaataccaatcagcgaccttttgggacagcggtg

SEQ ID NO: 12028 - DNA, 140 bp, Artificial Sequence
  Synthetic
caccgctgtcccaaaaggtcgctgattggtatttaggtacctgccgtcggcttttgcaaaataggtagctgtagtgcgtacctatttaggaccgccgtacaaagttatgacgggtcctctcatatcagcagccagggcct

SEQ ID NO: 12029 - DNA, 140 bp, Artificial Sequence
  Synthetic
aggccctggctgctgatatgtgtaagaaggaagaagccgcaggactggtactggtgggcgacttgactaatccgccctaccacgaattcgcatatgaagggctaaaaatccgccctgcctgaccttttgggacagcggtg

SEQ ID NO: 12030 - DNA, 140 bp, Artificial Sequence
  Synthetic
caccgctgtcccaaaaggtcaggcagggcggatttttagcccttcatatgcgaattcgtggtagggcggattagtcaagtcgcccaccagtaccagtcctgcggcttcttccttcttacacatatcagcagccagggcct

SEQ ID NO: 12031 - DNA, 140 bp, Artificial Sequence
  Synthetic
aggccctggctgctgatatgtgaagacaatgtcatgagccccgggtactatcagctgctacaagcatccttaacatgttctccccgacgccagcggcgcagtattaaggaccacttcaatgaccttttgggacagcggtg

SEQ ID NO: 12032 - DNA, 140 bp, Artificial Sequence
  Synthetic
caccgctgtcccaaaaggtcattgaagtggtccttaatactgcgccgctggcgtcggggagaacatgttaaggatgcttgtagcagctgatagtacccggggctcatgacattgtcttcacatatcagcagccagggcct

SEQ ID NO: 12033 - DNA, 140 bp, Artificial Sequence
  Synthetic
aggccctggctgctgatatgtgcaacagaccagtcgacgtgttgtacgtagacgaggcgtttgcgtgccactctggaacgctacttgctttgatcgccttggtgagaccaaggcagaaaggaccttttgggacagcggtg

SEQ ID NO: 12034 - DNA, 140 bp, Artificial Sequence
  Synthetic
caccgctgtcccaaaaggtcctttctgccttggtctcaccaaggcgatcaaagcaagtagcgttccagagtggcacgcaaacgcctcgtctacgtacaacacgtcgactggtctgttgcacatatcagcagccagggcct

SEQ ID NO: 12035 - DNA, 140 bp, Artificial Sequence
  Synthetic
aggccctggctgctgatatgatgccatgccgcggtcaccaatcacaaaaaatggcagtataattcccctctggtcccgcgcaatgctgaattcggggaccggaaaggaaaagttcacattgaccttttgggacagcggtg

SEQ ID NO: 12036 - DNA, 140 bp, Artificial Sequence
  Synthetic
caccgctgtcccaaaaggtcaatgtgaacttttcctttccggtccccgaattcagcattgcgcgggaccagaggggaattatactgccattttttgtgattggtgaccgcggcatggcatcatatcagcagccagggcct

SEQ ID NO: 12037 - DNA, 140 bp, Artificial Sequence
  Synthetic
aggccctggctgctgatatgccatttcctctggcaaatgtgacatgcagggtgcctaaagcaagaaaccccaccgtgacgtacggaaaaaaccaagtcatcatgttgctgtatccggaccgaccttttgggacagcggtg

SEQ ID NO: 12038 - DNA, 140 bp, Artificial Sequence
  Synthetic
caccgctgtcccaaaaggtcggtccggatacagcaacatgatgacttggttttttccgtacgtcacggtggggtttcttgctttaggcaccctgcatgtcacatttgccagaggaaatggcatatcagcagccagggcct

SEQ ID NO: 12039 - DNA, 140 bp, Artificial Sequence
  Synthetic
aggccctggctgctgatatggcacgtcaacgtactcctaacgcgtacggaaggtaaactggtatggaagacactttccggcgacccgtggataaagacgctgcagaacccaccgaaaggagaccttttgggacagcggtg

SEQ ID NO: 12040 - DNA, 140 bp, Artificial Sequence
  Synthetic
caccgctgtcccaaaaggtctcctttcggtgggttctgcagcgtctttatccacgggtcgccggaaagtgtcttccataccagtttaccttccgtacgcgttaggagtacgttgacgtgccatatcagcagccagggcct

SEQ ID NO: 12041 - DNA, 140 bp, Artificial Sequence
  Synthetic
aggccctggctgctgatatgtattattatgagctgtacccaactatgactgtggtagttttgtcagtggcctcgttcatactcctgtcgatggtgggtgtagcagtggggatgtgcatgtgaccttttgggacagcggtg

SEQ ID NO: 12042 - DNA, 140 bp, Artificial Sequence
  Synthetic
caccgctgtcccaaaaggtcacatgcacatccccactgctacacccaccatcgacaggagtatgaacgaggccactgacaaaactaccacagtcatagttgggtacagctcataataatacatatcagcagccagggcct

SEQ ID NO: 12043 - DNA, 140 bp, Artificial Sequence
  Synthetic
aggccctggctgctgatatgtttggctgcaagcccttattccgctggcagccctgattgtcctatgtaactgtctgagactcttaccatgctgttgtaaaatgctgacttttttagccgtgaccttttgggacagcggtg

SEQ ID NO: 12044 - DNA, 140 bp, Artificial Sequence
  Synthetic
caccgctgtcccaaaaggtcacggctaaaaaagtcagcattttacaacagcatggtaagagtctcagacagttacataggacaatcagggctgccagcggaataagggcttgcagccaaacatatcagcagccagggcct

SEQ ID NO: 12045 - DNA, 140 bp, Artificial Sequence
  Synthetic
aggccctggctgctgatatgccaacgtttgttgggctaagagcttggtccctatcctcgaaacagcggggataaaactaaatgataggcagtggtctcagataattcaagccttcaaagagaccttttgggacagcggtg

SEQ ID NO: 12046 - DNA, 140 bp, Artificial Sequence
  Synthetic
caccgctgtcccaaaaggtctctttgaaggcttgaattatctgagaccactgcctatcatttagttttatccccgctgtttcgaggatagggaccaagctcttagcccaacaaacgttggcatatcagcagccagggcct

SEQ ID NO: 12047 - DNA, 140 bp, Artificial Sequence
  Synthetic
aggccctggctgctgatatgtcccgaacacggtgggagtaccgtataagactctagtcaacagaccgggctacagccccatggcactggagatggagcttctgtctgtcaccttggaaccgaccttttgggacagcggtg

SEQ ID NO: 12048 - DNA, 140 bp, Artificial Sequence
  Synthetic
caccgctgtcccaaaaggtcggttccaaggtgacagacagaagctccatctccagtgccatggggctgtagcccggtctgttgactagagtcttatacggtactcccaccgtgttcgggacatatcagcagccagggcct

SEQ ID NO: 12049 - DNA, 140 bp, Artificial Sequence
  Synthetic
aggccctggctgctgatatggctcataccgcatccgcatcagctaagctccgcgtcctttaccaaggaagtaatatcactgttgctgcttatgcaaacggcgaccatgccgtcacagttagaccttttgggacagcggtg

SEQ ID NO: 12050 - DNA, 140 bp, Artificial Sequence
  Synthetic
caccgctgtcccaaaaggtctaactgtgacggcatggtcgccgtttgcataagcagcaacagtgatattacttccttggtaaaggacgcggagcttagctgatgcggatgcggtatgagccatatcagcagccagggcct

SEQ ID NO: 12051 - DNA, 140 bp, Artificial Sequence
  Synthetic
atacgccatgctgggtctcccgtcgacgcgccatctttaacggacatgtcgtgtgaggtatcagcctgcacccattcctcagactttgggggcgttgccatcattaaatatgcagccagtcgtacttgggagtcggccat

SEQ ID NO: 12052 - DNA, 140 bp, Artificial Sequence
  Synthetic
atggccgactcccaagtacgactggctgcatatttaatgatggcaacgcccccaaagtctgaggaatgggtgcaggctgatacctcacacgacatgtccgttaaagatggcgcgtcgacgggagacccagcatggcgtat

SEQ ID NO: 12053 - DNA, 140 bp, Artificial Sequence
  Synthetic
aggccctggctgctgatatgtataaccttgcactgcctactaagagagtcacttgggtagcgccgttaggtgtccgcggagcggactacacatacaacctagagttgggtctgccagcaagaccttttgggacagcggtg

SEQ ID NO: 12054 - DNA, 140 bp, Artificial Sequence
  Synthetic
caccgctgtcccaaaaggtcttgctggcagacccaactctaggttgtatgtgtagtccgctccgcggacacctaacggcgctacccaagtgactctcttagtaggcagtgcaaggttatacatatcagcagccagggcct

SEQ ID NO: 12055 - DNA, 140 bp, Artificial Sequence
  Synthetic
aggccctggctgctgatatgacttgacaactaggtatgaaggcatacgcgtccctaaagagacacaccgcatatagttatgaatcaatagataagtatagatcaaagggctgaacaacccgaccttttgggacagcggtg

SEQ ID NO: 12056 - DNA, 140 bp, Artificial Sequence
  Synthetic
caccgctgtcccaaaaggtcgggttgttcagccctttgatctatacttatctattgattcataactatatgcggtgtgtctctttagggacgcgtatgccttcatacctagttgtcaagtcatatcagcagccagggcct

SEQ ID NO: 12057 - DNA, 140 bp, Artificial Sequence
  Synthetic
aggccctggctgctgatatgggacgcaagtttagatcgtctagagcgttgaaaccaccatgtgtcaccagcaacactgagatgtttttcctattcagcaactttgacaatggcagaaggagaccttttgggacagcggtg

SEQ ID NO: 12058 - DNA, 140 bp, Artificial Sequence
  Synthetic
caccgctgtcccaaaaggtctccttctgccattgtcaaagttgctgaataggaaaaacatctcagtgttgctggtgacacatggtggtttcaacgctctagacgatctaaacttgcgtcccatatcagcagccagggcct

SEQ ID NO: 12059 - DNA, 140 bp, Artificial Sequence
  Synthetic
aggccctggctgctgatatgccctgaataataacaaaatataaaaaccaataaaaatcataaaatagaaaaccataaatagaagtagttcaaagggctataaaacccctgaatagtaacagaccttttgggacagcggtg

SEQ ID NO: 12060 - DNA, 140 bp, Artificial Sequence
  Synthetic
caccgctgtcccaaaaggtctgttactattcaggggttttatagccctttgaactacttctatttatggttttctattttatgatttttattggtttttatattttgttattattcagggcatatcagcagccagggcct

SEQ ID NO: 12061 - DNA, 140 bp, Artificial Sequence
  Synthetic
atacgccatgctgggtctccgtaggagatgttcaaagattataaaaccctgaacagtaataaaatataaaattaataatgagtaccataattggcaaatggaagagatgtaggtactaagcgtacttgggagtcggccat

SEQ ID NO: 12062 - DNA, 140 bp, Artificial Sequence
  Synthetic
atggccgactcccaagtacgcttagtacctacatctcttccatttgccaattatggtactcattattaattttatattttattactgttcagggttttataatctttgaacatctcctacggagacccagcatggcgtat

SEQ ID NO: 12063 - DNA, 140 bp, Artificial Sequence
  Synthetic
aggccctggctgctgatatgattaataatgagtaccataattggcaaatggaagagatgtaggtactaagcttcttaaaagcagccgaactcactttgagatgtaggcatagcataccgagaccttttgggacagcggtg

SEQ ID NO: 12064 - DNA, 140 bp, Artificial Sequence
  Synthetic
caccgctgtcccaaaaggtctcggtatgctatgcctacatctcaaagtgagttcggctgcttttaagaagcttagtacctacatctcttccatttgccaattatggtactcattattaatcatatcagcagccagggcct

SEQ ID NO: 12065 - DNA, 140 bp, Artificial Sequence
  Synthetic
atacgccatgctgggtctccccagcaggagattaataacccatcatggatcctccggcgtacgtggacatagacgctgacagcgcctttttgaaggccctgcaacgtgcgtaccccatgtcgtacttgggagtcggccat

SEQ ID NO: 12066 - DNA, 140 bp, Artificial Sequence
  Synthetic
atggccgactcccaagtacgacatggggtacgcacgttgcagggccttcaaaaaggcgctgtcagcgtctatgtccacgtacgccggaggatccatgatgggttattaatctcctgctggggagacccagcatggcgtat

SEQ ID NO: 12067 - DNA, 140 bp, Artificial Sequence
  Synthetic
aggccctggctgctgatatggcgtgcaccctgacagcagcttggcaggcagaaaaggatacagcaccacggaaggcgcactgtactcatatctagaagggacccgttttcatcagacggcgaccttttgggacagcggtg

SEQ ID NO: 12068 - DNA, 140 bp, Artificial Sequence
  Synthetic
caccgctgtcccaaaaggtcgccgtctgatgaaaacgggtcccttctagatatgagtacagtgcgccttccgtggtgctgtatccttttctgcctgccaagctgctgtcagggtgcacgccatatcagcagccagggcct

SEQ ID NO: 12069 - DNA, 140 bp, Artificial Sequence
  Synthetic
atacgccatgctgggtctccacgtggaacagcttgaggacagagcgggcgcaggaataatagagaatccgagaggatttcccaaagttactgaccaaccaacagaccacgtcgtgggagacgtacttgggagtcggccat

SEQ ID NO: 12070 - DNA, 140 bp, Artificial Sequence
  Synthetic
atggccgactcccaagtacgtctcccacgacgtggtctgttggttggtcagtaactttgggaaatcctctcggattctctattattcctgcgcccgctctgtcctcaagctgttccacgtggagacccagcatggcgtat

SEQ ID NO: 12071 - DNA, 140 bp, Artificial Sequence
  Synthetic
aggccctggctgctgatatgaagtacaaaatagaaggagtgcaaaaagtcaaatgctctaaggtaatgctatttgaccacaacgtgccatcgcgcgtaagtccaagggaatatagatcttgaccttttgggacagcggtg

SEQ ID NO: 12072 - DNA, 140 bp, Artificial Sequence
  Synthetic
caccgctgtcccaaaaggtcaagatctatattcccttggacttacgcgcgatggcacgttgtggtcaaatagcattaccttagagcatttgactttttgcactccttctattttgtacttcatatcagcagccagggcct

SEQ ID NO: 12073 - DNA, 140 bp, Artificial Sequence
  Synthetic
aggccctggctgctgatatggcagggaggtatgcggtcgaagcgtacgacggccgagtcctagtgccctcaggctatgcaatttcgcctgaagacttccagagtctaagcgaaagcgcaagaccttttgggacagcggtg

SEQ ID NO: 12074 - DNA, 140 bp, Artificial Sequence
  Synthetic
caccgctgtcccaaaaggtcttgcgctttcgcttagactctggaagtcttcaggcgaaattgcatagcctgagggcactaggactcggccgtcgtacgcttcgaccgcatacctccctgccatatcagcagccagggcct

SEQ ID NO: 12075 - DNA, 140 bp, Artificial Sequence
  Synthetic
aggccctggctgctgatatgcaattcgacctaagcgttgatggcgagatactgcccgtcccgtcagacctggatgctgacgccccagccctagaaccagcactagacgacggggcgacacgaccttttgggacagcggtg

SEQ ID NO: 12076 - DNA, 140 bp, Artificial Sequence
  Synthetic
caccgctgtcccaaaaggtcgtgtcgccccgtcgtctagtgctggttctagggctggggcgtcagcatccaggtctgacgggacgggcagtatctcgccatcaacgcttaggtcgaattgcatatcagcagccagggcct

SEQ ID NO: 12077 - DNA, 140 bp, Artificial Sequence
  Synthetic
aggccctggctgctgatatgatggatgcaacagaccagtcgacgtgttgtacgtagacgaggagtttgcgtgccactctggaacgctagatgctttgatcgccttggtgagaccaaggcagaccttttgggacagcggtg

SEQ ID NO: 12078 - DNA, 140 bp, Artificial Sequence
  Synthetic
caccgctgtcccaaaaggtctgccttggtctcaccaaggcgatcaaagcatctagcgttccagagtggcacgcaaactcctcgtctacgtacaacacgtcgactggtctgttgcatccatcatatcagcagccagggcct

SEQ ID NO: 12079 - DNA, 140 bp, Artificial Sequence
  Synthetic
aggccctggctgctgatatgacatgtctgccgaggatttcgatgccatcatagccgcacactttaagccaggagacactgttttggaaacggacatagcctccttcgataagagccaagagaccttttgggacagcggtg

SEQ ID NO: 12080 - DNA, 140 bp, Artificial Sequence
  Synthetic
caccgctgtcccaaaaggtctcttggctcttatcgaaggaggctatgtccgtttccaaaacagtgtctcctggcttaaagtgtgcggctatgatggcatcgaaatcctcggcagacatgtcatatcagcagccagggcct

SEQ ID NO: 12081 - DNA, 140 bp, Artificial Sequence
  Synthetic
aggccctggctgctgatatgacgtccgattgtccaatcccgagtccgcagtggcagcatgcaatgagttcttagctagaaactatccaactgtctcgtcgtaccaaattaccgacgagtagaccttttgggacagcggtg

SEQ ID NO: 12082 - DNA, 140 bp, Artificial Sequence
  Synthetic
caccgctgtcccaaaaggtctactcgtcggtaatttggtacgacgagacagttggatagtttctagctaagaactcattgcatgctgccactgcggactcgggattggacaatcggacgtcatatcagcagccagggcct

SEQ ID NO: 12083 - DNA, 140 bp, Artificial Sequence
  Synthetic
atacgccatgctgggtctcctgatgcatatctagacatggtggacgggtcggagaattgcctggacccagcgacatttaatccgtcaaaactcgggagctaccggaaacagcacgcttaccgtacttgggagtcggccat

SEQ ID NO: 12084 - DNA, 140 bp, Artificial Sequence
  Synthetic
atggccgactcccaagtacggtaagcgtgctgtttccggtagctcccgagttttgacggattaaatgtcgctgggtccaggcaattctccgacccgtccaccatgtctagatatgcatcaggagacccagcatggcgtat

SEQ ID NO: 12085 - DNA, 140 bp, Artificial Sequence
  Synthetic
aggccctggctgctgatatgtctcagcagttaataaactgacaatgcgcgcggtaccccaacagaagccacgcaggaatcggaagaataagaagcaaaagcaaaaacggggggggccacagaccttttgggacagcggtg

SEQ ID NO: 12086 - DNA, 140 bp, Artificial Sequence
  Synthetic
caccgctgtcccaaaaggtctgtggccccccccgtttttgcttttgcttcttattcttccgattcctgcgtggcttctgttggggtaccgcgcgcattgtcagtttattaactgctgagacatatcagcagccagggcct

SEQ ID NO: 12087 - DNA, 140 bp, Artificial Sequence
  Synthetic
atacgccatgctgggtctccaaacaacacaaatcaaaagaagcagccacttaaaaagaaaccggctcaaaagaaaaagaagccgggccgcagagagaggatgtgcatgaaaatcgaaaatcgtacttgggagtcggccat

SEQ ID NO: 12088 - DNA, 140 bp, Artificial Sequence
  Synthetic
atggccgactcccaagtacgattttcgattttcatgcacatcctctctctgcggcccggcttctttttcttttgagccggtttctttttaagtggctgcttcttttgatttgtgttgtttggagacccagcatggcgtat

SEQ ID NO: 12089 - DNA, 140 bp, Artificial Sequence
  Synthetic
aggccctggctgctgatatgtctggctttaagtattggctaaaggaacgcggggcgtcactgcagcacacagcaccatttggctgccaaatagcaacaaacccggtaagagcggtgaactgaccttttgggacagcggtg

SEQ ID NO: 12090 - DNA, 140 bp, Artificial Sequence
  Synthetic
caccgctgtcccaaaaggtcagttcaccgctcttaccgggtttgttgctatttggcagccaaatggtgctgtgtgctgcagtgacgccccgcgttcctttagccaatacttaaagccagacatatcagcagccagggcct

SEQ ID NO: 12091 - DNA, 140 bp, Artificial Sequence
  Synthetic
atacgccatgctgggtctccagcaccatttggctgccaaatagcaacaaacccggtaagagcggtgaactgcgccgtagggaacatgcccatcgccatcgacataccggaagcggccttccgtacttgggagtcggccat

SEQ ID NO: 12092 - DNA, 140 bp, Artificial Sequence
  Synthetic
atggccgactcccaagtacggaaggccgcttccggtatgtcgatggcgatgggcatgttccctacggcgcagttcaccgctcttaccgggtttgttgctatttggcagccaaatggtgctggagacccagcatggcgtat

SEQ ID NO: 12093 - DNA, 140 bp, Artificial Sequence
  Synthetic
atacgccatgctgggtctcccttaggaggagctaatgaaggagcccgtacagccctctcggtggtgacctggaataaagacattgtcactaggatcacccccgagggggctgaagagtgccgtacttgggagtcggccat

SEQ ID NO: 12094 - DNA, 140 bp, Artificial Sequence
  Synthetic
atggccgactcccaagtacggcactcttcagccccctcgggggtgatcctagtgacaatgtctttattccaggtcaccaccgagagggctgtacgggctccttcattagctcctcctaagggagacccagcatggcgtat

SEQ ID NO: 12095 - DNA, 140 bp, Artificial Sequence
  Synthetic
aggccctggctgctgatatgagtcttgccattccagttatgtgcctgttggcaaacaccacgttcccctgctcccagcccccttgcacgccctgctgctacgaaaaggaaccggaggaaagaccttttgggacagcggtg

SEQ ID NO: 12096 - DNA, 140 bp, Artificial Sequence
  Synthetic
caccgctgtcccaaaaggtctttcctccggttccttttcgtagcagcagggcgtgcaagggggctgggagcaggggaacgtggtgtttgccaacaggcacataactggaatggcaagactcatatcagcagccagggcct

SEQ ID NO: 12097 - DNA, 140 bp, Artificial Sequence
  Synthetic
aggccctggctgctgatatgacagacctgacggaaggtagacgaggcaaattgtctattatgagaggaaaaaagctaaaaccgtgcgaccgtgtgctgttctcagtagggtcaacgctctgaccttttgggacagcggtg

SEQ ID NO: 12098 - DNA, 140 bp, Artificial Sequence
  Synthetic
caccgctgtcccaaaaggtcagagcgttgaccctactgagaacagcacacggtcgcacggttttagcttttttcctctcataatagacaatttgcctcgtctaccttccgtcaggtctgtcatatcagcagccagggcct

SEQ ID NO: 12099 - DNA, 140 bp, Artificial Sequence
  Synthetic
aggccctggctgctgatatgcatttaaagggcaagctcagcttcacatgccgctgtgatacagtggtttcgtgcgaaggctacgtcgtcaagagaataacgatgagcccaggcctttacggaccttttgggacagcggtg

SEQ ID NO: 12100 - DNA, 140 bp, Artificial Sequence
  Synthetic
caccgctgtcccaaaaggtccgtaaaggcctgggctcatcgttattctcttgacgacgtagccttcgcacgaaaccactgtatcacagcggcatgtgaagctgagcttgccctttaaatgcatatcagcagccagggcct

SEQ ID NO: 12101 - DNA, 140 bp, Artificial Sequence
  Synthetic
aggccctggctgctgatatggtgcgaaggctacgtcgtcaagagaataacgatgagcccaggcctttacggaaaaaccacagggtatgcggtaacccaccacgcagacggatttctggtggaccttttgggacagcggtg

SEQ ID NO: 12102 - DNA, 140 bp, Artificial Sequence
  Synthetic
caccgctgtcccaaaaggtccaccagaaatccgtctgcgtggtgggttaccgcataccctgtggtttttccgtaaaggcctgggctcatcgttattctcttgacgacgtagccttcgcaccatatcagcagccagggcct

SEQ ID NO: 12103 - DNA, 140 bp, Artificial Sequence
  Synthetic
atacgccatgctgggtctcccaccatctggctttaagtattggctaaaagaacgcggggcgccactgcagcacacagcaccatttggctgccaaatagcaacaaacccggtaagagcggtcgtacttgggagtcggccat

SEQ ID NO: 12104 - DNA, 140 bp, Artificial Sequence
  Synthetic
atggccgactcccaagtacgaccgctcttaccgggtttgttgctatttggcagccaaatggtgctgtgtgctgcagtggcgccccgcgttcttttagccaatacttaaagccagatggtgggagacccagcatggcgtat

SEQ ID NO: 12105 - DNA, 140 bp, Artificial Sequence
  Synthetic
aggccctggctgctgatatggccggaaagacatggaagatgaaaaactcctgggggtcagagaaagaacactgacctgctgctgtctatgggcatttaagaagcagaaaacacacacggtgaccttttgggacagcggtg

SEQ ID NO: 12106 - DNA, 140 bp, Artificial Sequence
  Synthetic
caccgctgtcccaaaaggtcaccgtgtgtgttttctgcttcttaaatgcccatagacagcagcaggtcagtgttctttctctgacccccaggagtttttcatcttccatgtctttccggccatatcagcagccagggcct

SEQ ID NO: 12107 - DNA, 140 bp, Artificial Sequence
  Synthetic
atacgccatgctgggtctccgtaggctacgtgtgtcacacgtagcctaccagtttcttactgctctactctgcaaagcaagagattaataacccatcatggattctgtgtacgtggatatcgtacttgggagtcggccat

SEQ ID NO: 12108 - DNA, 140 bp, Artificial Sequence
  Synthetic
atggccgactcccaagtacgatatccacgtacacagaatccatgatgggttattaatctcttgctttgcagagtagagcagtaagaaactggtaggctacgtgtgacacacgtagcctacggagacccagcatggcgtat

SEQ ID NO: 12109 - DNA, 140 bp, Artificial Sequence
  Synthetic
atacgccatgctgggtctcccagagcgggtgcaggaatgatagagactccgagaggagctatcaaagttactgcccaaccaacagaccacgtcgtgggagagtacttggttctttccccgcgtacttgggagtcggccat

SEQ ID NO: 12110 - DNA, 140 bp, Artificial Sequence
  Synthetic
atggccgactcccaagtacgcggggaaagaaccaagtactctcccacgacgtggtctgttggttgggcagtaactttgatagctcctctcggagtctctatcattcctgcacccgctctgggagacccagcatggcgtat

SEQ ID NO: 12111 - DNA, 140 bp, Artificial Sequence
  Synthetic
aggccctggctgctgatatgaagcgtacgacggcagagtcctagtgccctcaggctacgcaatctcgcctgaagacttccagagcctaagcgaaagcgcaacgatggtgtacaacgaaaggaccttttgggacagcggtg

SEQ ID NO: 12112 - DNA, 140 bp, Artificial Sequence
  Synthetic
caccgctgtcccaaaaggtcctttcgttgtacaccatcgttgcgctttcgcttaggctctggaagtcttcaggcgagattgcgtagcctgagggcactaggactctgccgtcgtacgcttcatatcagcagccagggcct

SEQ ID NO: 12113 - DNA, 140 bp, Artificial Sequence
  Synthetic
atacgccatgctgggtctcctgtctatcatgagagggaaaaagctaaaaccgtgcgaccgtgtgctgttctcagtagggtcaacgctttacccggaaagccgcatgctacttaagagctgcgtacttgggagtcggccat

SEQ ID NO: 12114 - DNA, 140 bp, Artificial Sequence
  Synthetic
atggccgactcccaagtacgcagctcttaagtagcatgcggctttccgggtaaagcgttgaccctactgagaacagcacacggtcgcacggttttagctttttccctctcatgatagacaggagacccagcatggcgtat

SEQ ID NO: 12115 - DNA, 140 bp, Artificial Sequence
  Synthetic
aggccctggctgctgatatggagtgtcattctcggtgtgcacgtacgtgccggcgaccatttgtgatcaaatgaccggcatccttgctacagaagtcacgccggaggatgcacagaagctgaccttttgggacagcggtg

SEQ ID NO: 12116 - DNA, 140 bp, Artificial Sequence
  Synthetic
caccgctgtcccaaaaggtcagcttctgtgcatcctccggcgtgacttctgtagcaaggatgccggtcatttgatcacaaatggtcgccggcacgtacgtgcacaccgagaatgacactccatatcagcagccagggcct

SEQ ID NO: 12117 - DNA, 140 bp, Artificial Sequence
  Synthetic
aggccctggctgctgatatggatgctgcaagaaggaagaagctgcaggattggtactggtgggcgacttgactaatccgccctaccacgaattcgcatacgaagggctaaaaattcgcccgaccttttgggacagcggtg

SEQ ID NO: 12118 - DNA, 140 bp, Artificial Sequence
  Synthetic
caccgctgtcccaaaaggtcgggcgaatttttagcccttcgtatgcgaattcgtggtagggcggattagtcaagtcgcccaccagtaccaatcctgcagcttcttccttcttgcagcatccatatcagcagccagggcct

SEQ ID NO: 12119 - DNA, 140 bp, Artificial Sequence
  Synthetic
atacgccatgctgggtctccactaatccgccctaccacgaattcgcatacgaagggctaaaaattcgccccgcttgtccatataaaattgcagtcataggagtcttcggggtaccaggatcgtacttgggagtcggccat

SEQ ID NO: 12120 - DNA, 140 bp, Artificial Sequence
  Synthetic
atggccgactcccaagtacgatcctggtaccccgaagactcctatgactgcaattttatatggacaagcggggcgaatttttagcccttcgtatgcgaattcgtggtagggcggattagtggagacccagcatggcgtat

SEQ ID NO: 12121 - DNA, 140 bp, Artificial Sequence
  Synthetic
atacgccatgctgggtctccgcagatagaaccagtgaacgagtcatctgcgtattgggacgcaagtttagatcatctagagcgttgaaaccaccatgtgtcaccagcaacactgagatgtcgtacttgggagtcggccat

SEQ ID NO: 12122 - DNA, 140 bp, Artificial Sequence
  Synthetic
atggccgactcccaagtacgacatctcagtgttgctggtgacacatggtggtttcaacgctctagatgatctaaacttgcgtcccaatacgcagatgactcgttcactggttctatctgcggagacccagcatggcgtat

SEQ ID NO: 12123 - DNA, 140 bp, Artificial Sequence
  Synthetic
atacgccatgctgggtctccaaaagtatttccaggcggtgtacactgcctgtgactgccattgtgtcgtcgttgcattacgaaggcaaaatgcgcactacgaatgagtacaacatgccgacgtacttgggagtcggccat

SEQ ID NO: 12124 - DNA, 140 bp, Artificial Sequence
  Synthetic
atggccgactcccaagtacgtcggcatgttgtactcattcgtagtgcgcattttgccttcgtaatgcaacgacgacacaatggcagtcacaggcagtgtacaccgcctggaaatacttttggagacccagcatggcgtat

SEQ ID NO: 12125 - DNA, 140 bp, Artificial Sequence
  Synthetic
aggccctggctgctgatatggtcatgaacaatcaactgaatgcagcctttgtaggacaggccacccgagcaggatgtgcaccgtcgtaccgggtaaaacgcatggatatcgcgaagaacggaccttttgggacagcggtg

SEQ ID NO: 12126 - DNA, 140 bp, Artificial Sequence
  Synthetic
caccgctgtcccaaaaggtccgttcttcgcgatatccatgcgttttacccggtacgacggtgcacatcctgctcgggtggcctgtcctacaaaggctgcattcagttgattgttcatgaccatatcagcagccagggcct

SEQ ID NO: 12127 - DNA, 140 bp, Artificial Sequence
  Synthetic
aggccctggctgctgatatgacacgaggtcatgacagcagccgcatcccaagggttaaccagaaaaggagtttacgcagttaggcaaaaagttaacgaaaacccactctatgcatcaacagaccttttgggacagcggtg

SEQ ID NO: 12128 - DNA, 140 bp, Artificial Sequence
  Synthetic
caccgctgtcccaaaaggtctgttgatgcatagagtgggttttcgttaactttttgcctaactgcgtaaactccttttctggttaacccttgggatgcggctgctgtcatgacctcgtgtcatatcagcagccagggcct

SEQ ID NO: 12129 - DNA, 140 bp, Artificial Sequence
  Synthetic
atacgccatgctgggtctcctttacgcagttaggcaaaaagttaacgaaaacccactctatgcatcaacatcagagcacgtcaacgtactcctaacgcgtacggaaggtaaactggtatgcgtacttgggagtcggccat

SEQ ID NO: 12130 - DNA, 140 bp, Artificial Sequence
  Synthetic
atggccgactcccaagtacgcataccagtttaccttccgtacgcgttaggagtacgttgacgtgctctgatgttgatgcatagagtgggttttcgttaactttttgcctaactgcgtaaaggagacccagcatggcgtat

SEQ ID NO: 12131 - DNA, 140 bp, Artificial Sequence
  Synthetic
aggccctggctgctgatatgttaacgtgcttcagagggtgggttaaacaactgcaaattgactatcgtggacacgaggtcatgacagcagccgcatcccaagggttaaccagaaaaggaggaccttttgggacagcggtg

SEQ ID NO: 12132 - DNA, 140 bp, Artificial Sequence
  Synthetic
caccgctgtcccaaaaggtcctccttttctggttaacccttgggatgcggctgctgtcatgacctcgtgtccacgatagtcaatttgcagttgtttaacccaccctctgaagcacgttaacatatcagcagccagggcct

SEQ ID NO: 12133 - DNA, 140 bp, Artificial Sequence
  Synthetic
aggccctggctgctgatatgaaggaaacttcaaggcaactattaaggagtgggaggtggagcacgcatcgataatggcgggcatctgcagtcaccaagtgacctttgacacgttccaaaagaccttttgggacagcggtg

SEQ ID NO: 12134 - DNA, 140 bp, Artificial Sequence
  Synthetic
caccgctgtcccaaaaggtcttttggaacgtgtcaaaggtcacttggtgactgcagatgcccgccattatcgatgcgtgctccacctcccactccttaatagttgccttgaagtttccttcatatcagcagccagggcct

SEQ ID NO: 12135 - DNA, 140 bp, Artificial Sequence
  Synthetic
aggccctggctgctgatatgaaagaagacaaagcatactcacccgaagtagccctgaatgaaatatgcacgcgcatgtatggggtggatctagacagcgggctattctctaaaccgttgggaccttttgggacagcggtg

SEQ ID NO: 12136 - DNA, 140 bp, Artificial Sequence
  Synthetic
caccgctgtcccaaaaggtcccaacggtttagagaatagcccgctgtctagatccaccccatacatgcgcgtgcatatttcattcagggctacttcgggtgagtatgctttgtcttctttcatatcagcagccagggcct

SEQ ID NO: 12137 - DNA, 140 bp, Artificial Sequence
  Synthetic
aggccctggctgctgatatgagactaccacactcattagtggccgaacaccgcccagtaaaaggggaaagaatggaatggctggttaacaagataaacggacatcatgtgctcctggttagaccttttgggacagcggtg

SEQ ID NO: 12138 - DNA, 140 bp, Artificial Sequence
  Synthetic
caccgctgtcccaaaaggtctaaccaggagcacatgatgtccgtttatcttgttaaccagccattccattctttccccttttactgggcggtgttcggccactaatgagtgtggtagtctcatatcagcagccagggcct

SEQ ID NO: 12139 - DNA, 140 bp, Artificial Sequence
  Synthetic
aggccctggctgctgatatggcggctataaccttgcactgcctactaagagagtcacctgggtagcgccactaggtgtccgcggagcggactatacatacaacctagagctgggtctaccgaccttttgggacagcggtg

SEQ ID NO: 12140 - DNA, 140 bp, Artificial Sequence
  Synthetic
caccgctgtcccaaaaggtcggtagacccagctctaggttgtatgtatagtccgctccgcggacacctagtggcgctacccaggtgactctcttagtaggcagtgcaaggttatagccgccatatcagcagccagggcct

SEQ ID NO: 12141 - DNA, 140 bp, Artificial Sequence
  Synthetic
atacgccatgctgggtctcctgccatcgcgcgtaagtccaagggaatacagaccttcccaggagtctgtacaggaagtgagtacgaccacgtcactgacgcatagccaattcgatctaagcgtacttgggagtcggccat

SEQ ID NO: 12142 - DNA, 140 bp, Artificial Sequence
  Synthetic
atggccgactcccaagtacgcttagatcgaattggctatgcgtcagtgacgtggtcgtactcacttcctgtacagactcctgggaaggtctgtattcccttggacttacgcgcgatggcaggagacccagcatggcgtat

SEQ ID NO: 12143 - DNA, 140 bp, Artificial Sequence
  Synthetic
aggccctggctgctgatatggcaaccggaaaccttgcggccgtgtctgactgggtaatgagcaccgtacctgtcgcgccgcccagaagaaggcgagggagaaacctgactgtgacatgcggaccttttgggacagcggtg

SEQ ID NO: 12144 - DNA, 140 bp, Artificial Sequence
  Synthetic
caccgctgtcccaaaaggtccgcatgtcacagtcaggtttctccctcgccttcttctgggcggcgcgacaggtacggtgctcattacccagtcagacacggccgcaaggtttccggttgccatatcagcagccagggcct

SEQ ID NO: 12145 - DNA, 140 bp, Artificial Sequence
  Synthetic
atacgccatgctgggtctcctaggacaggccacccgagcaggatgtgcaccatcgtaccgggtaaagcgcatggacatcgcgaagaacgatgaagagtgcgtggtcaacgccgccaaccccgtacttgggagtcggccat

SEQ ID NO: 12146 - DNA, 140 bp, Artificial Sequence
  Synthetic
atggccgactcccaagtacggggttggcggcgttgaccacgcactcttcatcgttcttcgcgatgtccatgcgctttacccggtacgatggtgcacatcctgctcgggtggcctgtcctaggagacccagcatggcgtat

SEQ ID NO: 12147 - DNA, 140 bp, Artificial Sequence
  Synthetic
atacgccatgctgggtctccacgagagggaagggaatataacacccatggctagcgtccgattctttagggcagagctgtgtccagtcgtacaagaaacagcggagacgcgtgacacagccgtacttgggagtcggccat

SEQ ID NO: 12148 - DNA, 140 bp, Artificial Sequence
  Synthetic
atggccgactcccaagtacggctgtgtcacgcgtctccgctgtttcttgtacgactggacacagctctgccctaaagaatcggacgctagccatgggtgttatattcccttccctctcgtggagacccagcatggcgtat

SEQ ID NO: 12149 - DNA, 140 bp, Artificial Sequence
  Synthetic
atacgccatgctgggtctcccggacccaagtggagctgctggatgagcacatctccatagactgcgatgtcattcgcgtgcaccctgacagtagtttggcaggtagaaaaggatacagcacgtacttgggagtcggccat

SEQ ID NO: 12150 - DNA, 140 bp, Artificial Sequence
  Synthetic
atggccgactcccaagtacgtgctgtatccttttctacctgccaaactactgtcagggtgcacgcgaatgacatcgcagtctatggagatgtgctcatccagcagctccacttgggtccgggagacccagcatggcgtat

SEQ ID NO: 12151 - DNA, 140 bp, Artificial Sequence
  Synthetic
aggccctggctgctgatatgtggtccacgtgctcagacacggacgacgagttatgactagacagggcaggtgggtatatattctcgtcggacactggtccaggccatttacaacagaagtgaccttttgggacagcggtg

SEQ ID NO: 12152 - DNA, 140 bp, Artificial Sequence
  Synthetic
caccgctgtcccaaaaggtcacttctgttgtaaatggcctggaccagtgtccgacgagaatatatacccacctgccctgtctagtcataactcgtcgtccgtgtctgagcacgtggaccacatatcagcagccagggcct

SEQ ID NO: 12153 - DNA, 140 bp, Artificial Sequence
  Synthetic
atacgccatgctgggtctccccactttggactcagcagtattcaacgtggagtgttttaaaaaattcgcatgcaaccgagaatactgggaagaatttgctgccagccctatcaggataaccgtacttgggagtcggccat

SEQ ID NO: 12154 - DNA, 140 bp, Artificial Sequence
  Synthetic
atggccgactcccaagtacggttatcctgatagggctggcagcaaattcttcccagtattctcggttgcatgcgaattttttaaaacactccacgttgaatactgctgagtccaaagtggggagacccagcatggcgtat

SEQ ID NO: 12155 - DNA, 140 bp, Artificial Sequence
  Synthetic
atacgccatgctgggtctcccagcgttgcttgcaagaacccataatctgctgccgctgcaggatgtaccaatggataggttcacagtagatatgaaaagggacgtgaaggtaactcctggcgtacttgggagtcggccat

SEQ ID NO: 12156 - DNA, 140 bp, Artificial Sequence
  Synthetic
atggccgactcccaagtacgccaggagttaccttcacgtcccttttcatatctactgtgaacctatccattggtacatcctgcagcggcagcagattatgggttcttgcaagcaacgctgggagacccagcatggcgtat

SEQ ID NO: 12157 - DNA, 140 bp, Artificial Sequence
  Synthetic
aggccctggctgctgatatgccctgctgctacgaaaaggaaccggaggaaaccctacgcatgcttgaggacaacgtcatgagacctgggtactatcagctgctacaagcatccttaacatgaccttttgggacagcggtg

SEQ ID NO: 12158 - DNA, 140 bp, Artificial Sequence
  Synthetic
caccgctgtcccaaaaggtcatgttaaggatgcttgtagcagctgatagtacccaggtctcatgacgttgtcctcaagcatgcgtagggtttcctccggttccttttcgtagcagcagggcatatcagcagccagggcct

SEQ ID NO: 12159 - DNA, 140 bp, Artificial Sequence
  Synthetic
aggccctggctgctgatatgctcgtgccatagtcccgtagcactagaacgcatcagaaatgaagcgacagacgggacgctgaaaatccaggtctccttgcaaattggaataaagacggatgaccttttgggacagcggtg

SEQ ID NO: 12160 - DNA, 140 bp, Artificial Sequence
  Synthetic
caccgctgtcccaaaaggtcatccgtctttattccaatttgcaaggagacctggattttcagcgtcccgtctgtcgcttcatttctgatgcgttctagtgctacgggactatggcacgagcatatcagcagccagggcct

SEQ ID NO: 12161 - DNA, 140 bp, Artificial Sequence
  Synthetic
atacgccatgctgggtctccttactggaacaaagggacacttcatcctggcccgatgtccgaaaggagaaactctgacggtgggatttactgacagtaggaagattagtcactcatgtaccgtacttgggagtcggccat

SEQ ID NO: 12162 - DNA, 140 bp, Artificial Sequence
  Synthetic
atggccgactcccaagtacggtacatgagtgactaatcttcctactgtcagtaaatcccaccgtcagagtttctcctttcggacatcgggccaggatgaagtgtccctttgttccagtaaggagacccagcatggcgtat

SEQ ID NO: 12163 - DNA, 140 bp, Artificial Sequence
  Synthetic
atacgccatgctgggtctccttactggaacaatgggacacttcatcctggcccgatgtccgaaaggagaaactctgacggtgggatttactgacagtaggaagattagtcactcatgtaccgtacttgggagtcggccat

SEQ ID NO: 12164 - DNA, 140 bp, Artificial Sequence
  Synthetic
atggccgactcccaagtacggtacatgagtgactaatcttcctactgtcagtaaatcccaccgtcagagtttctcctttcggacatcgggccaggatgaagtgtcccattgttccagtaaggagacccagcatggcgtat

SEQ ID NO: 12165 - DNA, 140 bp, Artificial Sequence
  Synthetic
atacgccatgctgggtctccttactggaacaacgggacacttcatcctggcccgatgtccgaaaggagaaactctgacggtgggatttactgacagtaggaagattagtcactcatgtaccgtacttgggagtcggccat

SEQ ID NO: 12166 - DNA, 140 bp, Artificial Sequence
  Synthetic
atggccgactcccaagtacggtacatgagtgactaatcttcctactgtcagtaaatcccaccgtcagagtttctcctttcggacatcgggccaggatgaagtgtcccgttgttccagtaaggagacccagcatggcgtat

SEQ ID NO: 12167 - DNA, 140 bp, Artificial Sequence
  Synthetic
atacgccatgctgggtctccttactggaacaaggggacacttcatcctggcccgatgtccgaaaggagaaactctgacggtgggatttactgacagtaggaagattagtcactcatgtaccgtacttgggagtcggccat

SEQ ID NO: 12168 - DNA, 140 bp, Artificial Sequence
  Synthetic
atggccgactcccaagtacggtacatgagtgactaatcttcctactgtcagtaaatcccaccgtcagagtttctcctttcggacatcgggccaggatgaagtgtccccttgttccagtaaggagacccagcatggcgtat

SEQ ID NO: 12169 - DNA, 140 bp, Artificial Sequence
  Synthetic
atacgccatgctgggtctccaccgccgcaactgccgaggagatagaggtacacatgcccccagacacccctgatcgcacattgatgtcacaacagtccggcaacgtaaagatcacagtcacgtacttgggagtcggccat

SEQ ID NO: 12170 - DNA, 140 bp, Artificial Sequence
  Synthetic
atggccgactcccaagtacgtgactgtgatctttacgttgccggactgttgtgacatcaatgtgcgatcaggggtgtctgggggcatgtgtacctctatctcctcggcagttgcggcggtggagacccagcatggcgtat

SEQ ID NO: 12171 - DNA, 140 bp, Artificial Sequence
  Synthetic
aggccctggctgctgatatgttgcacaccctgctgctacgaaaaagagccggagaaaaccttgcgcatgcttgaagacaatgtcatgagccccgggtactatcagctgctacaagcatccgaccttttgggacagcggtg

SEQ ID NO: 12172 - DNA, 140 bp, Artificial Sequence
  Synthetic
caccgctgtcccaaaaggtcggatgcttgtagcagctgatagtacccggggctcatgacattgtcttcaagcatgcgcaaggttttctccggctctttttcgtagcagcagggtgtgcaacatatcagcagccagggcct

SEQ ID NO: 12173 - DNA, 140 bp, Artificial Sequence
  Synthetic
aggccctggctgctgatatgtgcacgattactggaacaatgggacacttcattctggcccgatgtccgaaaggagaaactctgacggtggggtttactgacggtaggaagatcagtcactgaccttttgggacagcggtg

SEQ ID NO: 12174 - DNA, 140 bp, Artificial Sequence
  Synthetic
caccgctgtcccaaaaggtcagtgactgatcttcctaccgtcagtaaaccccaccgtcagagtttctcctttcggacatcgggccagaatgaagtgtcccattgttccagtaatcgtgcacatatcagcagccagggcct

SEQ ID NO: 12175 - DNA, 140 bp, Artificial Sequence
  Synthetic
atacgccatgctgggtctccctggtcccgcgtaatgctgaattcggggaccggaaaggaaaagttcacattccatttcctctggcaaatgtgacatgcagggtgcctaaagcaagaaacccgtacttgggagtcggccat

SEQ ID NO: 12176 - DNA, 140 bp, Artificial Sequence
  Synthetic
atggccgactcccaagtacgggtttcttgctttaggcaccctgcatgtcacatttgccagaggaaatggaatgtgaacttttcctttccggtccccgaattcagcattacgcgggaccagggagacccagcatggcgtat

SEQ ID NO: 12177 - DNA, 140 bp, Artificial Sequence
  Synthetic
aggccctggctgctgatatgatcccgaacacggtgggagtaccgtataagactctagtcaacagaccgggctacagccccatggtattggagatggagcttctgtctgtcaccttggaacgaccttttgggacagcggtg

SEQ ID NO: 12178 - DNA, 140 bp, Artificial Sequence
  Synthetic
caccgctgtcccaaaaggtcgttccaaggtgacagacagaagctccatctccaataccatggggctgtagcccggtctgttgactagagtcttatacggtactcccaccgtgttcgggatcatatcagcagccagggcct

SEQ ID NO: 12179 - DNA, 140 bp, Artificial Sequence
  Synthetic
aggccctggctgctgatatgcaacgctatcgcttgattacatcacgtgcgagtataaaaccgttatcccgtctccgtacgtgaaatgctgcggtacagcagagtgtaaggacaagagcctgaccttttgggacagcggtg

SEQ ID NO: 12180 - DNA, 140 bp, Artificial Sequence
  Synthetic
caccgctgtcccaaaaggtcaggctcttgtccttacactctgctgtaccgcagcatttcacgtacggagacgggataacggttttatactcgcacgtgatgtaatcaagcgatagcgttgcatatcagcagccagggcct

SEQ ID NO: 12181 - DNA, 140 bp, Artificial Sequence
  Synthetic
aggccctggctgctgatatggcgtctgcccgatgcgcagtgcggaagatcccgagagactcgctaattatgcgagaaagctagtatctgccgcaggaaaagtcctggacagaaacatctcgaccttttgggacagcggtg

SEQ ID NO: 12182 - DNA, 140 bp, Artificial Sequence
  Synthetic
caccgctgtcccaaaaggtcgagatgtttctgtccaggacttttcctgcggcagatactagctttctcgcataattagcgagtctctcgggatcttccgcactgcgcatcgggcagacgccatatcagcagccagggcct

SEQ ID NO: 12183 - DNA, 140 bp, Artificial Sequence
  Synthetic
atacgccatgctgggtctcccgaccctggactccgcgctctactatccaaatcatcaggcccagaccgcgccctcagaggcaagctgggcagcttgcccagctgatctcagcagttaatacgtacttgggagtcggccat

SEQ ID NO: 12184 - DNA, 140 bp, Artificial Sequence
  Synthetic
atggccgactcccaagtacgtattaactgctgagatcagctgggcaagctgcccagcttgcctctgagggcgcggtctgggcctgatgatttggatagtagagcgcggagtccagggtcgggagacccagcatggcgtat

SEQ ID NO: 12185 - DNA, 140 bp, Artificial Sequence
  Synthetic
aggccctggctgctgatatgagatgtaggtacttaagcttcctaaaagcagccgaactcactttgagaagtaggcatagcataccgaactcttccacgattctccgaacccacagggacggaccttttgggacagcggtg

SEQ ID NO: 12186 - DNA, 140 bp, Artificial Sequence
  Synthetic
caccgctgtcccaaaaggtccgtccctgtgggttcggagaatcgtggaagagttcggtatgctatgcctacttctcaaagtgagttcggctgcttttaggaagcttaagtacctacatctcatatcagcagccagggcct

SEQ ID NO: 12187 - DNA, 140 bp, Artificial Sequence
  Synthetic
atacgccatgctgggtctcctcgtcgacgcgccatctttaacggacatgtcgtgtgaggtatcagcctgcacccattcctcagactttgggggcgtagccatcattaaatatgcagccagcgtacttgggagtcggccat

SEQ ID NO: 12188 - DNA, 140 bp, Artificial Sequence
  Synthetic
atggccgactcccaagtacgctggctgcatatttaatgatggctacgcccccaaagtctgaggaatgggtgcaggctgatacctcacacgacatgtccgttaaagatggcgcgtcgacgaggagacccagcatggcgtat

SEQ ID NO: 12189 - DNA, 140 bp, Artificial Sequence
  Synthetic
atacgccatgctgggtctcccacctttgcaagctccagatccaatttcgagaagctcagaggacccgtcataaatttgtacggcggtcctaaataggtacgcactacagctacctattttcgtacttgggagtcggccat

SEQ ID NO: 12190 - DNA, 140 bp, Artificial Sequence
  Synthetic
atggccgactcccaagtacgaaaataggtagctgtagtgcgtacctatttaggaccgccgtacaaatttatgacgggtcctctgagcttctcgaaattggatctggagcttgcaaaggtgggagacccagcatggcgtat

SEQ ID NO: 12191 - DNA, 140 bp, Artificial Sequence
  Synthetic
aggccctggctgctgatatggggaagctgaaatagaagtagaagggaactctcagttgcaaatctctttttcgacggccctagccagcgccgaatttcgcgtacaagtctgttctacacagaccttttgggacagcggtg

SEQ ID NO: 12192 - DNA, 140 bp, Artificial Sequence
  Synthetic
caccgctgtcccaaaaggtctgtgtagaacagacttgtacgcgaaattcggcgctggctagggccgtcgaaaaagagatttgcaactgagagttcccttctacttctatttcagcttccccatatcagcagccagggcct

SEQ ID NO: 12193 - DNA, 140 bp, Artificial Sequence
  Synthetic
aggccctggctgctgatatgcccacattctgcttgcacactgacgtctcatgtagacaaagggcggacgtcgctatataccaggacgtctacgccgtgaatgcaccaacatcgctataccgaccttttgggacagcggtg

SEQ ID NO: 12194 - DNA, 140 bp, Artificial Sequence
  Synthetic
caccgctgtcccaaaaggtcggtatagcgatgttggtgcattcacggcgtagacgtcctggtatatagcgacgtccgccctttgtctacatgagacgtcagtgtgcaagcagaatgtgggcatatcagcagccagggcct

SEQ ID NO: 12195 - DNA, 140 bp, Artificial Sequence
  Synthetic
aggccctggctgctgatatgcccacattctgcttgcacactgacgtctcatgtagacaaagggcggacgtcgctatataccaggacgtctacgccgtgtatgcaccaacatcgctataccgaccttttgggacagcggtg

SEQ ID NO: 12196 - DNA, 140 bp, Artificial Sequence
  Synthetic
caccgctgtcccaaaaggtcggtatagcgatgttggtgcatacacggcgtagacgtcctggtatatagcgacgtccgccctttgtctacatgagacgtcagtgtgcaagcagaatgtgggcatatcagcagccagggcct

SEQ ID NO: 12197 - DNA, 140 bp, Artificial Sequence
  Synthetic
aggccctggctgctgatatgcccacattctgcttgcacactgacgtctcatgtagacaaagggcggacgtcgctatataccaggacgtctacgccgtgcatgcaccaacatcgctataccgaccttttgggacagcggtg

SEQ ID NO: 12198 - DNA, 140 bp, Artificial Sequence
  Synthetic
caccgctgtcccaaaaggtcggtatagcgatgttggtgcatgcacggcgtagacgtcctggtatatagcgacgtccgccctttgtctacatgagacgtcagtgtgcaagcagaatgtgggcatatcagcagccagggcct

SEQ ID NO: 12199 - DNA, 140 bp, Artificial Sequence
  Synthetic
aggccctggctgctgatatgcccacattctgcttgcacactgacgtctcatgtagacaaagggcggacgtcgctatataccaggacgtctacgccgtggatgcaccaacatcgctataccgaccttttgggacagcggtg

SEQ ID NO: 12200 - DNA, 140 bp, Artificial Sequence
  Synthetic
caccgctgtcccaaaaggtcggtatagcgatgttggtgcatccacggcgtagacgtcctggtatatagcgacgtccgccctttgtctacatgagacgtcagtgtgcaagcagaatgtgggcatatcagcagccagggcct

SEQ ID NO: 12201 - DNA, 140 bp, Artificial Sequence
  Synthetic
atacgccatgctgggtctcccaacaaaaatcataaaatagaaaactagaaatagaagtaggtaagaaggtatatgtgtcccctaagagacacaccatatatagttcaaagggctataaaacgtacttgggagtcggccat

SEQ ID NO: 12202 - DNA, 140 bp, Artificial Sequence
  Synthetic
atggccgactcccaagtacgttttatagccctttgaactatatatggtgtgtctcttaggggacacatataccttcttacctacttctatttctagttttctattttatgatttttgttgggagacccagcatggcgtat

SEQ ID NO: 12203 - DNA, 140 bp, Artificial Sequence
  Synthetic
atacgccatgctgggtctccaaagttaatgaaaaccccctttacgcatcaacatcagagcacgtgaacgtgctactgacgcgtacggaaggcaaactagtatggaagacactttccggagcgtacttgggagtcggccat

SEQ ID NO: 12204 - DNA, 140 bp, Artificial Sequence
  Synthetic
atggccgactcccaagtacgctccggaaagtgtcttccatactagtttgccttccgtacgcgtcagtagcacgttcacgtgctctgatgttgatgcgtaaagggggttttcattaactttggagacccagcatggcgtat

SEQ ID NO: 12205 - DNA, 140 bp, Artificial Sequence
  Synthetic
aggccctggctgctgatatggaactcgctttgagatgtaggcgtagcacaccgaactcttccataattctccgaacccacagggacgtaggagatgttcaaagtgactataaaaccctgagaccttttgggacagcggtg

SEQ ID NO: 12206 - DNA, 140 bp, Artificial Sequence
  Synthetic
caccgctgtcccaaaaggtctcagggttttatagtcactttgaacatctcctacgtccctgtgggttcggagaattatggaagagttcggtgtgctacgcctacatctcaaagcgagttccatatcagcagccagggcct

SEQ ID NO: 12207 - DNA, 140 bp, Artificial Sequence
  Synthetic
atacgccatgctgggtctccacagtaataaaatataaaattaataatgagtaccataattggcaaatggaagagacgtaggtactaagcttcttaaaagcagccgaactcactttgagatcgtacttgggagtcggccat

SEQ ID NO: 12208 - DNA, 140 bp, Artificial Sequence
  Synthetic
atggccgactcccaagtacgatctcaaagtgagttcggctgcttttaagaagcttagtacctacgtctcttccatttgccaattatggtactcattattaattttatattttattactgtggagacccagcatggcgtat

SEQ ID NO: 12209 - DNA, 140 bp, Artificial Sequence
  Synthetic
aggccctggctgctgatatgagagacgtaggtactaagcttcttaaaagcagccgaactcactttgagatgtaggcatagcataccgaactcttccacaattctccgtacccatagggacgaccttttgggacagcggtg

SEQ ID NO: 12210 - DNA, 140 bp, Artificial Sequence
  Synthetic
caccgctgtcccaaaaggtcgtccctatgggtacggagaattgtggaagagttcggtatgctatgcctacatctcaaagtgagttcggctgcttttaagaagcttagtacctacgtctctcatatcagcagccagggcct

SEQ ID NO: 12211 - DNA, 140 bp, Artificial Sequence
  Synthetic
atacgccatgctgggtctcctaaccatcaagtgaccttcgacacgttccagaataaagccaatgtctgctgggcgaagagcttagtccccatcctagaaacggcagggataaaattaaaccgtacttgggagtcggccat

SEQ ID NO: 12212 - DNA, 140 bp, Artificial Sequence
  Synthetic
atggccgactcccaagtacggtttaattttatccctgccgtttctaggatggggactaagctcttcgcccagcagacattggctttattctggaacgtgtcgaaggtcacttgatggttaggagacccagcatggcgtat

SEQ ID NO: 12213 - DNA, 140 bp, Artificial Sequence
  Synthetic
aggccctggctgctgatatggatcaaagggccgaataacccctgaatagtaacaaaatatgaaaatcaataaaaatcataaaatagaaaaaccataaacagaagtagttcaaagggctatgaccttttgggacagcggtg

SEQ ID NO: 12214 - DNA, 140 bp, Artificial Sequence
  Synthetic
caccgctgtcccaaaaggtcatagccctttgaactacttctgtttatggtttttctattttatgatttttattgattttcatattttgttactattcaggggttattcggccctttgatccatatcagcagccagggcct

SEQ ID NO: 12215 - DNA, 140 bp, Artificial Sequence
  Synthetic
atacgccatgctgggtctcccacaagaagtaagttcgaccacatcactgacgcacagccaattcgaccttagtgttgacggtgaggtactgcccgctccgtctgacctggaagctgatgccgtacttgggagtcggccat

SEQ ID NO: 12216 - DNA, 140 bp, Artificial Sequence
  Synthetic
atggccgactcccaagtacggcatcagcttccaggtcagacggagcgggcagtacctcaccgtcaacactaaggtcgaattggctgtgcgtcagtgatgtggtcgaacttacttcttgtgggagacccagcatggcgtat

SEQ ID NO: 12217 - DNA, 140 bp, Artificial Sequence
  Synthetic
aggccctggctgctgatatgagtgttgacggtgaggtactgcccgctccgtctgacctggaagctgatgctccgattccggagccaacaccagacgacagagcggtacttactttgcctcgaccttttgggacagcggtg

SEQ ID NO: 12218 - DNA, 140 bp, Artificial Sequence
  Synthetic
caccgctgtcccaaaaggtcgaggcaaagtaagtaccgctctgtcgtctggtgttggctccggaatcggagcatcagcttccaggtcagacggagcgggcagtacctcaccgtcaacactcatatcagcagccagggcct

SEQ ID NO: 12219 - DNA, 140 bp, Artificial Sequence
  Synthetic
atacgccatgctgggtctccagaacttgacaacctatgtcacaaaactaaaaggaccaaaagcagcagcattgtttgccaagacacataacctgctaccactgcaggaggtaccaatggacgtacttgggagtcggccat

SEQ ID NO: 12220 - DNA, 140 bp, Artificial Sequence
  Synthetic
atggccgactcccaagtacgtccattggtacctcctgcagtggtagcaggttatgtgtcttggcaaacaatgctgctgcttttggtccttttagttttgtgacataggttgtcaagttctggagacccagcatggcgtat

SEQ ID NO: 12221 - DNA, 140 bp, Artificial Sequence
  Synthetic
atacgccatgctgggtctccgaatgcagtccttctacctaatgtacacacgctgtttgacatgtctgccgaggactttgacgccattatcgccgcgcacttcaagccaggggacgccgtacgtacttgggagtcggccat

SEQ ID NO: 12222 - DNA, 140 bp, Artificial Sequence
  Synthetic
atggccgactcccaagtacgtacggcgtcccctggcttgaagtgcgcggcgataatggcgtcaaagtcctcggcagacatgtcaaacagcgtgtgtacattaggtagaaggactgcattcggagacccagcatggcgtat

SEQ ID NO: 12223 - DNA, 140 bp, Artificial Sequence
  Synthetic
aggccctggctgctgatatggtaccgagtctgtggtcgtccgggttgtcaatccctttgaggactagaatcaaatggttgctaagcaaggtgccaaaaaccgacctgatcccatacagcggaccttttgggacagcggtg

SEQ ID NO: 12224 - DNA, 140 bp, Artificial Sequence
  Synthetic
caccgctgtcccaaaaggtccgctgtatgggatcaggtcggtttttggcaccttgcttagcaaccatttgattctagtcctcaaagggattgacaacccggacgaccacagactcggtaccatatcagcagccagggcct

SEQ ID NO: 12225 - DNA, 140 bp, Artificial Sequence
  Synthetic
aggccctggctgctgatatggaagcagaactgactcgcgaagccctaccacctctacaggcagcacaggaagatgttcaggtcgaaatcgacgtggaacagcttgaggacagagcgggcggaccttttgggacagcggtg

SEQ ID NO: 12226 - DNA, 140 bp, Artificial Sequence
  Synthetic
caccgctgtcccaaaaggtccgcccgctctgtcctcaagctgttccacgtcgatttcgacctgaacatcttcctgtgctgcctgtagaggtggtagggcttcgcgagtcagttctgcttccatatcagcagccagggcct

SEQ ID NO: 12227 - DNA, 140 bp, Artificial Sequence
  Synthetic
aggccctggctgctgatatgcttgggtgcagaagattacgggaggagtaggattaattgttgctgttgctgccttaattttaattgtggtgctatgcgtgtcgtttagcaggcactaaacgaccttttgggacagcggtg

SEQ ID NO: 12228 - DNA, 140 bp, Artificial Sequence
  Synthetic
caccgctgtcccaaaaggtcgtttagtgcctgctaaacgacacgcatagcaccacaattaaaattaaggcagcaacagcaacaattaatcctactcctcccgtaatcttctgcacccaagcatatcagcagccagggcct

SEQ ID NO: 12229 - DNA, 140 bp, Artificial Sequence
  Synthetic
aggccctggctgctgatatgatttaagcttcctaaaagcagccgaactcactttgagacgtaggcatagcataccgaactcttccactattctccgaacccacagggacgtaggagatgtgaccttttgggacagcggtg

SEQ ID NO: 12230 - DNA, 140 bp, Artificial Sequence
  Synthetic
caccgctgtcccaaaaggtcacatctcctacgtccctgtgggttcggagaatagtggaagagttcggtatgctatgcctacgtctcaaagtgagttcggctgcttttaggaagcttaaatcatatcagcagccagggcct

SEQ ID NO: 12231 - DNA, 140 bp, Artificial Sequence
  Synthetic
aggccctggctgctgatatgggccgagtcctagtgccctcaggctatgcaatctcgcctgaagacttccagagtctaagcgaaagcgcaacgatggtgtataacgaaagagagttcgtaagaccttttgggacagcggtg

SEQ ID NO: 12232 - DNA, 140 bp, Artificial Sequence
  Synthetic
caccgctgtcccaaaaggtcttacgaactctctttcgttatacaccatcgttgcgctttcgcttagactctggaagtcttcaggcgagattgcatagcctgagggcactaggactcggcccatatcagcagccagggcct

SEQ ID NO: 12233 - DNA, 140 bp, Artificial Sequence
  Synthetic
aggccctggctgctgatatggaccgagcgacattcaatccgtcaaaactcaggagctacccgaaacagcacgcttaccacgcgccctccatcagaagcgctgtaccgtccccattccagagaccttttgggacagcggtg

SEQ ID NO: 12234 - DNA, 140 bp, Artificial Sequence
  Synthetic
caccgctgtcccaaaaggtctctggaatggggacggtacagcgcttctgatggagggcgcgtggtaagcgtgctgtttcgggtagctcctgagttttgacggattgaatgtcgctcggtccatatcagcagccagggcct

SEQ ID NO: 12235 - DNA, 140 bp, Artificial Sequence
  Synthetic
aggccctggctgctgatatgaaaacataaagttaataaaaatcaaatgaataccataattggcaaacggaagagatgtaggtacttaagcttcctaaaagcagccgaactcacttgagaagaccttttgggacagcggtg

SEQ ID NO: 12236 - DNA, 140 bp, Artificial Sequence
  Synthetic
caccgctgtcccaaaaggtcttctcaagtgagttcggctgcttttaggaagcttaagtacctacatctcttccgtttgccaattatggtattcatttgatttttattaactttatgttttcatatcagcagccagggcct

SEQ ID NO: 12237 - DNA, 140 bp, Artificial Sequence
  Synthetic
aggccctggctgctgatatgtggtggggctgaaccagagaatagtggttaacggcagaacgcaacggaacacgaacaccatgaagaactatctgcttcccgtggtcgcccaggccttcaggaccttttgggacagcggtg

SEQ ID NO: 12238 - DNA, 140 bp, Artificial Sequence
  Synthetic
caccgctgtcccaaaaggtcctgaaggcctgggcgaccacgggaagcagatagttcttcatggtgttcgtgttccgttgcgttctgccgttaaccactattctctggttcagccccaccacatatcagcagccagggcct

SEQ ID NO: 12239 - DNA, 140 bp, Artificial Sequence
  Synthetic
aggccctggctgctgatatgatggattctgtgtacgtggatatagacgctgacagcgcctttttgaaggccctgcaacgtgcgtaccccatgtttgaggtggaacctaggcaggtcacatgaccttttgggacagcggtg

SEQ ID NO: 12240 - DNA, 140 bp, Artificial Sequence
  Synthetic
caccgctgtcccaaaaggtcatgtgacctgcctaggttccacctcaaacatggggtacgcacgttgcagggccttcaaaaaggcgctgtcagcgtctatatccacgtacacagaatccatcatatcagcagccagggcct

SEQ ID NO: 12241 - DNA, 140 bp, Artificial Sequence
  Synthetic
atacgccatgctgggtctcccaaatgaccatgctaatgctagagcgttctcgcatctagccataaaactaatagagcaggaaattgatcccgactcaaccatcctggatataggtagtgccgtacttgggagtcggccat

SEQ ID NO: 12242 - DNA, 140 bp, Artificial Sequence
  Synthetic
atggccgactcccaagtacggcactacctatatccaggatggttgagtcgggatcaatttcctgctctattagttttatggctagatgcgagaacgctctagcattagcatggtcatttgggagacccagcatggcgtat

SEQ ID NO: 12243 - DNA, 140 bp, Artificial Sequence
  Synthetic
atacgccatgctgggtctccgccagcaaggaggatgatgtcggacaggaagtaccactgcgtttgcccgatgcgcagcgcagaagatcccgagagactcgctaattatgcgagaaagctccgtacttgggagtcggccat

SEQ ID NO: 12244 - DNA, 140 bp, Artificial Sequence
  Synthetic
atggccgactcccaagtacggagctttctcgcataattagcgagtctctcgggatcttctgcgctgcgcatcgggcaaacgcagtggtacttcctgtccgacatcatcctccttgctggcggagacccagcatggcgtat

SEQ ID NO: 12245 - DNA, 140 bp, Artificial Sequence
  Synthetic
aggccctggctgctgatatgtgcgcagcgcagaagatcccgagagactcgctaattatgcgagaaagctcgcatctgccgcaggaaaagtcctggacagaaacatttctggaaagatcgggaccttttgggacagcggtg

SEQ ID NO: 12246 - DNA, 140 bp, Artificial Sequence
  Synthetic
caccgctgtcccaaaaggtcccgatctttccagaaatgtttctgtccaggacttttcctgcggcagatgcgagctttctcgcataattagcgagtctctcgggatcttctgcgctgcgcacatatcagcagccagggcct

SEQ ID NO: 12247 - DNA, 140 bp, Artificial Sequence
  Synthetic
aggccctggctgctgatatgaaccgtgcgaccgtgtgctgttctcagtagggtcaacgctttacccggaaagccgcatgctacttaagagctggcacctaccatcggtgttccatctaaagaccttttgggacagcggtg

SEQ ID NO: 12248 - DNA, 140 bp, Artificial Sequence
  Synthetic
caccgctgtcccaaaaggtctttagatggaacaccgatggtaggtgccagctcttaagtagcatgcggctttccgggtaaagcgttgaccctactgagaacagcacacggtcgcacggttcatatcagcagccagggcct

SEQ ID NO: 12249 - DNA, 140 bp, Artificial Sequence
  Synthetic
aggccctggctgctgatatgagccgcatgctacttaagagctggcacctaccatcggtgttccatctaaagggcaagcttagcttcacatgccgctgtgacacagtggtttcgtgtgagggaccttttgggacagcggtg

SEQ ID NO: 12250 - DNA, 140 bp, Artificial Sequence
  Synthetic
caccgctgtcccaaaaggtccctcacacgaaaccactgtgtcacagcggcatgtgaagctaagcttgccctttagatggaacaccgatggtaggtgccagctcttaagtagcatgcggctcatatcagcagccagggcct

SEQ ID NO: 12251 - DNA, 140 bp, Artificial Sequence
  Synthetic
aggccctggctgctgatatggggcaagcttagcttcacatgccgctgtgacacagtggtttcgtgtgagggctacgtcgttaagagaataacgatgagcccaggcctttatggaaaaaccgaccttttgggacagcggtg

SEQ ID NO: 12252 - DNA, 140 bp, Artificial Sequence
  Synthetic
caccgctgtcccaaaaggtcggtttttccataaaggcctgggctcatcgttattctcttaacgacgtagccctcacacgaaaccactgtgtcacagcggcatgtgaagctaagcttgccccatatcagcagccagggcct

SEQ ID NO: 12253 - DNA, 140 bp, Artificial Sequence
  Synthetic
atacgccatgctgggtctccggttaacggcagaacgcaacggaacacgaacaccatgaagaactacctgcttcccgtggtcgcccaggccttcagtaagtgggcgaaggagtgccggaagcgtacttgggagtcggccat

SEQ ID NO: 12254 - DNA, 140 bp, Artificial Sequence
  Synthetic
atggccgactcccaagtacgcttccggcactccttcgcccacttactgaaggcctgggcgaccacgggaagcaggtagttcttcatggtgttcgtgttccgttgcgttctgccgttaaccggagacccagcatggcgtat

SEQ ID NO: 12255 - DNA, 140 bp, Artificial Sequence
  Synthetic
atacgccatgctgggtctccgcggaaatgcccaagaagcccaggatgctgaaaaagaagcagaggaagaacgagaagcagaactgactcatgaggctctaccacccctacaggcagcacacgtacttgggagtcggccat

SEQ ID NO: 12256 - DNA, 140 bp, Artificial Sequence
  Synthetic
atggccgactcccaagtacgtgtgctgcctgtaggggtggtagagcctcatgagtcagttctgcttctcgttcttcctctgcttctttttcagcatcctgggcttcttgggcatttccgcggagacccagcatggcgtat

SEQ ID NO: 12257 - DNA, 140 bp, Artificial Sequence
  Synthetic
aggccctggctgctgatatgggaagatgtccaggtcgaaatcgacgtggaacaacttgaggatagagctggtgctggaataatagagactccgagaggcgctattaaagttactgcccaagaccttttgggacagcggtg

SEQ ID NO: 12258 - DNA, 140 bp, Artificial Sequence
  Synthetic
caccgctgtcccaaaaggtcttgggcagtaactttaatagcgcctctcggagtctctattattccagcaccagctctatcctcaagttgttccacgtcgatttcgacctggacatcttcccatatcagcagccagggcct

SEQ ID NO: 12259 - DNA, 140 bp, Artificial Sequence
  Synthetic
aggccctggctgctgatatgccagagtctaagcgaaagcgcaacgatggtgtacaacgaaagagagttcgtaaacagaaagttacaccacattgcgatgcacggaccagctctgaacactgaccttttgggacagcggtg

SEQ ID NO: 12260 - DNA, 140 bp, Artificial Sequence
  Synthetic
caccgctgtcccaaaaggtcagtgttcagagctggtccgtgcatcgcaatgtggtgtaactttctgtttacgaactctctttcgttgtacaccatcgttgcgctttcgcttagactctggcatatcagcagccagggcct

SEQ ID NO: 12261 - DNA, 140 bp, Artificial Sequence
  Synthetic
atacgccatgctgggtctccgacgaagagtcgtatgagcttgtgagggcagagaggacagaacacgagtacgtctacgacgtggaccagagaagatgctgcaagaaggaagaagctgcagcgtacttgggagtcggccat

SEQ ID NO: 12262 - DNA, 140 bp, Artificial Sequence
  Synthetic
atggccgactcccaagtacgctgcagcttcttccttcttgcagcatcttctctggtccacgtcgtagacgtactcgtgttctgtcctctctgccctcacaagctcatacgactcttcgtcggagacccagcatggcgtat

SEQ ID NO: 12263 - DNA, 140 bp, Artificial Sequence
  Synthetic
atacgccatgctgggtctcctacgaagggctaaaaattcgccccgcttgtccatataaaattgcagttataggagtcttcggggtaccaggatctggtaagtcagccattatcaagaacccgtacttgggagtcggccat

SEQ ID NO: 12264 - DNA, 140 bp, Artificial Sequence
  Synthetic
atggccgactcccaagtacgggttcttgataatggctgacttaccagatcctggtaccccgaagactcctataactgcaattttatatggacaagcggggcgaatttttagcccttcgtaggagacccagcatggcgtat

SEQ ID NO: 12265 - DNA, 140 bp, Artificial Sequence
  Synthetic
atacgccatgctgggtctccgaaatcagcaccgacgtgatgagacagagaggtctagaaatatctgcacgtacggttgattcgctgctcttgaatggatgcaatagaccagtcgacgtgtcgtacttgggagtcggccat

SEQ ID NO: 12266 - DNA, 140 bp, Artificial Sequence
  Synthetic
atggccgactcccaagtacgacacgtcgactggtctattgcatccattcaagagcagcgaatcaaccgtacgtgcagatatttctagacctctctgtctcatcacgtcggtgctgatttcggagacccagcatggcgtat

SEQ ID NO: 12267 - DNA, 140 bp, Artificial Sequence
  Synthetic
aggccctggctgctgatatgatcgccttggtgagaccaagactgaaagttgtactttgtggtgacccgaagcagtgcggcttcttcaatatgatgcagatgaaagtcaactacaatcatagaccttttgggacagcggtg

SEQ ID NO: 12268 - DNA, 140 bp, Artificial Sequence
  Synthetic
caccgctgtcccaaaaggtctatgattgtagttgactttcatctgcatcatattgaagaagccgcactgcttcgggtcaccacaaagtacaactttcagtcttggtctcaccaaggcgatcatatcagcagccagggcct

SEQ ID NO: 12269 - DNA, 140 bp, Artificial Sequence
  Synthetic
aggccctggctgctgatatggcagtgcggcttcttcaatatgatgcagatgaaagtcaactacaatcataacatctgcactcaagtgtaccgcaaaagtatttccaggcggtgtacactggaccttttgggacagcggtg

SEQ ID NO: 12270 - DNA, 140 bp, Artificial Sequence
  Synthetic
caccgctgtcccaaaaggtccagtgtacaccgcctggaaatacttttgcggtacacttgagtgcagatgttatgattgtagttgactttcatctgcatcatattgaagaagccgcactgccatatcagcagccagggcct

SEQ ID NO: 12271 - DNA, 140 bp, Artificial Sequence
  Synthetic
atacgccatgctgggtctccaacctgaccctggagacctcgtgttaacgtgcttcagagggtgggttaaacaactgcaaattgactatcgtggacacgaggtcatgacagcagccgcatccgtacttgggagtcggccat

SEQ ID NO: 12272 - DNA, 140 bp, Artificial Sequence
  Synthetic
atggccgactcccaagtacggatgcggctgctgtcatgacctcgtgtccacgatagtcaatttgcagttgtttaacccaccctctgaagcacgttaacacgaggtctccagggtcaggttggagacccagcatggcgtat

SEQ ID NO: 12273 - DNA, 140 bp, Artificial Sequence
  Synthetic
aggccctggctgctgatatggggaatataacacccatggctagcgtccgattctttagggcagagctgtgtccggtcgtacaagaaacagcggagacgcgtgacacagcaatgtctcttcgaccttttgggacagcggtg

SEQ ID NO: 12274 - DNA, 140 bp, Artificial Sequence
  Synthetic
caccgctgtcccaaaaggtcgaagagacattgctgtgtcacgcgtctccgctgtttcttgtacgaccggacacagctctgccctaaagaatcggacgctagccatgggtgttatattccccatatcagcagccagggcct

SEQ ID NO: 12275 - DNA, 140 bp, Artificial Sequence
  Synthetic
aggccctggctgctgatatgagagagtcacctgggtagcgccactaggtgtccgcggagcggactatacatacaacctagagctgggtctaccggcaacacttggtaggtatgacctagtgaccttttgggacagcggtg

SEQ ID NO: 12276 - DNA, 140 bp, Artificial Sequence
  Synthetic
caccgctgtcccaaaaggtcactaggtcatacctaccaagtgttgccggtagacccagctctaggttgtatgtatagtccgctccgcggacacctagtggcgctacccaggtgactctctcatatcagcagccagggcct

SEQ ID NO: 12277 - DNA, 140 bp, Artificial Sequence
  Synthetic
aggccctggctgctgatatgacccgaaacagcacgcttaccacgcgccctccatcagaagcgctgtaccgtccccattccagaacacactacaaaatgtactggcagcagccacgaaaaggaccttttgggacagcggtg

SEQ ID NO: 12278 - DNA, 140 bp, Artificial Sequence
  Synthetic
caccgctgtcccaaaaggtccttttcgtggctgctgccagtacattttgtagtgtgttctggaatggggacggtacagcgcttctgatggagggcgcgtggtaagcgtgctgtttcgggtcatatcagcagccagggcct

SEQ ID NO: 12279 - DNA, 140 bp, Artificial Sequence
  Synthetic
atacgccatgctgggtctccaaactgcaacgtcacacagatgagggaattacccactttggactcaacagtattcaacgtggagtgtttcaaaaaattcgcatgcaaccaaaaatactggcgtacttgggagtcggccat

SEQ ID NO: 12280 - DNA, 140 bp, Artificial Sequence
  Synthetic
atggccgactcccaagtacgccagtatttttggttgcatgcgaattttttgaaacactccacgttgaatactgttgagtccaaagtgggtaattccctcatctgtgtgacgttgcagtttggagacccagcatggcgtat

SEQ ID NO: 12281 - DNA, 140 bp, Artificial Sequence
  Synthetic
atacgccatgctgggtctccgagcattgaaaccaccatgtatcaccagtaatactgagatgttcttcctatttagcagttttgacaatggcagaaggaattttacaacgcatgttatgaacgtacttgggagtcggccat

SEQ ID NO: 12282 - DNA, 140 bp, Artificial Sequence
  Synthetic
atggccgactcccaagtacgttcataacatgcgttgtaaaattccttctgccattgtcaaaactgctaaataggaagaacatctcagtattactggtgatacatggtggtttcaatgctcggagacccagcatggcgtat

SEQ ID NO: 12283 - DNA, 140 bp, Artificial Sequence
  Synthetic
aggccctggctgctgatatgcagtaggaaccgcaaaaacagttatgtgcggtacatatccagtaatccatgccgtaggaccaaacttctcaaattacacggagtccgaaggggaccgtgagaccttttgggacagcggtg

SEQ ID NO: 12284 - DNA, 140 bp, Artificial Sequence
  Synthetic
caccgctgtcccaaaaggtctcacggtccccttcggactccgtgtaatttgagaagtttggtcctacggcatggattactggatatgtaccgcacataactgtttttgcggttcctactgcatatcagcagccagggcct

SEQ ID NO: 12285 - DNA, 140 bp, Artificial Sequence
  Synthetic
aggccctggctgctgatatgattggcggctgcctatcgagaagtcgcaaaggaagtaactagactgggagtaaatagcgtagctatacctctcctctccacaggtgtatactcaggaggggaccttttgggacagcggtg

SEQ ID NO: 12286 - DNA, 140 bp, Artificial Sequence
  Synthetic
caccgctgtcccaaaaggtcccctcctgagtatacacctgtggagaggagaggtatagctacgctatttactcccagtctagttacttcctttgcgacttctcgataggcagccgccaatcatatcagcagccagggcct

SEQ ID NO: 12287 - DNA, 140 bp, Artificial Sequence
  Synthetic
atacgccatgctgggtctccaaagacaggctaacccagtcactgaaccacctctttacagccatggactcgacggatgcagacgtggtcatctactgccgagacaaggaatgggagaagacgtacttgggagtcggccat

SEQ ID NO: 12288 - DNA, 140 bp, Artificial Sequence
  Synthetic
atggccgactcccaagtacgtcttctcccattccttgtctcggcagtagatgaccacgtctgcatccgtcgagtccatggctgtaaagaggtggttcagtgactgggttagcctgtctttggagacccagcatggcgtat

SEQ ID NO: 12289 - DNA, 140 bp, Artificial Sequence
  Synthetic
aggccctggctgctgatatgggcaggtagaaaaggatacagcaccacggaaggcgcactgtattcatatctagaagggacacgttttcaccagacggcagtggatgtggcagagatacatgaccttttgggacagcggtg

SEQ ID NO: 12290 - DNA, 140 bp, Artificial Sequence
  Synthetic
caccgctgtcccaaaaggtcatgtatctctgccacatccactgccgtctggtgaaaacgtgtcccttctagatatgaatacagtgcgccttccgtggtgctgtatccttttctacctgcccatatcagcagccagggcct

SEQ ID NO: 12291 - DNA, 140 bp, Artificial Sequence
  Synthetic
aggccctggctgctgatatggacaaaatccgcatgcgcggccttcatcggcgacgacaacataatacatggagtcgtctccgatgaattaatggcagccagatgtgccacttggatgaacgaccttttgggacagcggtg

SEQ ID NO: 12292 - DNA, 140 bp, Artificial Sequence
  Synthetic
caccgctgtcccaaaaggtcgttcatccaagtggcacatctggctgccattaattcatcggagacgactccatgtattatgttgtcgtcgccgatgaaggccgcgcatgcggattttgtccatatcagcagccagggcct

SEQ ID NO: 12293 - DNA, 140 bp, Artificial Sequence
  Synthetic
aggccctggctgctgatatgactatgtggccaaagcaaatagaggccaatgagcaagtctgcctatatgccctgggggaaagtattgagtcaatcaggcagaaatgcccggtggatgatggaccttttgggacagcggtg

SEQ ID NO: 12294 - DNA, 140 bp, Artificial Sequence
  Synthetic
caccgctgtcccaaaaggtccatcatccaccgggcatttctgcctgattgactcaatactttcccccagggcatataggcagacttgctcattggcctctatttgctttggccacatagtcatatcagcagccagggcct

SEQ ID NO: 12295 - DNA, 140 bp, Artificial Sequence
  Synthetic
atacgccatgctgggtctccaattgtgtgttcttcatttccccttccaaagtacaagatagaaggagtgcaaaaagtcaaatgctccaaggtaatgttatttgatcacaatgtgccatcgcgtacttgggagtcggccat

SEQ ID NO: 12296 - DNA, 140 bp, Artificial Sequence
  Synthetic
atggccgactcccaagtacgcgatggcacattgtgatcaaataacattaccttggagcatttgactttttgcactccttctatcttgtactttggaaggggaaatgaagaacacacaattggagacccagcatggcgtat

SEQ ID NO: 12297 - DNA, 140 bp, Artificial Sequence
  Synthetic
aggccctggctgctgatatgggtgacgaacaagatgaagatagaagacgagcgctggccgacgaagtgatcagatggcaacgaacagggctaattgatgagctggagaaagcggtatactgaccttttgggacagcggtg

SEQ ID NO: 12298 - DNA, 140 bp, Artificial Sequence
  Synthetic
caccgctgtcccaaaaggtcagtataccgctttctccagctcatcaattagccctgttcgttgccatctgatcacttcgtcggccagcgctcgtcttctatcttcatcttgttcgtcacccatatcagcagccagggcct

SEQ ID NO: 12299 - DNA, 140 bp, Artificial Sequence
  Synthetic
aggccctggctgctgatatgacacccatggctagcgtccgattctttagagcagagcagtgtccgaccgtacaagaaacagcggagacgcgtgacacagctatttcctttcgggcaccgcgaccttttgggacagcggtg

SEQ ID NO: 12300 - DNA, 140 bp, Artificial Sequence
  Synthetic
caccgctgtcccaaaaggtcgcggtgcccgaaaggaaatagctgtgtcacgcgtctccgctgtttcttgtacggtcggacactgctctgctctaaagaatcggacgctagccatgggtgtcatatcagcagccagggcct

SEQ ID NO: 12301 - DNA, 140 bp, Artificial Sequence
  Synthetic
aggccctggctgctgatatgtgctgccgctgcaggatgtaccaatggataggttcacagtagatatgaaaagggacgtgaaggtaactcctggcacaaagcatacagaggaaaggcctaagaccttttgggacagcggtg

SEQ ID NO: 12302 - DNA, 140 bp, Artificial Sequence
  Synthetic
caccgctgtcccaaaaggtcttaggcctttcctctgtatgctttgtgccaggagttaccttcacgtcccttttcatatctactgtgaacctatccattggtacatcctgcagcggcagcacatatcagcagccagggcct

SEQ ID NO: 12303 - DNA, 140 bp, Artificial Sequence
  Synthetic
aggccctggctgctgatatgcgaaaaggaaccggaggaaaccctacgcatgcttgaggacaacgtcatgagacctgggtactatcagctgctacaggcatccttaacatgttctccccacgaccttttgggacagcggtg

SEQ ID NO: 12304 - DNA, 140 bp, Artificial Sequence
  Synthetic
caccgctgtcccaaaaggtcgtggggagaacatgttaaggatgcctgtagcagctgatagtacccaggtctcatgacgttgtcctcaagcatgcgtagggtttcctccggttccttttcgcatatcagcagccagggcct

SEQ ID NO: 12305 - DNA, 140 bp, Artificial Sequence
  Synthetic
atacgccatgctgggtctccgcgctatgatgaaatccggtatgttcctaactctgttcgtcaacacattgttaaatagcaccaacgctagccgggtgttggaagatcgtctgacaaaatccgtacttgggagtcggccat

SEQ ID NO: 12306 - DNA, 140 bp, Artificial Sequence
  Synthetic
atggccgactcccaagtacggattttgtcagacgatcttccaacacccggctagcgttggtgctatttaacaatgtgttgacgaacagagttaggaacataccggatttcatcatagcgcggagacccagcatggcgtat

SEQ ID NO: 12307 - DNA, 140 bp, Artificial Sequence
  Synthetic
aggccctggctgctgatatgtccagatccaacttcgagaagctcagaggacccgtcataaccttgtacggcggtcctaaataggtacgcactacagctacctattttgcaaaagccgacagaccttttgggacagcggtg

SEQ ID NO: 12308 - DNA, 140 bp, Artificial Sequence
  Synthetic
caccgctgtcccaaaaggtctgtcggcttttgcaaaataggtagctgtagtgcgtacctatttaggaccgccgtacaaggttatgacgggtcctctgagcttctcgaagttggatctggacatatcagcagccagggcct

SEQ ID NO: 12309 - DNA, 140 bp, Artificial Sequence
  Synthetic
aggccctggctgctgatatgtaccgaggagatagaggtacacatgcccccagacacccctgatcacacattaatgtcacaacagtccggcaatgtaaagatcacagtcaatggccagacggaccttttgggacagcggtg

SEQ ID NO: 12310 - DNA, 140 bp, Artificial Sequence
  Synthetic
caccgctgtcccaaaaggtccgtctggccattgactgtgatctttacattgccggactgttgtgacattaatgtgtgatcaggggtgtctgggggcatgtgtacctctatctcctcggtacatatcagcagccagggcct

SEQ ID NO: 12311 - DNA, 140 bp, Artificial Sequence
  Synthetic
atacgccatgctgggtctccgcaggtacctaaataccaatcagccataatggagtttatcccaacccaaactttctacaataggaggtaccagcctcgaccttggactccgcgccctactcgtacttgggagtcggccat

SEQ ID NO: 12312 - DNA, 140 bp, Artificial Sequence
  Synthetic
atggccgactcccaagtacgagtagggcgcggagtccaaggtcgaggctggtacctcctattgtagaaagtttgggttgggataaactccattatggctgattggtatttaggtacctgcggagacccagcatggcgtat

SEQ ID NO: 12313 - DNA, 140 bp, Artificial Sequence
  Synthetic
atacgccatgctgggtctccatccaagtcatcagacccagaccgcgtccgcaaaggaaggccgggcaacttgcccagctgatctcagcagttaataaactgacaatgcgcgtggtacctccgtacttgggagtcggccat

SEQ ID NO: 12314 - DNA, 140 bp, Artificial Sequence
  Synthetic
atggccgactcccaagtacggaggtaccacgcgcattgtcagtttattaactgctgagatcagctgggcaagttgcccggccttcctttgcggacgcggtctgggtctgatgacttggatggagacccagcatggcgtat

SEQ ID NO: 12315 - DNA, 140 bp, Artificial Sequence
  Synthetic
atacgccatgctgggtctcccaggcgccacgaaacaatacgaatcaaaagaagcagccccccaaaaagaaaccggttcaaaagaaaaagaagccgggccgcagagagagaatgtgcatgacgtacttgggagtcggccat

SEQ ID NO: 12316 - DNA, 140 bp, Artificial Sequence
  Synthetic
atggccgactcccaagtacgtcatgcacattctctctctgcggcccggcttctttttcttttgaaccggtttctttttggggggctgcttcttttgattcgtattgtttcgtggcgcctgggagacccagcatggcgtat

SEQ ID NO: 12317 - DNA, 140 bp, Artificial Sequence
  Synthetic
aggccctggctgctgatatgtaagaaggaagtcgtgctaaccgtgccgactgaagggctcgaggtcacgtggggcaacaacgagccgtataagtattggccgcagttatctacaaacggtgaccttttgggacagcggtg

SEQ ID NO: 12318 - DNA, 140 bp, Artificial Sequence
  Synthetic
caccgctgtcccaaaaggtcaccgtttgtagataactgcggccaatacttatacggctcgttgttgccccacgtgacctcgagcccttcagtcggcacggttagcacgacttccttcttacatatcagcagccagggcct

SEQ ID NO: 12319 - DNA, 140 bp, Artificial Sequence
  Synthetic
aggccctggctgctgatatgacgttcccctgctcccggcccccttgcacaccctgctgctacgaaaaagagccggagaaaaccttgcgcatgcttgaagacaatgtcatgagccccgggtgaccttttgggacagcggtg

SEQ ID NO: 12320 - DNA, 140 bp, Artificial Sequence
  Synthetic
caccgctgtcccaaaaggtcacccggggctcatgacattgtcttcaagcatgcgcaaggttttctccggctctttttcgtagcagcagggtgtgcaagggggccgggagcaggggaacgtcatatcagcagccagggcct

SEQ ID NO: 12321 - DNA, 140 bp, Artificial Sequence
  Synthetic
aggccctggctgctgatatgcgctagaacgcatcagaaacgaagcgacagacgggacgttgaaaatccaggtttccttgcaaatcggaataaagacggatgatagccatgattggaccaagaccttttgggacagcggtg

SEQ ID NO: 12322 - DNA, 140 bp, Artificial Sequence
  Synthetic
caccgctgtcccaaaaggtcttggtccaatcatggctatcatccgtctttattccgatttgcaaggaaacctggattttcaacgtcccgtctgtcgcttcgtttctgatgcgttctagcgcatatcagcagccagggcct

SEQ ID NO: 12323 - DNA, 140 bp, Artificial Sequence
  Synthetic
aggccctggctgctgatatgcctaatatgctgcatcagaacagctaaagcggccacataccaagaggctgcgatatacctgtggaacgggcagcaacctttgttttggctacaagcccttgaccttttgggacagcggtg

SEQ ID NO: 12324 - DNA, 140 bp, Artificial Sequence
  Synthetic
caccgctgtcccaaaaggtcaagggcttgtagccaaaacaaaggttgctgcccgttccacaggtatatcgcagcctcttggtatgtggccgctttagctgttctgatgcagcatattaggcatatcagcagccagggcct

SEQ ID NO: 12325 - DNA, 140 bp, Artificial Sequence
  Synthetic
atacgccatgctgggtctcctgacggtaggaagatcagtcactcatgtacgcacccatttcaccatgaccctcctgtgataggccgggaaaaattccattcccgaccgcagcacggtaggcgtacttgggagtcggccat

SEQ ID NO: 12326 - DNA, 140 bp, Artificial Sequence
  Synthetic
atggccgactcccaagtacgcctaccgtgctgcggtcgggaatggaatttttcccggcctatcacaggagggtcatggtgaaatgggtgcgtacatgagtgactgatcttcctaccgtcaggagacccagcatggcgtat

SEQ ID NO: 12327 - DNA, 140 bp, Artificial Sequence
  Synthetic
aggccctggctgctgatatgacactgtgagcgcgtacgaacacgtaacagtgatcccgaacacggtgggagtaccgtataagactctagtcaatagacctggctacagccccatggtattgaccttttgggacagcggtg

SEQ ID NO: 12328 - DNA, 140 bp, Artificial Sequence
  Synthetic
caccgctgtcccaaaaggtcaataccatggggctgtagccaggtctattgactagagtcttatacggtactcccaccgtgttcgggatcactgttacgtgttcgtacgcgctcacagtgtcatatcagcagccagggcct

SEQ ID NO: 12329 - DNA, 140 bp, Artificial Sequence
  Synthetic
atacgccatgctgggtctccaagtgcaattgtggtgactcaagtgaaggattaaccactacagataaagtgattaataactgcaaggtcgatcaatgccatgccgcggtcaccaatcacacgtacttgggagtcggccat

SEQ ID NO: 12330 - DNA, 140 bp, Artificial Sequence
  Synthetic
atggccgactcccaagtacgtgtgattggtgaccgcggcatggcattgatcgaccttgcagttattaatcactttatctgtagtggttaatccttcacttgagtcaccacaattgcacttggagacccagcatggcgtat

SEQ ID NO: 12331 - DNA, 140 bp, Artificial Sequence
  Synthetic
aggccctggctgctgatatgcagggtgcctaaagcaagaaaccccaccgtgacgtacgaaaaaaaccaagtcatcatgttgctgtatcctgaccacccaacgctcctgtcctacaggaatgaccttttgggacagcggtg

SEQ ID NO: 12332 - DNA, 140 bp, Artificial Sequence
  Synthetic
caccgctgtcccaaaaggtcattcctgtaggacaggagcgttgggtggtcaggatacagcaacatgatgacttggtttttttcgtacgtcacggtggggtttcttgctttaggcaccctgcatatcagcagccagggcct

SEQ ID NO: 12333 - DNA, 140 bp, Artificial Sequence
  Synthetic
atacgccatgctgggtctcccctatgcaaacggcgaccatgccgtcacagttaaggacgccaaattcattgtggggcctatgtctttagcctggacacctttcgacaacaaaattgtggtcgtacttgggagtcggccat

SEQ ID NO: 12334 - DNA, 140 bp, Artificial Sequence
  Synthetic
atggccgactcccaagtacgaccacaattttgttgtcgaaaggtgtccaggctaaagacataggccccacaatgaatttggcgtccttaactgtgacggcatggtcgccgtttgcataggggagacccagcatggcgtat

SEQ ID NO: 12335 - DNA, 140 bp, Artificial Sequence
  Synthetic
atacgccatgctgggtctcccatcgacataccggaagcggccttcactagggtcgtcggcgcgccctctttaacggacatgtcgtgcgaggtaccagcctgcacccattcctcagactttcgtacttgggagtcggccat

SEQ ID NO: 12336 - DNA, 140 bp, Artificial Sequence
  Synthetic
atggccgactcccaagtacgaaagtctgaggaatgggtgcaggctggtacctcgcacgacatgtccgttaaagagggcgcgccgacgaccctagtgaaggccgcttccggtatgtcgatgggagacccagcatggcgtat

SEQ ID NO: 12337 - DNA, 140 bp, Artificial Sequence
  Synthetic
atacgccatgctgggtctccgcttctgtctgtcaccttggaaccaacgctatcgcttgattacatcacgtgcgagtataaaaccgttatcccgtctccgtacgtgaaatgctgcggtacacgtacttgggagtcggccat

SEQ ID NO: 12338 - DNA, 140 bp, Artificial Sequence
  Synthetic
atggccgactcccaagtacgtgtaccgcagcatttcacgtacggagacgggataacggttttatactcgcacgtgatgtaatcaagcgatagcgttggttccaaggtgacagacagaagcggagacccagcatggcgtat

SEQ ID NO: 12339 - DNA, 140 bp, Artificial Sequence
  Synthetic
aggccctggctgctgatatgatcacgggaggtgtgggactggttgttgctgttgccgcactgattctaatcgtggtactatgcgtgtcgttcagcaggcactaacttgacaattaagtatgaccttttgggacagcggtg

SEQ ID NO: 12340 - DNA, 140 bp, Artificial Sequence
  Synthetic
caccgctgtcccaaaaggtcatacttaattgtcaagttagtgcctgctgaacgacacgcatagtaccacgattagaatcagtgcggcaacagcaacaaccagtcccacacctcccgtgatcatatcagcagccagggcct

SEQ ID NO: 12341 - DNA, 140 bp, Artificial Sequence
  Synthetic
aggccctggctgctgatatggccatcattaaatatgcagccagtaagaaaggcaagtgtgcagtgcactcgatgactaacgccgtcactattcgggaagctgaaatagaagtagaagggagaccttttgggacagcggtg

SEQ ID NO: 12342 - DNA, 140 bp, Artificial Sequence
  Synthetic
caccgctgtcccaaaaggtctcccttctacttctatttcagcttcccgaatagtgacggcgttagtcatcgagtgcactgcacacttgcctttcttactggctgcatatttaatgatggccatatcagcagccagggcct

SEQ ID NO: 12343 - DNA, 75 bp, Artificial Sequence
  Synthetic
tgatcatctgcgaagaaaaaatgtaacacccctacaatggattccgataagattgttttcaaggtaaacaatcaa

SEQ ID NO: 12344 - DNA, 75 bp, Artificial Sequence
  Synthetic
ttggtgtctgttaagccggaggtgatagtagatcagtatgaatataagtaccctgcaatcaaagatcagaggaag

SEQ ID NO: 12345 - DNA, 75 bp, Artificial Sequence
  Synthetic
cctagcattactcttggaaaggccccagatttaaataaagcgtacaagtctatattatctggcatgaacgccgcg

SEQ ID NO: 12346 - DNA, 75 bp, Artificial Sequence
  Synthetic
cagatttaaataaagcgtacaagtctatattatctggcatgaacgccgcgaagttggacccggaagatgtttgct

SEQ ID NO: 12347 - DNA, 75 bp, Artificial Sequence
  Synthetic
tatattatctggcatgaacgccgcgaagttggacccggaagatgtttgctcctacctagcggcagctatggagtt

SEQ ID NO: 12348 - DNA, 75 bp, Artificial Sequence
  Synthetic
gtttgaggggatctgcccagaggactggacaagttacgggattttgattgccagaaaaggagacaaaatcacacc

SEQ ID NO: 12349 - DNA, 75 bp, Artificial Sequence
  Synthetic
tggacaagttacgggattttgattgccagaaaaggagacaaaatcacaccggctactttagttgacataaggagg

SEQ ID NO: 12350 - DNA, 75 bp, Artificial Sequence
  Synthetic
ccagaaaaggagacaaaatcacaccggctactttagttgacataaggaggacagatattgagggtagctgggctc

SEQ ID NO: 12351 - DNA, 75 bp, Artificial Sequence
  Synthetic
tagcaggggggcaggactttaccagagaccctacaatcgcagagcatgcatctctggtgggtcttcttctgagcc

SEQ ID NO: 12352 - DNA, 75 bp, Artificial Sequence
  Synthetic
tctacagattgagcaaaatttcaggtcaaaacacgggaaactacaaaaccaacatcgcagacaggattgagcaga

SEQ ID NO: 12353 - DNA, 75 bp, Artificial Sequence
  Synthetic
tttttgagaccgccccctttgcaaagatcgtagaacatcacacattaatgaccacccacaaaatgtgtgcaaatt

SEQ ID NO: 12354 - DNA, 75 bp, Artificial Sequence
  Synthetic
ggagcacaattccaaactttagatttctggctgggacttatgatatgttcttttctcgagttgaacatttatact

SEQ ID NO: 12355 - DNA, 75 bp, Artificial Sequence
  Synthetic
tctggctgggacttatgatatgttcttttctcgagttgaacatttatactccgcaattcgggtaggtacggtggt

SEQ ID NO: 12356 - DNA, 75 bp, Artificial Sequence
  Synthetic
aacggcttatgaagactgttccggacttgtctcgttcacaggattcatcaagcaaataaacctcactgctaggga

SEQ ID NO: 12357 - DNA, 75 bp, Artificial Sequence
  Synthetic
agcgatactttacttcttccataagaactttgaggaggaaatcaggagaatgtttgagcccggacaagaaactgc

SEQ ID NO: 12358 - DNA, 75 bp, Artificial Sequence
  Synthetic
cgttcctcactcttatttcatccacttcagatcccttgggctcagtggaaagtctccatactcctccaatgcagt

SEQ ID NO: 12359 - DNA, 75 bp, Artificial Sequence
  Synthetic
cggccatgtgtttaatctcattcattttgtgggttgttacatggggcagataagatctttaaatgccactgttat

SEQ ID NO: 12360 - DNA, 75 bp, Artificial Sequence
  Synthetic
atctacttgcgcacctcacgagatgtcagtcttggggggttacctaggggaagagttcttcgggaaagggacatt

SEQ ID NO: 12361 - DNA, 75 bp, Artificial Sequence
  Synthetic
tgagagaagattcttcagagacgagaaagaacttcaggattatgaagcagcagaggccatgaagatagacctcgc

SEQ ID NO: 12362 - DNA, 75 bp, Artificial Sequence
  Synthetic
aaagaacttcaggattatgaagcagcagaggccatgaagatagacctcgcactggcggacgatggaactgtcaat

SEQ ID NO: 12363 - DNA, 75 bp, Artificial Sequence
  Synthetic
cagaggccatgaagatagacctcgcactggcggacgatggaactgtcaattccgatgatgaggattatctctcag

SEQ ID NO: 12364 - DNA, 75 bp, Artificial Sequence
  Synthetic
gggaaacgaggagcccggaggcagtttatacgagaataatgatgaatggaggccgactcaagaagtcacacatca

SEQ ID NO: 12365 - DNA, 75 bp, Artificial Sequence
  Synthetic
ggaggtacatctcagtgagttctaaccatcagtctcgaccgaactcgtttgctgaattcctaaacaagacatact

SEQ ID NO: 12366 - DNA, 75 bp, Artificial Sequence
  Synthetic
cgagtgattcttaactagacgctacaagcctgattcataaactatcaggaaggttgcttcttcttccaagaaaaa

SEQ ID NO: 12367 - DNA, 75 bp, Artificial Sequence
  Synthetic
aagcctgattcataaactatcaggaaggttgcttcttcttccaagaaaaaaactaacacccctccttttgatcca

SEQ ID NO: 12368 - DNA, 75 bp, Artificial Sequence
  Synthetic
tcttcaatatgagcaagatctttgtcaatccgagtgcaatcagagcaggcatggccgatctggaaatggcagagg

SEQ ID NO: 12369 - DNA, 75 bp, Artificial Sequence
  Synthetic
caatccgagtgcaatcagagcaggcatggccgatctggaaatggcagaggagactgtcgacttgataaatcggaa

SEQ ID NO: 12370 - DNA, 75 bp, Artificial Sequence
  Synthetic
cattgaggacaatcaagctcatctccagggtgagcctatagaagtcgacagcctacctgaagagattgggaagct

SEQ ID NO: 12371 - DNA, 75 bp, Artificial Sequence
  Synthetic
agctttgagaataatcccatagacatagatggtaggatgaatgaggacttccaaatggaagaggctgaagatcca

SEQ ID NO: 12372 - DNA, 75 bp, Artificial Sequence
  Synthetic
agtatccagtttcaatcgtatctggacaacataggaatccagattgtaagaaagatgaagaccggggagcgtttc

SEQ ID NO: 12373 - DNA, 75 bp, Artificial Sequence
  Synthetic
ttcaagatttggtcccagactgttgaagagatcatctcttacgttggagccaactttcccaacccttctgggaag

SEQ ID NO: 12374 - DNA, 75 bp, Artificial Sequence
  Synthetic
acgactgagagcaagtcaacccagacgacacccaagaaggtgaagcctgaacccccttcagctccaaccgagaaa

SEQ ID NO: 12375 - DNA, 75 bp, Artificial Sequence
  Synthetic
cgacacccaagaaggtgaagcctgaacccccttcagctccaaccgagaaacccgaacaattgtcaaggaccagca

SEQ ID NO: 12376 - DNA, 75 bp, Artificial Sequence
  Synthetic
tggctcccgagacgacatcaggccccctggccctagactggtcagcaaccaatgatgatgatgatgtctctgtgg

SEQ ID NO: 12377 - DNA, 75 bp, Artificial Sequence
  Synthetic
aggccgagatcgcacatcagattgcagaaagcttctcgaagaagtacaagttcccctccagatcctccggaatat

SEQ ID NO: 12378 - DNA, 75 bp, Artificial Sequence
  Synthetic
tcctgtataactttgagcagctaaagatgaacctcgatgatatagtgaaggaggcgaggggtgtgccaggcatca

SEQ ID NO: 12379 - DNA, 75 bp, Artificial Sequence
  Synthetic
gatgaacctcgatgatatagtgaaggaggcgaggggtgtgccaggcatcatccgtcttgccaaggagggtcttcg

SEQ ID NO: 12380 - DNA, 75 bp, Artificial Sequence
  Synthetic
tccgtcttgccaaggagggtcttcgtctccctctaagatgtatcctcgggtgggttgcatcgtctcactccaaga

SEQ ID NO: 12381 - DNA, 75 bp, Artificial Sequence
  Synthetic
tctccctctaagatgtatcctcgggtgggttgcatcgtctcactccaagaagtttcaactgctggttgggtcaga

SEQ ID NO: 12382 - DNA, 75 bp, Artificial Sequence
  Synthetic
aaagctgagcaagattatgcaggatgatctgaaccgttatatgtcatgttgatctgttctgctatacaagacaaa

SEQ ID NO: 12383 - DNA, 75 bp, Artificial Sequence
  Synthetic
gatctgaaccgttatatgtcatgttgatctgttctgctatacaagacaaactattcagccagcgtcagctgtctt

SEQ ID NO: 12384 - DNA, 75 bp, Artificial Sequence
  Synthetic
ctattcagccagcgtcagctgtcttactcagatcatggaaaaaactgtcaacaccactgataaaatgaacttctt

SEQ ID NO: 12385 - DNA, 75 bp, Artificial Sequence
  Synthetic
acgcaagatagttaggaattgcaaggatgaggacgaccagaagccccctcttgcatctgcgcctccgaatgacga

SEQ ID NO: 12386 - DNA, 75 bp, Artificial Sequence
  Synthetic
cgacctgtggcttccccctcccgaatatgttcctctaaccgagatcaccggtaaaaagaatatgcgaaatttctg

SEQ ID NO: 12387 - DNA, 75 bp, Artificial Sequence
  Synthetic
tatcaatggtgaggtcaagatttgtagtcctaatggttactctttcaggatcttgagacatatcctaaggtcctt

SEQ ID NO: 12388 - DNA, 75 bp, Artificial Sequence
  Synthetic
tgacgagatctactcggggaaccatagaatgattgggctggttaaagtggtcataggtctagcattatctggagc

SEQ ID NO: 12389 - DNA, 75 bp, Artificial Sequence
  Synthetic
agaatgattgggctggttaaagtggtcataggtctagcattatctggagctcctgtcccagaggggatgaattgg

SEQ ID NO: 12390 - DNA, 75 bp, Artificial Sequence
  Synthetic
gtctataagctgaggcggactctgatatttcaatgggcagaatcccgcggtccattggacggagaagagctggaa

SEQ ID NO: 12391 - DNA, 75 bp, Artificial Sequence
  Synthetic
tactctcaggaaatcacatgggatgatgactctgagtttgtcggcctacagataagggtgagtgccagacaatgc

SEQ ID NO: 12392 - DNA, 75 bp, Artificial Sequence
  Synthetic
catattcagggccggatttggtgcatcaacatgaattccagggcatgccagctatggtccgacatgtctctcaaa

SEQ ID NO: 12393 - DNA, 75 bp, Artificial Sequence
  Synthetic
acccaacaatctgaagatgacaaaaatagttctctcctcttagaatagtaatgtcttcttcatgtccactcactg

SEQ ID NO: 12394 - DNA, 75 bp, Artificial Sequence
  Synthetic
gtttacctccgagatggagagtgcacagttttatcttcaacttcttgtgagcaatagaacaaaaacatgttatgg

SEQ ID NO: 12395 - DNA, 75 bp, Artificial Sequence
  Synthetic
gcaatagaacaaaaacatgttatggtgccatactatcgctgcattttatcaagatacctgattacatttacatgt

SEQ ID NO: 12396 - DNA, 75 bp, Artificial Sequence
  Synthetic
gaaatatcccagatgtgaaaaaaacagttaacatccctcgaacattttgggaaaaatgctcctccaagttatcct

SEQ ID NO: 12397 - DNA, 75 bp, Artificial Sequence
  Synthetic
cctcatgtctctgacggccttcttaccgtgtacagggaaattccctctctacacaataccagacaaattaggccc

SEQ ID NO: 12398 - DNA, 75 bp, Artificial Sequence
  Synthetic
ttggagtccgatagacattcatcatttgagctgtccaaacaatttaattgttgaggatgaaggatgtacaagctt

SEQ ID NO: 12399 - DNA, 75 bp, Artificial Sequence
  Synthetic
gtcagggttctcatatatggagttgaaggtcggattcataaccaccatcaaggtcagcggattcacatgcaccgg

SEQ ID NO: 12400 - DNA, 75 bp, Artificial Sequence
  Synthetic
agtcgtgaccgaatcagagacttatactaacttctttggttatgtcactaccactttcaagcgaaaacactttcg

SEQ ID NO: 12401 - DNA, 75 bp, Artificial Sequence
  Synthetic
ccctaccccagagtcttgtagaaaagcatacaactggaaaattgcaggtgaccccagatatgaggagtccttaca

SEQ ID NO: 12402 - DNA, 75 bp, Artificial Sequence
  Synthetic
caacccttacccggattatcactggttgagaacggtcacaacaactaaggaatccctcttgatcatatcacccag

SEQ ID NO: 12403 - DNA, 75 bp, Artificial Sequence
  Synthetic
aatccctcttgatcatatcacccagcgtagtagacatggatccttacgacaaatctctccactcgagaatgttcc

SEQ ID NO: 12404 - DNA, 75 bp, Artificial Sequence
  Synthetic
ctaaagggtcatgctcaggagcctcaatcccttcagttttttgctcaactaatcacgactatacactgtggatgc

SEQ ID NO: 12405 - DNA, 75 bp, Artificial Sequence
  Synthetic
cagaggattccaattccgggatgtcttgcgacatatttacaatgagcaaaggaaaaaaagcgtcaaagggaggca

SEQ ID NO: 12406 - DNA, 75 bp, Artificial Sequence
  Synthetic
ttgcgacatatttacaatgagcaaaggaaaaaaagcgtcaaagggaggcaaggtgtgtgggttcgttgatgaacg

SEQ ID NO: 12407 - DNA, 75 bp, Artificial Sequence
  Synthetic
aggtgtgtgggttcgttgatgaacgtggattgtataaatctttgaagggggcatgtaaactcaagttgtgcggaa

SEQ ID NO: 12408 - DNA, 75 bp, Artificial Sequence
  Synthetic
tctctggtctccgactgatggatgggtcttgggtttccatccagaatcacgaagaggtcaaatggtgctctccca

SEQ ID NO: 12409 - DNA, 75 bp, Artificial Sequence
  Synthetic
atcaattcgtcaacattcatgacttcaatgcagatgagattgaacatcttatagtagaggagttgatcaaggaaa

SEQ ID NO: 12410 - DNA, 75 bp, Artificial Sequence
  Synthetic
gagaagagtgtctagatgcactggagtcaataataactaccaaatcagtcagtttccgacgtctcagtcacctga

SEQ ID NO: 12411 - DNA, 75 bp, Artificial Sequence
  Synthetic
ggaagcttgtaccaggttttggcaaagcttatactatcatcaacaagacactcatggaagccgatgcccattaca

SEQ ID NO: 12412 - DNA, 75 bp, Artificial Sequence
  Synthetic
agcttatactatcatcaacaagacactcatggaagccgatgcccattacaagtcagtcagaacatgggatgagat

SEQ ID NO: 12413 - DNA, 75 bp, Artificial Sequence
  Synthetic
agtcagtcagaacatgggatgagattatcccatccaaaggatgtctaaaagtcagagaaaagtgtcaccctccta

SEQ ID NO: 12414 - DNA, 75 bp, Artificial Sequence
  Synthetic
gtcagagaaaagtgtcaccctcctaacaatggggtgttcttcaatgggatcattttgagtccggacggacaagtt

SEQ ID NO: 12415 - DNA, 75 bp, Artificial Sequence
  Synthetic
ttaatccccgaaatgcagtcatccttgctacaccaacatacagagttacttgaatcctcagttatacctctcatc

SEQ ID NO: 12416 - DNA, 75 bp, Artificial Sequence
  Synthetic
catccactggcagatccatccactatcttcaggggggatgatgaggccgagggattcattgaggtccatcttcca

SEQ ID NO: 12417 - DNA, 75 bp, Artificial Sequence
  Synthetic
gacatccaaaagcaagtctccggaatcgacttgggtctctcagagtgggagagacacttgataataggtatttcg

SEQ ID NO: 12418 - DNA, 75 bp, Artificial Sequence
  Synthetic
gcgataatcctgttcattctagcaataattttcacgatctgttgtagaaggtgcaagaggcggaaaaaggtcaga

SEQ ID NO: 12419 - DNA, 75 bp, Artificial Sequence
  Synthetic
actgatcatatagagctggatcgtaaggtgtcagtgacctctcagagtgggaagtcgatcccttcctgggagtca

SEQ ID NO: 12420 - DNA, 75 bp, Artificial Sequence
  Synthetic
tacaaaatcgagacagggggcaactccagatcatgagtcaccagttgtggacaaggtctttctgacaatcagctc

SEQ ID NO: 12421 - DNA, 75 bp, Artificial Sequence
  Synthetic
acaaggtctttctgacaatcagctctcttcttgacaccggagagcagttccacccatcaatcactcatgagccat

SEQ ID NO: 12422 - DNA, 75 bp, Artificial Sequence
  Synthetic
atgcaatactaagactcacaagaccgaatggctctcacacatcattcctattgatcagacaagattgatttgggt

SEQ ID NO: 12423 - DNA, 75 bp, Artificial Sequence
  Synthetic
ttgatcagacaagattgatttgggtgcaacggtacacagggtcctgtagcaattccaatgatctatggtgcctta

SEQ ID NO: 12424 - DNA, 75 bp, Artificial Sequence
  Synthetic
gcaacggtacacagggtcctgtagcaattccaatgatctatggtgccttagtagaataaaacaaatatattggac

SEQ ID NO: 12425 - DNA, 75 bp, Artificial Sequence
  Synthetic
taatcaagtagaggagaatactaaagaattgcctctttacgctcctccttgtaaatatctacccatttgtcttag

SEQ ID NO: 12426 - DNA, 75 bp, Artificial Sequence
  Synthetic
agtatgactcatcttgttggagagaggaaggttcttccttctagagaaatgtatgttcagcccttgttggtcaat

SEQ ID NO: 12427 - DNA, 75 bp, Artificial Sequence
  Synthetic
tgagacaggagttgggtgcgtatattagcagcaggttgaatcatcatgaccatatgaccatgaaaaaaacatcat

SEQ ID NO: 12428 - DNA, 75 bp, Artificial Sequence
  Synthetic
cccagcaaggggcaacacccctcctcaaaaaaacatccttgtcaggatgattgacccaggtgaggtatatgacga

SEQ ID NO: 12429 - DNA, 75 bp, Artificial Sequence
  Synthetic
caaaaaaacatccttgtcaggatgattgacccaggtgaggtatatgacgatccaattgaccccgtggagcctgaa

SEQ ID NO: 12430 - DNA, 75 bp, Artificial Sequence
  Synthetic
tccaattgaccccgtggagcctgaacccgagctaaaaaccaacaatgcagtcattcccaacatcctcaggaactc

SEQ ID NO: 12431 - DNA, 75 bp, Artificial Sequence
  Synthetic
ggattataatctcaattcccctctgatagaggacccatctaggcttatgttagagtggttaaccaccgggaataa

SEQ ID NO: 12432 - DNA, 75 bp, Artificial Sequence
  Synthetic
atagaggacccatctaggcttatgttagagtggttaaccaccgggaataagcccagtagattgacccttacagac

SEQ ID NO: 12433 - DNA, 75 bp, Artificial Sequence
  Synthetic
aattgcatccgctcctataaaactctgaaatgttactttagaaaagtagacatcggttctgtgaaagtcggaggt

SEQ ID NO: 12434 - DNA, 75 bp, Artificial Sequence
  Synthetic
tctgctgcacaagccatgacatccctatggcttcatggggaacactctgagtcaaacagaagtaggaagtgtcta

SEQ ID NO: 12435 - DNA, 75 bp, Artificial Sequence
  Synthetic
tcagatctcactcagttttatcagaagtcatcaccgatcgagaaacttctaaattacacattggggaacagaggg

SEQ ID NO: 12436 - DNA, 75 bp, Artificial Sequence
  Synthetic
ctcaggataccgccagagggggtccttctctgtttgaagaaagtagattacgataggtctttcgggagatatcta

SEQ ID NO: 12437 - DNA, 75 bp, Artificial Sequence
  Synthetic
cgataggtctttcgggagatatctagcaaacatttactcttcttatctgttttttcatgtcatcgtcctatacat

SEQ ID NO: 12438 - DNA, 75 bp, Artificial Sequence
  Synthetic
gaatgctttagactgggatgaggaaaagactattcttgcattgtggagggatctgaactctgttgacatcaagaa

SEQ ID NO: 12439 - DNA, 75 bp, Artificial Sequence
  Synthetic
agatcaggtcaagtttagagactcaatctggggttccttaatagtcaccaaggaatttgtatattcccaaaactc

SEQ ID NO: 12440 - DNA, 75 bp, Artificial Sequence
  Synthetic
caactgtctgtttgacaggaattatactctgatgctcaaagatcttttcctgtctagattcaactctctgctcat

SEQ ID NO: 12441 - DNA, 75 bp, Artificial Sequence
  Synthetic
actgctttctcctccagaacctagatattctgatgatctaatatctctgctatgccagctttacattgcaggaga

SEQ ID NO: 12442 - DNA, 75 bp, Artificial Sequence
  Synthetic
tattctgatgatctaatatctctgctatgccagctttacattgcaggagatcacgtcttatcgatgtgtggaaac

SEQ ID NO: 12443 - DNA, 75 bp, Artificial Sequence
  Synthetic
tctggatacgatgtgattaaaatgctagaaccgtatgtcataaacagtttggtgcagagagccgaaagttttaga

SEQ ID NO: 12444 - DNA, 75 bp, Artificial Sequence
  Synthetic
ccgttgatacactcattgggagactttcccctattcattagggagaaagtgggacagcttgaaggaacattcggt

SEQ ID NO: 12445 - DNA, 75 bp, Artificial Sequence
  Synthetic
ccaagtgcaagaaggttttttcaagttttggatcaagtggacaacatacacgacctggtttttgtatatggttgt

SEQ ID NO: 12446 - DNA, 75 bp, Artificial Sequence
  Synthetic
tatagacattggggtcatccttatatagactacagaaagggcctgttgaagctgtacgaccaagttcatgtcaaa

SEQ ID NO: 12447 - DNA, 75 bp, Artificial Sequence
  Synthetic
aagatgatagacggggcttatcaagaatgtctggcaagtgacctggcaaaaaggatcctcaggtgggggtttgac

SEQ ID NO: 12448 - DNA, 75 bp, Artificial Sequence
  Synthetic
aagtactctaagtggtatctagaccccaaattattggctccagaccaccctttagctccttacataaaaacacaa

SEQ ID NO: 12449 - DNA, 75 bp, Artificial Sequence
  Synthetic
acatggcccccgaaacacatagttgatcttgttgggaatacatggcataagctccccatcacacaaatctttgag

SEQ ID NO: 12450 - DNA, 75 bp, Artificial Sequence
  Synthetic
ataccagagtctatggatccgtcagaaattttggatgacaagtctcattctttcaccagaacgaaattggcatct

SEQ ID NO: 12451 - DNA, 75 bp, Artificial Sequence
  Synthetic
tggctagcagagaacagaggaggtcctgtccccagtgagaaggtaatcataactgcactttctaaacccccagta

SEQ ID NO: 12452 - DNA, 75 bp, Artificial Sequence
  Synthetic
aaccctagggaattcctaaagtcaatagatctcggaggtctacccgacgacgacttgataataggcttgaaacca

SEQ ID NO: 12453 - DNA, 75 bp, Artificial Sequence
  Synthetic
aaagagagagagttgaagatagagggtcgattcttcgctcttatgtcctggaatttgagactttactttgtaatc

SEQ ID NO: 12454 - DNA, 75 bp, Artificial Sequence
  Synthetic
acagaaaagcttttagcaaattacatactacctctttttgatgccctaactatgacagacaatctaaacaaggta

SEQ ID NO: 12455 - DNA, 75 bp, Artificial Sequence
  Synthetic
tttaagaagttaattgatcgcgtgacgggacagggattgcaagattattctagggtcacttatgcctttcatctg

SEQ ID NO: 12456 - DNA, 75 bp, Artificial Sequence
  Synthetic
gattatgaaaagtggaacaatcatcagaggctggaatcaaccaaagatgtcttttccgtgttagatcaggtgttc

SEQ ID NO: 12457 - DNA, 75 bp, Artificial Sequence
  Synthetic
ggactcaaaaaagtcttctcaaggactcatgagttctttcaaaaatcttggatatattactcagacaggtcagac

SEQ ID NO: 12458 - DNA, 75 bp, Artificial Sequence
  Synthetic
ctgatagggttatgggaggatcagatctactgtctggatatgtctgacggacctacttgctggaacggtcaagat

SEQ ID NO: 12459 - DNA, 75 bp, Artificial Sequence
  Synthetic
ggaggcttggaaggcctccgacaaaagggttggagcctagtaagtctgttgatgatagatagggagtctcaaact

SEQ ID NO: 12460 - DNA, 75 bp, Artificial Sequence
  Synthetic
agggttggagcctagtaagtctgttgatgatagatagggagtctcaaactaggaacacgaggacaaagattctgg

SEQ ID NO: 12461 - DNA, 75 bp, Artificial Sequence
  Synthetic
cgcaaggtgacaatcaagtgctgtgtccgacctatatgttatcatccgggctctcccacgaggggcttttatatg

SEQ ID NO: 12462 - DNA, 75 bp, Artificial Sequence
  Synthetic
tctctcgatttacagagcgatagaagatggagcatctaaattgggccttattataaagaaggaagaaacaatgtg

SEQ ID NO: 12463 - DNA, 75 bp, Artificial Sequence
  Synthetic
cagttatgacttccttatctatggtaaaacacctctcttccgaggcaatatactggtccccgaatctaagagatg

SEQ ID NO: 12464 - DNA, 75 bp, Artificial Sequence
  Synthetic
aaaacacctctcttccgaggcaatatactggtccccgaatctaagagatgggctcgagtttcttgtatctctaat

SEQ ID NO: 12465 - DNA, 75 bp, Artificial Sequence
  Synthetic
ggctcgagtttcttgtatctctaatgatcagatagtcaatctcgccaatattatgtcgactgtatcaactaatgc

SEQ ID NO: 12466 - DNA, 75 bp, Artificial Sequence
  Synthetic
cttgactgtggctcaacactctcagtctttgatcaaacccatgagggattttctgctcatggctgtccaggcagt

SEQ ID NO: 12467 - DNA, 75 bp, Artificial Sequence
  Synthetic
gtttcattatttgcttttcagccccatcttaaaagggagggtgtacaagattttgagtgccgaaggagatgattt

SEQ ID NO: 12468 - DNA, 75 bp, Artificial Sequence
  Synthetic
atcttaaaagggagggtgtacaagattttgagtgccgaaggagatgatttcctccttgccatgtcacgcattgtt

SEQ ID NO: 12469 - DNA, 75 bp, Artificial Sequence
  Synthetic
tatttggacccatccctcggaggagtctctggaatgtctttaggaaggttccacatccgccagttttccgatcct

SEQ ID NO: 12470 - DNA, 75 bp, Artificial Sequence
  Synthetic
gtttcagagggtctatccttttggaaagagatttggaccagttcatcagagtcatggattcactctctatgtcaa

SEQ ID NO: 12471 - DNA, 75 bp, Artificial Sequence
  Synthetic
gtcatggattcactctctatgtcaagaagcaggcaacccggatttgggtgatagaagcttagagagttttacccg

SEQ ID NO: 12472 - DNA, 75 bp, Artificial Sequence
  Synthetic
cttgctagaggaccctaccactctaaacatcagaggaggggcaagtcccaccattcttctaaaagatgccatcag

SEQ ID NO: 12473 - DNA, 75 bp, Artificial Sequence
  Synthetic
gaaagctctctatgatgaggttgataaggtggaaaattccgaattcagggaggctatcttgttgtcgaagaccca

SEQ ID NO: 12474 - DNA, 75 bp, Artificial Sequence
  Synthetic
tagagataacttcatcctcttcctcaaatcgatcgagccgttgttccctaggtttcttagcgaactttttagctc

SEQ ID NO: 12475 - DNA, 75 bp, Artificial Sequence
  Synthetic
aaatcgatcgagccgttgttccctaggtttcttagcgaactttttagctcttctttcctgggcatacctgagtcc

SEQ ID NO: 12476 - DNA, 75 bp, Artificial Sequence
  Synthetic
ataattggactcattcaaaattcaagaacaatcagacgacaattcagacgaagcctttctaggtctttagaagag

SEQ ID NO: 12477 - DNA, 75 bp, Artificial Sequence
  Synthetic
tccttttacaactccgagattcacggaataagcagaatgacccaggtccctcaaaggataggaagagtgtggtct

SEQ ID NO: 12478 - DNA, 75 bp, Artificial Sequence
  Synthetic
tcaaaggataggaagagtgtggtcttgttcctcagagagagccgatttgttgagggagatttcttggggacgaaa

SEQ ID NO: 12479 - DNA, 75 bp, Artificial Sequence
  Synthetic
agtggttggaactactgttccgcatccgtcggaaatgttagccttactgccaaagtcctcaatctcttgtccatg

SEQ ID NO: 12480 - DNA, 75 bp, Artificial Sequence
  Synthetic
tggtttaacagggagtgagaatccgagagtatcggtttctgtgttaccttcatttgatcagtcctttttctccag

SEQ ID NO: 12481 - DNA, 75 bp, Artificial Sequence
  Synthetic
aggtcccttaaaaggataccttggatcatcgacatctatgtcaactcaattgtttcatgcttgggagaaggtgac

SEQ ID NO: 12482 - DNA, 75 bp, Artificial Sequence
  Synthetic
aaatgtccatgtagttaagagggctctgtcgcttaaagaatccattaactggtttatatctcgaaattcgaatct

SEQ ID NO: 12483 - DNA, 75 bp, Artificial Sequence
  Synthetic
agcccagactctgatcagaaatataatctctctaacaggcccccagttccctctagaggaagccccagtgttcaa

SEQ ID NO: 12484 - DNA, 75 bp, Artificial Sequence
  Synthetic
gaggacaggatccgcactacacaggtttaagtctgccagatatagcgagggaggttactcatcaatctgtcctaa

SEQ ID NO: 12485 - DNA, 75 bp, Artificial Sequence
  Synthetic
tttgttgtcccatatctccgtcagcacagatactatgtcagaccttacacatgatggcaggaatttcgacttcat

SEQ ID NO: 12486 - DNA, 75 bp, Artificial Sequence
  Synthetic
gtttcaacccctaatgctttatgcccagacgtggacctcagagcttgttcaaaaggacatcagattgaaagattc

SEQ ID NO: 12487 - DNA, 75 bp, Artificial Sequence
  Synthetic
aaaaggacatcagattgaaagattctacttttcattggcatcttcgctgtccaaaatgcatcagatcaatagatg

SEQ ID NO: 12488 - DNA, 75 bp, Artificial Sequence
  Synthetic
acgtcattctggacaccccccaggtatttgatttccccgatgtatccaaaaggatctcaagaatggtgtctggcg

SEQ ID NO: 12489 - DNA, 75 bp, Artificial Sequence
  Synthetic
ctgtacctcagtttcagaaacttcccgaggtcaacttgaaaccaggtcactttgagtctctatgtggcaaggata

SEQ ID NO: 12490 - DNA, 75 bp, Artificial Sequence
  Synthetic
tttgagtctctatgtggcaaggataagtcccgacatatcggctcagctcagggtttgctatattctatcttggtt

SEQ ID NO: 12491 - DNA, 75 bp, Artificial Sequence
  Synthetic
gccacccatgatcctgggtacaatgatggcaccatattcccagtgaacatctacggtaagatatctcctaaagat

SEQ ID NO: 12492 - DNA, 75 bp, Artificial Sequence
  Synthetic
tacctcagagggcttgcaaggggcatcttgattggctcgtctatttgttttttgacaaggatgacaaatattaac

SEQ ID NO: 12493 - DNA, 75 bp, Artificial Sequence
  Synthetic
aaggcttgacaaccacccatcgttatatgtcatgcttcgtgagccatctctcagatcagagattttctcgatccc

SEQ ID NO: 12494 - DNA, 75 bp, Artificial Sequence
  Synthetic
tcagaaaataccggctgcatatccaaccacaatgaaggagggcaacagatctgtgttgtgttatttacaacatgt

SEQ ID NO: 12495 - DNA, 75 bp, Artificial Sequence
  Synthetic
ctgtgttgtgttatttacaacatgtactccgttatgagagagatataatcacatcatcacccgaaaatgactggc

SEQ ID NO: 12496 - DNA, 75 bp, Artificial Sequence
  Synthetic
acatcatcacccgaaaatgactggctctggatcttctctgactttaggagcatgaagatgacttatctgacctta

SEQ ID NO: 12497 - DNA, 75 bp, Artificial Sequence
  Synthetic
ataacataccagtcccacatcttccttcaaaggatagaaaggagcttatctaagaaaatgagggctgatctcagg

SEQ ID NO: 12498 - DNA, 75 bp, Artificial Sequence
  Synthetic
cagttgagttcacttatgcgacaggttctggggggtcatggagaagacaccttggattctggagaagatatccaa

SEQ ID NO: 12499 - DNA, 75 bp, Artificial Sequence
  Synthetic
ttctggggggtcatggagaagacaccttggattctggagaagatatccaaagattgttaagagatgctatccaaa

SEQ ID NO: 12500 - DNA, 75 bp, Artificial Sequence
  Synthetic
gaaccaagtgggttgatcaggaagtccgccatgccgccaagaccatgactaacgatcacagcccctccaagaaaa

SEQ ID NO: 12501 - DNA, 75 bp, Artificial Sequence
  Synthetic
catctaggaaagtcgggtgctctgagtggatatgctcggctcagcaagtttcaatctccacctcttcaaatcctg

SEQ ID NO: 12502 - DNA, 75 bp, Artificial Sequence
  Synthetic
tcaatctccacctcttcaaatcctgcccctgtctcagagatggatgtaagaactctttctcgaaaacttcaaaac

SEQ ID NO: 12503 - DNA, 75 bp, Artificial Sequence
  Synthetic
ccccttatttcgggactaagagtagttcaatgtgcaacaggagcccattacaagctcaaaccaatcctggacaat

SEQ ID NO: 12504 - DNA, 75 bp, Artificial Sequence
  Synthetic
ctgaatacttacccttctttttgtttggtggtgggtgatgggtcagggggaatctcaagaaccgtcctaaacatg

SEQ ID NO: 12505 - DNA, 75 bp, Artificial Sequence
  Synthetic
ttccctgatgccaagttggtgttcaacagcctgttagaagtgagtgacctcatggcttcagggactcacccgtta

SEQ ID NO: 12506 - DNA, 75 bp, Artificial Sequence
  Synthetic
cctccctccgcaatcatgagcggaggcgaggatattacatctagggttattgactttgaatcaatttgggagaag

SEQ ID NO: 12507 - DNA, 75 bp, Artificial Sequence
  Synthetic
ccatctgacttgcgaaatctgtctacatggagatatttccaatcagtccaaagtcagttaaacatgtcatacgac

SEQ ID NO: 12508 - DNA, 75 bp, Artificial Sequence
  Synthetic
ctgataatctgtgacgcagaggtaacagacatagcatctgtgaacaagataacattacttatgtcagattttgtt

SEQ ID NO: 12509 - DNA, 75 bp, Artificial Sequence
  Synthetic
cagacatagcatctgtgaacaagataacattacttatgtcagattttgttctgtctatagatggacccgtagact

SEQ ID NO: 12510 - DNA, 75 bp, Artificial Sequence
  Synthetic
aacattacttatgtcagattttgttctgtctatagatggacccgtagacttgatattcaagtcatatgggtctat

SEQ ID NO: 12511 - DNA, 75 bp, Artificial Sequence
  Synthetic
gttggtggacccggactataaagcaattcaacatctctccagggctttcccccaggtgactggatacattactca

SEQ ID NO: 12512 - DNA, 75 bp, Artificial Sequence
  Synthetic
attcaacatctctccagggctttcccccaggtgactggatacattactcaactaacatcttccttctcgtcagaa

SEQ ID NO: 12513 - DNA, 75 bp, Artificial Sequence
  Synthetic
ctgtatttaaggttttctaaaagggggaaattctttagagacgctgaatatttgacctcctccactttaagggaa

SEQ ID NO: 12514 - DNA, 75 bp, Artificial Sequence
  Synthetic
atgagccttgttctattcaattgtagcagtcccaagagtgagctccagagagctcgctcactaaactaccaggac

SEQ ID NO: 12515 - DNA, 75 bp, Artificial Sequence
  Synthetic
gcagtcccaagagtgagctccagagagctcgctcactaaactaccaggacttagtaagaggttttcccgaggaga

SEQ ID NO: 12516 - DNA, 75 bp, Artificial Sequence
  Synthetic
ttgtgtctaacccgtataatgaaatgatcataactctgatagacagtgaggtcgagtcattcttagttcacaaaa

SEQ ID NO: 12517 - DNA, 75 bp, Artificial Sequence
  Synthetic
gtcgagtcattcttagttcacaaaatggtagatgatctagagctgcaaagaggaaccctatcaagaatgtcaatt

SEQ ID NO: 12518 - DNA, 75 bp, Artificial Sequence
  Synthetic
aggaaccctatcaagaatgtcaattatcatagccatcgtgatagtgtattctaacagggtgttcaacgtgtctaa

SEQ ID NO: 12519 - DNA, 75 bp, Artificial Sequence
  Synthetic
gccgcttaatgatcccttgttttatcccccctcggacccaaagatcttaagacacttcaacatctgttgcagcac

SEQ ID NO: 12520 - DNA, 75 bp, Artificial Sequence
  Synthetic
gacacttcaacatctgttgcagcacaatgatgtacctatccacagttctgggagatgtcccaaactttgctaggc

SEQ ID NO: 12521 - DNA, 75 bp, Artificial Sequence
  Synthetic
aatgatgtacctatccacagttctgggagatgtcccaaactttgctaggctgcatgagttatataatggccccat

SEQ ID NO: 12522 - DNA, 75 bp, Artificial Sequence
  Synthetic
cacttattattttaaaaagcagataattagaggaagcatatatctgtcttggagttggtcagatgatacctcggt

SEQ ID NO: 12523 - DNA, 75 bp, Artificial Sequence
  Synthetic
gttcaagagggtgtcttgcaactcaaacctcagcttgtcatcccactggattcgattgatttacaaaatagtcaa

SEQ ID NO: 12524 - DNA, 75 bp, Artificial Sequence
  Synthetic
aacgacccgtctgacagggagtccagttgacttgtcaaaggaagtcgagaaacacttgagaggatataatagatg

SEQ ID NO: 12525 - DNA, 75 bp, Artificial Sequence
  Synthetic
gatggataaccctcaatgatgtgaaatctaggtcctctcttctggattacagctgtctttgatgcaagcctctca

SEQ ID NO: 12526 - DNA, 75 bp, Artificial Sequence
  Synthetic
acgcttaacgacaaaaccagagaaggagtagacatgatcatttgcgaagcaaaaatgtaacacccctacaatgga

SEQ ID NO: 12527 - DNA, 75 bp, Artificial Sequence
  Synthetic
ttctgataagattgtctttaaggtcaacaatcagttggtgtctgttaagccggaggtgatagtagatcaatatga

SEQ ID NO: 12528 - DNA, 75 bp, Artificial Sequence
  Synthetic
gtacaaatatcccgctatcaaagaccaaaagaagcctagtataactcttgggaaggctccagatttaaataaggc

SEQ ID NO: 12529 - DNA, 75 bp, Artificial Sequence
  Synthetic
atataagtccatattatcgggaatgaatgctgcaaagctggaccccgatgatgtatgttcttacttagctgcagc

SEQ ID NO: 12530 - DNA, 75 bp, Artificial Sequence
  Synthetic
tatggagttatttgagggggtctgcccagaagattggacgagttatgggattttgattgccagaaaaggagataa

SEQ ID NO: 12531 - DNA, 75 bp, Artificial Sequence
  Synthetic
aattacaccagccacccttgttgacataaagagaacagatattgagggcaattgggcattgacgggaggacaaga

SEQ ID NO: 12532 - DNA, 75 bp, Artificial Sequence
  Synthetic
cttgaccagggatcccacagtagcagaacatgcttctctagtaggtcttcttctaagcctttataggttaagcaa

SEQ ID NO: 12533 - DNA, 75 bp, Artificial Sequence
  Synthetic
gatatcaggccagaacacaggaaattataagaccaacattgcagatagaatagaacagatttttgaaactgcccc

SEQ ID NO: 12534 - DNA, 75 bp, Artificial Sequence
  Synthetic
ttttgcaaagattgtggaacatcacacgttaatgactactcataagatgtgtgcaaactggagtacgatcccaaa

SEQ ID NO: 12535 - DNA, 75 bp, Artificial Sequence
  Synthetic
ttttagatttttggccggaacttatgacatgttcttttctcgagttgagcacttatactctgcaattcgagtagg

SEQ ID NO: 12536 - DNA, 75 bp, Artificial Sequence
  Synthetic
gacggtggtaaccgcttatgaagattgttctggacttgtctcgtttacagggtttatcaaacagatcaacctcac

SEQ ID NO: 12537 - DNA, 75 bp, Artificial Sequence
  Synthetic
tgctagggaagcaatactatatttcttccataagaacttcgaagaagaaattagaagaatgtttgaacccggaca

SEQ ID NO: 12538 - DNA, 75 bp, Artificial Sequence
  Synthetic
agagactgctgttcctcactcttatttcatccatttcagatctctaggacttagcggaaagtccccttactcctc

SEQ ID NO: 12539 - DNA, 75 bp, Artificial Sequence
  Synthetic
caatgcagttggccatgtgttcaatctcatccatttcgtgggatgttacatgggccagataagatctttgaatgc

SEQ ID NO: 12540 - DNA, 75 bp, Artificial Sequence
  Synthetic
gactgtcatatccacctgtgctcctcatgagatgtctgttttgggaggctatcttggggaggagtttttcgggaa

SEQ ID NO: 12541 - DNA, 75 bp, Artificial Sequence
  Synthetic
ggggacgtttgaacggagattcttcagaaatgagaaagaactgcaagattatgaggcagcagagtctatgaaaac

SEQ ID NO: 12542 - DNA, 75 bp, Artificial Sequence
  Synthetic
agacattgctttggcagatgatgcaacagtcaactcagatgatgaggattacttttcaggagaaacaagaggtcc

SEQ ID NO: 12543 - DNA, 75 bp, Artificial Sequence
  Synthetic
agaggcagtttatacaagaataatgatgaatgggggtcgacttaaaaggtcacacattaggagatacatctcagt

SEQ ID NO: 12544 - DNA, 75 bp, Artificial Sequence
  Synthetic
cagctccaaccatcagtcccgaccgaactcatttgcggagtttctcaacaagacatattcaagtgactcgtaatc

SEQ ID NO: 12545 - DNA, 75 bp, Artificial Sequence
  Synthetic
agatgtgtcagatcttgcccctaaattattgagaacatcacctcatcttacaagaaaaaaactaacacccctcct

SEQ ID NO: 12546 - DNA, 75 bp, Artificial Sequence
  Synthetic
ttcgatccatcttcgctatgagcaagatctttgtcaatccgagtgcgatcagggcaggcatggccgacctggaaa

SEQ ID NO: 12547 - DNA, 75 bp, Artificial Sequence
  Synthetic
tggcagaggagactgttgatttgataaacagaaacattgaggataatcaagcacatcttcagggggagcctattg

SEQ ID NO: 12548 - DNA, 75 bp, Artificial Sequence
  Synthetic
aggttgacagtctccccgaggatatcaaaaagcttgatattagtgaaggaagatccaaaagtttagtggataatc

SEQ ID NO: 12549 - DNA, 75 bp, Artificial Sequence
  Synthetic
ctcaggatgttgagtgcaggatgagtgaggacttccaaatggacgaagttgaagacccgaacatccaatttcagt

SEQ ID NO: 12550 - DNA, 75 bp, Artificial Sequence
  Synthetic
cttacttggacaatataggaatccagatcgtcagaaagatgagaactggggagcgattctttaaaatctggtccc

SEQ ID NO: 12551 - DNA, 75 bp, Artificial Sequence
  Synthetic
aaactgtagaagagatcatttcttatgtgggggtcaactttcccagccaatcagggaagacaaccgagaataaat

SEQ ID NO: 12552 - DNA, 75 bp, Artificial Sequence
  Synthetic
ccactcagacaacccccaagaaagtcaaaactgagccctcctcaactccagccaaaagatcagatcaactgtcca

SEQ ID NO: 12553 - DNA, 75 bp, Artificial Sequence
  Synthetic
aaactgagatggctgccaagacagcctctggcccccctgccttagaatggtctacaaccaatgatgaggatgatg

SEQ ID NO: 12554 - DNA, 75 bp, Artificial Sequence
  Synthetic
tctccgtggaagccgaaattgcacatcaaattgcagagagcttctcaaagaagtacaagttcccctctagatcat

SEQ ID NO: 12555 - DNA, 75 bp, Artificial Sequence
  Synthetic
ctggaatattcctgtacaacttcgagcaattgaagatgaatctcgatgatatagtgaaggaagctaagagtgttc

SEQ ID NO: 12556 - DNA, 75 bp, Artificial Sequence
  Synthetic
ctggtgttaccagccttgccagagatggtctccggcttcctctcaggtgtatacttggatgggttggatcttctc

SEQ ID NO: 12557 - DNA, 75 bp, Artificial Sequence
  Synthetic
actccaaaaagtttcaactactggttgggtcagaaaaattgaacaagattatgcaggatgatctgaaccgttaca

SEQ ID NO: 12558 - DNA, 75 bp, Artificial Sequence
  Synthetic
tgtcatgttaatccgtcctgttacacagctcaaactttccggtggatatccgctgtttgaagtaattcatgagaa

SEQ ID NO: 12559 - DNA, 75 bp, Artificial Sequence
  Synthetic
aaactgtcaacaccactgataaaatgaactttctccgcaagatagtcaggaattgcaaggatgaggatgatcaga

SEQ ID NO: 12560 - DNA, 75 bp, Artificial Sequence
  Synthetic
agcccccactggtatctgctccaccagatgatgatgatctatggcttcctcctccagagtatgttcctctgaccg

SEQ ID NO: 12561 - DNA, 75 bp, Artificial Sequence
  Synthetic
agatcactggtaagaggaacatgcgaaacttttgtatcaatggagaggtcaaagtctgtagtcctaatggttatt

SEQ ID NO: 12562 - DNA, 75 bp, Artificial Sequence
  Synthetic
cctttaggattttaagacacattttgaaatcgtttgacgagatttactctggaaaccatagaatgatcgggctgg

SEQ ID NO: 12563 - DNA, 75 bp, Artificial Sequence
  Synthetic
tcaaggtggtcataggtctggctctgtctggagctcccgttccggaaggaatgaattgggtctacaaattgagga

SEQ ID NO: 12564 - DNA, 75 bp, Artificial Sequence
  Synthetic
gaaccctgatatttcaatgggctgaatctcgtgggccgctagacggggaagaattggaatattctcaagagataa

SEQ ID NO: 12565 - DNA, 75 bp, Artificial Sequence
  Synthetic
catgggatgatgattcagagtttataggcctgcagataagagtgagtgcgaggcaatgccatattcagggccgga

SEQ ID NO: 12566 - DNA, 75 bp, Artificial Sequence
  Synthetic
tttggtgcatcaatatgaactcccgggcatgccagctatggtctgacatgtctctcaaaactcagcagtctgaag

SEQ ID NO: 12567 - DNA, 75 bp, Artificial Sequence
  Synthetic
aggacaagaacagttctctcctgttagagtagtgatttccccctcatgtctactcactgatttacctctgagatg

SEQ ID NO: 12568 - DNA, 75 bp, Artificial Sequence
  Synthetic
tactcactgatttacctctgagatggagaatgcacagttttatcttcaacttcctgtgagcaatagaacaaaaac

SEQ ID NO: 12569 - DNA, 75 bp, Artificial Sequence
  Synthetic
atgttatggtgccatacaatcgctgcattttatcaagatacctgattacatttacatgtgaaacctcccagatgt

SEQ ID NO: 12570 - DNA, 75 bp, Artificial Sequence
  Synthetic
gaaaaaaacagttaacacccctcgaacattctgagaaagatgctccttcaaattgtcctccttatgtccctgatg

SEQ ID NO: 12571 - DNA, 75 bp, Artificial Sequence
  Synthetic
gtcttctcaccatgccctgggaaattccctctctacacaatacccgacaaattgggcccttggagcccgatagat

SEQ ID NO: 12572 - DNA, 75 bp, Artificial Sequence
  Synthetic
attcatcatttgagctgtccaaacaacctgattgttgaggatgagggatgcacgagcctgtccgggttttcatat

SEQ ID NO: 12573 - DNA, 75 bp, Artificial Sequence
  Synthetic
atggagctaaaggttgggtttataaccactataaaggttagcgggtttacctgcactggagttgtgactgagtca

SEQ ID NO: 12574 - DNA, 75 bp, Artificial Sequence
  Synthetic
gagacctacactaacttctttgggtatgtcacgactactttcaagaggaaacactttcgtcctaccccggagttt

SEQ ID NO: 12575 - DNA, 75 bp, Artificial Sequence
  Synthetic
tgtaggaatgcgtacaactggaaagttgcaggtgaccccaggtatgaggagtctctgcacaacccttatccagac

SEQ ID NO: 12576 - DNA, 75 bp, Artificial Sequence
  Synthetic
tatcactggttgagaacagttacaaccactaaggagtctctcttgatcatatcacccagtgtagtcgacatggac

SEQ ID NO: 12577 - DNA, 75 bp, Artificial Sequence
  Synthetic
ccctatgacaaatccttgcattcgaaaatgttccctaaaggcacatgctcgggagcctcggtcccttcgattttc

SEQ ID NO: 12578 - DNA, 75 bp, Artificial Sequence
  Synthetic
tgctccactaatcatgattacacattgtggatgcctgagaatcctaaaccaggaatgtcatgtgacatctttaca

SEQ ID NO: 12579 - DNA, 75 bp, Artificial Sequence
  Synthetic
acaagcaaaggaaagaaagcatcgaagggaggtaaggtgtgcgggttcgttgacgaacgtggattgtacaaatct

SEQ ID NO: 12580 - DNA, 75 bp, Artificial Sequence
  Synthetic
ctgaagggagcatgcaaacttaagttgtgcggaatctctggtctcaggcttatggacgggtcttgggtctccatc

SEQ ID NO: 12581 - DNA, 75 bp, Artificial Sequence
  Synthetic
caaaatcatgaggaggccaaatggtgctctcctgatcagttggtaaatattcatgactttcattcagacgagata

SEQ ID NO: 12582 - DNA, 75 bp, Artificial Sequence
  Synthetic
gaacacttaattgtagaagaactggtcaggaagagagaagaatgtttggatgcactggagtcaataatgactacc

SEQ ID NO: 12583 - DNA, 75 bp, Artificial Sequence
  Synthetic
aaatcagtcagttttagacgtctcagccacctaaggaagcttgtgccaggattcgggaaggcttataccattgtc

SEQ ID NO: 12584 - DNA, 75 bp, Artificial Sequence
  Synthetic
aacaaaacactcatggaggctgatgcacactataaatcagtcagaacatggaatgagatcataccatctaaaggg

SEQ ID NO: 12585 - DNA, 75 bp, Artificial Sequence
  Synthetic
tgtctaaaggttagagagaggtgtcatcctccttataacggggtgttctttaacgggatcattttaagtccagac

SEQ ID NO: 12586 - DNA, 75 bp, Artificial Sequence
  Synthetic
ggacatgtcttaattccggagatgcagtcctccttgctacaacagcacgttgagctacttgaatcatcagtaata

SEQ ID NO: 12587 - DNA, 75 bp, Artificial Sequence
  Synthetic
cctcttatccatcctctggcagatccgtccactgtctttaaaagagatgatgaagcagaagacttcatagaagtc

SEQ ID NO: 12588 - DNA, 75 bp, Artificial Sequence
  Synthetic
caccttcccgatgtccaaaagcaggtctccgggatcgacttgggtctctcggagtgggagagatatctgatcatc

SEQ ID NO: 12589 - DNA, 75 bp, Artificial Sequence
  Synthetic
ggggcttctgctgtagtcctgtttgctctggcaataatttttgcagtttgttgcagaaggtgtaagagacggaaa

SEQ ID NO: 12590 - DNA, 75 bp, Artificial Sequence
  Synthetic
aaggccagaactgatcgtatagagttagaccgtaaagtgtcagtaacatctcaaagtgggaaggtgatcccttct

SEQ ID NO: 12591 - DNA, 75 bp, Artificial Sequence
  Synthetic
tgggaatcctacaaaattgaagccggaggtcatttcagatcgtgagatactggtttcaggtcaatttttaggaca

SEQ ID NO: 12592 - DNA, 75 bp, Artificial Sequence
  Synthetic
atcaactctcctcataacagtagagagcggtccaactcattgattgttcatgagccatatgcaatactgagatct

SEQ ID NO: 12593 - DNA, 75 bp, Artificial Sequence
  Synthetic
acaatactgtgtggctcccatacatcatccctattaatcagataagattgatttgggtgtaacggtacatagggt

SEQ ID NO: 12594 - DNA, 75 bp, Artificial Sequence
  Synthetic
cctgcagcaatttcaatgatctatggtgctttagcagaataagagcaattaaaatggactaatcaagcagaggag

SEQ ID NO: 12595 - DNA, 75 bp, Artificial Sequence
  Synthetic
aatactagagaactgcctaattttcccttccccttgtaaatatgcctatctgttttagtgtgctacccattttat

SEQ ID NO: 12596 - DNA, 75 bp, Artificial Sequence
  Synthetic
caaagaaagaaaattttccttctctgggggatagtatctatgcagtccccgttgattacataaaataagagtcaa

SEQ ID NO: 12597 - DNA, 75 bp, Artificial Sequence
  Synthetic
atgtacataccagaaacgggtcgaatcatcctaatcatgtaaccatgaaaaaaacattgcctcagtaaggaataa

SEQ ID NO: 12598 - DNA, 75 bp, Artificial Sequence
  Synthetic
cattcctcctcagaaacatcattccaaaatgattgaccctggtgaggtgtatgacgatccaatcgaccccgtcga

SEQ ID NO: 12599 - DNA, 75 bp, Artificial Sequence
  Synthetic
gcctgaacctgaactaaaaaacaacacagtgattcctaacatcctccggaactctgattacaatcttaactcccc

SEQ ID NO: 12600 - DNA, 75 bp, Artificial Sequence
  Synthetic
cttgatcgaagactcagcaaggctcatgttggagtggctgaccaccggaaacaggcctggacgactgaccctcac

SEQ ID NO: 12601 - DNA, 75 bp, Artificial Sequence
  Synthetic
tgacaactgcataagatcctataagactttaaagtgttacttccgaaaggtcgatgttgggtctttgaaagtcgg

SEQ ID NO: 12602 - DNA, 75 bp, Artificial Sequence
  Synthetic
gggtcttgcagcacaagccatgatatcgctatggctccatggagagcactccgagtcgaacagaagcagaaaatg

SEQ ID NO: 12603 - DNA, 75 bp, Artificial Sequence
  Synthetic
tctctcagatctcacccaattttatcaaaaatcttcccctattgagaaacttctgaattacacactaggaaacag

SEQ ID NO: 12604 - DNA, 75 bp, Artificial Sequence
  Synthetic
aggcctcaggataccaccagagggagtccttttctgtctaaagaaggtagattatgacagggcctttgggaggta

SEQ ID NO: 12605 - DNA, 75 bp, Artificial Sequence
  Synthetic
cttagcaaacatttatgcctcttatctgtttttccatgttatcattctgtacatgaatgccctagactgggatga

SEQ ID NO: 12606 - DNA, 75 bp, Artificial Sequence
  Synthetic
ggagaagactatccttgccttgtggaaagatttgagctctgtagatatcaagaaagaccaggtaaaatttagaga

SEQ ID NO: 12607 - DNA, 75 bp, Artificial Sequence
  Synthetic
cccaatatggggctctttgatagtcacaaaagactttgtatactctcaaaatgccaattgtctgtttgatagaaa

SEQ ID NO: 12608 - DNA, 75 bp, Artificial Sequence
  Synthetic
ttatactttgatgctaaaagacctctttctatccagattcaactccctactcatattactttctcctccagagcc

SEQ ID NO: 12609 - DNA, 75 bp, Artificial Sequence
  Synthetic
taggtattctgatgatttaatatcccagctgtgccagctttatattgcaggagataacgttttgtcaatgtgtgg

SEQ ID NO: 12610 - DNA, 75 bp, Artificial Sequence
  Synthetic
aaactcggggtatgatgttattaaaatgctagagccttatgtagtgaacagtctggttcagagagctgagggttt

SEQ ID NO: 12611 - DNA, 75 bp, Artificial Sequence
  Synthetic
cagaccgttgatccattctttaggggatttccctctattcatcagggacaaggtgggtcaacttgaaggtacatt

SEQ ID NO: 12612 - DNA, 75 bp, Artificial Sequence
  Synthetic
cggtccgagcgccaggaaattcttccaggttctagaccaattcgacaacatacatgatctggtgtttgtgtatgg

SEQ ID NO: 12613 - DNA, 75 bp, Artificial Sequence
  Synthetic
ttgttacagacattggggtcatccctatatagactatagaaaaggcttgtcaaagctgtatgaccaagtccatat

SEQ ID NO: 12614 - DNA, 75 bp, Artificial Sequence
  Synthetic
caagaaggtgatagatgggacttatcaagaatgtctagcgagtgatctggccaaaagggttctcaggtgggggtt

SEQ ID NO: 12615 - DNA, 75 bp, Artificial Sequence
  Synthetic
tgacaaatactctaagtggtatctagatcccaaactgttggctcaagatcaccctttgactccctatataaggac

SEQ ID NO: 12616 - DNA, 75 bp, Artificial Sequence
  Synthetic
acagacatggcctccaaaacacatagttgatcttgttggaaatacctggcataggcttcctattacccagatttt

SEQ ID NO: 12617 - DNA, 75 bp, Artificial Sequence
  Synthetic
tgagataccagagtccatggatccatctgaaatcctggatgacaagtcacactctttaaccaggacgaagttggc

SEQ ID NO: 12618 - DNA, 75 bp, Artificial Sequence
  Synthetic
gtcttggcttgccgagaatagaggaggtcctgttcctagtgagaaggtgatcataacagcactctctaaaccccc

SEQ ID NO: 12619 - DNA, 75 bp, Artificial Sequence
  Synthetic
agtgaacccgagagaatttctaaagtcgatagatctcggaggtctacctgatgatgacctgataataggcttgaa

SEQ ID NO: 12620 - DNA, 75 bp, Artificial Sequence
  Synthetic
accgaaggaaagagaattgaagatagagggtcgattttttgcccttatgtcctggaatctaagactctactttgt

SEQ ID NO: 12621 - DNA, 75 bp, Artificial Sequence
  Synthetic
catcacagagaagcttttagccaattacatattacctctctttgatgccttgaccatgacagacaacttgaacaa

SEQ ID NO: 12622 - DNA, 75 bp, Artificial Sequence
  Synthetic
agtgtttaaaaagctgatagatcgagtgacgggacagggattacaggattactccagggttacatatgcattcca

SEQ ID NO: 12623 - DNA, 75 bp, Artificial Sequence
  Synthetic
tctagattatgagaaatggaataaccatcaaaggctggaatcaaccaaagatgtcttttctgtactagatcaggt

SEQ ID NO: 12624 - DNA, 75 bp, Artificial Sequence
  Synthetic
gtttggacttaagaaagtcttctcaaggactcatgagttctttcagaaatcctgggtgtattattcagatagatc

SEQ ID NO: 12625 - DNA, 75 bp, Artificial Sequence
  Synthetic
agaccttattgggttgtgggaagatcagatctactgcttggacatgtcggatggacccacctgttggaatggtca

SEQ ID NO: 12626 - DNA, 75 bp, Artificial Sequence
  Synthetic
agatggaggcttggagggtctcagacagaagggttggagcctagtaagtctactgatgatagaccgagagtctca

SEQ ID NO: 12627 - DNA, 75 bp, Artificial Sequence
  Synthetic
aactcgaaatacaaggacaaaaatcttggcccaaggtgacaatcaggtgttatgtccaacctacatgttgtcatc

SEQ ID NO: 12628 - DNA, 75 bp, Artificial Sequence
  Synthetic
cggactctctcaggaagggcttctgtatgagcttgaaagtatctcaagaaacgctctctcgatctacagagctat

SEQ ID NO: 12629 - DNA, 75 bp, Artificial Sequence
  Synthetic
cgaggatggggcttcaaaattgggtctcatcatcaaaaaagaggagacaatgtgtagttatgacttccttatcta

SEQ ID NO: 12630 - DNA, 75 bp, Artificial Sequence
  Synthetic
cgggaagacacccctttttagagggaacatactggtcccagagtcaaagaggtgggctcgtgtatcttgtatctc

SEQ ID NO: 12631 - DNA, 75 bp, Artificial Sequence
  Synthetic
taatgatcagatagtcaatcttgccaacatcatgtcaacggtttccactaacgctctgactgtggctcaacactc

SEQ ID NO: 12632 - DNA, 75 bp, Artificial Sequence
  Synthetic
tcagtctctaattaaaccaatgagagacttcctgctcatgtcagttcaagcggtgtttcactatctgctgtttag

SEQ ID NO: 12633 - DNA, 75 bp, Artificial Sequence
  Synthetic
ccctatcctgaaaggaagagtttacaagattctaagtgctgacggagatgactttctccttgctatgtcccgcat

SEQ ID NO: 12634 - DNA, 75 bp, Artificial Sequence
  Synthetic
tatttacttggacccatccctcgggggagtctcagggatgtcattgggaagatttcacattcgtcaattctccga

SEQ ID NO: 12635 - DNA, 75 bp, Artificial Sequence
  Synthetic
tcctgtatccgagggtttgtcattctggaaagaaatctggtccagttcatcggagccgtggattcattctctatg

SEQ ID NO: 12636 - DNA, 75 bp, Artificial Sequence
  Synthetic
tcaagaggctggcaacccggacttgggagatagaagcttagagagtttcactcgcttgttggaagacccgactac

SEQ ID NO: 12637 - DNA, 75 bp, Artificial Sequence
  Synthetic
tctgaacatcagaggaggggcgagtcctacaattcttctgaaggatgccatcaggaaagccttgtatgatgaagt

SEQ ID NO: 12638 - DNA, 75 bp, Artificial Sequence
  Synthetic
tgataaggttgagaattcggaattcagagaggcgatcctgttatcaaagacccatagggacaactttattctttt

SEQ ID NO: 12639 - DNA, 75 bp, Artificial Sequence
  Synthetic
cctaaaatcaatcgaacctttattcccgagatttctcagtgagctcttcagttcttcctttcttggtatacctga

SEQ ID NO: 12640 - DNA, 75 bp, Artificial Sequence
  Synthetic
gtccataattggactcattcaaaattcacggacaatcagacgacaattcagacggagcctttccaggtccttaga

SEQ ID NO: 12641 - DNA, 75 bp, Artificial Sequence
  Synthetic
ggagtctttttataactctgagattcacggaattaacaggatgacccaggttccacagaggataggaagggtgtg

SEQ ID NO: 12642 - DNA, 75 bp, Artificial Sequence
  Synthetic
gtcttgctcttccgagagggctgacttgttgagagagatctcttgggggagaaaagtggttggaaccaccgttcc

SEQ ID NO: 12643 - DNA, 75 bp, Artificial Sequence
  Synthetic
acatccatcagaaatgctgaccctattgccaaaatcttccatctcttgcgtctgtggcccaacagggagtgagaa

SEQ ID NO: 12644 - DNA, 75 bp, Artificial Sequence
  Synthetic
cccgagagtgtcagtgtccgtgttaccttcatttgaccagtcatttttctctcgaggccccttaaaaggatacct

SEQ ID NO: 12645 - DNA, 75 bp, Artificial Sequence
  Synthetic
agggtcctcgacatctatgtcaacccagctgtttcatgcttgggagaaagtgaccaatgtccatgtggtcaagag

SEQ ID NO: 12646 - DNA, 75 bp, Artificial Sequence
  Synthetic
ggccttgtcactcaaggaatccatcaattggtttatagccagagattctaaccttgcccagaccctgattaaaaa

SEQ ID NO: 12647 - DNA, 75 bp, Artificial Sequence
  Synthetic
cataatctccctaacgggtcctcagtttcctctcgaggaagccccagtgtttaagagaaccgggtcagcattgca

SEQ ID NO: 12648 - DNA, 75 bp, Artificial Sequence
  Synthetic
cagattcaagtctgctagatacagtgaagggggttactcgtcaatctgtccaaatttattgtctcatatttctgt

SEQ ID NO: 12649 - DNA, 75 bp, Artificial Sequence
  Synthetic
cagcacagacaccatgtcagaccttacacaagatggcaggaattttgatttcatgtttcaacctctgatgcttta

SEQ ID NO: 12650 - DNA, 75 bp, Artificial Sequence
  Synthetic
cgctcaaacatggacttcagagcttgttcaaaaggacatcagactgaaggattccaccttccattggcatcttcg

SEQ ID NO: 12651 - DNA, 75 bp, Artificial Sequence
  Synthetic
ttgtcagaaatgtatcagatcaatagatgatatcaccttggacacttctcaggttttcgagtttcccgatgtctc

SEQ ID NO: 12652 - DNA, 75 bp, Artificial Sequence
  Synthetic
caagagaatttcgaggatggtgtctggtgccgtacctcagtttcagaaacttcccgaggtctacttgaagccagg

SEQ ID NO: 12653 - DNA, 75 bp, Artificial Sequence
  Synthetic
tcactttgattctctctgcggaaaggacaaatctagacatatcggttcagcccaagggttgttgtattctattct

SEQ ID NO: 12654 - DNA, 75 bp, Artificial Sequence
  Synthetic
tgttgctactcatgatcctgggtataatgatgggactatatttccagtgaacatttacagcaagatatctccgaa

SEQ ID NO: 12655 - DNA, 75 bp, Artificial Sequence
  Synthetic
ggattatcttcgaggactagcaaggggtgtattgattggctcatccatttgcttcttgactaggatgacaaacat

SEQ ID NO: 12656 - DNA, 75 bp, Artificial Sequence
  Synthetic
caacataaatagacccctggagttaatctccggagttatttcttatatactcttaaggcttgacaaccatccatc

SEQ ID NO: 12657 - DNA, 75 bp, Artificial Sequence
  Synthetic
tctgtatgtcatgctcagggaatcatctctcagatcagagatcttttcaatccctcaaaaaatcccagcagcata

SEQ ID NO: 12658 - DNA, 75 bp, Artificial Sequence
  Synthetic
tccaaccacaatgaaagagggtaatagatctgtgctatgttacctacaacatgtgcttcgttatgaaagagatat

SEQ ID NO: 12659 - DNA, 75 bp, Artificial Sequence
  Synthetic
aatcacatcatcaccggagaacgactggctttggatcttctctgacttccgaagcacaaagatgacttatctgac

SEQ ID NO: 12660 - DNA, 75 bp, Artificial Sequence
  Synthetic
cttaatcacataccagtctcacatcctccttcagaggatagagagaagcttgtccaagaaaatgagagctgatct

SEQ ID NO: 12661 - DNA, 75 bp, Artificial Sequence
  Synthetic
caggcagttgagttcactgatgaggcaagtcctgggaggtcacggggaagattctttggactcaggagaggacat

SEQ ID NO: 12662 - DNA, 75 bp, Artificial Sequence
  Synthetic
ccagagattgttaagagatgctctccagaggacaagatgggtagaccaggaagtccgccatgccgccaagacaat

SEQ ID NO: 12663 - DNA, 75 bp, Artificial Sequence
  Synthetic
gacaggtgaccatagcccttccaagaagacatctcggaaggctggttgttctgagtggatatgttcagcccagca

SEQ ID NO: 12664 - DNA, 75 bp, Artificial Sequence
  Synthetic
ggtagcaatatccacctcttcaaatccagctccagtttcagagatggatataagaaccctttcccgaaagcttca

SEQ ID NO: 12665 - DNA, 75 bp, Artificial Sequence
  Synthetic
aaatcctctcatttcaggtctaagggtggtccaatgggcaactggtgcacattacaaactcaagccgatccttga

SEQ ID NO: 12666 - DNA, 75 bp, Artificial Sequence
  Synthetic
tgacctcaatgcttacccttctttctgtttggttgtcggtgatggctcaggaggaatttcgagaactgtattaaa

SEQ ID NO: 12667 - DNA, 75 bp, Artificial Sequence
  Synthetic
catgtttcctgatgccaagttagtcttcaacagcttactagaggtgagtgacctcatggcctcgggaactcaccc

SEQ ID NO: 12668 - DNA, 75 bp, Artificial Sequence
  Synthetic
cctacctccatcagccattatgagcgggggcgatgacatcgtgtctagggtcgttgattttgagtcaatttggga

SEQ ID NO: 12669 - DNA, 75 bp, Artificial Sequence
  Synthetic
gaagccgtctgatctgagaaacctgtctacatggagatattttcaatcagtccagagtaaattgaacatgtcata

SEQ ID NO: 12670 - DNA, 75 bp, Artificial Sequence
  Synthetic
tgacttgataatctgtgacgcagaggtcacagacataatatcagtgaacaagataacattgctcatgtcagactt

SEQ ID NO: 12671 - DNA, 75 bp, Artificial Sequence
  Synthetic
tgttttgtcgatagatgggcccctagatctgatattcaaatcctatgggaccatgctggtgaatccagactataa

SEQ ID NO: 12672 - DNA, 75 bp, Artificial Sequence
  Synthetic
ggcaattcaacatctctccagggcgttccctaaggcaactggatacatcacccaactgacatcctctttctcatc

SEQ ID NO: 12673 - DNA, 75 bp, Artificial Sequence
  Synthetic
agagttgtatctgaggttttctaaaagaggcaagttttttagagatgtggaatacctgacttcttccaccttaag

SEQ ID NO: 12674 - DNA, 75 bp, Artificial Sequence
  Synthetic
ggaaatgagtcttgtactgttcaattgtagtagtccgaaaagtgagttgcagagagcccgctcgttgaactatca

SEQ ID NO: 12675 - DNA, 75 bp, Artificial Sequence
  Synthetic
agatcttataagaggctttcctgaggagattgtgtccaacccatacaatgaaatgataataacactgatagacag

SEQ ID NO: 12676 - DNA, 75 bp, Artificial Sequence
  Synthetic
tgaagttgaatcttttctggttcacaagatggtagatgacttggagctacaaagaggaactctgtcgaaaatgtc

SEQ ID NO: 12677 - DNA, 75 bp, Artificial Sequence
  Synthetic
catcatcatcgccattgtgatagtatactctaatagggtgtttaatgtgtccaagccacttagcgatcctgtttt

SEQ ID NO: 12678 - DNA, 75 bp, Artificial Sequence
  Synthetic
ttaccccccttctgacccaaagattctaaggcatttcaacatatgctgcagtacaatgttgtacttatcaactat

SEQ ID NO: 12679 - DNA, 75 bp, Artificial Sequence
  Synthetic
tttgggagacgttcccaactttgctaggttgcatgaattgtataacagcccaatcacttattatttcaaaaagca

SEQ ID NO: 12680 - DNA, 75 bp, Artificial Sequence
  Synthetic
gataatcagagggagcatatatctttcttggagttggtcagatgacacttcagtgttcaaaagggtgtcttgcaa

SEQ ID NO: 12681 - DNA, 75 bp, Artificial Sequence
  Synthetic
ctcaaatctcagcttgtcatcccattggattcgattaatttacaaaataatcaagacaacccgttttacaggaag

SEQ ID NO: 12682 - DNA, 75 bp, Artificial Sequence
  Synthetic
tcacgttgatctatctaaggaagtcgaaaagcacttgaaagggtataataggtggataaccttcaatgatgtgag

SEQ ID NO: 12683 - DNA, 75 bp, Artificial Sequence
  Synthetic
atctagatcatctctcttggattatagttgtctctgattgggatcctccagcgtcttctctattgaaatcatgtt

SEQ ID NO: 12684 - DNA, 75 bp, Artificial Sequence
  Synthetic
tggtgcgagaggcttgaaaaaaacatatgcaagattcagaacctgtacttgtttgaatgtttttatttcttgttg

SEQ ID NO: 12685 - DNA, 75 bp, Artificial Sequence
  Synthetic
aaaaacatatgcaagattcagaacctgtacttgtttgaatgtttttatttcttgttggttttttttgttaagcgt

SEQ ID NO: 12686 - DNA, 75 bp, Artificial Sequence
  Synthetic
atggagtctgataagattgcctttaagatcaacaatcaattggtgtctgttaagccggaggtgatagtagatcag

SEQ ID NO: 12687 - DNA, 75 bp, Artificial Sequence
  Synthetic
aaagcgtacaagtctatattatctggcatgaacgccgcgaagttggacccggacgatgtttgctcctacctagct

SEQ ID NO: 12688 - DNA, 75 bp, Artificial Sequence
  Synthetic
gcagctatggagttatttgaggggatctgcccagaggactggacaagttacgggattttgattgccagaaaagga

SEQ ID NO: 12689 - DNA, 75 bp, Artificial Sequence
  Synthetic
gacaaaatcacaccggctactttagttgacataaggagaacagatattcagggcagctgggctctggcagggggg

SEQ ID NO: 12690 - DNA, 75 bp, Artificial Sequence
  Synthetic
cttatgatatgttcttttctcgagttgaacatttatactccgcaattcgggtaggcacggtagtaacggcttatg

SEQ ID NO: 12691 - DNA, 75 bp, Artificial Sequence
  Synthetic
ggattatgaagcagcagaggccatgaagatagacctcgcactggcggacgatggaactgtcaattcgtatgatga

SEQ ID NO: 12692 - DNA, 75 bp, Artificial Sequence
  Synthetic
ggattatctctcaggggagacgaggagcccggaggcagtttatacgagaataatgatgaatggaggccgactcaa

SEQ ID NO: 12693 - DNA, 75 bp, Artificial Sequence
  Synthetic
tcagtgagttctaaccatcagtctcggccgaactcgtttgctgaattcctaaacaagacatactcgagtgattct

SEQ ID NO: 12694 - DNA, 75 bp, Artificial Sequence
  Synthetic
taactagacgctcaagcctgattcataaactatcaggaaggttgcttcttcttccaagaaaaaaactaacacccc

SEQ ID NO: 12695 - DNA, 75 bp, Artificial Sequence
  Synthetic
taaactatcaggaaggttgcttcttcttccaagaaaaaaactaacacccctccttttgtaccatcttcaatatga

SEQ ID NO: 12696 - DNA, 75 bp, Artificial Sequence
  Synthetic
agattgggaagctcaatatcaatgaggcaaagcctcaaagctttgagaacaatcccatagacatagatggtagga

SEQ ID NO: 12697 - DNA, 75 bp, Artificial Sequence
  Synthetic
aatcccatagacatagatggtaggatgaatgaagacttccaaatgaaagaggttgaagatccaagtatccagttc

SEQ ID NO: 12698 - DNA, 75 bp, Artificial Sequence
  Synthetic
aggagggtcttcgcctccctctaagatgtatcctcggatgggttgcatcgtctcactccaagaagtttcaactgc

SEQ ID NO: 12699 - DNA, 75 bp, Artificial Sequence
  Synthetic
atgtatcctcggatgggttgcatcgtctcactccaagaagtttcaactgctagttgggtcagagaagctgagcaa

SEQ ID NO: 12700 - DNA, 75 bp, Artificial Sequence
  Synthetic
cgtcagctgtcttactcatatcatgaggaagactgtcaacaccactgataaaatgaactttctacgcaagatagt

SEQ ID NO: 12701 - DNA, 75 bp, Artificial Sequence
  Synthetic
taggaattgcaaggatgaggacgaccagaagccccctcttgcatctacgcttccgaatgacgacgacctgtggct

SEQ ID NO: 12702 - DNA, 75 bp, Artificial Sequence
  Synthetic
tccccctcccgaatatgttcctctaaccgagatcaccggtaaaaagaatatgcgaaatttatgtatcaatggtga

SEQ ID NO: 12703 - DNA, 75 bp, Artificial Sequence
  Synthetic
ggtcaaagtttgtagtcctaatggttactcgttcaggatcttgagacatatcctggaatctcttgacgagatcta

SEQ ID NO: 12704 - DNA, 75 bp, Artificial Sequence
  Synthetic
ctcggggaaccatagaatgatcgggctggtcaaagtggtcatggatctgacattatctggagctccctgtccaga

SEQ ID NO: 12705 - DNA, 75 bp, Artificial Sequence
  Synthetic
agggatgaattgggtctataagctgaggcggactctgatatttcaatgggcagaatcccgcggtccattggacgg

SEQ ID NO: 12706 - DNA, 75 bp, Artificial Sequence
  Synthetic
gatggagagtgcacagttttatcttcaacttcttgtgagcaatagaacaaaaacatgttatggtgccatactatc

SEQ ID NO: 12707 - DNA, 75 bp, Artificial Sequence
  Synthetic
gctgcatttttatcaagatacctgattacatttacatgtgaaatatcccagatgtgaaaaaaacagtttaacatc

SEQ ID NO: 12708 - DNA, 75 bp, Artificial Sequence
  Synthetic
cctcgaacattttgggaaagatgctcctccaagttatcctcctcgtgtctctgacggccatcttaccgtgtacag

SEQ ID NO: 12709 - DNA, 75 bp, Artificial Sequence
  Synthetic
ctgacggccatcttaccgtgtacagggcaattccctctctatgcaataccagacaaattaggcccttggagtccg

SEQ ID NO: 12710 - DNA, 75 bp, Artificial Sequence
  Synthetic
gttcgttgatgaacgtggattgtataaatctctaaagggggcgtgcaaactcaagttatgcggaatctctggtct

SEQ ID NO: 12711 - DNA, 75 bp, Artificial Sequence
  Synthetic
cagactactggatgggtcttgggtttccatccagaatcacgaagaggtcaaatggtgctctcctaatcaattggt

SEQ ID NO: 12712 - DNA, 75 bp, Artificial Sequence
  Synthetic
caacattcatgacttcaatgcagatgagattgaacatcttatagtggaggagttaatcaaggaaagagaagagtg

SEQ ID NO: 12713 - DNA, 75 bp, Artificial Sequence
  Synthetic
aacatgggatgagattatcccatccaaaggatgtctgaaggtcagagaaaagtgtcaccctccttacaatggggt

SEQ ID NO: 12714 - DNA, 75 bp, Artificial Sequence
  Synthetic
agtgtcaccctccttacaatggggtgttcttcaatgggatcattttgggtccggacggacaagtcttaatccccg

SEQ ID NO: 12715 - DNA, 75 bp, Artificial Sequence
  Synthetic
agatgcagtcatccttgctacaccaacatacagagttacttgaatcctcagttatacctctcatccatccgctgg

SEQ ID NO: 12716 - DNA, 75 bp, Artificial Sequence
  Synthetic
cagatccatccaccatcttcaggggggatgatgaggccgagggattcattgaggtccatcttccggacatccaaa

SEQ ID NO: 12717 - DNA, 75 bp, Artificial Sequence
  Synthetic
agcaagtctctggaatcgacttgggtctctcagagtgggagagatatttgataataggtatttcggcgataatcc

SEQ ID NO: 12718 - DNA, 75 bp, Artificial Sequence
  Synthetic
tagagctggatcgtaaggtgtcagtcacctctcagagtgggaagtcgatcccttcctgggagtcatacaaatcga

SEQ ID NO: 12719 - DNA, 75 bp, Artificial Sequence
  Synthetic
gacaggggcactccagatcatgagtcaccagttgtcgacaaagtctttctgcaatcagctctcttcttgacgcca

SEQ ID NO: 12720 - DNA, 75 bp, Artificial Sequence
  Synthetic
gcaatcagctctcttcttgacgccagagagcagttccacccatcgatcactcatgagccatatgcaatactaaga

SEQ ID NO: 12721 - DNA, 75 bp, Artificial Sequence
  Synthetic
ggtcctgtagcaattccaatgatctatggtgccttagtagaataaaaacaaatatattggactaatcaagtagag

SEQ ID NO: 12722 - DNA, 75 bp, Artificial Sequence
  Synthetic
gagaatactaaagaattgcctccttacgctcctccttgtaaatatctacccatttgtcttagagtataactcatc

SEQ ID NO: 12723 - DNA, 75 bp, Artificial Sequence
  Synthetic
ttgttgagagaggaaggttcttccttcgagagaaatgtatgttcagcccttgtttgtcaattgagacaggagttg

SEQ ID NO: 12724 - DNA, 75 bp, Artificial Sequence
  Synthetic
ggtgtgcatattagcagcaagttgaatcatcatgaccatataaccatgagaaaaacatcatcccagcaaggggca

SEQ ID NO: 12725 - DNA, 75 bp, Artificial Sequence
  Synthetic
ttgagcctgaacccgaactaaaaaccaacaatgcagttatccccaacatcctcaggaactcggattataatctca

SEQ ID NO: 12726 - DNA, 75 bp, Artificial Sequence
  Synthetic
attcccctctgatagaacacccatctaggcttatgttagagtggttaaccaccgggaataagcccatgagattga

SEQ ID NO: 12727 - DNA, 75 bp, Artificial Sequence
  Synthetic
taggcttatgttagagtggttaaccaccgggaataagcccatgagattgacccttacagacaattgcatccgctc

SEQ ID NO: 12728 - DNA, 75 bp, Artificial Sequence
  Synthetic
aaagtagattatgataggtctttcgggagatatctagcaaacatttactcttcttatctgttttttcatgtcatc

SEQ ID NO: 12729 - DNA, 75 bp, Artificial Sequence
  Synthetic
ggagatatctagcaaacatttactcttcttatctgttttttcatgtcatcatcttatacatgaatgctttagact

SEQ ID NO: 12730 - DNA, 75 bp, Artificial Sequence
  Synthetic
tgtgtggaaactctggatacgatgtgattaaaatgctagagccgtatgtcataaacagtttggtgcagagagccg

SEQ ID NO: 12731 - DNA, 75 bp, Artificial Sequence
  Synthetic
gattaaaatgctagagccgtatgtcataaacagtttggtgcagagagccgaagagtttagaccgttgatacactc

SEQ ID NO: 12732 - DNA, 75 bp, Artificial Sequence
  Synthetic
atcaggtgttcggactcaaaaaagtcttctcaaggactcatgagttctttcaaaaatcttggatatactactcag

SEQ ID NO: 12733 - DNA, 75 bp, Artificial Sequence
  Synthetic
cttctcaaggactcatgagttctttcaaaaatcttggatatactactcagacagatcagacctgatagggttatg

SEQ ID NO: 12734 - DNA, 75 bp, Artificial Sequence
  Synthetic
ggaggatcagatctactgtctggatatgtctgacggacctacctgctggaacggtcaagatggagggctggaagg

SEQ ID NO: 12735 - DNA, 75 bp, Artificial Sequence
  Synthetic
cctccgacaaaaaggttggagcctagtaagcttgctgatgatagatagggaatctcaaactaggaatacaaggac

SEQ ID NO: 12736 - DNA, 75 bp, Artificial Sequence
  Synthetic
gtaagcttgctgatgatagatagggaatctcaaactaggaatacaaggacaaaagattttgcgcaaggtgacaat

SEQ ID NO: 12737 - DNA, 75 bp, Artificial Sequence
  Synthetic
tatcatccgggctctcccacgaggggcttttatatgagcttgagagtatttccaggaatgctctctcgatttaca

SEQ ID NO: 12738 - DNA, 75 bp, Artificial Sequence
  Synthetic
gtatctctaatgatcaaatagtcaatctcgccaatatcatgtcgactgtatcaactaatgccttgactgtggctc

SEQ ID NO: 12739 - DNA, 75 bp, Artificial Sequence
  Synthetic
aacactctcaatctttgatcaaacccatgaggggatttttgcttatggctgtccaggcggtgtttcattatttgc

SEQ ID NO: 12740 - DNA, 75 bp, Artificial Sequence
  Synthetic
ttttcagccccatcttaaaagggagggtgtacaagattttgagtgccgaaggagatgatttcctccttgctatgt

SEQ ID NO: 12741 - DNA, 75 bp, Artificial Sequence
  Synthetic
ggtgtacaagattttgagtgccgaaggagatgatttcctccttgctatgtcacgtattgtttatttggacccatc

SEQ ID NO: 12742 - DNA, 75 bp, Artificial Sequence
  Synthetic
agttcatcagagtcatggattcactctctatgtcaagaagcaggcaacccggatttgggtgatagaagcttagag

SEQ ID NO: 12743 - DNA, 75 bp, Artificial Sequence
  Synthetic
ctctatgtcaagaagcaggcaacccggatttgggtgatagaagcttagagaaatttacccgcttgctagaggacc

SEQ ID NO: 12744 - DNA, 75 bp, Artificial Sequence
  Synthetic
gatgccatcaggaaagctctctatgatgaggttgataaggtggaaaattccgaattcagggaggctatcttattg

SEQ ID NO: 12745 - DNA, 75 bp, Artificial Sequence
  Synthetic
tcaaggcaccatagagataacttcatcctcttcctcaaatcgatcgagccgttgttccctaggttcctcagcgaa

SEQ ID NO: 12746 - DNA, 75 bp, Artificial Sequence
  Synthetic
gttgttccctaggttcctcagcgaactatttagctcttctttcctgggcatacccgagtccataattggactcat

SEQ ID NO: 12747 - DNA, 75 bp, Artificial Sequence
  Synthetic
gagtgtggtcttgttcctcagagagagcccatttgttgagggagatttcttggggacgaaaacgtgttggaacta

SEQ ID NO: 12748 - DNA, 75 bp, Artificial Sequence
  Synthetic
ctgttccgcatccgtcagaaatgttagctttactgccaaagtcctcaatctcttgtccatgtggtctaacaggga

SEQ ID NO: 12749 - DNA, 75 bp, Artificial Sequence
  Synthetic
gtgagaatccgagagtatcgatttctgtgttaccttcaatttatcagtccttcttctccagaggtcccttaaaag

SEQ ID NO: 12750 - DNA, 75 bp, Artificial Sequence
  Synthetic
gataccttggatcatcgacatctatgtcaactcagacgtttcatgcctgggagaaggtgacaaatgtccatgtag

SEQ ID NO: 12751 - DNA, 75 bp, Artificial Sequence
  Synthetic
ttgaaagattctacttttcattggcatcttcgctgtccaaaatgcatcagatcaatagatgacgtcattctggta

SEQ ID NO: 12752 - DNA, 75 bp, Artificial Sequence
  Synthetic
cacccccaggtatttgatttccccgatgtatccaaaaggatctcaagaatggtgtctggcgctgtacctagttcc

SEQ ID NO: 12753 - DNA, 75 bp, Artificial Sequence
  Synthetic
cagatacttcccgaggtcaacttgttgccaggtcactttgagtctctatgtggaagggataagtcccgacatatc

SEQ ID NO: 12754 - DNA, 75 bp, Artificial Sequence
  Synthetic
tggaagggataagtcccgacatatcggctcagctcagggtttgctgtattctatcttggtcgccacccatgatcc

SEQ ID NO: 12755 - DNA, 75 bp, Artificial Sequence
  Synthetic
ctcctaaagattacctcagagggcttgcaaggggcatcttgattggctcatctatctgtctgttgacaaggatga

SEQ ID NO: 12756 - DNA, 75 bp, Artificial Sequence
  Synthetic
caaatattaacataaatagacccctggaattgatttcaggagtcattacatatatactcttaaggcttgacaacc

SEQ ID NO: 12757 - DNA, 75 bp, Artificial Sequence
  Synthetic
cagattttgttctgtctatagatggacccgtcgacttgatatttaagtcatatgggtctatgttggtggacccgg

SEQ ID NO: 12758 - DNA, 75 bp, Artificial Sequence
  Synthetic
cagggcttttccccaggtgactggatacattactcaactaacatcctccttctcgtcagagctgtatttaaggtt

SEQ ID NO: 12759 - DNA, 75 bp, Artificial Sequence
  Synthetic
ccacagttctgggagatgtcccaaactttgctaggcagcatgagttgtataatggccccatcacttattatttta

SEQ ID NO: 12760 - DNA, 75 bp, Artificial Sequence
  Synthetic
aaaatagtcaaaacgacccgtctgacagggagtccagttgacttgtcaaaggaagtcgagaaacacttaagagga

SEQ ID NO: 12761 - DNA, 75 bp, Artificial Sequence
  Synthetic
cagggagtccagttgacttgtcaaaggaagtcgagaaacacttaagaggatataacagatggataaccctcaatg

SEQ ID NO: 12762 - DNA, 75 bp, Artificial Sequence
  Synthetic
atgtgaaatctaggtcgtctcttctggattacagctgtctttgatgcaagcctctcataggtttttcttttgaaa

SEQ ID NO: 12763 - DNA, 75 bp, Artificial Sequence
  Synthetic
aaaatatgtttggagagaaaagcctgaaaaaaacatatgcaagattcagaacatatacttgtttgaatggaaggg

SEQ ID NO: 12764 - DNA, 75 bp, Artificial Sequence
  Synthetic
accagagggaaaatataacaatgtcgttttatagcgatgtaaataatacttatgtaggcccgaaagtggcatcaa

SEQ ID NO: 12765 - DNA, 75 bp, Artificial Sequence
  Synthetic
tcgtagtcgaagtcgactgcatcgagttgctttcggggcttgtatgatcttattcctccactagtggggatatcc

SEQ ID NO: 12766 - DNA, 75 bp, Artificial Sequence
  Synthetic
aggggtcatacaagatgtcttctgtctttaaagcctttgaacagttcactcttgaacaggatcaatatgtcggag

SEQ ID NO: 12767 - DNA, 75 bp, Artificial Sequence
  Synthetic
gcaataatcttgaattgccgccagagacacttcaaactacaatcaaggttttcattcttaatacccagaaccctc

SEQ ID NO: 12768 - DNA, 75 bp, Artificial Sequence
  Synthetic
aaacaaggtatcaaatgctttgcttctgcttgagaattatagctagtaactctgcaagaactgctcaaaaatatg

SEQ ID NO: 12769 - DNA, 75 bp, Artificial Sequence
  Synthetic
gtgcaatgctcacagtccttagtctacctactgctatgatgcacaaccacatgaggattgcagatcgttcacccg

SEQ ID NO: 12770 - DNA, 75 bp, Artificial Sequence
  Synthetic
attcaatcatagaacgaattgagattgaaggttttgagccaggatcatacaggcttcgcccaaatgcaagaacac

SEQ ID NO: 12771 - DNA, 75 bp, Artificial Sequence
  Synthetic
ccatgacacaaggagaaatcatagcaatggaaaatatggctgatgatctgcctgacacaattgtcaaccaaaccc

SEQ ID NO: 12772 - DNA, 75 bp, Artificial Sequence
  Synthetic
catttgttaacactgcaacagaggatgagatttgtgacgagatggaaaaattcttgaatgcagtctatagtgtgc

SEQ ID NO: 12773 - DNA, 75 bp, Artificial Sequence
  Synthetic
taatccaggtctgggtcatggtgtgcaaatgcatgacagcatttgatcaacctacaggatctgatgcaaggagac

SEQ ID NO: 12774 - DNA, 75 bp, Artificial Sequence
  Synthetic
tagccaagtatcaacaacaaggacgtatggatcaaaagtatgtccttcagggtgaggttaggaggctaatacagt

SEQ ID NO: 12775 - DNA, 75 bp, Artificial Sequence
  Synthetic
tatgtatcagagaaagccttaccatcagacaatttttagttaatgagatgcagactgctagaagacaaggcccca

SEQ ID NO: 12776 - DNA, 75 bp, Artificial Sequence
  Synthetic
ttacaggaaagtactatgctatggttggcgatgttgcaagatatatagagaatgcaggaatgggagccttcttta

SEQ ID NO: 12777 - DNA, 75 bp, Artificial Sequence
  Synthetic
tgactgttaagtttgcacttgggaacagatggcctcctttagcattagctgcattctcaggagagcttgtcaaga

SEQ ID NO: 12778 - DNA, 75 bp, Artificial Sequence
  Synthetic
tcaaagggctcatgatgttatataggaaattgggtgacagagcaaagtatatggctctccttgaaatgtcagaga

SEQ ID NO: 12779 - DNA, 75 bp, Artificial Sequence
  Synthetic
tgatggattttgcgcctgctaattaccagttgctatatagttatgctatggggattggtagtgtccaggatccac

SEQ ID NO: 12780 - DNA, 75 bp, Artificial Sequence
  Synthetic
agatgagaggatataactttgctagaccattccttaacccagcattctttcagctcggcatggagacagcaaaca

SEQ ID NO: 12781 - DNA, 75 bp, Artificial Sequence
  Synthetic
gacaacagggttcagtggatcgtgagatggcagaggagcttggactcacagatacagagagaagagagatggcag

SEQ ID NO: 12782 - DNA, 75 bp, Artificial Sequence
  Synthetic
ctcaagtcacccgcctcacaactggcagaggtgccggagatcaacaggacattgtcaatatctttggtgcgcgcg

SEQ ID NO: 12783 - DNA, 75 bp, Artificial Sequence
  Synthetic
cacggaatggtagacatggggcacaagaacggcagtttagagtgattgagggtgatgatgtagatgatgaggagg

SEQ ID NO: 12784 - DNA, 75 bp, Artificial Sequence
  Synthetic
gtgaagatgatgaccaagataatgacgatgaggaagcacagcgtcaacagtacattgccaatgaacaagcaagat

SEQ ID NO: 12785 - DNA, 75 bp, Artificial Sequence
  Synthetic
ggcaagcaaggcttgctgagatcgaagagcgacaggcagcagagagagggcgcaatcgtcaaggaagacaacagg

SEQ ID NO: 12786 - DNA, 75 bp, Artificial Sequence
  Synthetic
accaagctcgagacattcagagagccacagcccaagttcaccaggagccagctgcccaagatttgattgccgatc

SEQ ID NO: 12787 - DNA, 75 bp, Artificial Sequence
  Synthetic
tgattgaataagctagaccaaaaaagcttccgccaataatctgatcctacttcagctgcattgcaagtgtttgaa

SEQ ID NO: 12788 - DNA, 75 bp, Artificial Sequence
  Synthetic
tatggcattaactatcaggctattatagaattcttttaagaaaaaattgaaatttgggcccgaagagtggtttct

SEQ ID NO: 12789 - DNA, 75 bp, Artificial Sequence
  Synthetic
ctcgggtccttacctcttcgggctaatccaatcaaggataccgacaatagacgatctgtgtgttcataagagatt

SEQ ID NO: 12790 - DNA, 75 bp, Artificial Sequence
  Synthetic
tgaagctcaacatggatacaaacccatcagatgaagagatctctgcttggatagataaagggcttgatactattc

SEQ ID NO: 12791 - DNA, 75 bp, Artificial Sequence
  Synthetic
aacactttgtgtcaggtcctgtaacatcacaaagcagtcttggaaagagtacaattaagcctggtaacactcgag

SEQ ID NO: 12792 - DNA, 75 bp, Artificial Sequence
  Synthetic
gtctcgtcaagtctgctgagtcaaaaagcatgctagctaaattggcacctccatcaagcatgcaacctgcccctc

SEQ ID NO: 12793 - DNA, 75 bp, Artificial Sequence
  Synthetic
ctcccagagaagaccaggcatcatcatcaggaggagcccggcctaaaagtaaaaaatcagtatcattccaaaaac

SEQ ID NO: 12794 - DNA, 75 bp, Artificial Sequence
  Synthetic
ctcaagcctctcagagtgtgatatcagatgatgcaatctatgaagaggtaattcggccagacaatgatgaatttc

SEQ ID NO: 12795 - DNA, 75 bp, Artificial Sequence
  Synthetic
agccattattgcaaaagtctccatctccagagcaaaaagcaaaagaccgcttgttaaatactgtgataatgggtg

SEQ ID NO: 12796 - DNA, 75 bp, Artificial Sequence
  Synthetic
atcatcaacccccaagtactagccatagtgggcaaccatttaagaggggggttcggagtgacaggagttcagcaa

SEQ ID NO: 12797 - DNA, 75 bp, Artificial Sequence
  Synthetic
caagttcagaactcaagagacgccatcggagagagtttgatcttagatggactggaagaagaccccatgtcagtg

SEQ ID NO: 12798 - DNA, 75 bp, Artificial Sequence
  Synthetic
aatggtgcaaccccatatgtgccccaatcactccaatcccacggagatttacatgccgctgtggagactgccctg

SEQ ID NO: 12799 - DNA, 75 bp, Artificial Sequence
  Synthetic
atgtctgccccatgtgtgagggagattttaaggtacttaaaattgctggagaaccgttttaatcaaatggattgg

SEQ ID NO: 12800 - DNA, 75 bp, Artificial Sequence
  Synthetic
aagttggacaagctgattggacaacagagtacaataacccaaattaggaatgaacagatgggactaaaagctaat

SEQ ID NO: 12801 - DNA, 75 bp, Artificial Sequence
  Synthetic
atggctatgatagaggggttgattacctctatcaaaatcatggatcctggggttggtactggagcaaacgccgca

SEQ ID NO: 12802 - DNA, 75 bp, Artificial Sequence
  Synthetic
caggccaaaaaattgttcaaagaagtgccggttgttattagtggtcctgttgtgggagagaacccattggtgaca

SEQ ID NO: 12803 - DNA, 75 bp, Artificial Sequence
  Synthetic
gctactgagcttgagatccaagatcttggcaaaccagcaataccatctaaagggagttcgaaaaaggctggactg

SEQ ID NO: 12804 - DNA, 75 bp, Artificial Sequence
  Synthetic
actgaagcagatttggctgggtacaagatgaccctgatgacattgatcaaggattgcattcccaatgcttcgatg

SEQ ID NO: 12805 - DNA, 75 bp, Artificial Sequence
  Synthetic
caacaagagtttgagaggagagtaaatcaaatcaagaatgaagttgatttcaaggcgctcaagagagagatatta

SEQ ID NO: 12806 - DNA, 75 bp, Artificial Sequence
  Synthetic
agagctgctgtctaagaagaatccaaattatgcttagtacccatactgcaaggctttcaaggaatcatgctgctt

SEQ ID NO: 12807 - DNA, 75 bp, Artificial Sequence
  Synthetic
aaatagtgcacataatcaatacattccatgcaaacaaatgacatcctgattagtagatatagttaatttgcaatt

SEQ ID NO: 12808 - DNA, 75 bp, Artificial Sequence
  Synthetic
taagaaaaaaccaaaagtgggcccggacccatcaagcccaggagccctcaaccatggcccacagacaggcatccg

SEQ ID NO: 12809 - DNA, 75 bp, Artificial Sequence
  Synthetic
tatctctgaaggtcgatcctgtaagtgagaagaatcatctgaggccgtttccaatagtgcaggtaacaccggaca

SEQ ID NO: 12810 - DNA, 75 bp, Artificial Sequence
  Synthetic
gcggcaatggaagaggtaggctaatgaagcaaatccgaatcaaagatttgacacctgctggctccactgagcccc

SEQ ID NO: 12811 - DNA, 75 bp, Artificial Sequence
  Synthetic
caatcacatttgtgaacacatatggattcgtgaagcctttgagaacgaggagtgaattcttttctgaatttcacc

SEQ ID NO: 12812 - DNA, 75 bp, Artificial Sequence
  Synthetic
gacctgattcatcaccaagcatcactgcctgcactcttcccttcggtgctggcccaaacatagatcatcccatgc

SEQ ID NO: 12813 - DNA, 75 bp, Artificial Sequence
  Synthetic
gcttacttgaggagatagaaaaatgccacattgtaatgaggaaaagtgcaagccttagagaggaagttgtgtata

SEQ ID NO: 12814 - DNA, 75 bp, Artificial Sequence
  Synthetic
ctatacaaaaattgcctccgatacttgcatatcaccaaattgcttcacagaaacttatttgtgtgccctctgaaa

SEQ ID NO: 12815 - DNA, 75 bp, Artificial Sequence
  Synthetic
agtatcttaaggctccaagcaagatgcagtccggagttgactacacttattgcatatcatttctctcaattgtct

SEQ ID NO: 12816 - DNA, 75 bp, Artificial Sequence
  Synthetic
actgtccccctagcttaaaattccgtgtgcttcgcccattgcaaatgatgagatccagtacaatgagaagcatac

SEQ ID NO: 12817 - DNA, 75 bp, Artificial Sequence
  Synthetic
aaattgaggttcttctggaggttgactgtgatgactcatcaccagccacaagattcctcattcgagatgaggcaa

SEQ ID NO: 12818 - DNA, 75 bp, Artificial Sequence
  Synthetic
ctcaaaaatggagagcatctgtatggttccatctgtgcaatattatcaagagtcatcagggaggagataaatatg

SEQ ID NO: 12819 - DNA, 75 bp, Artificial Sequence
  Synthetic
atgaccattatttcaatgataagtgcagaaaaatggatttggaggttggtatcattgacatgtggggtccaactt

SEQ ID NO: 12820 - DNA, 75 bp, Artificial Sequence
  Synthetic
ttttggttaaggcccatggaagagtaccaaagagtgctaaagtctacttcagtcaaaagaattgggcatgccatc

SEQ ID NO: 12821 - DNA, 75 bp, Artificial Sequence
  Synthetic
ctttggtggatgctgcaccagcattgagcaaaattctctggtcagttggtgcatcgattgtgcaagtcaatgcta

SEQ ID NO: 12822 - DNA, 75 bp, Artificial Sequence
  Synthetic
ttctgcagccatcagacctgaatcagcttgctcaattctcagatgtaatctatcctaaagttaagattaacagag

SEQ ID NO: 12823 - DNA, 75 bp, Artificial Sequence
  Synthetic
ctttggcagggagtcctccgagcaaatggaacccagtcaagaaagcagtacttgggtaaatgagtgctggccaga

SEQ ID NO: 12824 - DNA, 75 bp, Artificial Sequence
  Synthetic
gcattctcaagactcctccaccaggtccacagaacacagaaccccgaatgacaaagaagaggatttgcatcaccc

SEQ ID NO: 12825 - DNA, 75 bp, Artificial Sequence
  Synthetic
cactggacagaaggaaccaactcagatctgctacagcatccacaatcatcacaaagtcagcaatcgcatccttct

SEQ ID NO: 12826 - DNA, 75 bp, Artificial Sequence
  Synthetic
ctaaaaacaaactctctagcttgctcaaaattgcccaacagttaatcaatcatcccgtagatagatagatttcca

SEQ ID NO: 12827 - DNA, 75 bp, Artificial Sequence
  Synthetic
tgctaatacgcttaatgcatttaagaaaaaacttgaggatatatagtctgtatgattgaataaatgagatgggat

SEQ ID NO: 12828 - DNA, 75 bp, Artificial Sequence
  Synthetic
gatcatcttagaagaaaagaagaatgggcccggaccccataaatgtccggacactctagattccaacatggctct

SEQ ID NO: 12829 - DNA, 75 bp, Artificial Sequence
  Synthetic
atcaactcatcttagacaagcctattctgtgatgtggataatgatcatcttaagtctctttcaaatcatcccagg

SEQ ID NO: 12830 - DNA, 75 bp, Artificial Sequence
  Synthetic
tgtgactcctataaattcaaaggtcctaacacagctcggtgtaatcacaaaacatacccgccagcttaagtttta

SEQ ID NO: 12831 - DNA, 75 bp, Artificial Sequence
  Synthetic
ttcacattcaacaccaagctatttagtggttaaattggttcctactatcaatactgagagcacggtatgtaattt

SEQ ID NO: 12832 - DNA, 75 bp, Artificial Sequence
  Synthetic
tactagcctgagcagatataaagattcagtccgcgaactgattactccattagctaaaaatattgataacttgaa

SEQ ID NO: 12833 - DNA, 75 bp, Artificial Sequence
  Synthetic
ttccatcttgacaatacctaagaggagaaagagaatggccggagtggtcatagggctcgctgcacttggagtagc

SEQ ID NO: 12834 - DNA, 75 bp, Artificial Sequence
  Synthetic
cgcagctgcccaggcaacagctgctgttgcgctgatcgaggcaaagaaaaataccgaacagattcaagcattatc

SEQ ID NO: 12835 - DNA, 75 bp, Artificial Sequence
  Synthetic
cgaatcaattcaaaatactaataaagctgtatcatctattgagaaaggtctttcctctgccgcaattgcagtaca

SEQ ID NO: 12836 - DNA, 75 bp, Artificial Sequence
  Synthetic
ggctattcaaaatcagatcaataatgtaatcaacccagcgcttacagcattggactgcggggttactgatgcaca

SEQ ID NO: 12837 - DNA, 75 bp, Artificial Sequence
  Synthetic
attggggaatatattaaatttatacttaatcaagacactaacagttttccagaaacagatcacaaatcctgcact

SEQ ID NO: 12838 - DNA, 75 bp, Artificial Sequence
  Synthetic
gcaacctttaagtatccaagcattaaacattattatgcaagaaacatcatctgtactccgaaattttaccaaaac

SEQ ID NO: 12839 - DNA, 75 bp, Artificial Sequence
  Synthetic
tgatgagattgagcatactgatttgttaacatctggtctgatcactggccaagtagtaggtgtaaatcttacgaa

SEQ ID NO: 12840 - DNA, 75 bp, Artificial Sequence
  Synthetic
tctacagcttataattgctgcctttattccttctattgccccactcaatcaagcatacattttggattttattag

SEQ ID NO: 12841 - DNA, 75 bp, Artificial Sequence
  Synthetic
gataacagttaatataaacaattcagaaagcatgatccaaattccagaaaggattatggagcatggtatcagtct

SEQ ID NO: 12842 - DNA, 75 bp, Artificial Sequence
  Synthetic
gtatcaatttgggggtgatcagtgtaccttcagtgactggagtgcatattgcccatatagtgatgcaactctaat

SEQ ID NO: 12843 - DNA, 75 bp, Artificial Sequence
  Synthetic
ggcaccaggactgcaaaactgttttcgcggacaagcggcagattgtgttttttcaacagtaatgggttctttccc

SEQ ID NO: 12844 - DNA, 75 bp, Artificial Sequence
  Synthetic
gaatagatttgtatcagtgcaaggggtattttatgtcaactgtaaatttattagatgtgcttgcacccagccaca

SEQ ID NO: 12845 - DNA, 75 bp, Artificial Sequence
  Synthetic
acggctgataactcaagacgactcactctctctaactcaaattgatgcgaaaacatgtagaatgttaacattagg

SEQ ID NO: 12846 - DNA, 75 bp, Artificial Sequence
  Synthetic
ctttgtgcaattctccattaatgaatatgcaaatgtgacatactcttttaaaaataatgtgactgcaggtcaatt

SEQ ID NO: 12847 - DNA, 75 bp, Artificial Sequence
  Synthetic
aataatgacaaatcccattgatctatccactgagatcaaacagatgaatgactctgtagatgaagctgcccgtta

SEQ ID NO: 12848 - DNA, 75 bp, Artificial Sequence
  Synthetic
tattgagaaaagtaatgcagccctgaacaagttaatgtacgggggtagatcagatattgtgactactgtgttact

SEQ ID NO: 12849 - DNA, 75 bp, Artificial Sequence
  Synthetic
tgtaggatttattctactagtagtatatgtgatatttgtaacatacattctaaaaatattaatgaaggaggttgc

SEQ ID NO: 12850 - DNA, 75 bp, Artificial Sequence
  Synthetic
aagattaagaaactcaaatcatcctgacttaatcaaaccatataattacccaatgtaataatggtcatgtgaatc

SEQ ID NO: 12851 - DNA, 75 bp, Artificial Sequence
  Synthetic
tattatctcagtatgatatttacctgactgctatagactcaacagcttatctcgcattaacaaatttgtaacttc

SEQ ID NO: 12852 - DNA, 75 bp, Artificial Sequence
  Synthetic
atccttactcttatatatatatttcggcttataagattttaagaaaaaactgataagttgaggttactgagtgcg

SEQ ID NO: 12853 - DNA, 75 bp, Artificial Sequence
  Synthetic
aaagataatcaaacatgggcccgaccccttaaggcctcaacaaccctcaatgtcaatcatggcaaccaacctcag

SEQ ID NO: 12854 - DNA, 75 bp, Artificial Sequence
  Synthetic
cactatcaccaatgggaaattttcacaaaattctgatgagggaagcttgacagagcttccattttttgaacataa

SEQ ID NO: 12855 - DNA, 75 bp, Artificial Sequence
  Synthetic
cagaaaggtggccacaacaaaaagaacttgtcggtttgttttcagatctgtcataactctatgcaacttaactat

SEQ ID NO: 12856 - DNA, 75 bp, Artificial Sequence
  Synthetic
tttaatagttactgttgttgtgttattccagcaagcaggattcattaaaaggacagaatccaatcaggtatgtga

SEQ ID NO: 12857 - DNA, 75 bp, Artificial Sequence
  Synthetic
gacactgcaaaatgatatgcatggggtagtcacaatgtccaagggagtgataaccacactgaacaacttaattga

SEQ ID NO: 12858 - DNA, 75 bp, Artificial Sequence
  Synthetic
gatcacttcagttaatctacctttccaaatgaagcaattcggccaaggtattgtaacccaggtaacccaaatggt

SEQ ID NO: 12859 - DNA, 75 bp, Artificial Sequence
  Synthetic
tcgtcagtgcaatgctgtctgtaaggggccaacaatcggtccagacattcaaaacattgtataccctgcttctta

SEQ ID NO: 12860 - DNA, 75 bp, Artificial Sequence
  Synthetic
tgaatctatgatcaaacatccagtaaataatagtaatatattgctcagtgagataagacaacctttgaactttgt

SEQ ID NO: 12861 - DNA, 75 bp, Artificial Sequence
  Synthetic
tccaaacactggcaaactaaatggatgtactagaactccttccttttcagtgtataatgggttttggtgctacac

SEQ ID NO: 12862 - DNA, 75 bp, Artificial Sequence
  Synthetic
tcatgcagaatcagactggaattgcaacgggtcgtcaccttacatgcaggtatttagagtgggtgttgttactag

SEQ ID NO: 12863 - DNA, 75 bp, Artificial Sequence
  Synthetic
tgattatgattataatgtgattcataaaactctacacacaaaaacatctagattagccaatgtcacctatcaatg

SEQ ID NO: 12864 - DNA, 75 bp, Artificial Sequence
  Synthetic
ctcaactatatcaacaggatatgaatgttactttctgtgttcaacacctaatgttgatgaaattactgattacaa

SEQ ID NO: 12865 - DNA, 75 bp, Artificial Sequence
  Synthetic
gacacctggaattgaatcattgcaaatatataagattgataatagagggacgtttgcaaagttccctataactga

SEQ ID NO: 12866 - DNA, 75 bp, Artificial Sequence
  Synthetic
ccaattaaacaaagaactgctaacagcactttatcctggacctggtaatggggtgctataccaaggaaggctctt

SEQ ID NO: 12867 - DNA, 75 bp, Artificial Sequence
  Synthetic
atttccaatgcatggaggtatgcaatcatcagagctgaacaaagtaaacttaaataacactgtcctaagtcagtt

SEQ ID NO: 12868 - DNA, 75 bp, Artificial Sequence
  Synthetic
caatgataataagggatgtaatgcaactgaaattaaattggaatcagagtttccgggaacattcaccagtcccta

SEQ ID NO: 12869 - DNA, 75 bp, Artificial Sequence
  Synthetic
ttactctaaccaggttatgctaaactacattctaatatgtgagatgattgagaatttgccaggtaattgtgattt

SEQ ID NO: 12870 - DNA, 75 bp, Artificial Sequence
  Synthetic
gcaaattgtagctccaaagaatatgagcatgggatctgaaagtcagctatactcaataaataataaactttatct

SEQ ID NO: 12871 - DNA, 75 bp, Artificial Sequence
  Synthetic
ataccaaaggagctcttctaggtggccttatcctcttatatatgaagtgggaactagattaacaaaccgtcagtt

SEQ ID NO: 12872 - DNA, 75 bp, Artificial Sequence
  Synthetic
tagattaagggcaattaatagattcttaataaaatcaacaactcgacctgggtctgagggttgtaacatttatag

SEQ ID NO: 12873 - DNA, 75 bp, Artificial Sequence
  Synthetic
agtatgccccaaggtatgtgtgacaggagtttaccaagcaccgtggatccttcacgtgtcgaaagcaggttcgca

SEQ ID NO: 12874 - DNA, 75 bp, Artificial Sequence
  Synthetic
gtctattgcaaaagtgctttatgcagtagcatggagcaaagatcacatgagcagaaaagggcccctcttttcaat

SEQ ID NO: 12875 - DNA, 75 bp, Artificial Sequence
  Synthetic
ctgtgataatgacacatgttttcttacaaaatctttagcatctgagcatgttcactctggatattctattacaag

SEQ ID NO: 12876 - DNA, 75 bp, Artificial Sequence
  Synthetic
atgctatttggaaaatagtgaacgacatataatatgtgtagtaattatggagttagatgcatcaccctgggcaga

SEQ ID NO: 12877 - DNA, 75 bp, Artificial Sequence
  Synthetic
aatgagaattcaatcagttatttataatattaccttaccatcttgaatttaatggagctttgaatcttgaaatta

SEQ ID NO: 12878 - DNA, 75 bp, Artificial Sequence
  Synthetic
aggaatcttatgacaaattctgtaacattagtatctaattgtttatctcacatgaacccatctatcataaagtga

SEQ ID NO: 12879 - DNA, 75 bp, Artificial Sequence
  Synthetic
attataggtttaagaaaaaagttgagtagaagtgatctttcattagcttgcaccctaaaataaattgcggttcaa

SEQ ID NO: 12880 - DNA, 75 bp, Artificial Sequence
  Synthetic
tgaatcataatattacatcacaggacaataataatgggccagaatggctgccccctcgcagatcattctgcccga

SEQ ID NO: 12881 - DNA, 75 bp, Artificial Sequence
  Synthetic
agtccaccttgattctcctattgttcaaaacaagcttttatatcttgttagagttgcaggtcttcctttgcctga

SEQ ID NO: 12882 - DNA, 75 bp, Artificial Sequence
  Synthetic
cttattctttgaggatgaccatttccccggagtagactggcagagagtaaggcgcgaggaaaatcgactatcgtc

SEQ ID NO: 12883 - DNA, 75 bp, Artificial Sequence
  Synthetic
taggcttgaatctgtccgctcacgtctactatcaaagcttaacactgctagagggaagaatcccatcaataagac

SEQ ID NO: 12884 - DNA, 75 bp, Artificial Sequence
  Synthetic
tgctcccctaattagattatggccttcatgtcttccttttattcacgagtttgtatttccagacgcgctagctcg

SEQ ID NO: 12885 - DNA, 75 bp, Artificial Sequence
  Synthetic
cttttctgaagccgatcgaattactgcccaggctattcagcatcttagtcctggaattacagcactattgaattc

SEQ ID NO: 12886 - DNA, 75 bp, Artificial Sequence
  Synthetic
gataagtcaaaaactaacacactgtactgagctattttctcacaatgaaactaagtgtacagagcctgaatatca

SEQ ID NO: 12887 - DNA, 75 bp, Artificial Sequence
  Synthetic
tactaggcctagaaatctcaatgacttgaacaattgctatgtaggagctgaatggaaagaccaattcaacatgtg

SEQ ID NO: 12888 - DNA, 75 bp, Artificial Sequence
  Synthetic
gtttcttatcaggcatcaaatgcgacttttgattatgaagaacaatgagtcggtaaacccaaatctaattgtaga

SEQ ID NO: 12889 - DNA, 75 bp, Artificial Sequence
  Synthetic
gattgattacagagagaaagctgccataatcacacctgaattagtcacactgtggtcctctgaatctaatttcgt

SEQ ID NO: 12890 - DNA, 75 bp, Artificial Sequence
  Synthetic
tacatactttacttttgaaatggtcttgatggtctgtgatctgtatgagggaagaatgaatgtcattgcagttgc

SEQ ID NO: 12891 - DNA, 75 bp, Artificial Sequence
  Synthetic
taagatgagttgctatctctcccctcttgtaccaaggcttaagaaaatcttttcaattgtagatgatctttgtct

SEQ ID NO: 12892 - DNA, 75 bp, Artificial Sequence
  Synthetic
tatgctcggcaaccaagtgtatcctgtagtagcttcattagaaagtcttgtttatggccagctacaattacttga

SEQ ID NO: 12893 - DNA, 75 bp, Artificial Sequence
  Synthetic
ccctgttgaagaagtttgcggtgatttctattcttttatatgttctgagctagttacagctttgcttgcaagtga

SEQ ID NO: 12894 - DNA, 75 bp, Artificial Sequence
  Synthetic
tcagattacattagagaacgccatttcaattgcagggtccttaacatcttgttattgcgggatcagtccagattt

SEQ ID NO: 12895 - DNA, 75 bp, Artificial Sequence
  Synthetic
agttgctgaattgttatgtgtaatgcggttgtggggccatccaatgctcacttctgaaaaggctgcagagaaagt

SEQ ID NO: 12896 - DNA, 75 bp, Artificial Sequence
  Synthetic
aaggaagtccatgtgtgcaccaaaggtaattgatttggaaacaacccttaagacattagcttttttcaacgagat

SEQ ID NO: 12897 - DNA, 75 bp, Artificial Sequence
  Synthetic
catcatcaatggctacaggagaaaacacaatggtatctggcccaaatgtaaattaccaccatttgcatcgttaag

SEQ ID NO: 12898 - DNA, 75 bp, Artificial Sequence
  Synthetic
tctaagagaactcaaacatgataattctgaactatcacaccaatatacattaactcattggaaggaaattgctta

SEQ ID NO: 12899 - DNA, 75 bp, Artificial Sequence
  Synthetic
cattgagtttgagaaaagttttgatgccgatcctggggatgatttgagtatattcatgaaagacaaagcaattag

SEQ ID NO: 12900 - DNA, 75 bp, Artificial Sequence
  Synthetic
tgcgccaaaaaaggattggttaagtgtcttcaggaagagcttaattaagccattatgtgaatccttacactcacc

SEQ ID NO: 12901 - DNA, 75 bp, Artificial Sequence
  Synthetic
cctaccagaaccttttaacagaaggttgttactcaatttcttgaacgatgactccttcgatccagcagttgaatt

SEQ ID NO: 12902 - DNA, 75 bp, Artificial Sequence
  Synthetic
gcagtatgttacatcaggagaatacttggatgatgagaccttctgtgcatcatattctctcaaggaaaaggaaat

SEQ ID NO: 12903 - DNA, 75 bp, Artificial Sequence
  Synthetic
caaagaaaccggcagaatctttgctaagcttaccaaaaagatgagatcatgtcaggttatcagtgaatcattact

SEQ ID NO: 12904 - DNA, 75 bp, Artificial Sequence
  Synthetic
tgcttctcatgcaggtaagctatttagagaaaatggtgtagtgatggatcatcttaatttgactaaatctttact

SEQ ID NO: 12905 - DNA, 75 bp, Artificial Sequence
  Synthetic
aacaatgtcacaaataggcctgatatctagaaaggaacgaaggaatgtaagagaaaatattacagtcgtgtccaa

SEQ ID NO: 12906 - DNA, 75 bp, Artificial Sequence
  Synthetic
gatcagtaaacatgataaatcttctgttcaaaatcctgggttcaagccagatcatcctaatgtatcagaagtcac

SEQ ID NO: 12907 - DNA, 75 bp, Artificial Sequence
  Synthetic
tgagattgctgcattctttctaaccactgacctacagaaatactgtcttaattggagataccaatcaataattct

SEQ ID NO: 12908 - DNA, 75 bp, Artificial Sequence
  Synthetic
atttgccacaaatttaaataaattatacggatacactcatctatttgagtggatccatctaagattgatgaggtc

SEQ ID NO: 12909 - DNA, 75 bp, Artificial Sequence
  Synthetic
tacactctatgttggagatccctttaacccaccacggttcatagataccaccaatttggatgaagttcctaatga

SEQ ID NO: 12910 - DNA, 75 bp, Artificial Sequence
  Synthetic
gggcatctttattgtgtcacccagaggaggaatagaaggtttgtgccaaaaaatgtggacaatgatttccattgc

SEQ ID NO: 12911 - DNA, 75 bp, Artificial Sequence
  Synthetic
agttatcatactctctgcaacagaggcgaatacccgtgtaatgagtatggtacaaggagacaatcaagcaattgc

SEQ ID NO: 12912 - DNA, 75 bp, Artificial Sequence
  Synthetic
cattacagcaaaagtcccaagagcagttccttatcgtgagaagaagagaattgcctatgagaacagtaaattatt

SEQ ID NO: 12913 - DNA, 75 bp, Artificial Sequence
  Synthetic
tatagagagattaagagccaataacaaaggattgggacatcaccttaaggagcaggagaccattctgagctcaga

SEQ ID NO: 12914 - DNA, 75 bp, Artificial Sequence
  Synthetic
gttttttgtatatagtaaacgaatcttctttcgcggtagaattctaagccaggctctaaaaaatgttagcaaact

SEQ ID NO: 12915 - DNA, 75 bp, Artificial Sequence
  Synthetic
taatctcattgctgatgtgcttagcgaatgcagccagacttcttgtgcaaatctaaccacaactgtaatgcgctt

SEQ ID NO: 12916 - DNA, 75 bp, Artificial Sequence
  Synthetic
gactgaaaatggagtagagaaggacatatgttattttctgagcatctttttatctgtcagacagctggtttatga

SEQ ID NO: 12917 - DNA, 75 bp, Artificial Sequence
  Synthetic
cttattattccctatgactactttcattgaggactccataaccactctttaccttaaccatcctatactgattgc

SEQ ID NO: 12918 - DNA, 75 bp, Artificial Sequence
  Synthetic
aaggctgtgtgttctaccatcccagttaggtggcttaaataattactcaatcagcagactatttaacagaaacat

SEQ ID NO: 12919 - DNA, 75 bp, Artificial Sequence
  Synthetic
tggagaccctttaacatctgctattgcagacctcaaaagattcatcaatgtaggaatactgccaaaatggattct

SEQ ID NO: 12920 - DNA, 75 bp, Artificial Sequence
  Synthetic
ttcaaatttacttagcagagatcctggtgaggggacatggagcacactttcatctgatccctatgctctcaatat

SEQ ID NO: 12921 - DNA, 75 bp, Artificial Sequence
  Synthetic
caactacctataccctcccacaacataccttaagaaacatactcaaagagtgcttattgagcatagtgtcaatcc

SEQ ID NO: 12922 - DNA, 75 bp, Artificial Sequence
  Synthetic
tatgctgtatggaatttttacagatgatgccctccaggaagagaatcggctctctcaatttttactggacagacc

SEQ ID NO: 12923 - DNA, 75 bp, Artificial Sequence
  Synthetic
catagtaatgccgagggttgcccatataatcattgaacagacttcatgtggtcggcggcggcaaattcaggggta

SEQ ID NO: 12924 - DNA, 75 bp, Artificial Sequence
  Synthetic
tttggatactactagaacaataatcaggcatgcattgtcaaggcaaccgcccgggtataagaaagttgagaaaat

SEQ ID NO: 12925 - DNA, 75 bp, Artificial Sequence
  Synthetic
attagaatacaacagattatatttagcatacaatcaggaattaatagcaaaaccaaacaaaaagcgagcactgag

SEQ ID NO: 12926 - DNA, 75 bp, Artificial Sequence
  Synthetic
agctaaagatgaggaactattgcctgtgtgcagtattgacctttcgaaactcttgaggaaactatcatggtcttc

SEQ ID NO: 12927 - DNA, 75 bp, Artificial Sequence
  Synthetic
acttctatcaggtcgtgggattgatggattagagacaccagatccgatagagctagtgacaggttatctcattca

SEQ ID NO: 12928 - DNA, 75 bp, Artificial Sequence
  Synthetic
gggaaatgatacatgcctaccatgcttacaaggtgatcggaaatttacatggttttttgttcccccaggtatcac

SEQ ID NO: 12929 - DNA, 75 bp, Artificial Sequence
  Synthetic
attggatgcaccccctgaagataaccctcctattagggtgccttacattggatcaaggacagatgaaagacgagt

SEQ ID NO: 12930 - DNA, 75 bp, Artificial Sequence
  Synthetic
cgcatcactggggtatgttaaaggtgccacaccagcccttaaggcagccctgagattggctggggtgtatatctg

SEQ ID NO: 12931 - DNA, 75 bp, Artificial Sequence
  Synthetic
ggcctttggggacacggacacaaattgggatgatgcttatcatctagcatcaactagaatttcaatcacattgga

SEQ ID NO: 12932 - DNA, 75 bp, Artificial Sequence
  Synthetic
ccagctaagagctcttactcctctgccgacaagtgctaacttaactcatagattggatgatgggttaagtcagat

SEQ ID NO: 12933 - DNA, 75 bp, Artificial Sequence
  Synthetic
gaaattcacacctgctagctcatatgcctactctagttatgtacatatctcgaatgacaaccaaaacttagaggt

SEQ ID NO: 12934 - DNA, 75 bp, Artificial Sequence
  Synthetic
cttgcagaaacaattggattccaacttgatataccaacaacttatgatattaggtctcggtatcatagaaacctg

SEQ ID NO: 12935 - DNA, 75 bp, Artificial Sequence
  Synthetic
gttacagcttcctcaatgggaaaacaagaatgatctatctctccatctgcatacaggaggctcgtgctgtgtgag

SEQ ID NO: 12936 - DNA, 75 bp, Artificial Sequence
  Synthetic
accagtagatatgtgcatcgtcaatgaatcagatgtagaagtcccaaccttggttgtaccatattccaataagtt

SEQ ID NO: 12937 - DNA, 75 bp, Artificial Sequence
  Synthetic
cgtgtatgaccaaaatccattaaatcatgaagatcagctgcatattgggaatttatcatttcaagcaaatctgtc

SEQ ID NO: 12938 - DNA, 75 bp, Artificial Sequence
  Synthetic
tggattagacctgatcccaacattggaaaaaatccctctgctggctcatttagtagggatgcaattttctcacag

SEQ ID NO: 12939 - DNA, 75 bp, Artificial Sequence
  Synthetic
catttccggtttagatgaatcagtttcattgatgaatgatgcagtagttgagactgattatgcaaataactggat

SEQ ID NO: 12940 - DNA, 75 bp, Artificial Sequence
  Synthetic
cagcgagtgcctaaacacacaattggataaagttttttattatgcagcatggagtgtgatgctggaaatgtcata

SEQ ID NO: 12941 - DNA, 75 bp, Artificial Sequence
  Synthetic
tcaaatgtactatttgagaatcactggacctactgccatagccgattatatctcaatagttctggatagaatccc

SEQ ID NO: 12942 - DNA, 75 bp, Artificial Sequence
  Synthetic
cggtcttgccctgacaggtatatcatctacaattaaccatccaaaaatattaaggagattgataaacctaggaat

SEQ ID NO: 12943 - DNA, 75 bp, Artificial Sequence
  Synthetic
tgtcgtaccaagcaattctccttatcttgcaaccttggactatcaaaagataacgacatctgcaattatgtgggg

SEQ ID NO: 12944 - DNA, 75 bp, Artificial Sequence
  Synthetic
tgtccataaagttctatctgatattagtgctggaattgatatagaattagttataccatcagaggattcaactga

SEQ ID NO: 12945 - DNA, 75 bp, Artificial Sequence
  Synthetic
gctttcagacagagttttaaatttgattgcaagaaaattgtcattggtatccttaattctaactatctctaagga

SEQ ID NO: 12946 - DNA, 75 bp, Artificial Sequence
  Synthetic
tttggcatatgttaggggtttgacaccagaacagaaatgcaaatctctcacagacaaattgatggctgagttaga

SEQ ID NO: 12947 - DNA, 75 bp, Artificial Sequence
  Synthetic
tctgtattatattgatccagaattggcaaataaattgaaattgatgatttgcgaacccaaaatatctgcattccc

SEQ ID NO: 12948 - DNA, 75 bp, Artificial Sequence
  Synthetic
aagcaatcattactatctaatgagaaagttactgaattggataagggagtctgatgaagcccaatgctttttgtc

SEQ ID NO: 12949 - DNA, 75 bp, Artificial Sequence
  Synthetic
tgcctactatgacagttttggttttctagatacaatgatacaaattgatccactgccatcgaatgatgaagagaa

SEQ ID NO: 12950 - DNA, 75 bp, Artificial Sequence
  Synthetic
tagtgcaatggcaacacttactaagtttgactttactgtcagtttaactaacattgataaggatgcagagaaaca

SEQ ID NO: 12951 - DNA, 75 bp, Artificial Sequence
  Synthetic
ctgctatcctaagacagatccaagcttacaactgtttatgaaaggggttcctgatcccccaattcaccatgttct

SEQ ID NO: 12952 - DNA, 75 bp, Artificial Sequence
  Synthetic
gcgccccatagggttatcatctacatcttggtacaagggcttatcaattatcaacatacttaagaggatgaagat

SEQ ID NO: 12953 - DNA, 75 bp, Artificial Sequence
  Synthetic
cccctcaggtgatcatctttatcttgcagaaggcagtggggctttgatgacattgattgagacttactttcctgg

SEQ ID NO: 12954 - DNA, 75 bp, Artificial Sequence
  Synthetic
caataaaatcttttacaacagcctattctccagtggacaaaaccctccccaaagaaatttcaaaccactaccaac

SEQ ID NO: 12955 - DNA, 75 bp, Artificial Sequence
  Synthetic
acaattcgctgaaagtatggtttatatgaatatcatgcagcaagaatctacccttgaagacggagttgagttgtt

SEQ ID NO: 12956 - DNA, 75 bp, Artificial Sequence
  Synthetic
tgttcccttatggagtggttacagtaaacagacagatttgggaacaaaagagtgtgttgaatacatccttgagag

SEQ ID NO: 12957 - DNA, 75 bp, Artificial Sequence
  Synthetic
tgtcgctgggaaccgagtgactctaatttcctcggatcttgaggaggggctaggtgttaatccaggagtgatatc

SEQ ID NO: 12958 - DNA, 75 bp, Artificial Sequence
  Synthetic
taaggcaatgatacacacaatcttattagcatatttgctactaagagagaatggaatatttattctgaaagttaa

SEQ ID NO: 12959 - DNA, 75 bp, Artificial Sequence
  Synthetic
cttcactcccttttcaaaattctccaggattatttcactgatttatcagaagtttaaggatgttactattttaag

SEQ ID NO: 12960 - DNA, 75 bp, Artificial Sequence
  Synthetic
atctgcatattctgatcccagtcatgatgagttttatctcgtggcagtagcatcatgtgagtccactgtcactga

SEQ ID NO: 12961 - DNA, 75 bp, Artificial Sequence
  Synthetic
tttcaatcaggcaagatacatatcagagagcatagatgaatcatcactaacgttaattagctctgaagtcatttc

SEQ ID NO: 12962 - DNA, 75 bp, Artificial Sequence
  Synthetic
tcaaatccatacagaacttgaaattcataagaatgatgttctagatgtcatcaacatacaaatagcaactgcaca

SEQ ID NO: 12963 - DNA, 75 bp, Artificial Sequence
  Synthetic
gtgtaatgagaactatgatgatcacttattgctcacaagattggcatcagtcaatcacctcaaccgtgtcttcct

SEQ ID NO: 12964 - DNA, 75 bp, Artificial Sequence
  Synthetic
tactgaagcatcagcatcattgcacgatatggtagagaggattagtgcagtagtaaccctgtatttgaaagagac

SEQ ID NO: 12965 - DNA, 75 bp, Artificial Sequence
  Synthetic
tatcaatattatagagtcagcacaattggataggactaaattaatttacaactcatacaatgtatccaattacgg

SEQ ID NO: 12966 - DNA, 75 bp, Artificial Sequence
  Synthetic
gaaaatacgcacatcggcaaagattactgcccgattgattttagacattataattagaaattggaccagactagg

SEQ ID NO: 12967 - DNA, 75 bp, Artificial Sequence
  Synthetic
aaatggattacggatcagagttaaaaattctattgagcaaggccagtttgttttaagttgtgtaatgacacctgc

SEQ ID NO: 12968 - DNA, 75 bp, Artificial Sequence
  Synthetic
cacatttcttaaatacagcactgcaaggagatacatcactaagactctcggacttgatcaactgaatatagaatt

SEQ ID NO: 12969 - DNA, 75 bp, Artificial Sequence
  Synthetic
tactcagaatattcaatgcctcttatcgcgatcagaacaaaaaagggtctggaaagatataggttgtatggtatt

SEQ ID NO: 12970 - DNA, 75 bp, Artificial Sequence
  Synthetic
tgttgagtcacagtttacagatcaaatctctgatgacataccagactcagattttatttgggatgaagatgagca

SEQ ID NO: 12971 - DNA, 75 bp, Artificial Sequence
  Synthetic
aattgagcgcggaatcgacggggaggagatctaagatgataatggagaaaattacagttgtttttttaagaaaaa

SEQ ID NO: 12972 - DNA, 75 bp, Artificial Sequence
  Synthetic
ggagatctaagatgataatggagaaaattacagttgtttttttaagaaaaacgacttattgattttccccttggt

SEQ ID NO: 12973 - DNA, 75 bp, Artificial Sequence
  Synthetic
accagagggaaaattaagaaaggtcgttccaagacgacttaaaagaagatatcgtaggcccgaatgtggcacaag

SEQ ID NO: 12974 - DNA, 75 bp, Artificial Sequence
  Synthetic
ccggggccgaaatcgacaacaaagggtttggattggtgtaaggtttaagtagactgtaccaagagtgaattacag

SEQ ID NO: 12975 - DNA, 75 bp, Artificial Sequence
  Synthetic
gacagactccaatcatgtcgtccgtatttagagccttcgagcagtttactttagagcaggaacaacatgagagag

SEQ ID NO: 12976 - DNA, 75 bp, Artificial Sequence
  Synthetic
gcagtgatcttgaggtaccccctgagaccctgcaaaccaccataaaggtgtttattctgaacactcctaaccccc

SEQ ID NO: 12977 - DNA, 75 bp, Artificial Sequence
  Synthetic
aaattagatatcaaatgatgaacttttgcttaagaatcatagccagcagctcatcgcgcattgctcagaaaaatg

SEQ ID NO: 12978 - DNA, 75 bp, Artificial Sequence
  Synthetic
gtgcattgctcaccctgcttagcttgcctactgctatgatgcagaaccacatcagaattgcagatcggtcaccag

SEQ ID NO: 12979 - DNA, 75 bp, Artificial Sequence
  Synthetic
attcaataattgagcgaatagaaattgaggggtttgaacaaggcacttacagactgcgcccgaacgctcgcacgc

SEQ ID NO: 12980 - DNA, 75 bp, Artificial Sequence
  Synthetic
ccatgactaatggggaaataactgcccttgaacagatggcggaagatttgccagaaggcattgccaatgatactc

SEQ ID NO: 12981 - DNA, 75 bp, Artificial Sequence
  Synthetic
cttacattaaccccaacattgagggagatgattgtgatgaaatggagaagtttcttaatgccatttacagtgtgt

SEQ ID NO: 12982 - DNA, 75 bp, Artificial Sequence
  Synthetic
tagtgcaggtctggatcacagtatgcaagtgcatgacagcatatgatcagcccactggatcagatgagaggcgac

SEQ ID NO: 12983 - DNA, 75 bp, Artificial Sequence
  Synthetic
tggcaaaataccaacaacaaggaaggcttgatcagaagtatgtcttacaaaatgaaatcagaagaatcatccaga

SEQ ID NO: 12984 - DNA, 75 bp, Artificial Sequence
  Synthetic
aatgtatcagagacagtttgacagtcagacaatttttgacatttgaactccagactgcaagaaagcaaggtccaa

SEQ ID NO: 12985 - DNA, 75 bp, Artificial Sequence
  Synthetic
taacaagtcgttattatgctatggtgggtgacattgggaaatatatagagaatgcagggatgagtgcttttttca

SEQ ID NO: 12986 - DNA, 75 bp, Artificial Sequence
  Synthetic
tgacaacccgttttgcgcttggaactaagtggccaccccttgcactagctgccttttcaggtgagttaatcaagc

SEQ ID NO: 12987 - DNA, 75 bp, Artificial Sequence
  Synthetic
ttaagtcccttatgatgctgtatagaagattgggagagagggcgagattcatggcccttctggaaatgcaggaaa

SEQ ID NO: 12988 - DNA, 75 bp, Artificial Sequence
  Synthetic
tgatggaatttgcccctgcaaattatcccttaacatacagctatgctatggggataggaagtgtccaagaccctc

SEQ ID NO: 12989 - DNA, 75 bp, Artificial Sequence
  Synthetic
agatgagaaattacaattttgcaaggacattcttgaatgcagcatacttccagcttggtgttgagaccgcaaatc

SEQ ID NO: 12990 - DNA, 75 bp, Artificial Sequence
  Synthetic
ggcagcaaggctctgtagacaagggaatggcagaagaattgggactatctgaagcagataagcgtgaaatgtctg

SEQ ID NO: 12991 - DNA, 75 bp, Artificial Sequence
  Synthetic
caacactgacacgtctaaccacaggaagaggtgcagtgggacccgcaggaaatgtagatgtgttgggcagaagac

SEQ ID NO: 12992 - DNA, 75 bp, Artificial Sequence
  Synthetic
caaccaccagattacagcagcaagatccagcacaattcagagttgttgaagaagatcaggaggatgatgaggatg

SEQ ID NO: 12993 - DNA, 75 bp, Artificial Sequence
  Synthetic
aagatgatgatgaaggatatgttcagccaagagcattgcaactgccgccaaatcccccagccaggaatgatgagt

SEQ ID NO: 12994 - DNA, 75 bp, Artificial Sequence
  Synthetic
ggttcagaagaatggccgaacaagaagtccagggtagacttgtgaggaccaccgctgacatacaccagatcatcc

SEQ ID NO: 12995 - DNA, 75 bp, Artificial Sequence
  Synthetic
ccgcaaccccaggaaatcaggaggatgaaaatcccctcgtagatatggatgagtgaaaaacagctatcaatcaag

SEQ ID NO: 12996 - DNA, 75 bp, Artificial Sequence
  Synthetic
ccactgcacacttggaaaatccaatccaattccccacaacccaagctcgatgccactgggagaccaaaaaacaaa

SEQ ID NO: 12997 - DNA, 75 bp, Artificial Sequence
  Synthetic
tataattttaaagaaaaacaaagatgggcccgaatgggcaaaggtttcggacatcaacaatccgcggctcagctc

SEQ ID NO: 12998 - DNA, 75 bp, Artificial Sequence
  Synthetic
attcggacaatccctccacacgcaccaccaaacacccgcgctcagccccattcagcatggacaccagcccatcag

SEQ ID NO: 12999 - DNA, 75 bp, Artificial Sequence
  Synthetic
atgctgagatagcggcctggattgacaaaggattggacacagtagaacattttataacatctggaagtgggactc

SEQ ID NO: 13000 - DNA, 75 bp, Artificial Sequence
  Synthetic
cgccgcagcaccccagaagccaaagagagccacagtcacaaggtctgcagcccagcaaaccccccaggaaacagc

SEQ ID NO: 13001 - DNA, 75 bp, Artificial Sequence
  Synthetic
ccgagaaacaacaacccgcaacaaccccaacccgagacccgtctctgaagaaggccccttccaaagatccagggg

SEQ ID NO: 13002 - DNA, 75 bp, Artificial Sequence
  Synthetic
cacggcccaagcaactatcaacagtcagatttgggccgggagttaccgttgcaccttgtggtccagaggattcga

SEQ ID NO: 13003 - DNA, 75 bp, Artificial Sequence
  Synthetic
tctatgaagaggtaattcccggagggtcaacctgtgccggccagaagcaaccagggaaagatgacagaaaaacga

SEQ ID NO: 13004 - DNA, 75 bp, Artificial Sequence
  Synthetic
aggccaaaaacaggatcctgagcatgcaagtagatgataccgtggtcggtggtgtggaccagggcatgcctagcc

SEQ ID NO: 13005 - DNA, 75 bp, Artificial Sequence
  Synthetic
attttaagagggggagatacagcttcaatgagtgcactgaaaggatctggaatcgccatcgcagagaatactcct

SEQ ID NO: 13006 - DNA, 75 bp, Artificial Sequence
  Synthetic
tcgattggagcacaggcagccctagagtcgtcgagtggtgcaacccaagctgtgtcccaattacaaattcaggag

SEQ ID NO: 13007 - DNA, 75 bp, Artificial Sequence
  Synthetic
caagagagccctgtagatgtggcaactgtcccagaacttgctccatgtgtgaaggagatactgagatatttgaag

SEQ ID NO: 13008 - DNA, 75 bp, Artificial Sequence
  Synthetic
gtcatagaaactagaatgacacagctggagtggaaagtggacaaaataattggtcagaataatatgattcagcaa

SEQ ID NO: 13009 - DNA, 75 bp, Artificial Sequence
  Synthetic
atcaggaatgatcagaccgctctaaaggccaatatggccacaattgaaggtatactcaccacaatcaaaattatg

SEQ ID NO: 13010 - DNA, 75 bp, Artificial Sequence
  Synthetic
gaccctggagtgccaacaagctccaatgcttcacaggttaagaaattattcaaagaaagtccagtagtcataagt

SEQ ID NO: 13011 - DNA, 75 bp, Artificial Sequence
  Synthetic
ggaccttgcagtgcagataatccgttaatcagtgctggttcactccagctggatgaattggctcgtccctctatt

SEQ ID NO: 13012 - DNA, 75 bp, Artificial Sequence
  Synthetic
ccaaccaccatggcaaaaaagaaacaagtcagcactgattcagagatatctgggtatcggctcacattaataaca

SEQ ID NO: 13013 - DNA, 75 bp, Artificial Sequence
  Synthetic
ttgatttccgactgcatccaaaaccctattcagcagcagacatttgagaaaaaggcgggcctggtcaaaaccgaa

SEQ ID NO: 13014 - DNA, 75 bp, Artificial Sequence
  Synthetic
caagagttcaaaaaactcaagagagagatcctcagagcagctgtgtaaaagtctgtcaggattgcagacagcact

SEQ ID NO: 13015 - DNA, 75 bp, Artificial Sequence
  Synthetic
ccgctatcccccagcatcaattgcagcagcacagccaaggatgcacaccgcaagcactgctctccctacaccaac

SEQ ID NO: 13016 - DNA, 75 bp, Artificial Sequence
  Synthetic
ccccatccatccatctcgccctcctgtgccagctacattctttttgcaagctttaagaaaaaacttataaactga

SEQ ID NO: 13017 - DNA, 75 bp, Artificial Sequence
  Synthetic
tacactaaaagtgggccagaacggtttaaggccctgattgcccaacatgagtagtatggcctcatcaattaagct

SEQ ID NO: 13018 - DNA, 75 bp, Artificial Sequence
  Synthetic
gccagtggatctaagaagtgaaaaatatcatcttcacccattcccaattgtgcagactccttcaggtgaggatgg

SEQ ID NO: 13019 - DNA, 75 bp, Artificial Sequence
  Synthetic
aaaagggagcagactggttaagcagttgcgcataaagaatctaatgcctagagggtcaactgagcaacctatcac

SEQ ID NO: 13020 - DNA, 75 bp, Artificial Sequence
  Synthetic
ttttttgaacacatacgggttcgtacgcccaatgaggactcacggtgaatttttctctgagtttcacaggcctga

SEQ ID NO: 13021 - DNA, 75 bp, Artificial Sequence
  Synthetic
taccacaccgtgtgtcactgcctgcatgctgccattcggtgctggcccattccttgacaatccgacacgcttgat

SEQ ID NO: 13022 - DNA, 75 bp, Artificial Sequence
  Synthetic
tgatgagatagataaagctcacattataattaggaaaagtgccagctaccgtgaggagattatatttgacatcaa

SEQ ID NO: 13023 - DNA, 75 bp, Artificial Sequence
  Synthetic
gaagttaccatcaatgttaacacagcaccaactggctcaggacaaaattatctgtgtctcctcagagaagtttct

SEQ ID NO: 13024 - DNA, 75 bp, Artificial Sequence
  Synthetic
taagtcaccagggaaggtcacgtctggagtggattacctctactcgataaccttcatgtcaatcacttactgccc

SEQ ID NO: 13025 - DNA, 75 bp, Artificial Sequence
  Synthetic
tgcaagttataagttcagggtttcaaggccattacaaatcatcagagcaaaagccatgaggagtgttcatctcga

SEQ ID NO: 13026 - DNA, 75 bp, Artificial Sequence
  Synthetic
aataatgatgagaattgaatgcaaaaaagactcgccactgctgaagaatatgattactaccgatggctctgaagg

SEQ ID NO: 13027 - DNA, 75 bp, Artificial Sequence
  Synthetic
tggggtggtatctgtctggtttcacatttgtaatctatataaggggaataatccggcaaaagaatatgatgattc

SEQ ID NO: 13028 - DNA, 75 bp, Artificial Sequence
  Synthetic
atacttttccaaaaaatgcaaacagatggatattgagtgtggcattgttgacatgtggggaccaacactgatggt

SEQ ID NO: 13029 - DNA, 75 bp, Artificial Sequence
  Synthetic
gcatgctcacggacacattccaaagatggctaaacctttctttaacagaaaaggttgggcatgttacccgttttc

SEQ ID NO: 13030 - DNA, 75 bp, Artificial Sequence
  Synthetic
cgacgctgcagccgggctaagcaagactctgtggtcagtgggtgcaactatagttgaagtcaatgccatactgca

SEQ ID NO: 13031 - DNA, 75 bp, Artificial Sequence
  Synthetic
ggcgtctgatttagctcagctaacacatgttcatgacatcatataccccaaagtgaagttaagcaaggaattggt

SEQ ID NO: 13032 - DNA, 75 bp, Artificial Sequence
  Synthetic
caattatcaaccctcaaaatggaaccctctcaagaaaattgtatccatctaatcagtggctccattaatttaccc

SEQ ID NO: 13033 - DNA, 75 bp, Artificial Sequence
  Synthetic
ctctagtcctcacgcgcttagaagacccccttgtattctgcagatcagccccacatgctagcaaccccagacgct

SEQ ID NO: 13034 - DNA, 75 bp, Artificial Sequence
  Synthetic
caggtaccgcgttgttccaaggcttccagcaattccgagtccacgattcatctgaggaaaagacctccacagtac

SEQ ID NO: 13035 - DNA, 75 bp, Artificial Sequence
  Synthetic
gctgccatgcgctatcccgctataacataggagtgtgctactctccattctgtccacgcccgagcaaattatatc

SEQ ID NO: 13036 - DNA, 75 bp, Artificial Sequence
  Synthetic
tattagtagatttaagaaaaaatgtaaccatctttaagtgcaagttgggcccgaccccctaacacagcatccact

SEQ ID NO: 13037 - DNA, 75 bp, Artificial Sequence
  Synthetic
gactgccgcatgccacgtctggatccagatacaacccgctgccacaacgaccaaagttaagtgaaacaatgctca

SEQ ID NO: 13038 - DNA, 75 bp, Artificial Sequence
  Synthetic
actcattttatcaaattatctgcttagcagtctgtttgacaacttacactgtaataagcattgatcaacataatc

SEQ ID NO: 13039 - DNA, 75 bp, Artificial Sequence
  Synthetic
ttctaaaagcaggagtaattgtcaagagcataaaaggccttaatttctactctcgcggtcaagcaaattatataa

SEQ ID NO: 13040 - DNA, 75 bp, Artificial Sequence
  Synthetic
tagtgaaattgatccctaatgttaatgttacagacactgactgtgatataggtagcattaagaggtataatgaaa

SEQ ID NO: 13041 - DNA, 75 bp, Artificial Sequence
  Synthetic
cagtgtattcattgatcaaacctcttgcagataatatagactatctccgaacacaatttgcccctaccaaacgta

SEQ ID NO: 13042 - DNA, 75 bp, Artificial Sequence
  Synthetic
agaagaggtttgcaggtgtggccatagggttaactgctttaggtgttgcaactgccgctcaagttacagctgctg

SEQ ID NO: 13043 - DNA, 75 bp, Artificial Sequence
  Synthetic
ttgcattggtaaaggctcaggaaaacgctcgcaaattagatgcgttagctgatagtattcaagccaccaatgaag

SEQ ID NO: 13044 - DNA, 75 bp, Artificial Sequence
  Synthetic
ctgttcaagatctaagcaccggacttcaagctggagctatagcaattcaagcaatccaatcagaaataaaccatg

SEQ ID NO: 13045 - DNA, 75 bp, Artificial Sequence
  Synthetic
tgatcaatcctgcattagaaagactctcgtgtgaaataatagatacaagggtcgcgagtatattgaacctatacc

SEQ ID NO: 13046 - DNA, 75 bp, Artificial Sequence
  Synthetic
taatcaggcttacgactgttttccacaggcaattagtcaatcccgctttgacacccttgagtatccaggcattga

SEQ ID NO: 13047 - DNA, 75 bp, Artificial Sequence
  Synthetic
atcatctgctgcaaggtgagactgagggactagtaaaaaatgaatcaaaaatgaccgacagcaaaattgacctac

SEQ ID NO: 13048 - DNA, 75 bp, Artificial Sequence
  Synthetic
taatgtcggggctcataacagggcaggtagtcggagtcaatataaaacacatgcagttaatgatcgcagtatttg

SEQ ID NO: 13049 - DNA, 75 bp, Artificial Sequence
  Synthetic
tcccgactacagcccaactcccgaatgcatatgttatcaaccttttgactatcactgccaatataaataattcag

SEQ ID NO: 13050 - DNA, 75 bp, Artificial Sequence
  Synthetic
aagttttagttcaacttccaaaccaaatattggagcgttctgggattatatatcaattccgtgggaaggactgtg

SEQ ID NO: 13051 - DNA, 75 bp, Artificial Sequence
  Synthetic
tgtcgagccctaatcacatgtattgcccatatagtgatgcttcaatcttgtcacctgaattacagttatgcttgc

SEQ ID NO: 13052 - DNA, 75 bp, Artificial Sequence
  Synthetic
aggggcgcctcgaaatgtgtcttttcacacaggttgtaggttccttcccgaccaggtttgcatcagataagggta

SEQ ID NO: 13053 - DNA, 75 bp, Artificial Sequence
  Synthetic
tagtgtatgcaaattgtaggcatttgcagtgtgcttgtagtgaaccagaagggatcatctatcaagatgatacat

SEQ ID NO: 13054 - DNA, 75 bp, Artificial Sequence
  Synthetic
cagcaatcactcaaatagatgcatcaaaatgcagcacattgaaacttgacatgctaaccttcaagttaagtacct

SEQ ID NO: 13055 - DNA, 75 bp, Artificial Sequence
  Synthetic
atgcaaacaaaacattcgatgcatcattctctgtcgggaaagaccaaatgctagtaactaatcttcttgacttgt

SEQ ID NO: 13056 - DNA, 75 bp, Artificial Sequence
  Synthetic
cagctgaactcaaaacaatgaatgcatcagttgctcatgccaacaaactaattgacaagagcaaccttctcatac

SEQ ID NO: 13057 - DNA, 75 bp, Artificial Sequence
  Synthetic
agtcaaatgcattgattggacactccaacactatcttcattgtggtcatagtcattttagctgtcatggtcttat

SEQ ID NO: 13058 - DNA, 75 bp, Artificial Sequence
  Synthetic
atctaataattgtcacatatataattaaagtcattatggtcgaagtgagcaggctaaagcgcatgaatatctact

SEQ ID NO: 13059 - DNA, 75 bp, Artificial Sequence
  Synthetic
ctatcgataaatgaatatgactatacattcagttcaaggccttttagattagctatcaagtagtatttagcagaa

SEQ ID NO: 13060 - DNA, 75 bp, Artificial Sequence
  Synthetic
caaataatgagcactgtatatattagaagattcaagtaaattcccccacctacgcttaggattctgatgtacagc

SEQ ID NO: 13061 - DNA, 75 bp, Artificial Sequence
  Synthetic
aaagaaatcactaaacagatcacagaacaatgctatttaagaaaaaactatgctgggcgcgaacccataagccca

SEQ ID NO: 13062 - DNA, 75 bp, Artificial Sequence
  Synthetic
cagtgcctcggcggaccccatccacagcaacatctagaccacgggacagaggcaacaatccaaacagaacatgga

SEQ ID NO: 13063 - DNA, 75 bp, Artificial Sequence
  Synthetic
taattctatgagtatcagcacaatctccttagatgcacagccacggatttggagtaggcatgagagccgtagaac

SEQ ID NO: 13064 - DNA, 75 bp, Artificial Sequence
  Synthetic
ttggagaaatattttccgcattacctccttggttctcttaggagtaactgtcatcatttgcatctggttatgctg

SEQ ID NO: 13065 - DNA, 75 bp, Artificial Sequence
  Synthetic
tgaggtcgctagggagagtgaattggaattattggcttctcccttaggtgctttgattatggccataaacaccat

SEQ ID NO: 13066 - DNA, 75 bp, Artificial Sequence
  Synthetic
aaagagtagtgtcgtcaagatgaccacagagctaaaccaggtcacattcacaacatcaattatcctcccgaataa

SEQ ID NO: 13067 - DNA, 75 bp, Artificial Sequence
  Synthetic
agttgaccaatttggccaaaatgtagtttcacaagttgcccagttagtgaagcaatgtaatgcggtctgtagagg

SEQ ID NO: 13068 - DNA, 75 bp, Artificial Sequence
  Synthetic
gcatcaagacacgccagagctcgaacaatttataaaccagaaaaatcctacatggatcctccagcctaattatac

SEQ ID NO: 13069 - DNA, 75 bp, Artificial Sequence
  Synthetic
cacaaaactgacaaatcttcatgaaatagattcaattataccattggttgattatccaggtttctctaagagttg

SEQ ID NO: 13070 - DNA, 75 bp, Artificial Sequence
  Synthetic
cacccgcttcccttcttttagtgaggggtcaaaattctggtgttttacatatgctgtggtcaaagagccttgtag

SEQ ID NO: 13071 - DNA, 75 bp, Artificial Sequence
  Synthetic
tgacatatcttcttccattcaagttgtcaaatacggtgcaataaaggcaaatcattcagatggtaatccctattt

SEQ ID NO: 13072 - DNA, 75 bp, Artificial Sequence
  Synthetic
agtcttgggaactaaagtccttgacgatgggaaattcagacgaggatgttctatcacatcatcactatatggatg

SEQ ID NO: 13073 - DNA, 75 bp, Artificial Sequence
  Synthetic
ctacttactttgctcaacagctaatgtctcagaagtaaatgattatgcacacactcctgcatatcctctcactct

SEQ ID NO: 13074 - DNA, 75 bp, Artificial Sequence
  Synthetic
tgaattaatcagcaaagatggtataactactgacttgagtccgacttatactgtccagttagataagtggtcagc

SEQ ID NO: 13075 - DNA, 75 bp, Artificial Sequence
  Synthetic
tctgtatcctggaattgggagtggtgtcatcttcaagggttatctaatgttccctgtatatggtggactgccttt

SEQ ID NO: 13076 - DNA, 75 bp, Artificial Sequence
  Synthetic
taaatctccactaatatcagcatcttgggttggccctgggaataagtggcctgttgatttttcttgctcagagga

SEQ ID NO: 13077 - DNA, 75 bp, Artificial Sequence
  Synthetic
tcagtactcaacctttaacttctcgaacccctactctgcactgtatagtccccatttctcgaataacattgttgt

SEQ ID NO: 13078 - DNA, 75 bp, Artificial Sequence
  Synthetic
tagtgcattatttgtctgcccactaaatgaaaatctgccgtatagctgtgaagttcaagtgttgccccaaggaaa

SEQ ID NO: 13079 - DNA, 75 bp, Artificial Sequence
  Synthetic
ccttacgataggtgctgaaggcaggttgtatgttatagatcaagatctgtactattaccaacggtcaacatcatg

SEQ ID NO: 13080 - DNA, 75 bp, Artificial Sequence
  Synthetic
gtggccatatttacagttatacaaattaaatattaggatcaccaatcgggtctttagagtgaggtctctatcact

SEQ ID NO: 13081 - DNA, 75 bp, Artificial Sequence
  Synthetic
tcttcccatcaaatctactacaagacccgggtatggcaattgcacatacttcaaactgtgtccgcacatatgtgt

SEQ ID NO: 13082 - DNA, 75 bp, Artificial Sequence
  Synthetic
gactggtgtatatcaaagcccgtggttgatatcaataagggataagagacctcatgaggagaaaaatattctcta

SEQ ID NO: 13083 - DNA, 75 bp, Artificial Sequence
  Synthetic
ctttattggctggagtcctgatgaacaaatacgtcaaaaccctcttgtatccttatgccatgaaactgcatgttt

SEQ ID NO: 13084 - DNA, 75 bp, Artificial Sequence
  Synthetic
cataaacaggagtcttgcaactaataagactcatgcaggatattcagaatcgcattgtgtacaatcattcgaacg

SEQ ID NO: 13085 - DNA, 75 bp, Artificial Sequence
  Synthetic
aaataaattgacttgtacagttttctatgaattaactgcaaaaccctgggctgaaatgcgtgtgcaatccttgct

SEQ ID NO: 13086 - DNA, 75 bp, Artificial Sequence
  Synthetic
ctttcaagtagacttcctataacacatctggtggttctttctctgttcatatgggccagtagtctttatacttgt

SEQ ID NO: 13087 - DNA, 75 bp, Artificial Sequence
  Synthetic
gtcttctgtgaataattaattgcatttaagaaaaaatctaataatgatcatataaccctgggccagaatggctgc

SEQ ID NO: 13088 - DNA, 75 bp, Artificial Sequence
  Synthetic
cccacagcaggtcattctgcccgaagttcatcttgactcccctattgtcttgaacaaactactctacttttccaa

SEQ ID NO: 13089 - DNA, 75 bp, Artificial Sequence
  Synthetic
actcgctggccttcctttgcctgatgattactcacacgatgagccttttactgacattgactgggcaagaattag

SEQ ID NO: 13090 - DNA, 75 bp, Artificial Sequence
  Synthetic
gagggaggaaaacaggctctctgatcggctgctcgaagcaaggaaggctttgatttcttggcttaattccaaaca

SEQ ID NO: 13091 - DNA, 75 bp, Artificial Sequence
  Synthetic
gatccgattggacaaaactaaccaatcttcatcaggctataatggggtccaagtacttttctggcccaaatgcat

SEQ ID NO: 13092 - DNA, 75 bp, Artificial Sequence
  Synthetic
gactatgttgcacacaactatcttacatgatttcttggggagattttctgacgcccacaatctaatcaatgccgc

SEQ ID NO: 13093 - DNA, 75 bp, Artificial Sequence
  Synthetic
ttgtgctaatctcgctgagcctataaatactgtgctcctaaatgttagtcaaaaactgaccggatcaagtaatct

SEQ ID NO: 13094 - DNA, 75 bp, Artificial Sequence
  Synthetic
cttctctcacaactctgcggcatgctctcttgaatcatcacacaataggccgcccagtatcttaggtctatctca

SEQ ID NO: 13095 - DNA, 75 bp, Artificial Sequence
  Synthetic
gacagtactttcctctccttggactgaccaatatgaattttggttccttctcagacatcaaatgcgatcattaat

SEQ ID NO: 13096 - DNA, 75 bp, Artificial Sequence
  Synthetic
tatgcagaacaattcaaactctacaacaagattagttatagaattgaatgagagaacaaaaatctgtataatcac

SEQ ID NO: 13097 - DNA, 75 bp, Artificial Sequence
  Synthetic
tcctgaaataattatattagggaatttggaagaacgtgccgtaacatactgcacatttgaaatgatgttaatgat

SEQ ID NO: 13098 - DNA, 75 bp, Artificial Sequence
  Synthetic
ttgtgatatgtatgaagggagacttaatgtcatcagtattagtggcttaagctgttacctgaatcctttaaaatc

SEQ ID NO: 13099 - DNA, 75 bp, Artificial Sequence
  Synthetic
aagattacaatccttgtttgacttagtggacgagttgtgtacaatccttggaaattctgtatatgcagtggttgc

SEQ ID NO: 13100 - DNA, 75 bp, Artificial Sequence
  Synthetic
aaatcttgaaagtctggtttacgcgcagcttcaattacttgaccctgtagctgatataaaaggagagtttttctc

SEQ ID NO: 13101 - DNA, 75 bp, Artificial Sequence
  Synthetic
ttttatatgcagtgagcttgtatcagccctccaatcaggaaacttctttagcaaccaggaagcaactgtcatcac

SEQ ID NO: 13102 - DNA, 75 bp, Artificial Sequence
  Synthetic
tagtaagctattgcaatgctatcagggattaactccggatctgactgcagaacttctttgtgtcatgcgattatg

SEQ ID NO: 13103 - DNA, 75 bp, Artificial Sequence
  Synthetic
gggacatccgatgttgacatctaagagcgcagcaaagaaggttcgtgaatcaatgtgtgcgcctaaactgataga

SEQ ID NO: 13104 - DNA, 75 bp, Artificial Sequence
  Synthetic
cctgcaaacaacacttaaaacattggctttctttaatgcaatagtaattaatgggttccgaaggaaacacaatgg

SEQ ID NO: 13105 - DNA, 75 bp, Artificial Sequence
  Synthetic
tatttggcctaaatgcatcttaccaccctttgcgtctcttagtttgatagaattaaagcatgacaactctgagct

SEQ ID NO: 13106 - DNA, 75 bp, Artificial Sequence
  Synthetic
ctcataccaatatgttttgaatcactggaaggagcttgctatgttggaattcgagaaaagcttcgatgcagaccc

SEQ ID NO: 13107 - DNA, 75 bp, Artificial Sequence
  Synthetic
tggggcggatctaagcatatttatgaaggacaaagcaataagttgtccaaaggcagactggctgagtgtttttag

SEQ ID NO: 13108 - DNA, 75 bp, Artificial Sequence
  Synthetic
gaagagcttaataaagccgttatgtgagaaactgaaaatcccacttccccaaagtttcaacaggagactactgct

SEQ ID NO: 13109 - DNA, 75 bp, Artificial Sequence
  Synthetic
taatttcctatctgatcacagcttcgacccagaaaaagaacttgagtatgtgaccacagggcaatatcttgatga

SEQ ID NO: 13110 - DNA, 75 bp, Artificial Sequence
  Synthetic
tgacactttctgtgcatcatattcactaaaggagaaagagatcaaagaaactgggcggatttttgcaaagttaac

SEQ ID NO: 13111 - DNA, 75 bp, Artificial Sequence
  Synthetic
aaagaagatgagatctgtgcaagtcatttctgaatcgctactggcaagccatgcaggaaagctgtttaaagagaa

SEQ ID NO: 13112 - DNA, 75 bp, Artificial Sequence
  Synthetic
cggagttgtgcaagaccagctcagcttgacaaagtcattactgacaatgtcacaaataggactgatctcacaaag

SEQ ID NO: 13113 - DNA, 75 bp, Artificial Sequence
  Synthetic
atctagaagatctgttagagaaaatgtcactctagtgacacatgtgacgtcatcaggaggaaatattaagagtat

SEQ ID NO: 13114 - DNA, 75 bp, Artificial Sequence
  Synthetic
gtcacctaatccaacacctggcactttaaaggacatagatgagaccacagagattgctgcatgctttctaactac

SEQ ID NO: 13115 - DNA, 75 bp, Artificial Sequence
  Synthetic
tgacctgagtaaatactgtctaaactggagatatcagtccattgtcatgtttgctacatcaatgaataagttgta

SEQ ID NO: 13116 - DNA, 75 bp, Artificial Sequence
  Synthetic
tgggtacaatcatctttttgaatggattcatctgcgtcttatgagatccacattgtacgttggtgacccatttaa

SEQ ID NO: 13117 - DNA, 75 bp, Artificial Sequence
  Synthetic
tccacctcaaaaattggacaccggtgatctggatgatgtattaaatgatgacatctttattgtttctccaagggg

SEQ ID NO: 13118 - DNA, 75 bp, Artificial Sequence
  Synthetic
aggaattgaagggttgtgccaaaaattgtggactatgatatctatatcagtaatcatactatctgccactgagtc

SEQ ID NO: 13119 - DNA, 75 bp, Artificial Sequence
  Synthetic
taacacacgggtaatgagtatggtacagggggataaccagacaatggcaataacaactaaggtcccaagatcatt

SEQ ID NO: 13120 - DNA, 75 bp, Artificial Sequence
  Synthetic
ggaccataagcaaaagaaggagattgcattcaaccacagtaagctttttatcgagagacttcgggcaaataattt

SEQ ID NO: 13121 - DNA, 75 bp, Artificial Sequence
  Synthetic
tggaatgggccatcatctaaaggaacaagaaacaatcgtaagttcggatttctttgtatatagcaagagaatctt

SEQ ID NO: 13122 - DNA, 75 bp, Artificial Sequence
  Synthetic
ttggaggggccgcatccttaaccaggctttgaaaaatgtcagtaagctctgtttaatagcagatgttttaagtga

SEQ ID NO: 13123 - DNA, 75 bp, Artificial Sequence
  Synthetic
gtgtactcaaacctcatgctcaaacttgacaacaactgttatgagactaactgagaatggtgtggagaaggatgt

SEQ ID NO: 13124 - DNA, 75 bp, Artificial Sequence
  Synthetic
gtgctattacctgagtatatttctgtctttaaaacagctggtttttgatctgctattcccaattaataagacctt

SEQ ID NO: 13125 - DNA, 75 bp, Artificial Sequence
  Synthetic
tgaggacaccacaactgaaacatatctcaatcatcctcttctgttatcccgtattgcaatcctaccctctcaact

SEQ ID NO: 13126 - DNA, 75 bp, Artificial Sequence
  Synthetic
aggaggtctgaactattattctactagtagattgtttaataggaatgttggagaccccctagtatctgctatttc

SEQ ID NO: 13127 - DNA, 75 bp, Artificial Sequence
  Synthetic
tgacctcaaacgcttcatagatgcaaaggcacttccatcgtggatcctgaagaacgttgctgccagaaaaccagg

SEQ ID NO: 13128 - DNA, 75 bp, Artificial Sequence
  Synthetic
aaaggggacctggagtaccttagccgcagatgcttatgctataaatatagattatctgtatccgcctactactta

SEQ ID NO: 13129 - DNA, 75 bp, Artificial Sequence
  Synthetic
tctcaagaagcacacccagagggttctgatggaagggagtgtgaatccaatgctacggggagtattcaatgacaa

SEQ ID NO: 13130 - DNA, 75 bp, Artificial Sequence
  Synthetic
ctccattcaagaggaagacaatctggcaaaattcttactcgatcgccctgttgttatgccacgtgtcgcccacat

SEQ ID NO: 13131 - DNA, 75 bp, Artificial Sequence
  Synthetic
cataattgaccaatcgtcttgtggaagaagaaagcagatccaagggtatcttgataccacacggacaatcattag

SEQ ID NO: 13132 - DNA, 75 bp, Artificial Sequence
  Synthetic
gcatgccttacagaacagccctctttctatcaagaaagcaaacagaatcattgattacaacactctgtatcttgc

SEQ ID NO: 13133 - DNA, 75 bp, Artificial Sequence
  Synthetic
ttacaatctggaaatccttgctgctcctaataaaggggaatcgatcaaacttaagggtagggaattgcttgatct

SEQ ID NO: 13134 - DNA, 75 bp, Artificial Sequence
  Synthetic
ttgcagtattgacatagcaagagttgtcaggaggctatcatggcttccccttttgtccggcagatcaattgatgg

SEQ ID NO: 13135 - DNA, 75 bp, Artificial Sequence
  Synthetic
cttggaaacacccgatcctatagaattggtaagggggactttaattgaaggtcctcgttcatgtgtttcctgttt

SEQ ID NO: 13136 - DNA, 75 bp, Artificial Sequence
  Synthetic
ggaaggggattcaaaatttacatggttatttactccaggcaatataactctggatgcccccccagaagagaatcc

SEQ ID NO: 13137 - DNA, 75 bp, Artificial Sequence
  Synthetic
gcccataagagtgccctatgtaggctctaaaacagatgaaaggcgagttgcatcacttggctacatcaaaggtgc

SEQ ID NO: 13138 - DNA, 75 bp, Artificial Sequence
  Synthetic
atcatctgcaacacgagccgcattaaggctggcaggcgtgtacatttgggcatttggagacactgaccaaaattg

SEQ ID NO: 13139 - DNA, 75 bp, Artificial Sequence
  Synthetic
ggaagaagcccttgcactggccaacaccagaattgacatagacatagaacatcttagagcactcacacctttacc

SEQ ID NO: 13140 - DNA, 75 bp, Artificial Sequence
  Synthetic
aacatctgcaaaccttacccatcgactagatgatggactcacacagctcaaattcactccagctagctcatatgc

SEQ ID NO: 13141 - DNA, 75 bp, Artificial Sequence
  Synthetic
atactcaagctatgtacatatttcaaatgataaccaaaatttggagattcttgagaggattcaggactcaaatat

SEQ ID NO: 13142 - DNA, 75 bp, Artificial Sequence
  Synthetic
catataccaacagttgatgttacttgggttaggaataatcgaaacctggttacaactacctatagacaggaaccc

SEQ ID NO: 13143 - DNA, 75 bp, Artificial Sequence
  Synthetic
gtcggatatctcaattcatctccacactgggtcatcatgttgcatcagagccgtagactcatgtatcatcaatga

SEQ ID NO: 13144 - DNA, 75 bp, Artificial Sequence
  Synthetic
gtcattacatcctatgccctcaatttacgttccaacatacaataaatttgtgttcgataagcacccccttaatga

SEQ ID NO: 13145 - DNA, 75 bp, Artificial Sequence
  Synthetic
ggaccaattactccaaattgacaaccttacattccaggctaatattagtgccatagatatgatagaaccaacaga

SEQ ID NO: 13146 - DNA, 75 bp, Artificial Sequence
  Synthetic
aagggtcagactgcttgctcattttgttggcatccaatttgcccacagcttaactggattagatgagacaacttc

SEQ ID NO: 13147 - DNA, 75 bp, Artificial Sequence
  Synthetic
tttgataaatgatgcaatagtagaaactgattattctaataattggatcagtgagtgcttaaatacatatctgga

SEQ ID NO: 13148 - DNA, 75 bp, Artificial Sequence
  Synthetic
cagggtgttttatttcgccgcttggaacatcctccttgaattagcataccaaatgtattatttaaggattgtggg

SEQ ID NO: 13149 - DNA, 75 bp, Artificial Sequence
  Synthetic
agtggaatccatattggattatttacatctagtgctcacaaggattccaggactagcacttacaggcattgcttc

SEQ ID NO: 13150 - DNA, 75 bp, Artificial Sequence
  Synthetic
cactattagtcaccccagaatactaagacggctaattaacctagagatagtcttgccaagtaattcaccctacct

SEQ ID NO: 13151 - DNA, 75 bp, Artificial Sequence
  Synthetic
tgcaactttagattatcacaagctgactcatgatgctatcctatggggggcaaggcatgtggcggcagatctcag

SEQ ID NO: 13152 - DNA, 75 bp, Artificial Sequence
  Synthetic
acaaggtgtagatcttgaagtagtcattccttctgaggacagcacagaaatatcagaccgagtgctgaaccttat

SEQ ID NO: 13153 - DNA, 75 bp, Artificial Sequence
  Synthetic
tgcacgaaaattatcactgatggcactaatattgactcaatcaacaagcctaccgcatgtaaggggactgacacc

SEQ ID NO: 13154 - DNA, 75 bp, Artificial Sequence
  Synthetic
agaacataagtgtaagatgctctctgatttcttagtgcagaatatcaccaattcaatcattgaccaaactacagc

SEQ ID NO: 13155 - DNA, 75 bp, Artificial Sequence
  Synthetic
tcagatgattaccaatgcaatacattctccaaaaatatctgcatttcctagcaacttgtattacttaacgaggaa

SEQ ID NO: 13156 - DNA, 75 bp, Artificial Sequence
  Synthetic
agtgttaaatttcattaggcaatcagatgaattgcaaatgctactctctgctttttatgacagttttggtttcct

SEQ ID NO: 13157 - DNA, 75 bp, Artificial Sequence
  Synthetic
tgaagcacaacagaatgtaggccttttgtacttatctagggatattgatcaccagtcagataccttgaccatttt

SEQ ID NO: 13158 - DNA, 75 bp, Artificial Sequence
  Synthetic
tgatttccacagatcaattattgatgatcagaggcaaggtgagagataccagtaccctcaagaagtgggagactc

SEQ ID NO: 13159 - DNA, 75 bp, Artificial Sequence
  Synthetic
actttacaagccgagtccagtagtacagccaccaacgcatcatgtcttacggtgtgtaggcctttcttcgacatc

SEQ ID NO: 13160 - DNA, 75 bp, Artificial Sequence
  Synthetic
atggtacaagggtttaagtgttttaaatgtgcttctctccaagaagataccagtgggtaaccatctttatttggc

SEQ ID NO: 13161 - DNA, 75 bp, Artificial Sequence
  Synthetic
tgaagggagtggggcattgatgacattatttgaggcgtatttaccaggtgttaaaatttactacaatagttactt

SEQ ID NO: 13162 - DNA, 75 bp, Artificial Sequence
  Synthetic
ttcaagtggccagaatccgcctcaaaggaattttgcaccattgcctacacaattcatggaaagtgttatagcgca

SEQ ID NO: 13163 - DNA, 75 bp, Artificial Sequence
  Synthetic
aaatatcaacaatgaaacaccaactgagcaaggattcatacaagaatttgtgccgttatggagtggatgtagcga

SEQ ID NO: 13164 - DNA, 75 bp, Artificial Sequence
  Synthetic
tcagactgatttaagcaagaaggagtgtgtagattttatcctgcaatcagttctaccatcatcaatttctctaat

SEQ ID NO: 13165 - DNA, 75 bp, Artificial Sequence
  Synthetic
atctgtagacttagaagaaggcttcacagcaaatagaaactgtctatcaaaggcactcatcaattctctgctgat

SEQ ID NO: 13166 - DNA, 75 bp, Artificial Sequence
  Synthetic
atcacacataaccatgattgaagggggaatcttaattatcaaggttaatttaacaccattctcaaaattctctag

SEQ ID NO: 13167 - DNA, 75 bp, Artificial Sequence
  Synthetic
aattgtgaccttgctacatgatagattcagtcagatagagctatgtaggtcaatttattccgacccaaattctga

SEQ ID NO: 13168 - DNA, 75 bp, Artificial Sequence
  Synthetic
tgagatttacttgattgcaactaattcacactcaatggacatcatggattttaatcattcattagacagtgcaga

SEQ ID NO: 13169 - DNA, 75 bp, Artificial Sequence
  Synthetic
aaggatggatcatgaatctttcactttaatttctccacagaccttgaaagacatccaagagggaattgctgatac

SEQ ID NO: 13170 - DNA, 75 bp, Artificial Sequence
  Synthetic
acaaaaacatgcatcaagctttattgacatccaaattaagacatgtcagtgttctgatgctgttgatgatcatat

SEQ ID NO: 13171 - DNA, 75 bp, Artificial Sequence
  Synthetic
tttgttgagcagattgggttgcaggactcagacaaacaaaattatagacatagcaggatcatcaagttttgcaga

SEQ ID NO: 13172 - DNA, 75 bp, Artificial Sequence
  Synthetic
ctatatggacagattgacagcagttttgactctatactttaaggaactgatctctatatgtgagtctgcaagtct

SEQ ID NO: 13173 - DNA, 75 bp, Artificial Sequence
  Synthetic
agacagaatgcaattgatatttacttcatacaatgtgcacttcaaggggaagatatcaacaaatgcaaaaaattc

SEQ ID NO: 13174 - DNA, 75 bp, Artificial Sequence
  Synthetic
agctagacacattctggatttgacaatcaggaattgggctttgctaccagtttcattgagacataagattagtca

SEQ ID NO: 13175 - DNA, 75 bp, Artificial Sequence
  Synthetic
ggccttagaattgggcatcttccgagtatgtgatgtaatcagtgcctcacaatttctcaagagatcctcggtaac

SEQ ID NO: 13176 - DNA, 75 bp, Artificial Sequence
  Synthetic
caaatttctcataaaatccttggggcagccacagattgatcaggagttttcaaccagcctcgctataacattaaa

SEQ ID NO: 13177 - DNA, 75 bp, Artificial Sequence
  Synthetic
taggccagagcaaaagaggatttggaaagcacttggaagtgtcattttgttagaaactcttgagcaagatacacc

SEQ ID NO: 13178 - DNA, 75 bp, Artificial Sequence
  Synthetic
taactatccccaaaatgatgtagatctagatcttgaattcgacatcgctggcgacgaaatctgaatctgtaaaga

SEQ ID NO: 13179 - DNA, 75 bp, Artificial Sequence
  Synthetic
cgaaatctgaatctgtaaagattacaagcaaagattggcaaatttaagaaaaaacttattcattttccccttggt

SEQ ID NO: 13180 - DNA, 75 bp, Artificial Sequence
  Synthetic
agtttttaaaaacttctgtgaaggtcacatccctagttggattacgccgcttttgaaaaatctagaagttgtttg

SEQ ID NO: 13181 - DNA, 75 bp, Artificial Sequence
  Synthetic
cacatccctagttggattacgccgcttttgaaaaatctagaagttgtttggaaaagagatatctggttcgtatga

SEQ ID NO: 13182 - DNA, 75 bp, Artificial Sequence
  Synthetic
ataggatgctcttgaagaaagggccttcgggccaaacatctggtcggccatcgaccagaccgccggacccagcgg

SEQ ID NO: 13183 - DNA, 75 bp, Artificial Sequence
  Synthetic
aaaagagggtaaaaagggccgcaggaaacaagaccagcaaaaaccagcggccatcaacacgaggagcaactccat

SEQ ID NO: 13184 - DNA, 75 bp, Artificial Sequence
  Synthetic
catcgctcctcaccagcttattcggacgcagaaaaggaggggaatggcttagaatcctccaacttgacataggag

SEQ ID NO: 13185 - DNA, 75 bp, Artificial Sequence
  Synthetic
acgcagaaaaggaggggaatggcttagaatcctccaacttgacataggagcctcggtgttgtggctggctctcgc

SEQ ID NO: 13186 - DNA, 75 bp, Artificial Sequence
  Synthetic
cctcggtgttgtggctggctctcgctgtcggatccctcggacaacaactgtggcgccagatcacaatgctgaaga

SEQ ID NO: 13187 - DNA, 75 bp, Artificial Sequence
  Synthetic
tgtcggatccctcggacaacaactgtggcgccagatcacaatgctgaagagacgtgtcaaccgcttggaggcaca

SEQ ID NO: 13188 - DNA, 75 bp, Artificial Sequence
  Synthetic
gcgtagccatagtcctgttttctttgtctgcctggctgtcttatttggattagctctctcggaaactctacggta

SEQ ID NO: 13189 - DNA, 75 bp, Artificial Sequence
  Synthetic
tggaactgatggaaatgggaaactgaccctggaaacggaagacggtactgctattgattctatcaattataaact

SEQ ID NO: 13190 - DNA, 75 bp, Artificial Sequence
  Synthetic
tccggctgacgcttgcctcgtaggacttccgattgagaaacactgcccgctcgtgagcaagctcgccgacctgga

SEQ ID NO: 13191 - DNA, 75 bp, Artificial Sequence
  Synthetic
caacattgactgtggctcaacgactgaagagtttaggctgaaatacaatagatgtcaagtcacgcccagaaagcg

SEQ ID NO: 13192 - DNA, 75 bp, Artificial Sequence
  Synthetic
gaagagtttaggctgaaatacaatagatgtcaagtcacgcccagaaagcgtaggagctctcaaccacggccggct

SEQ ID NO: 13193 - DNA, 75 bp, Artificial Sequence
  Synthetic
taggagctctcaaccacggccggcttcgcacactggcctaatcgaagaagttgagctcttgaccttcaaatttat

SEQ ID NO: 13194 - DNA, 75 bp, Artificial Sequence
  Synthetic
gcgtgagcacatgcctattttcgtcgtttgccttctcgttgtctccgttgctcggaaatggcccatgtggagtgt

SEQ ID NO: 13195 - DNA, 75 bp, Artificial Sequence
  Synthetic
agtggccataagtgtgctgacgtggaacgtggtccgagccacttccattgaacccctgtacacgataacggccac

SEQ ID NO: 13196 - DNA, 75 bp, Artificial Sequence
  Synthetic
tggaacatcaatgagtcacactcgtattctatcgaatgaaatgtactccatctctacgactcgagggctcatcca

SEQ ID NO: 13197 - DNA, 75 bp, Artificial Sequence
  Synthetic
attctatcgaatgaaatgtactccatctctacgactcgagggctcatccatctggacatccacaacataacagtg

SEQ ID NO: 13198 - DNA, 75 bp, Artificial Sequence
  Synthetic
caaggagaaagaccatttaaaacgttgctaacatcatgtgagatcgtcgagagtgtgtccgaagacacatgccct

SEQ ID NO: 13199 - DNA, 75 bp, Artificial Sequence
  Synthetic
ggtggatcccatctcgaaatggccaagttgcgacgtgctaaccggacctgcaaagtagatgcattcaataggggc

SEQ ID NO: 13200 - DNA, 75 bp, Artificial Sequence
  Synthetic
tggggaaccggctgttttgaatggggactaggacaagttgccacgtgcgttgaagtccaatgcctgaccatggta

SEQ ID NO: 13201 - DNA, 75 bp, Artificial Sequence
  Synthetic
gactaggacaagttgccacgtgcgttgaagtccaatgcctgaccatggtaaatgtatctgtgctcgttgactcag

SEQ ID NO: 13202 - DNA, 75 bp, Artificial Sequence
  Synthetic
ttattcaggccactgccagtatggaactccatgggcaccaagactcaagagccgtgttgcgtgatgttcccacgg

SEQ ID NO: 13203 - DNA, 75 bp, Artificial Sequence
  Synthetic
actccatgggcaccaagactcaagagccgtgttgcgtgatgttcccacggtatttcatttcggggacataggaac

SEQ ID NO: 13204 - DNA, 75 bp, Artificial Sequence
  Synthetic
catcaccttgacttgcggtgctaccactgacagattggctagccaacattaccatgtgcgtgattcgtcaaagtc

SEQ ID NO: 13205 - DNA, 75 bp, Artificial Sequence
  Synthetic
cggtctcgttttgaaagaagctgttgatgcctggcccggggttattcgcctcggtgaatacacatccgggatgga

SEQ ID NO: 13206 - DNA, 75 bp, Artificial Sequence
  Synthetic
gatgcctggcccggggttattcgcctcggtgaatacacatccgggatggagaaaataatcaactggggcgtcaca

SEQ ID NO: 13207 - DNA, 75 bp, Artificial Sequence
  Synthetic
acagccaatgagattaaggtcgattctgtgaacaacccgcaaattgattggaagggttctgttatccaggacatc

SEQ ID NO: 13208 - DNA, 75 bp, Artificial Sequence
  Synthetic
cgctccgtttcgttcacgtgcgaaatgatttttgagaacgtgacgtttactagtttaccgctgtgtgttggcaat

SEQ ID NO: 13209 - DNA, 75 bp, Artificial Sequence
  Synthetic
tagtttaccgctgtgtgttggcaatttgagtggggtatttgtccaaaacgggtatggccgtgatggcgttgtctc

SEQ ID NO: 13210 - DNA, 75 bp, Artificial Sequence
  Synthetic
gatcatcctcgaagagagcactccgcaggcttgtagcattcctatatcgagccgaggatgtactgtcgttgggtc

SEQ ID NO: 13211 - DNA, 75 bp, Artificial Sequence
  Synthetic
tactgtcatcgtcgcagcaaaaagtcaaagcggccgcgcgtacgtcatgtgtgggaacgggactggccacgtaga

SEQ ID NO: 13212 - DNA, 75 bp, Artificial Sequence
  Synthetic
actcgcggacagtgtcgtccctgttgactgtctcgtcacaccggtagcccaggcttggaggcttatgactcatgt

SEQ ID NO: 13213 - DNA, 75 bp, Artificial Sequence
  Synthetic
aggcttggaggcttatgactcatgtggccggtcgatactcaaaacatggcatggctggtatcggaagcgtctggg

SEQ ID NO: 13214 - DNA, 75 bp, Artificial Sequence
  Synthetic
aggacctggtgcggaactttcacttttcgtggagttggattccaggaggctggctcgttccagttgtgttgattg

SEQ ID NO: 13215 - DNA, 75 bp, Artificial Sequence
  Synthetic
tcttgtccatagtgttcctaggcaggggagttacgctcgttattgtcgtggtgataacctctatgtacattcgtc

SEQ ID NO: 13216 - DNA, 75 bp, Artificial Sequence
  Synthetic
gtgtggcgggggacattggttgtggaatcgacacaaccaggagaaccatctcgtgtggacaaggagccttcgtgt

SEQ ID NO: 13217 - DNA, 75 bp, Artificial Sequence
  Synthetic
ggaagcagcttggcagtggcccaatgaaagatcactccgttgagctcgacgactatgctttcaccaacttgtaca

SEQ ID NO: 13218 - DNA, 75 bp, Artificial Sequence
  Synthetic
gactatgctttcaccaacttgtacattcgcgacatgttcgatggtacaaacaaaccttgtttgatatgcgaggac

SEQ ID NO: 13219 - DNA, 75 bp, Artificial Sequence
  Synthetic
acattgcagtgcgccgccctgagacgagccgcagtcgccgcaagaattgctatgcatccaggggtgatgtatgtg

SEQ ID NO: 13220 - DNA, 75 bp, Artificial Sequence
  Synthetic
aacaccactctatcgtacaacagaacttttgttgaaacgcgaaaacgggttttgacagtgacgctggaatctttg

SEQ ID NO: 13221 - DNA, 75 bp, Artificial Sequence
  Synthetic
gagtataaagtaggatcctacgtcacacatggtcgtcttgagggggacatgggatatctgcccacatccttcggc

SEQ ID NO: 13222 - DNA, 75 bp, Artificial Sequence
  Synthetic
agccaccctgagcgtgaaactgataaagttctacgaattgtcgcagcgcgccccgacatacgacgcatgtgcggc

SEQ ID NO: 13223 - DNA, 75 bp, Artificial Sequence
  Synthetic
aaggctattgcattccagtttacgttcacgggatttcgaaggagtttgtacgggtcgaatgtacaagttgccgtg

SEQ ID NO: 13224 - DNA, 75 bp, Artificial Sequence
  Synthetic
tcaaagcatgtgactcgccactgtccaacatacttggccggggtagccgtaaaaaatgacaggaccataatcacc

SEQ ID NO: 13225 - DNA, 75 bp, Artificial Sequence
  Synthetic
agttgttcttgaaatgttgcaatcgcatagatgcctttggccttcgtcatacactcccgatgcattattagaccc

SEQ ID NO: 13226 - DNA, 75 bp, Artificial Sequence
  Synthetic
aacggacatgaacatcttcgtccctcctgcttggggaggtcccatctcaaaagccaaccatgtccccgggtataa

SEQ ID NO: 13227 - DNA, 75 bp, Artificial Sequence
  Synthetic
aatgcaaacagacttcccgtggagtagcccggagatctcgcttcatcaaggaccagttccaggcacccaagtcac

SEQ ID NO: 13228 - DNA, 75 bp, Artificial Sequence
  Synthetic
aattgacccaaaatgtgacggtagaatgcaagctaagcccgtggatccagaaagcaatgtgacttggtgttgcaa

SEQ ID NO: 13229 - DNA, 75 bp, Artificial Sequence
  Synthetic
atgcaagctaagcccgtggatccagaaagcaatgtgacttggtgttgcaaaacatgtgacgccattattcacttc

SEQ ID NO: 13230 - DNA, 75 bp, Artificial Sequence
  Synthetic
cgcgtcggagaagagtttttctatccaatggagattcagcctggcaccatggcgagccgtgaaaatccgcggcca

SEQ ID NO: 13231 - DNA, 75 bp, Artificial Sequence
  Synthetic
aagatagtggagaccccgctagatggtgaagaagagccgctaatggatgacatacttggaaggtatggcaaagct

SEQ ID NO: 13232 - DNA, 75 bp, Artificial Sequence
  Synthetic
gacgcaaccgcggattttcaccggcggaacccacgctcaggaggggggttcgacagatccgttttaaacctcctg

SEQ ID NO: 13233 - DNA, 75 bp, Artificial Sequence
  Synthetic
tgtctcgcaatcgccttgcagcttattggggcccgcacacgagcgacgacgtggtcacggttgattcttacaact

SEQ ID NO: 13234 - DNA, 75 bp, Artificial Sequence
  Synthetic
gtcgcgatgcttacttttggcctacccaacattttttcctcggtgggcttgtcggcatgggtgttgttagttgcg

SEQ ID NO: 13235 - DNA, 75 bp, Artificial Sequence
  Synthetic
tcatcggcatatcaacctatcgacgtcgtcatgaacctctggataatcctccagacagggagctcggctgtaatt

SEQ ID NO: 13236 - DNA, 75 bp, Artificial Sequence
  Synthetic
ctactagggttcatggttcgacgcaaactgtcaatagttttgggccatcaccaccttatggcctcaatttgtctc

SEQ ID NO: 13237 - DNA, 75 bp, Artificial Sequence
  Synthetic
ccaccttatggcctcaatttgtctccagtttctgttttgggttgtggaacgtcagcaacgagccttctccgtatt

SEQ ID NO: 13238 - DNA, 75 bp, Artificial Sequence
  Synthetic
cctagaagccgtagctgcgatagtgctgattggggcctatcgtgggatgactcaggaccttccaccagagatcct

SEQ ID NO: 13239 - DNA, 75 bp, Artificial Sequence
  Synthetic
cacgttttgcttgataatgggatggaaaacggcattggcgctaggtaccgttgccttactgacgcaaggtacgag

SEQ ID NO: 13240 - DNA, 75 bp, Artificial Sequence
  Synthetic
cgctttttacaagtggacgcagaaatcactagagtccaaaagctcctacaggacctctggcaggagcgcttggtt

SEQ ID NO: 13241 - DNA, 75 bp, Artificial Sequence
  Synthetic
ttggaccatttcctgtgcgagcgcgggcgccatttgggccgcggaacgggcagaccacccgtcggcagcggccgt

SEQ ID NO: 13242 - DNA, 75 bp, Artificial Sequence
  Synthetic
tttctatacatggaccaagccaatgtgaccatggagcttgagtttctctcgacgggggacgtgcctgacgggatc

SEQ ID NO: 13243 - DNA, 75 bp, Artificial Sequence
  Synthetic
gcccttgaagaagatgaagggggaaacttccgtgaccttcgaggaacatatagcgatgaggggatcactattggc

SEQ ID NO: 13244 - DNA, 75 bp, Artificial Sequence
  Synthetic
caagacatggggtctgcccagatcccagagaccatggtcatcatattgattggttgtgccctcacgtctgcttct

SEQ ID NO: 13245 - DNA, 75 bp, Artificial Sequence
  Synthetic
ttgtttgtcggagctctgtacaccatccttgctatcagcacaaacatacctcgcaatttattccgcctgtgcaga

SEQ ID NO: 13246 - DNA, 75 bp, Artificial Sequence
  Synthetic
ttgaaaataaatgagcattgccgctcggatgacttgcttggtttcgggggtgagtcgacacaaaagattgaaaca

SEQ ID NO: 13247 - DNA, 75 bp, Artificial Sequence
  Synthetic
agctttggagacttgccaaatggaatctatcgaattaatgtacgtagcttcatggaaaaccgacagcgtggagta

SEQ ID NO: 13248 - DNA, 75 bp, Artificial Sequence
  Synthetic
ggtgtggcaaaaaacggagttttccacacgttaatgcatgtcactcgtggagagcccctcaaatggcgagaaaag

SEQ ID NO: 13249 - DNA, 75 bp, Artificial Sequence
  Synthetic
ctagtgtccttacattcgggaagtgctttacgagatgtagtgtcgtatggagggccttggcagttggaaaatcca

SEQ ID NO: 13250 - DNA, 75 bp, Artificial Sequence
  Synthetic
actgttgcggaggagatatccctcatggcgtgcaaaccggataagactgtcgagtatcataaatacaagcctggt

SEQ ID NO: 13251 - DNA, 75 bp, Artificial Sequence
  Synthetic
tggcgtgcaaaccggataagactgtcgagtatcataaatacaagcctggtgttgtcaaactggacaacgagaacg

SEQ ID NO: 13252 - DNA, 75 bp, Artificial Sequence
  Synthetic
taatgttcataagcgttgattttggcaaagggtcctctggatctccgtttttcgttaatggagaagtggtgggtt

SEQ ID NO: 13253 - DNA, 75 bp, Artificial Sequence
  Synthetic
tttacggattcggattttacgtgaatggcgtctatcgttccattgttgcgggggggcgtcccggggacatagcgc

SEQ ID NO: 13254 - DNA, 75 bp, Artificial Sequence
  Synthetic
cgaatgaggttgctgactccacgagaaaattcatcacgtggcatccgggaaaaggaaagactcgtagggttatcg

SEQ ID NO: 13255 - DNA, 75 bp, Artificial Sequence
  Synthetic
aaaggaaagactcgtagggttatcgtttcggaagtcaaagcaaattttgacgcggggttgaggaccataatcctg

SEQ ID NO: 13256 - DNA, 75 bp, Artificial Sequence
  Synthetic
acacccactcgggttgtcatggctgaagttatggaagccctcgggcaagccggaataacgtgtgaccggaacctt

SEQ ID NO: 13257 - DNA, 75 bp, Artificial Sequence
  Synthetic
atgtattgtcgcagaaatttggtgacagttgcctgtcacgccacgttcacaaaatttgtgttgtcgcatggcgta

SEQ ID NO: 13258 - DNA, 75 bp, Artificial Sequence
  Synthetic
aagaaaattggggtggcgctcattgtcatggatgagtgtcacttcatggatcccatgtcaatagctgcccgggga

SEQ ID NO: 13259 - DNA, 75 bp, Artificial Sequence
  Synthetic
tcatggatgagtgtcacttcatggatcccatgtcaatagctgcccggggagtaatggagcatctacatgagaagg

SEQ ID NO: 13260 - DNA, 75 bp, Artificial Sequence
  Synthetic
gtaatggagcatctacatgagaagggaacgaaactcatgtatttgagtgccaccccccctggacactcccctgac

SEQ ID NO: 13261 - DNA, 75 bp, Artificial Sequence
  Synthetic
ggtggttcaaacttcccaattcatgaccaagctatcgcgttcccaagttggatgacccccgcctggattaacagt

SEQ ID NO: 13262 - DNA, 75 bp, Artificial Sequence
  Synthetic
gtcagaaaatcgcgtaattcaaagaaggccatcatgtttgtcccttcacatacacaagcgaattctctggctgcg

SEQ ID NO: 13263 - DNA, 75 bp, Artificial Sequence
  Synthetic
aggccatcatgtttgtcccttcacatacacaagcgaattctctggctgcgaccatccctggggcggttccccttc

SEQ ID NO: 13264 - DNA, 75 bp, Artificial Sequence
  Synthetic
accatccctggggcggttccccttcatcgcgcaaacttcacagctaattacgctcgggctagtagcgacgaaacc

SEQ ID NO: 13265 - DNA, 75 bp, Artificial Sequence
  Synthetic
cgctcgggctagtagcgacgaaacctctctggttgtttccactgacatttcggaaatgggggccaatttgggtgt

SEQ ID NO: 13266 - DNA, 75 bp, Artificial Sequence
  Synthetic
tgatatggttatcgacacccgcaaggttctccggcccctcgtagcatccgagaatagaatcaagttgactgaaac

SEQ ID NO: 13267 - DNA, 75 bp, Artificial Sequence
  Synthetic
caacgtgacaacatcttcaatgattcaacgacggggacgaaccggaaggcgtggcccgggaagttatgtgtttcc

SEQ ID NO: 13268 - DNA, 75 bp, Artificial Sequence
  Synthetic
tgttgacagccagactgaagaaaatccagttggatgggcctgttggccagaggcccagatgttgcttgatcaaat

SEQ ID NO: 13269 - DNA, 75 bp, Artificial Sequence
  Synthetic
ccagttggatgggcctgttggccagaggcccagatgttgcttgatcaaataggaatgacatttatgcccgaagag

SEQ ID NO: 13270 - DNA, 75 bp, Artificial Sequence
  Synthetic
gccatgtacagccaaccccctgggcgctataccttagttggggaagacctgctccgctttatgaagttcctggac

SEQ ID NO: 13271 - DNA, 75 bp, Artificial Sequence
  Synthetic
gctataccttagttggggaagacctgctccgctttatgaagttcctggacaaagacgatattcctacctggctcg

SEQ ID NO: 13272 - DNA, 75 bp, Artificial Sequence
  Synthetic
cttggcattgggcagaggcggccgaccgcagacattctgccctcttccagggtaatagcactggccaaatgctag

SEQ ID NO: 13273 - DNA, 75 bp, Artificial Sequence
  Synthetic
aaacgcgttatggaaggatggagtaccgaccaatgtatgtggatgaccggttcgagaacatagagtgggaccagc

SEQ ID NO: 13274 - DNA, 75 bp, Artificial Sequence
  Synthetic
ccgaccaatgtatgtggatgaccggttcgagaacatagagtgggaccagcgccgtttatctatagaaatgtacat

SEQ ID NO: 13275 - DNA, 75 bp, Artificial Sequence
  Synthetic
taacacacgcagttcagctagtctgtacgacatcctgtttagttttgactggcatggaatttggaaaaagacgac

SEQ ID NO: 13276 - DNA, 75 bp, Artificial Sequence
  Synthetic
ttcatcactatgggacctgcgcgacattgttagcggggacttgcacgaccagattctggctgagcagtctctcac

SEQ ID NO: 13277 - DNA, 75 bp, Artificial Sequence
  Synthetic
tgtgccatagccgtagccctgctgatgttcctttgggtttttacttgcctggtgtcatattcccggtcgggaaaa

SEQ ID NO: 13278 - DNA, 75 bp, Artificial Sequence
  Synthetic
aactcttttgagccaatgcccgtctctgatccactaggaggtggctttttcctaacgtcccctggagttctgcat

SEQ ID NO: 13279 - DNA, 75 bp, Artificial Sequence
  Synthetic
tactttggagtgcccctgggattttgtgtcattattttcctggcaatgtttatcgtgtatccggtgctctacaaa

SEQ ID NO: 13280 - DNA, 75 bp, Artificial Sequence
  Synthetic
gcagcaggaaaccggagttatctcgatagtgacctggttaagtgggttattttgggttcatgcgttatgtgtagc

SEQ ID NO: 13281 - DNA, 75 bp, Artificial Sequence
  Synthetic
gtcctcgcctgggagatgagattgtttccaaacatccgtgaggatattaaaaacatcatggccacttccaaccgc

SEQ ID NO: 13282 - DNA, 75 bp, Artificial Sequence
  Synthetic
aaacatcatggccacttccaaccgcatggaaaaccaggcacccccaactccaactgcgtggttcaccccaacgcc

SEQ ID NO: 13283 - DNA, 75 bp, Artificial Sequence
  Synthetic
caactgcgtggttcaccccaacgccatggaacggtggggcaaaccaacttgacactttgcaagtgtttttctgcg

SEQ ID NO: 13284 - DNA, 75 bp, Artificial Sequence
  Synthetic
atggaacggtggggcaaaccaacttgacactttgcaagtgtttttctgcgccaccatttttctcaataaattcgc

SEQ ID NO: 13285 - DNA, 75 bp, Artificial Sequence
  Synthetic
gttctggatccaggaaaactggacgtcccagatgtatgtaatgaagcatccggaaatggtaggcacagttggagg

SEQ ID NO: 13286 - DNA, 75 bp, Artificial Sequence
  Synthetic
tcccagatgtatgtaatgaagcatccggaaatggtaggcacagttggagggttccgtctagaccacatcccattt

SEQ ID NO: 13287 - DNA, 75 bp, Artificial Sequence
  Synthetic
cgggctgttattccatcctgctttgttattaccatgacagttggccttcccagcgttgtaattggagccggggca

SEQ ID NO: 13288 - DNA, 75 bp, Artificial Sequence
  Synthetic
gcagcactgttcatgttcattacatatcatcaaaacaaatggaatgccacgccaaaaattatctctgcccttgac

SEQ ID NO: 13289 - DNA, 75 bp, Artificial Sequence
  Synthetic
gcccgtgaccaaaaacatgataggccaacggacatagctgaccgcgtgtcagttgacaacactcgagccgttatg

SEQ ID NO: 13290 - DNA, 75 bp, Artificial Sequence
  Synthetic
acctcccgacattccacgcactatccttgttgtgtgcgcttgtctgtggcaactcctcaatccccggtcgcacat

SEQ ID NO: 13291 - DNA, 75 bp, Artificial Sequence
  Synthetic
ccacgacgtaatggatttcggatcaatgctgtcggccattggattgattgacatgaacttcctgttttataagtt

SEQ ID NO: 13292 - DNA, 75 bp, Artificial Sequence
  Synthetic
tttgcatattgccatgcgagccctcggagctatggcccctttcagtaaatttcgcgccctagaaaagtccaccac

SEQ ID NO: 13293 - DNA, 75 bp, Artificial Sequence
  Synthetic
gataggtctaggaatcaaatggaaatttatgctgaacgctttggacaaagacgcgtttgaaagatataaagttcg

SEQ ID NO: 13294 - DNA, 75 bp, Artificial Sequence
  Synthetic
aggagtgaatgagacaggtaaaggtgactacgtatccagaggaggacttaaactggatgaaataattcgcaaata

SEQ ID NO: 13295 - DNA, 75 bp, Artificial Sequence
  Synthetic
tcaatggacccccatggggcacgtcgttgaccttggctgtggacgtggcggctggagccaaagagtggttatgga

SEQ ID NO: 13296 - DNA, 75 bp, Artificial Sequence
  Synthetic
ggagacagtgacgtccgttcatgggttcacaattggtggcaatgacaaggaaaacccccagcgatttgtcacacg

SEQ ID NO: 13297 - DNA, 75 bp, Artificial Sequence
  Synthetic
tggatataatttgaccagcctcaagcccggggtggacgtctacaaactggagccaaagcgatgtgacacaatcat

SEQ ID NO: 13298 - DNA, 75 bp, Artificial Sequence
  Synthetic
gtgtgacatcggtgaaagtgacccaaatctcaccaaagagcggacaagaacactaaaagtcttacagctattgga

SEQ ID NO: 13299 - DNA, 75 bp, Artificial Sequence
  Synthetic
aatctcaccaaagagcggacaagaacactaaaagtcttacagctattggagacttggttatctatcaaccctgag

SEQ ID NO: 13300 - DNA, 75 bp, Artificial Sequence
  Synthetic
gcccaatttgtatgcaaggtcctatccccctactcccttgaggtgttgcggaaggttgaatccctccagcaaaag

SEQ ID NO: 13301 - DNA, 75 bp, Artificial Sequence
  Synthetic
tacaaaggtaagctcgtgcgcttggcacacagtaggaatagcacggctgaaatgtattacatatcaggaaatagg

SEQ ID NO: 13302 - DNA, 75 bp, Artificial Sequence
  Synthetic
tccaacgccgtaagggacgcttatatgaccctggctgctttaataggaagattttcgcgacacattgacagtgta

SEQ ID NO: 13303 - DNA, 75 bp, Artificial Sequence
  Synthetic
ttcctcccggagccaacactaccgcgaggaaccagagctgatccagcagctagcgtgtctgccatgaatgttgat

SEQ ID NO: 13304 - DNA, 75 bp, Artificial Sequence
  Synthetic
gacatggttgatcgtgtcagaaaggtccaacaggaaaacagcgcgacatggttcattgacccggaacacccgtat

SEQ ID NO: 13305 - DNA, 75 bp, Artificial Sequence
  Synthetic
aaaagctttagatattttgggtcttttgtaacggatgacgtaaaagtcggaggacaggctgtgaacccacttgta

SEQ ID NO: 13306 - DNA, 75 bp, Artificial Sequence
  Synthetic
cggaaaatcatgtggccctgggagaccgtcacgagtgtggtcagttttctcatgaccgatgtgtcaacctattcg

SEQ ID NO: 13307 - DNA, 75 bp, Artificial Sequence
  Synthetic
catgaccgatgtgtcaacctattcgcaacaaaaaatcttgcgggaaaaagttgataccgtgatacctcctcaccc

SEQ ID NO: 13308 - DNA, 75 bp, Artificial Sequence
  Synthetic
caacaaaaaatcttgcgggaaaaagttgataccgtgatacctcctcaccccccgcaaatacgtatggtcaacagc

SEQ ID NO: 13309 - DNA, 75 bp, Artificial Sequence
  Synthetic
cttattactaagcatttcatacgtattttcaaacgccgtggtttgacgccccgaattatgactaaagaagaattc

SEQ ID NO: 13310 - DNA, 75 bp, Artificial Sequence
  Synthetic
cccctggagggacgttcaagcagccgtgcaagaccaaggtttctggaatctcgttggacacgaacgcgctctaca

SEQ ID NO: 13311 - DNA, 75 bp, Artificial Sequence
  Synthetic
tctccaaggcaaatgctccatgtgtttatataacacgatgggtaagaaagaaaagaagccaagcgtagccggcga

SEQ ID NO: 13312 - DNA, 75 bp, Artificial Sequence
  Synthetic
ggcaaaaggatcgagaactatctggtacatgtggctcggaagtcgttttctggaatttgaggccttggggttcct

SEQ ID NO: 13313 - DNA, 75 bp, Artificial Sequence
  Synthetic
tacatgtggctcggaagtcgttttctggaatttgaggccttggggttcctaaatgctgatcactgggtcagtcgt

SEQ ID NO: 13314 - DNA, 75 bp, Artificial Sequence
  Synthetic
aaatgctgatcactgggtcagtcgtgaaaactttcctgggggtgtgggtggagtgggtgtcaattactttggcaa

SEQ ID NO: 13315 - DNA, 75 bp, Artificial Sequence
  Synthetic
ctacctaaaggaaatttcgctcaaaggcaagtatctctttgctgacgatatagcagggtgggatacgaaggtgag

SEQ ID NO: 13316 - DNA, 75 bp, Artificial Sequence
  Synthetic
ttctgaagaccttgaggatgaagagactctcttaaccgaactgactgcaaaccccttccaccgcgccctaatcgc

SEQ ID NO: 13317 - DNA, 75 bp, Artificial Sequence
  Synthetic
cgccacaatgaagttggcttaccggaacatagtggcgatgtttccccgcacccacacgcgatacggtagcggcac

SEQ ID NO: 13318 - DNA, 75 bp, Artificial Sequence
  Synthetic
aacatagtggcgatgtttccccgcacccacacgcgatacggtagcggcaccgttatggatgtcgtcgggcgcacc

SEQ ID NO: 13319 - DNA, 75 bp, Artificial Sequence
  Synthetic
gaccagcgaggctcagggcaggtggtaacgtatgccttgaatactataacgaacggtaaagtccaagtggcccga

SEQ ID NO: 13320 - DNA, 75 bp, Artificial Sequence
  Synthetic
actctcgagagtgaaggtttactttacgctgacacacaagtgattgaccgttggctgagcaaaaacctggacgac

SEQ ID NO: 13321 - DNA, 75 bp, Artificial Sequence
  Synthetic
gtgctaagctgcatgaccattgcgggagatgatgttgtagtgtcgacaatgaatcggtcatttgcctcttcctta

SEQ ID NO: 13322 - DNA, 75 bp, Artificial Sequence
  Synthetic
gactacttggagctgacgggaaagacccgtaaaaacgttccacgaggtgccccttcaaaaatggaaagcgactgg

SEQ ID NO: 13323 - DNA, 75 bp, Artificial Sequence
  Synthetic
cccgtaaaaacgttccacgaggtgccccttcaaaaatggaaagcgactggcaaaaagtcgaattttgctcacatc

SEQ ID NO: 13324 - DNA, 75 bp, Artificial Sequence
  Synthetic
caaaaagtcgaattttgctcacatcactaccacgaactttccctccgagatggacgcattctcatagtaccttgc

SEQ ID NO: 13325 - DNA, 75 bp, Artificial Sequence
  Synthetic
tggacgcattctcatagtaccttgccgtcaggaatctgaggttgttggacgcagtcgcctacaaaaaggaggaat

SEQ ID NO: 13326 - DNA, 75 bp, Artificial Sequence
  Synthetic
cgtgacaatggctgaaagcgcgtgcatggcgaaggcgtatgcccaaatgtgggcattgtatttcttccatagacg

SEQ ID NO: 13327 - DNA, 75 bp, Artificial Sequence
  Synthetic
cgatttaaggctcgggtttgccgctatcacctccgccgtcccttccaactggtttccagtcgggcgaacatcctg

SEQ ID NO: 13328 - DNA, 75 bp, Artificial Sequence
  Synthetic
gtcagtacatcaatttcacgaatggatgacgacatccgacatgctccgcgtttggaacgatgtgtggatatacaa

SEQ ID NO: 13329 - DNA, 75 bp, Artificial Sequence
  Synthetic
atgacgacatccgacatgctccgcgtttggaacgatgtgtggatatacaataacccgtggatcagagtgaaggac

SEQ ID NO: 13330 - DNA, 75 bp, Artificial Sequence
  Synthetic
ccaattggctcatgggatgagattccgtatctacacaagaggcaagacatcgcctgcggaagcttaatcggatcc

SEQ ID NO: 13331 - DNA, 75 bp, Artificial Sequence
  Synthetic
cgcctgcggaagcttaatcggatccaaagagcgagccgtttgggctcgggagatcgaaaatggagttttaagtat

SEQ ID NO: 13332 - DNA, 75 bp, Artificial Sequence
  Synthetic
ccgcaaaattctgaacgccgagtcgaaatgtgataacgtgtacaatgatgggctggtcatcatgtcgcgtttccg

SEQ ID NO: 13333 - DNA, 75 bp, Artificial Sequence
  Synthetic
aaagagtaatgacgtgatataactgcttcaatcatatcacctcaatttaaagggtcagggatagctttggcgaag

SEQ ID NO: 13334 - DNA, 75 bp, Artificial Sequence
  Synthetic
tattccaaataaggccacgtttcgccacgaattcacactcccagcttctctagctagggggtgaccctcacgcca

SEQ ID NO: 13335 - DNA, 75 bp, Artificial Sequence
  Synthetic
aattcccccagtttaatctgttcggaattggtgatgaccacttcccctcaatggggaacacaattgcgttcttaa

SEQ ID NO: 13336 - DNA, 75 bp, Artificial Sequence
  Synthetic
cagaacacaacattgaaaccatgtttacactttggacttagggaaatggtctccgcttgggcgatcttcccaaaa

SEQ ID NO: 13337 - DNA, 75 bp, Artificial Sequence
  Synthetic
cgagtccatcgtgtgcagatttggaaaaccaaatctccccgccccgagaggagaagtctctctcccctcggagtg

SEQ ID NO: 13338 - DNA, 75 bp, Artificial Sequence
  Synthetic
ggggctgcattgcagtggtttcagagcagggcacaatagtgtcgggcctgacgaccccgctcccccgagtcgccc

SEQ ID NO: 13339 - DNA, 75 bp, Artificial Sequence
  Synthetic
acgaccccgctcccccgagtcgcccaacggagtttggctcaactctaaaaagaaaataagccgatttggactttc

SEQ ID NO: 13340 - DNA, 75 bp, Artificial Sequence
  Synthetic
atagtcctattgcctcagatctactgttgcaacgcagcgcagggcatgaaaatgtcgggcctgacgaacccgcgc

SEQ ID NO: 13341 - DNA, 75 bp, Artificial Sequence
  Synthetic
gttgcaacgcagcgcagggcatgaaaatgtcgggcctgacgaacccgcgcacccgagtcccccagttggggaagg

SEQ ID NO: 13342 - DNA, 75 bp, Artificial Sequence
  Synthetic
acccgagtcccccagttggggaagggatccttgcatcccaccctcctgcaggaagggcgaaaatcctgctgaccc

SEQ ID NO: 13343 - DNA, 75 bp, Artificial Sequence
  Synthetic
ccctggtcatgggaaactgacccgagtaagtagtggcgcccttgcttgtacatccgccagctgatggtcttaagc

SEQ ID NO: 13344 - DNA, 75 bp, Artificial Sequence
  Synthetic
atccctcccctaggaaaggggcaagagtggcctgtaaacaccactggaaggctccagtgctcttgcctaaatggc

SEQ ID NO: 13345 - DNA, 75 bp, Artificial Sequence
  Synthetic
cagccaaagcaacccgaagctttaaaaatcgggcggagcaacagggagaaatcccggggaattgcgaaccccctc

SEQ ID NO: 13346 - DNA, 75 bp, Artificial Sequence
  Synthetic
cgaaatgtgaaaaattatggggaaaagtacccatctaagcctcccaccgttagggagtttggaataccttttcta

SEQ ID NO: 13347 - DNA, 75 bp, Artificial Sequence
  Synthetic
ttatggggaaaagtacccatctaagcctcccaccgttagggagtttggaataccttttctataccatagatgcgc

SEQ ID NO: 13348 - DNA, 75 bp, Artificial Sequence
  Synthetic
agtttttaaaaacttctgtgaaggtcacatccctagttggattacaccaattttaaaaatctagaagttgtttgg

SEQ ID NO: 13349 - DNA, 75 bp, Artificial Sequence
  Synthetic
aagagagatatctggttcgtatgaataggatgctcttgaagaaagggccttcgggccaaacatctggtcgcccat

SEQ ID NO: 13350 - DNA, 75 bp, Artificial Sequence
  Synthetic
cgactagaccgccggacccagcggaaaagagggtaaaacgggccgcaggaaataagaccagcaaaaaccagcggc

SEQ ID NO: 13351 - DNA, 75 bp, Artificial Sequence
  Synthetic
caccaacaaaaggagcgactccatcatcgctccttaccagcctattcggacgcagaaaaggaggggagtggctta

SEQ ID NO: 13352 - DNA, 75 bp, Artificial Sequence
  Synthetic
gaatcctccaactcgacatcggggctgcggtgttgtggctggccctcgctgtcggatctctcggacagcaattgt

SEQ ID NO: 13353 - DNA, 75 bp, Artificial Sequence
  Synthetic
ggcgccagatcacagcgctgaagaaacgtgtcaatcgcttggaggcacagcgtagtcatagtcctgttttcattg

SEQ ID NO: 13354 - DNA, 75 bp, Artificial Sequence
  Synthetic
tctgcctggcttttttattcggattggctctctcggaaactttacggtatggaactgatggaaatggaaaactga

SEQ ID NO: 13355 - DNA, 75 bp, Artificial Sequence
  Synthetic
ttctggaaacggaaaatggtactgccattgattctcgtaattacaaacttccgggtgacgcttgcctcgtgggac

SEQ ID NO: 13356 - DNA, 75 bp, Artificial Sequence
  Synthetic
ttccgattgagaaacattgcccacttgttggcaagttagccgatcttgacaacattgactgtggctcaacgattg

SEQ ID NO: 13357 - DNA, 75 bp, Artificial Sequence
  Synthetic
aggagtttaggctaaagtataacagatgtcaagtcacgcccagaaagcgtaggagctctcagccacggccggtct

SEQ ID NO: 13358 - DNA, 75 bp, Artificial Sequence
  Synthetic
aggagctctcagccacggccggtctcacacactggtctaattgaagaagttgagctcttgacctttaaattcatg

SEQ ID NO: 13359 - DNA, 75 bp, Artificial Sequence
  Synthetic
cgtgagcacatgcctattttcgtcgtttgccttctcgttgtctccgttgctcggaaatggcccatgtggagcgtg

SEQ ID NO: 13360 - DNA, 75 bp, Artificial Sequence
  Synthetic
gtggccataagcgtgctcacgtggaatgtggttcgagctacttcaattgagcccttgtacaccataacggccact

SEQ ID NO: 13361 - DNA, 75 bp, Artificial Sequence
  Synthetic
ggaacatcgctgagtcacacccgaattttgtcgaacgagatgtactccatctccacaactcgagggctcatccat

SEQ ID NO: 13362 - DNA, 75 bp, Artificial Sequence
  Synthetic
ctggacatccacaacataacggtgcaaggggaaagaccttttaaaacgttgctaacatcatgtgagattgtcgaa

SEQ ID NO: 13363 - DNA, 75 bp, Artificial Sequence
  Synthetic
agtgtgtctgaagacacatgccctggtggatcccatcttgaaatggctaaattgcgacgtgccaaccggacttgc

SEQ ID NO: 13364 - DNA, 75 bp, Artificial Sequence
  Synthetic
aaagtggacgcattcaatcgaggctggggaaccggctgttttgaatggggactaggacaagtcgctacgtgcgta

SEQ ID NO: 13365 - DNA, 75 bp, Artificial Sequence
  Synthetic
gaagtccaatgcctgaccatggtaaatgtatccgtgcttgttgactcagttattcaagccactgccagtatggaa

SEQ ID NO: 13366 - DNA, 75 bp, Artificial Sequence
  Synthetic
ctccacgggcaccaagactcaagagccgtgttgcgcgacgtccccactgtgttttacttcggggatataggaacc

SEQ ID NO: 13367 - DNA, 75 bp, Artificial Sequence
  Synthetic
atcaccttgacttgtggtgcaaccactgacagactggcaagtcaacattaccacgtgcgtgattcgtcgaagtcc

SEQ ID NO: 13368 - DNA, 75 bp, Artificial Sequence
  Synthetic
ggtctcgttttgaaagaggctgtagatgcctggccaggggttattcgtcttggcgagtatgtatccgggatggag

SEQ ID NO: 13369 - DNA, 75 bp, Artificial Sequence
  Synthetic
atgcctggccaggggttattcgtcttggcgagtatgtatccgggatggagaaaataatcaactggggcgccacga

SEQ ID NO: 13370 - DNA, 75 bp, Artificial Sequence
  Synthetic
cagccaatgagattaaggtcgattctgtgagcaacccgcaaattgattggaagggttctgttatccaggacatcc

SEQ ID NO: 13371 - DNA, 75 bp, Artificial Sequence
  Synthetic
gctctatttcgttcacgtgtgagatgatttttgagaacgtaacgtttactagcttgccgttgtgtgtgggtaatt

SEQ ID NO: 13372 - DNA, 75 bp, Artificial Sequence
  Synthetic
tgagtggggtattcgtccaaaacggatatggccgagacggtgttgtctcgatcatccttgaggaaagcaccgcac

SEQ ID NO: 13373 - DNA, 75 bp, Artificial Sequence
  Synthetic
aagcgtgtagcatccctatatcgagccgaggttgtactgtcgttgggtccactgtcattgtcgcggcaaagagtc

SEQ ID NO: 13374 - DNA, 75 bp, Artificial Sequence
  Synthetic
aaagcggccgtgcgtacgttatgtgcggaaatggaactggacatgtggaactcgcggacagcgtcgttcccgttg

SEQ ID NO: 13375 - DNA, 75 bp, Artificial Sequence
  Synthetic
agtgtcttgttacaccggtcgctcaggcttggaggctcatgactcatgttgcaggtcgatactcaaaacatggca

SEQ ID NO: 13376 - DNA, 75 bp, Artificial Sequence
  Synthetic
tggctggtatcggaagcgtttgggaggacctggttcgcaacgtccatttttcgtggagctggatccctgggggct

SEQ ID NO: 13377 - DNA, 75 bp, Artificial Sequence
  Synthetic
ggctcgttccagttgtgttgatcattttgtccattgttttccttggtagaggggttacactcgttcttgttgtgg

SEQ ID NO: 13378 - DNA, 75 bp, Artificial Sequence
  Synthetic
tggtagcttcaatgtacatccgccgcgtggcgggggatatcggttgcggaatcgacacgaccaggaggacaattt

SEQ ID NO: 13379 - DNA, 75 bp, Artificial Sequence
  Synthetic
cgtgtggacaaggagctttcgtgtggaagcagctcggtagtggtccaatgaaggatcactccgttgagctcgacg

SEQ ID NO: 13380 - DNA, 75 bp, Artificial Sequence
  Synthetic
attatgccttcaccaacttgtacattcgagacatgttcgacggtacaaacaaaccctgtttgatatgtgaggaca

SEQ ID NO: 13381 - DNA, 75 bp, Artificial Sequence
  Synthetic
cattgcagtgcgccgccctgagacgggcagcagttgcagcaagaattgctatgcatccaggggtaatgtacgtga

SEQ ID NO: 13382 - DNA, 75 bp, Artificial Sequence
  Synthetic
acactaccttgtcgtacaacagaactttcgttgaaactcggaaacgagtgttgacagtaacgctggaatctctgg

SEQ ID NO: 13383 - DNA, 75 bp, Artificial Sequence
  Synthetic
agtataaagtgggatcttacgtcacgcacggccgtcttgaaggagatatgggatatctgcccacatcctttggca

SEQ ID NO: 13384 - DNA, 75 bp, Artificial Sequence
  Synthetic
gccaccctgagcgtgaaactgacaaagtcctacgaattgtcgctgcgcgccctgacatacgacgcatgtgcggca

SEQ ID NO: 13385 - DNA, 75 bp, Artificial Sequence
  Synthetic
aagccattgcatttcagttcacgttcaccgggtttcggaggagtttgtatgggtcgaacgtacaagttgctgtgt

SEQ ID NO: 13386 - DNA, 75 bp, Artificial Sequence
  Synthetic
caaagcacgtgactcgccattgcccaacatatttagctggggtagccgtgaaaaatgataggaccataatcactg

SEQ ID NO: 13387 - DNA, 75 bp, Artificial Sequence
  Synthetic
acgggatgttttggatggagagcgagattgtaaacggaactcaacgcatagtcgttcttgaaatgttgcaatcac

SEQ ID NO: 13388 - DNA, 75 bp, Artificial Sequence
  Synthetic
atagatgcctatggccttcgtcatacactcctgatgcgctactagacccaacagatatgaacatattcgtccctc

SEQ ID NO: 13389 - DNA, 75 bp, Artificial Sequence
  Synthetic
ctgcttgggggggtcccatctcgaaagccaaccatgtccccgggtataaaatgcaaacagacttcccgtggagca

SEQ ID NO: 13390 - DNA, 75 bp, Artificial Sequence
  Synthetic
gtccagaaatctcgcttcatcaaggaccggttccaggcacccaagttacgatcgatccaaagtgtgacggtagaa

SEQ ID NO: 13391 - DNA, 75 bp, Artificial Sequence
  Synthetic
tgcaagctaagcctgtggacccagaaagcaatgtaacgtggtgttgcaaagcgtgtaacgccatcattcactttc

SEQ ID NO: 13392 - DNA, 75 bp, Artificial Sequence
  Synthetic
gtgtcggagaagagtttttctacccaatggagatccagcctggcactatgacgaaccatgaaaatccgcggccaa

SEQ ID NO: 13393 - DNA, 75 bp, Artificial Sequence
  Synthetic
agatagtagagaccccactagacggtgaagaagagccgctaatggaggacatacttggaagatacggcaaagctg

SEQ ID NO: 13394 - DNA, 75 bp, Artificial Sequence
  Synthetic
acgcaactgcggattttcaccggcggaacccgcgctcaggaggtgggttcgacagatccgttttaaacctcctgt

SEQ ID NO: 13395 - DNA, 75 bp, Artificial Sequence
  Synthetic
gtctcgcaattgccctgcagcttatcggggcccgcacacgagcgacgacgtggtcacggttaattctcacaactg

SEQ ID NO: 13396 - DNA, 75 bp, Artificial Sequence
  Synthetic
tagcgatgcttacttttggcctacccaacattttttcctcggtgggcttgtcggcatgggtatttttagttgcat

SEQ ID NO: 13397 - DNA, 75 bp, Artificial Sequence
  Synthetic
cctcggcatatcaacctatcgacgtcgtcatgaacctctggataatcctccagacagggagctcggcggtaatcc

SEQ ID NO: 13398 - DNA, 75 bp, Artificial Sequence
  Synthetic
cagacagggagctcggcggtaatccttctagggttcatggttcgacgcaaactgtcgatagtcttgggccatcac

SEQ ID NO: 13399 - DNA, 75 bp, Artificial Sequence
  Synthetic
ctagaagccgtagctgcgatagtgctgattggggcctatcgtgggatgacccaggaccttccaccagagatcctc

SEQ ID NO: 13400 - DNA, 75 bp, Artificial Sequence
  Synthetic
acgttttgcctgattatgggatggaaaacggctctggcgctgggtaccgttgccttactgacgcaaggtacgaac

SEQ ID NO: 13401 - DNA, 75 bp, Artificial Sequence
  Synthetic
ttctatatatggaccaagccaatgtgaccatggagcttgagtttctctcgacgggagacgtgcctgacgggattg

SEQ ID NO: 13402 - DNA, 75 bp, Artificial Sequence
  Synthetic
cccttgaggaagatgaggggggaaatttccgtgacctacgtggaacatatagcgatgagggaatcactattggcc

SEQ ID NO: 13403 - DNA, 75 bp, Artificial Sequence
  Synthetic
aggccacggggtccgcccagatcccagaaaccatggtcatcatactgattgggtgtgctctcacgtctgcttctt

SEQ ID NO: 13404 - DNA, 75 bp, Artificial Sequence
  Synthetic
tgtttgtcggagctttgtacaccatccttgccatcagcacaaacatacctcgcaatttgtttcgcctgtgcagat

SEQ ID NO: 13405 - DNA, 75 bp, Artificial Sequence
  Synthetic
taaaaataaatgagcattgtcgctcggatgacctgcttggtttcgggggtgagtcgacacaagaaattgaaacga

SEQ ID NO: 13406 - DNA, 75 bp, Artificial Sequence
  Synthetic
gtttcggagacctgccaaatggaatttatcgaattaatgtgcgcagtttcatggagaaccgacagcgaggagtgg

SEQ ID NO: 13407 - DNA, 75 bp, Artificial Sequence
  Synthetic
gcgtggctaaaaacggagttttccacacgttaatgcatgtcacccgtggagagcctctaaaatggcgagaaaagc

SEQ ID NO: 13408 - DNA, 75 bp, Artificial Sequence
  Synthetic
ttgtgtctttacattcaggaagtgctctacgagatgtcgtgtcgtatggagggccctggcagctggaaagcccaa

SEQ ID NO: 13409 - DNA, 75 bp, Artificial Sequence
  Synthetic
ctgttgcggaggaaatatccctcatggcgtgcaaaccggataagactgttgagtatcacaaatataagcctggtg

SEQ ID NO: 13410 - DNA, 75 bp, Artificial Sequence
  Synthetic
ttgtcaaactggatgacgagaacgtgatgttcataagcgttgattttggaaagggctcctctggatctccgtttt

SEQ ID NO: 13411 - DNA, 75 bp, Artificial Sequence
  Synthetic
tcgtaaatggagaggtagtggggttttacggttttggattttacgtgaatggtgtgtatcgttccattgtcgcgg

SEQ ID NO: 13412 - DNA, 75 bp, Artificial Sequence
  Synthetic
gggggcgccccggggatataaccccaaatgaggttgccgactccacaagaaaattcatcacgtggcacccgggca

SEQ ID NO: 13413 - DNA, 75 bp, Artificial Sequence
  Synthetic
aaggaaagactcgtagggttatcgtctcagaagttaaaacaaatttcgatgcagggttaaggactatcatcctga

SEQ ID NO: 13414 - DNA, 75 bp, Artificial Sequence
  Synthetic
cgcccactcgggttgttatggctgaagtcatggaagcccttggacaagccggaatcacgtgtgaccgaaacctta

SEQ ID NO: 13415 - DNA, 75 bp, Artificial Sequence
  Synthetic
tgtattgtcgaaggaatttggtcaccgttgcctgtcacgcaacgttcacaaaatttgtgttatcgcatggtgtta

SEQ ID NO: 13416 - DNA, 75 bp, Artificial Sequence
  Synthetic
taatggagcatttacatgagaagggtacgaaacttatgtatttgagtgctaccccccctggacactcccctgatg

SEQ ID NO: 13417 - DNA, 75 bp, Artificial Sequence
  Synthetic
gtggatccaacttcccgatatatgaccaagccatcgcattcccaagctggatgacccccgcctggattaacaacg

SEQ ID NO: 13418 - DNA, 75 bp, Artificial Sequence
  Synthetic
tcagaaaatcgcgcagttcgaagaaagccatcatgtttgtgccctcacacacacaggcgaattctttggctgcga

SEQ ID NO: 13419 - DNA, 75 bp, Artificial Sequence
  Synthetic
ccatccctggggctgtttccctccatcgctcaaatttcacggccaattacgctcgggccagtagcgacgaaacct

SEQ ID NO: 13420 - DNA, 75 bp, Artificial Sequence
  Synthetic
ctctggttatttccactgacatttccgaaatgggggccaatttgggtgttgatatggttatcgacacccgtaagg

SEQ ID NO: 13421 - DNA, 75 bp, Artificial Sequence
  Synthetic
tgctccggccccttgtagcatccgagaatagaattaaattgactgaaaccaacgtgacaacgtcctcaatgatcc

SEQ ID NO: 13422 - DNA, 75 bp, Artificial Sequence
  Synthetic
aacgacgaggacgaactggaaggcgtgggccgggaagttatgtgtttcccgttgacagccagactgaagagaatc

SEQ ID NO: 13423 - DNA, 75 bp, Artificial Sequence
  Synthetic
cagttggatgggcttgttggccagaagcccagatgttgcttgatcaaataggaatgacatttatgcctgaagaag

SEQ ID NO: 13424 - DNA, 75 bp, Artificial Sequence
  Synthetic
ccatgtacagtcaaccccctggacgctttaccttggttggcgaagacctacttcgctttatgaagtttctggaca

SEQ ID NO: 13425 - DNA, 75 bp, Artificial Sequence
  Synthetic
aagacgatattcctacctggctcgcctggcactgggcagaagcggcagaccgcagacattctgccctcttccagg

SEQ ID NO: 13426 - DNA, 75 bp, Artificial Sequence
  Synthetic
gtaacagcactggccaaatgctagaaacgcgctatggacggatggagtatcgaccaatgtatgtggatgaccggt

SEQ ID NO: 13427 - DNA, 75 bp, Artificial Sequence
  Synthetic
tcgagaacatagagtgggatcaacgccgcttatccatagaaatgtacatcaacacgcgcagctcagctagcctat

SEQ ID NO: 13428 - DNA, 75 bp, Artificial Sequence
  Synthetic
atgacattctgtttagctttgactggcatggaatttggaaaaagacgacttcatcattatgggacctgcgcgata

SEQ ID NO: 13429 - DNA, 75 bp, Artificial Sequence
  Synthetic
ttgttagtggggacttgcacgaccagatcctggccgagcaatctctcacctcaggaatggctttcatgcttggat

SEQ ID NO: 13430 - DNA, 75 bp, Artificial Sequence
  Synthetic
gtgccatagccgtagccctgctgatgatcctttgggtttttacctgcctcgtgtcatattcccgaccgggaaaaa

SEQ ID NO: 13431 - DNA, 75 bp, Artificial Sequence
  Synthetic
actcttttgagccaatgccagtctctgatccactagggggcggttttttcttgacgtccccgggggtcttgcatt

SEQ ID NO: 13432 - DNA, 75 bp, Artificial Sequence
  Synthetic
attttggagtgcccttaggattttgtgtcattatcttcctggcaatgtttatcgtatatccggtgctctataaag

SEQ ID NO: 13433 - DNA, 75 bp, Artificial Sequence
  Synthetic
cagcaggaaaccggagttacttcgacagtgacctggtcaagtgggtcattttgggttcatgcgcaatgtgtagtg

SEQ ID NO: 13434 - DNA, 75 bp, Artificial Sequence
  Synthetic
tcctcgcctgggagatgagattgttcccaaacatccgtgaggatattaaaaacatcatggccacatccaaccgca

SEQ ID NO: 13435 - DNA, 75 bp, Artificial Sequence
  Synthetic
tggaaaaccaggcacccccaactccaacagcgtggtttgccccaacgccatggaacggtggggcaaaccaacttg

SEQ ID NO: 13436 - DNA, 75 bp, Artificial Sequence
  Synthetic
acgctttgcaggtatttttctgtgctactattcttctcaataaatttgcgttctggatccaagaaaactggacat

SEQ ID NO: 13437 - DNA, 75 bp, Artificial Sequence
  Synthetic
cccagatgtatgtgatgaagcatccggaaatggtgggcacggttgggggatttcgtctggaccacatcccgttcc

SEQ ID NO: 13438 - DNA, 75 bp, Artificial Sequence
  Synthetic
gggctgttattccatcatgctttgtcatcaccatgacggttggcctccccagcgtcgtaatcggagccggggcag

SEQ ID NO: 13439 - DNA, 75 bp, Artificial Sequence
  Synthetic
cagcgctgttcatgttcatcacatatcatcaaaacaaatggaatgccacgccaaaaatcatctccgcccttgacg

SEQ ID NO: 13440 - DNA, 75 bp, Artificial Sequence
  Synthetic
cccgtgaccagaaacatgataggccgacggacatagctgaccgtgtgtctgttgacaacactcgagctgttatgt

SEQ ID NO: 13441 - DNA, 75 bp, Artificial Sequence
  Synthetic
acgcgtattgcatggtccttagtctattatgggtcttttgtactagatcaccgtccgacattccgcgcaccatcc

SEQ ID NO: 13442 - DNA, 75 bp, Artificial Sequence
  Synthetic
ttgtggtgtgcgcctgcctgtggcaactcctaaatccccggtctcatatccacgacgttatggatttcggatcaa

SEQ ID NO: 13443 - DNA, 75 bp, Artificial Sequence
  Synthetic
tgctgtcggctatcggattgattgacatgaacttcctgttttataaatttttgcatattgctatgcgagccctcg

SEQ ID NO: 13444 - DNA, 75 bp, Artificial Sequence
  Synthetic
gagccatggcccccttcagtaaatttcgcgccctggagaagtctaccaccataggtctgggaattaaatggaaat

SEQ ID NO: 13445 - DNA, 75 bp, Artificial Sequence
  Synthetic
ttatgctaaacgctttggacaaagacgcgtttgagaggtataaggtccgaggagtaaatgagacaggtaaaggtg

SEQ ID NO: 13446 - DNA, 75 bp, Artificial Sequence
  Synthetic
attacgtgtctagaggaggactcaaactagatgaaataatccgcaaatatcaatggacccctatggggcacgtcg

SEQ ID NO: 13447 - DNA, 75 bp, Artificial Sequence
  Synthetic
ttgaccttggctgtggacggggcggctggagccagagagtggttatggaggagacggtaacgtccgttcatgggt

SEQ ID NO: 13448 - DNA, 75 bp, Artificial Sequence
  Synthetic
ttacaattggcggaaatgacaaggaaaacccccagcggtttgtcacacgcgggtataatctaaccagccttaaac

SEQ ID NO: 13449 - DNA, 75 bp, Artificial Sequence
  Synthetic
ctggggtagacgtttacaaactggaaccaaagcgatgtgatacgatcatgtgtgacatcggtgaaagtgatccaa

SEQ ID NO: 13450 - DNA, 75 bp, Artificial Sequence
  Synthetic
atctcatcaaagagcggacaagaacgttaaaagtcttacagctattggagacctggttatctattaacccagagg

SEQ ID NO: 13451 - DNA, 75 bp, Artificial Sequence
  Synthetic
cccaatttgtatgcaaggtgctatccccctattcccttgaggtgttacggaaggttgaatccctccagcaaaagt

SEQ ID NO: 13452 - DNA, 75 bp, Artificial Sequence
  Synthetic
acaaaggaaagctcgtgcgtttagcacacagtaggaatagcacggccgaaatgtattatatatcaggaaataggt

SEQ ID NO: 13453 - DNA, 75 bp, Artificial Sequence
  Synthetic
ccaacgcagtaagagacgcctatatgaccctggccgctttaataggaagattttcgcggcacattgacagtgtat

SEQ ID NO: 13454 - DNA, 75 bp, Artificial Sequence
  Synthetic
tcctcccggagccaacgctaccacgaggaaccagagccgatccagctgccagtgtgtctgctatgaatgttgatg

SEQ ID NO: 13455 - DNA, 75 bp, Artificial Sequence
  Synthetic
acatggttgatcgtgtccgaaaagtccaacaagaaaacagcgcgacatggtttattgacccggaacacccataca

SEQ ID NO: 13456 - DNA, 75 bp, Artificial Sequence
  Synthetic
aaagtttcaggtatttcgggtccttcgtcacggatgacgtaaaagtcggaggacaagctgtgaatccacttgtac

SEQ ID NO: 13457 - DNA, 75 bp, Artificial Sequence
  Synthetic
ggaagatcatgtggccctgggagactgtcacgagcgtggtcagttttctcatgaccgatgtttcaacctattcgc

SEQ ID NO: 13458 - DNA, 75 bp, Artificial Sequence
  Synthetic
agcagaaaattttacgagaaaaagttgatactgtgataccaccccatcctccgcaaatacgtatggtcaacagcc

SEQ ID NO: 13459 - DNA, 75 bp, Artificial Sequence
  Synthetic
ttatcaccaagcatttcgtacgtatttttaaacgccgtggtttgactccccgaattatgactaaggaagaattca

SEQ ID NO: 13460 - DNA, 75 bp, Artificial Sequence
  Synthetic
tcgctaatgtcagaagtgacgcggccatcggttcgtggagtcgggacgtcccttggagggacgtgcaagaagcag

SEQ ID NO: 13461 - DNA, 75 bp, Artificial Sequence
  Synthetic
tgcaagatcaagggttttggaatctcgttggacacgaacgcgctttacatctccaaggcaaatgctccatgtgtt

SEQ ID NO: 13462 - DNA, 75 bp, Artificial Sequence
  Synthetic
tatataacacaatgggtaaaaaagaaaagaagccaagcgtagccggcgaagcgaaaggatcgagaactatctggt

SEQ ID NO: 13463 - DNA, 75 bp, Artificial Sequence
  Synthetic
acatgtggcttggaagtcgttttctggaatttgaggccctgggttttttaaatgctgaccactgggtcagtcgtg

SEQ ID NO: 13464 - DNA, 75 bp, Artificial Sequence
  Synthetic
aaaactttcccgggggcgtgggtggagtgggtgtcaattactttggcaactacctaaaggaaatttcgctcaagg

SEQ ID NO: 13465 - DNA, 75 bp, Artificial Sequence
  Synthetic
gaaagtttctcttcgctgacgatatagcagggtgggatacgaaagtgagctccgaagaccttgaagatgaagaga

SEQ ID NO: 13466 - DNA, 75 bp, Artificial Sequence
  Synthetic
ctcttttaaccgagttgaccgcaaatcccttccaccgggccctaatcgcagccactatgaagctggcttatcgga

SEQ ID NO: 13467 - DNA, 75 bp, Artificial Sequence
  Synthetic
acatagtggcaatgttcccccgaacccacacgcgatacggtagcggcaccgtcatggatgtcgtcgggcgcactg

SEQ ID NO: 13468 - DNA, 75 bp, Artificial Sequence
  Synthetic
accagcgaggctcagggcaggtggtaacatacgccctgaatacgattacgaacggcaaagtccaagtagcccgca

SEQ ID NO: 13469 - DNA, 75 bp, Artificial Sequence
  Synthetic
ctctcgagagtgaaggcttactttacgctgacatgcaagtaattgaccgttggctaagcaaaaacctggacgacg

SEQ ID NO: 13470 - DNA, 75 bp, Artificial Sequence
  Synthetic
tgctaagttgcatgaccattgcgggagacgatgttgtggtgtcgacaatgaaccggtcatttgcctctgctttag

SEQ ID NO: 13471 - DNA, 75 bp, Artificial Sequence
  Synthetic
actacctggaactaacaggaaaaacccgtaaaaacgtaccacgaggtgctccatcaaaaatggaaagtgactggc

SEQ ID NO: 13472 - DNA, 75 bp, Artificial Sequence
  Synthetic
aaaaagtcgaattttgctcacaccactaccatgaactttcactccgagatggacgcattctcatagtaccttgcc

SEQ ID NO: 13473 - DNA, 75 bp, Artificial Sequence
  Synthetic
gtcaagaatctgaggttgtgggacgcagtcgtctacaaaaaggaggaattgtgacgatggctgaaagcgcgtgta

SEQ ID NO: 13474 - DNA, 75 bp, Artificial Sequence
  Synthetic
tggcgaaggcgtatgcccaaatgtgggcattatacttctttcatagacgcgatttaagactagggtttgctgcga

SEQ ID NO: 13475 - DNA, 75 bp, Artificial Sequence
  Synthetic
tcacctccgccgtcccttcaaactggttcccaatcgggcgtacatcctggtcggtgcaccaatttcacgaatgga

SEQ ID NO: 13476 - DNA, 75 bp, Artificial Sequence
  Synthetic
tgacgacatccgatatgcttcgcgtttggaacgatgtgtggatatataataacccgtggatcagagtaaaggacc

SEQ ID NO: 13477 - DNA, 75 bp, Artificial Sequence
  Synthetic
cgatcggctcgtgggatgagattccttatctacacaagaggcaagacatcgcctgcggaagcttaattggatcta

SEQ ID NO: 13478 - DNA, 75 bp, Artificial Sequence
  Synthetic
aagagcgagccgcttgggctcgggagatcgaaaatggagttataagtatccgcaaaattctgaacactgagtcag

SEQ ID NO: 13479 - DNA, 75 bp, Artificial Sequence
  Synthetic
gatgtgacaacgtgtacaatgatggtctggccatcatgtcgcgttttcggaagagtaatgacgtgatctaattgc

SEQ ID NO: 13480 - DNA, 75 bp, Artificial Sequence
  Synthetic
tacaatcatatcacctcaaccaaagggccaggaatagccttggcaaagcattccaaataaggcccctttccgcca

SEQ ID NO: 13481 - DNA, 75 bp, Artificial Sequence
  Synthetic
aaaactcacgctcctagctctcttagctaggagatgatcctttcgccaatatccctcagcctagtctgtttggaa

SEQ ID NO: 13482 - DNA, 75 bp, Artificial Sequence
  Synthetic
ttggtgatgttcctccccccttaactgggaaagcaattgcgttctaaagagaacacaacatggaaaccatgttca

SEQ ID NO: 13483 - DNA, 75 bp, Artificial Sequence
  Synthetic
cactttagacttagggaaatggtctccgcttgggcgatcttcccaaaacaagttcatcgtgtgtagatttggaaa

SEQ ID NO: 13484 - DNA, 75 bp, Artificial Sequence
  Synthetic
accaaatctccccaccccgaaaggagaagtttttctcctttcggagtaggggctgcattgcagtggtttcagagc

SEQ ID NO: 13485 - DNA, 75 bp, Artificial Sequence
  Synthetic
agggcacaacagtgtcgggcctgacgaccccgctcccccgagtcaccaactggagtttggctcaactccaaaaag

SEQ ID NO: 13486 - DNA, 75 bp, Artificial Sequence
  Synthetic
aaaatgagccattctggacttgcatagtcctattgccacagatccactgttgcaactcagcgcagggcatgaaaa

SEQ ID NO: 13487 - DNA, 75 bp, Artificial Sequence
  Synthetic
tgtcgggcctgacgaacccgcgcacccgagtcccccaattggggaagggatccttgcatcccaccctcttgcagg

SEQ ID NO: 13488 - DNA, 75 bp, Artificial Sequence
  Synthetic
aagggccaaaatcctgctgacccccctggtcatgggaatctgacccaagtgagtagtggcgcccttacttgtacc

SEQ ID NO: 13489 - DNA, 75 bp, Artificial Sequence
  Synthetic
ctggtcatgggaatctgacccaagtgagtagtggcgcccttacttgtaccccagccagctgatggccttaagcat

SEQ ID NO: 13490 - DNA, 75 bp, Artificial Sequence
  Synthetic
tatggggaaaagtacccatctaagcctcccaccgttagggagtttggaataccttttctataccatagatgcgct

SEQ ID NO: 13491 - DNA, 75 bp, Artificial Sequence
  Synthetic
cccccaactacttctgtgaaggtcatatccctagttggattacgccgcttttgaaaaatctagaagttgtttgga

SEQ ID NO: 13492 - DNA, 75 bp, Artificial Sequence
  Synthetic
gcggtgttgtggctggctctcgctgtcggatctctcggacaacaactgtggcgccagatcacaatgctgaagaaa

SEQ ID NO: 13493 - DNA, 75 bp, Artificial Sequence
  Synthetic
tcggatctctcggacaacaactgtggcgccagatcacaatgctgaagaaacgtgtcaatcgcttggaggcacagc

SEQ ID NO: 13494 - DNA, 75 bp, Artificial Sequence
  Synthetic
ggagctctcaaccacggccggcctcgcacactggcctaattgaagaagttgagctcttgacctttaaatttacgc

SEQ ID NO: 13495 - DNA, 75 bp, Artificial Sequence
  Synthetic
cctatcgaatgaaatgtactccatctctacgactcgagggctcatccatcttgacattcacaacataacagtgca

SEQ ID NO: 13496 - DNA, 75 bp, Artificial Sequence
  Synthetic
ctaggacaagttgccacgtgcgttgaagtccaatgcctgaccatggtaaatgtctctgtgcttgttgactcagtt

SEQ ID NO: 13497 - DNA, 75 bp, Artificial Sequence
  Synthetic
tttcatttcggggacataggaaccatcaccttgacttgcggtgcaaccactgacagattggctagccaacattac

SEQ ID NO: 13498 - DNA, 75 bp, Artificial Sequence
  Synthetic
tcaccttgacttgcggtgcaaccactgacagattggctagccaacattaccacgtgcgtgattcctcaaagtccg

SEQ ID NO: 13499 - DNA, 75 bp, Artificial Sequence
  Synthetic
gctcgttccagttgtgttgattgtcttgtccatagtgttcctaggcagaggagttacgctcgttattgtcgtggt

SEQ ID NO: 13500 - DNA, 75 bp, Artificial Sequence
  Synthetic
ttgtccatagtgttcctaggcagaggagttacgctcgttattgtcgtggtgatagcctcaatgtacattcgtcgt

SEQ ID NO: 13501 - DNA, 75 bp, Artificial Sequence
  Synthetic
ctatgctttcaccaacttgtacattcgcgacatgttcgacggtacaaataaaccttgtttgatatgcgaggacac

SEQ ID NO: 13502 - DNA, 75 bp, Artificial Sequence
  Synthetic
aaaatgacaggaccataatcaccgacgggatgttttggatggagagcgagattgtaaacggaacccaacgcatag

SEQ ID NO: 13503 - DNA, 75 bp, Artificial Sequence
  Synthetic
ttgttcttgaaatgttgcaatcacatagatgcctttggccttcgtcatacactcccgatgcattgtcagacccaa

SEQ ID NO: 13504 - DNA, 75 bp, Artificial Sequence
  Synthetic
gcaagctaagcccgtggatccagaaagcaatgtgacttggtgttgcaaaacatgcgacgccattatccacttccg

SEQ ID NO: 13505 - DNA, 75 bp, Artificial Sequence
  Synthetic
ggaccatttcctgtgcgagcgcgggcgccatttgggccgcggaacgggcagaccacccgtcggcagcggccgttc

SEQ ID NO: 13506 - DNA, 75 bp, Artificial Sequence
  Synthetic
tcgccctaataacaatcatagcctttctatacatggaccaagccaatgtgaccatggagcttgagtttctctcga

SEQ ID NO: 13507 - DNA, 75 bp, Artificial Sequence
  Synthetic
agtcgacacaaaagattgaaacaagctttggagacttgccaaatggaatctatcgaattaatgtacgtagtttca

SEQ ID NO: 13508 - DNA, 75 bp, Artificial Sequence
  Synthetic
ctttggagacttgccaaatggaatctatcgaattaatgtacgtagtttcatggaaaaccgacaacgtggagtggg

SEQ ID NO: 13509 - DNA, 75 bp, Artificial Sequence
  Synthetic
agcccctcaaatggcgagaaaagctagtgtccttacattcgggaagtgctttacgagatgtagtgtcgtatggtg

SEQ ID NO: 13510 - DNA, 75 bp, Artificial Sequence
  Synthetic
agtgtccttacattcgggaagtgctttacgagatgtagtgtcgtatggtggaccttggcagttggaaagtccaac

SEQ ID NO: 13511 - DNA, 75 bp, Artificial Sequence
  Synthetic
gcgtgcaaaccggataagactgtcgagtatcataaatacaagcctggtgtcgtaaagctggacaatgagaacgta

SEQ ID NO: 13512 - DNA, 75 bp, Artificial Sequence
  Synthetic
catccctggggcggttccccttcatcgcgcaaactttgcagctaattacgctcgggctagtaacgacgaaacctc

SEQ ID NO: 13513 - DNA, 75 bp, Artificial Sequence
  Synthetic
ctcgggctagtaacgacgaaacctctctggttgtttccactgacatttcggaaatgggggctaatctgggtgttg

SEQ ID NO: 13514 - DNA, 75 bp, Artificial Sequence
  Synthetic
gaccaatgtatgtggatgaccggttcgagaacatagagtgggaccaacgccgtttatcaatagaaatgtacatta

SEQ ID NO: 13515 - DNA, 75 bp, Artificial Sequence
  Synthetic
attctggctgagcagtctctcacctcaggaatggccttcatgctcggatgtgccatagccgtagccctgctgatg

SEQ ID NO: 13516 - DNA, 75 bp, Artificial Sequence
  Synthetic
tgccatagccgtagccctgctgatgttcctttgggtttttatttgcttggtgtcatattcccggtcggggaaaaa

SEQ ID NO: 13517 - DNA, 75 bp, Artificial Sequence
  Synthetic
tcgtgtatccggtgctctacaaagcagcaggaaaccggagttatctcgatagtgacctggtcaagtgggttattt

SEQ ID NO: 13518 - DNA, 75 bp, Artificial Sequence
  Synthetic
agcaggaaaccggagttatctcgatagtgacctggtcaagtgggttattttaggttcatgcgtaatgtgtagtgt

SEQ ID NO: 13519 - DNA, 75 bp, Artificial Sequence
  Synthetic
ggaacggcggggcaaaccaacttgacactttgcaagtgtttttctgcgccaccattcttctcaacaaattcgcgt

SEQ ID NO: 13520 - DNA, 75 bp, Artificial Sequence
  Synthetic
ccagatgtatgtaatgaagcatccggaaatggtaggcacagttggagggtttcgtctagaccacatcccgtttcg

SEQ ID NO: 13521 - DNA, 75 bp, Artificial Sequence
  Synthetic
ttgacaacactcgagccgttatgtactcgtattgtatggtacttagtttattatgggtcttttgcactagatcac

SEQ ID NO: 13522 - DNA, 75 bp, Artificial Sequence
  Synthetic
cgtccgacattccacgcaccatccttgttgtgtgcgcttgtctgtggcaactcctcaatccccggtcacacatcc

SEQ ID NO: 13523 - DNA, 75 bp, Artificial Sequence
  Synthetic
gcgtgtctgccatgaatgttgatgacatggttgatcgcgtcagaaaggtccaacaggaaaacagcgcgacatggt

SEQ ID NO: 13524 - DNA, 75 bp, Artificial Sequence
  Synthetic
catggttgatcgcgtcagaaaggtccaacaggaaaacagcgcgacatggtttattgacccggaacacccgtataa

SEQ ID NO: 13525 - DNA, 75 bp, Artificial Sequence
  Synthetic
acaaaaaatcttgcgggaaaaagttgataccgtgatacctcctcatcctccgcaaatacgtatggtcaatagcct

SEQ ID NO: 13526 - DNA, 75 bp, Artificial Sequence
  Synthetic
gaattatgactaaagaagaattcatcgccaatgttagaaacgatgcagccgttggttcgtggagtcgggacgtcc

SEQ ID NO: 13527 - DNA, 75 bp, Artificial Sequence
  Synthetic
atgctgatcactgggtcagtcgtgaaaactttcctgggggcgtaggtggagtgggtgtcaattactttggcaact

SEQ ID NO: 13528 - DNA, 75 bp, Artificial Sequence
  Synthetic
accttaaggaaatttcgctcaaaggaaagtatctctttgctgacgatatagcagggtgggatacgaaggtgagtt

SEQ ID NO: 13529 - DNA, 75 bp, Artificial Sequence
  Synthetic
ctgaagaccttgaagatgaagagactctcttgaccgaactgactgcaaatcccttccaccgcgccctaatcgccg

SEQ ID NO: 13530 - DNA, 75 bp, Artificial Sequence
  Synthetic
ccacaatgaagttggcctaccggaacatagtggcgatgtttccccgaacccacacgcgatacggtagcggcactg

SEQ ID NO: 13531 - DNA, 75 bp, Artificial Sequence
  Synthetic
ttatggatgtcgtcgggcgcaccgaccagcgaggctcggggcaggtggtaacgtatgccttgaatactataacga

SEQ ID NO: 13532 - DNA, 75 bp, Artificial Sequence
  Synthetic
aaaagtcgaattttgctcacatcactaccatgaactttcgctccgagatggacgcattctcatagtaccttgccg

SEQ ID NO: 13533 - DNA, 75 bp, Artificial Sequence
  Synthetic
gacgcattctcatagtaccttgccgtcaagaatctgaggttgttggacgcagtcgcttacaaaaaggaggaatcg

SEQ ID NO: 13534 - DNA, 75 bp, Artificial Sequence
  Synthetic
cctgcggaagcttaatcggatccaaagagcgagccgcttgggctcgggagatcgaaaatggagttataagtgtcc

SEQ ID NO: 13535 - DNA, 75 bp, Artificial Sequence
  Synthetic
ctggtcatcatgtcgcgtttccgaaagagtaatgacgtgatataactgcttcaatcatatcacctcaatttaagg

SEQ ID NO: 13536 - DNA, 75 bp, Artificial Sequence
  Synthetic
gtcaggaaaagctttggctaagtattccaaataaggcccgtttcgccacgaattcacacccccagcttctctagc

SEQ ID NO: 13537 - DNA, 75 bp, Artificial Sequence
  Synthetic
tagggggtgaccctcacgctaaattcccccagtttagtctgctcggaattggtgatgaccacttccccttaatgg

SEQ ID NO: 13538 - DNA, 75 bp, Artificial Sequence
  Synthetic
cccccagtttagtctgctcggaattggtgatgaccacttccccttaatggggaacacaattgtgttctcaacaga

SEQ ID NO: 13539 - DNA, 75 bp, Artificial Sequence
  Synthetic
ggcacaatagtgtcgggcctgacgaccccgctcccccgagtcgcccaacggagtttggctcaactctaaaaagaa

SEQ ID NO: 13540 - DNA, 75 bp, Artificial Sequence
  Synthetic
ccccgctcccccgagtcgcccaacggagtttggctcaactctaaaaagaaaatgagccaatttggactttcatag

SEQ ID NO: 13541 - DNA, 75 bp, Artificial Sequence
  Synthetic
gagtcccccagctggggaagggatccttgcatccccccctcctgcaggaagggcaaaaatcctgctgacccccct

SEQ ID NO: 13542 - DNA, 75 bp, Artificial Sequence
  Synthetic
tctaagcctcccaccgttagggagtttggaataccttttctataccatagatgcgcagaagctttaaaaatcggg

SEQ ID NO: 13543 - DNA, 75 bp, Artificial Sequence
  Synthetic
tctaagcctcccaccgttagggagtttggaataccttttctataccatagatgcgctgaagctttaaaaatcggg

SEQ ID NO: 13544 - DNA, 75 bp, Artificial Sequence
  Synthetic
tctaagcctcccaccgttagggagtttggaataccttttctataccatagatgcgccgaagctttaaaaatcggg

SEQ ID NO: 13545 - DNA, 75 bp, Artificial Sequence
  Synthetic
tctaagcctcccaccgttagggagtttggaataccttttctataccatagatgcgcggaagctttaaaaatcggg

SEQ ID NO: 13546 - DNA, 75 bp, Artificial Sequence
  Synthetic
acacaaagacggcgtatatcttatgaaaatctttcagtacatctgttatataagtgtcgtggtgtcgagactagt

SEQ ID NO: 13547 - DNA, 75 bp, Artificial Sequence
  Synthetic
tctccactactcaactcccacttattctaacaaaatctgctttagctctggatcaccagagtctatagttaccaa

SEQ ID NO: 13548 - DNA, 75 bp, Artificial Sequence
  Synthetic
ttactggatggaagtgatggagtcattccctgccggccaccaaaaatgtgaacttggtgatggccaattttcagc

SEQ ID NO: 13549 - DNA, 75 bp, Artificial Sequence
  Synthetic
tgtcgcattagacgatatgccaaagttcataaaggcaatgacaacttctgaccaggccctgagacttacttgcat

SEQ ID NO: 13550 - DNA, 75 bp, Artificial Sequence
  Synthetic
tagtcagaatgacagctacatttctgagctgaccactgatggagatgtcattccaggagagttccactctgagat

SEQ ID NO: 13551 - DNA, 75 bp, Artificial Sequence
  Synthetic
tgattgcaagagtggatcaataattaaggaattgtccaaagtcaatgtagcaccggctggagttcatgccagaga

SEQ ID NO: 13552 - DNA, 75 bp, Artificial Sequence
  Synthetic
tttactgctagaggatgcagagaccaatgccattctgcagcagagggaccagctgatagctgaactaagagaaaa

SEQ ID NO: 13553 - DNA, 75 bp, Artificial Sequence
  Synthetic
attgcgggatagcaaggtcagagaagatgctgcattgcaaaggagtaaggtaaacacagaacttctttctgagac

SEQ ID NO: 13554 - DNA, 75 bp, Artificial Sequence
  Synthetic
aaaagagaaggctgacaaactgcagagaagagctgatgaactgattcttcacctggaaagtgagagagcagaggg

SEQ ID NO: 13555 - DNA, 75 bp, Artificial Sequence
  Synthetic
caggatcagtaggaacaggtcaaagtggctagagcatgagctcaaggatgcaaaggaagatatctctaggttaag

SEQ ID NO: 13556 - DNA, 75 bp, Artificial Sequence
  Synthetic
gttggatgtcggaagaaccacaaccaggaagcctaaaagcctcattggcctaaccaccacaattattccactaat

SEQ ID NO: 13557 - DNA, 75 bp, Artificial Sequence
  Synthetic
gttgctaatgacttcagaagccacaaaaatatccaaagtaagagccaagtgctctcacgcaaggaacagaattgg

SEQ ID NO: 13558 - DNA, 75 bp, Artificial Sequence
  Synthetic
cagtgggaagaacgttctaccaggagttgaggaccccacctgctcgattataaattatgagaccagatgtgattc

SEQ ID NO: 13559 - DNA, 75 bp, Artificial Sequence
  Synthetic
tctagaatctctaatgattgaggacctatacccatttgcctcatcacatatccacaagcaaacattgctagaagc

SEQ ID NO: 13560 - DNA, 75 bp, Artificial Sequence
  Synthetic
cctaaatgacaacttcatcacaaaggatagtgatggaatatgcaatctgcagtcagataggaaagcagattgtta

SEQ ID NO: 13561 - DNA, 75 bp, Artificial Sequence
  Synthetic
taacaagaggagcaggatgagacccttttgtccaaatggctttcgtgctgcccactacttggatgatgaagggaa

SEQ ID NO: 13562 - DNA, 75 bp, Artificial Sequence
  Synthetic
gttgagaggaattcattgccctagtggaatggaaatcacagaagactgcattaattgcaggaagatgaaaacttc

SEQ ID NO: 13563 - DNA, 75 bp, Artificial Sequence
  Synthetic
tttgacaaaacatggaagtgtgcaaatgcaagatgcaatgtgtcaagaagtccaagaacagtactctggacctct

SEQ ID NO: 13564 - DNA, 75 bp, Artificial Sequence
  Synthetic
ccctgcacctagaggctactgcaagattgggaataaagaatataagaagtgcaagacatctcatactgaaccaag

SEQ ID NO: 13565 - DNA, 75 bp, Artificial Sequence
  Synthetic
acatgtacctttcatctctctgaaaggagttggtaaagtgtatttggatgggctggttatcagaaatgatgagga

SEQ ID NO: 13566 - DNA, 75 bp, Artificial Sequence
  Synthetic
gtctgaaaagaactcttttgtctgctataagcacaaagggcagtatgcaactaatgaagggacagaagcgaggat

SEQ ID NO: 13567 - DNA, 75 bp, Artificial Sequence
  Synthetic
ctatgaagttgccaaactgtcagagtgttctaattttgacagttcaaagaatggaaagtgcacaggtgatcatgt

SEQ ID NO: 13568 - DNA, 75 bp, Artificial Sequence
  Synthetic
cttctgctccaaatacagatgtgagcaggattatccagaagtatcttgtgtggtagccccaggatccggtcctgt

SEQ ID NO: 13569 - DNA, 75 bp, Artificial Sequence
  Synthetic
gctggtcaggtttgcaggaggatgggtgaagcctgtttgttttggttacgagaatgtcattgttgacatagaggt

SEQ ID NO: 13570 - DNA, 75 bp, Artificial Sequence
  Synthetic
tcccgattatggaatggtgcaggaggaggagtgtgaggcttgtgtcttctcttgtgatgacgacggaattcgtat

SEQ ID NO: 13571 - DNA, 75 bp, Artificial Sequence
  Synthetic
cagaacaacaggattcaaagtcaatgctgtgattgcatgctcaagtgggcattgctcaacctattcgcagacacc

SEQ ID NO: 13572 - DNA, 75 bp, Artificial Sequence
  Synthetic
atcaacaaatgtgttttttaggtacccaggaatgagctatagtgatggatcaaagataggggttcatctatctca

SEQ ID NO: 13573 - DNA, 75 bp, Artificial Sequence
  Synthetic
tgatgatgacaccataagctcgcacatggtgcttcagtgtgaggctagagactcttgttccatcaactcatgctt

SEQ ID NO: 13574 - DNA, 75 bp, Artificial Sequence
  Synthetic
actatgctcccacacattaattaactatcaatgccacactttcctcagtgcactcatctgcacactattcctgac

SEQ ID NO: 13575 - DNA, 75 bp, Artificial Sequence
  Synthetic
atcttgcattatactggctgtcctagtgatcaaaagggcttttgggtgtgcaaagaacatcccttcagctattat

SEQ ID NO: 13576 - DNA, 75 bp, Artificial Sequence
  Synthetic
gggcccaattaaatggataaaaacactgttttgctggatcatgtctagactgagacagtgttttactaggcaagt

SEQ ID NO: 13577 - DNA, 75 bp, Artificial Sequence
  Synthetic
acagaatataaatgcagaaataggctggaggccgaataacagggttgtcccaatacctaggtacaccggatttat

SEQ ID NO: 13578 - DNA, 75 bp, Artificial Sequence
  Synthetic
ggcggtgatgctgtcccttttctgtctttgctctgcctgctctgaaaccgtcctgtccaactcaaagctctcaaa

SEQ ID NO: 13579 - DNA, 75 bp, Artificial Sequence
  Synthetic
atgctcagtgagtgaaggaaagactgtatgcaccctaaatggagctatggtgataaaagcaggaactataggaac

SEQ ID NO: 13580 - DNA, 75 bp, Artificial Sequence
  Synthetic
tgaatcatgctttgtgatcaagtcacctggaggccagaagtctcacatctctctaaagacagtctcaagtgagct

SEQ ID NO: 13581 - DNA, 75 bp, Artificial Sequence
  Synthetic
aatatgcagggaaggagactccttttggacctcagattatgctcccaagtgcttaagttccagaaggtgttactg

SEQ ID NO: 13582 - DNA, 75 bp, Artificial Sequence
  Synthetic
ggtgggtgagtgtcactcaacaaactgccagtcgtgggatagcaacacagtttcgactgaattcttaaaatttgg

SEQ ID NO: 13583 - DNA, 75 bp, Artificial Sequence
  Synthetic
aaatgaaacaaggcttaatgaaaacaaatgctttgagcagtgcggtggggtatcctgtgggtgctttaacatgaa

SEQ ID NO: 13584 - DNA, 75 bp, Artificial Sequence
  Synthetic
tccttcatgcttattctcacacgctagcttggaatcagttagcaagaaggcaattcgtgcgttctcttgtgtaga

SEQ ID NO: 13585 - DNA, 75 bp, Artificial Sequence
  Synthetic
ttggactcacagaatcacatttgagatgatggacactaaaggacaaaaagagacgttcagcctctcagacacagg

SEQ ID NO: 13586 - DNA, 75 bp, Artificial Sequence
  Synthetic
gacaaaattcactccctggggctcactgagtctagggatagatgctgagtccatgaccgggacaaactccttgat

SEQ ID NO: 13587 - DNA, 75 bp, Artificial Sequence
  Synthetic
gttcttgcaagaccccttaacgggatttgcgctagtggacgaagagctatcctccacccctagggcaggatttat

SEQ ID NO: 13588 - DNA, 75 bp, Artificial Sequence
  Synthetic
aggagaagtcaggtgttcatcagaaataactgcagtctcagcacacaagtcttgcaagtgggcccccaacctgat

SEQ ID NO: 13589 - DNA, 75 bp, Artificial Sequence
  Synthetic
caagtatagaccggtcactgattatgtggaatgttcttctgacctcataaacccatttactctcttcagaagggg

SEQ ID NO: 13590 - DNA, 75 bp, Artificial Sequence
  Synthetic
ttttttacctcagtataggaatggcaagatgtttactcagtccatagataagaagaccgtccaagcagtttcttc

SEQ ID NO: 13591 - DNA, 75 bp, Artificial Sequence
  Synthetic
cctgtctataaaggccacagttagattgctctttgaaggcctgcaagttgaatttattgatgatgagaatgactg

SEQ ID NO: 13592 - DNA, 75 bp, Artificial Sequence
  Synthetic
caaagctgcacaaaggaacatctcgggttgctatctctgtaatgaaggatcaagagtgtgtctgagcatcactag

SEQ ID NO: 13593 - DNA, 75 bp, Artificial Sequence
  Synthetic
taagctcaatggatcattttacgcagagtctgtttctgggctgcacttagctattcaggttgtcgctggtacttc

SEQ ID NO: 13594 - DNA, 75 bp, Artificial Sequence
  Synthetic
agattactgctcttacactcattttgattcacccagcgtttctgagacgattcgctactcttgcgggggagctga

SEQ ID NO: 13595 - DNA, 75 bp, Artificial Sequence
  Synthetic
gaaagagctacacatcactgggactctaatttcggtagagccgcatgatgacagaaaccctcagtcatcaggttc

SEQ ID NO: 13596 - DNA, 75 bp, Artificial Sequence
  Synthetic
tatagtagtcaatcctagagaggcctcctggaacataatctcttggattaagggattcatctccttctttggagg

SEQ ID NO: 13597 - DNA, 75 bp, Artificial Sequence
  Synthetic
acctctcaagactgcagctatagttgtcgggctagttatactggcactcattataattgtcattgcagtcgtaat

SEQ ID NO: 13598 - DNA, 75 bp, Artificial Sequence
  Synthetic
agccaggagtggagtgctcaaaagcatgatccagaaggcaaaaattctgtaagcccacatccgctgcgcctcccc

SEQ ID NO: 13599 - DNA, 75 bp, Artificial Sequence
  Synthetic
catcatcaccaccatccatcatccacccaacagggcagcacctcaatcagtccctcaggttaatattggcactaa

SEQ ID NO: 13600 - DNA, 75 bp, Artificial Sequence
  Synthetic
tagtgagagtaagaggttaatatacaagacaagggcccgtgttacctatcagttgtatatgatactgtgggatta

SEQ ID NO: 13601 - DNA, 75 bp, Artificial Sequence
  Synthetic
gggcccgtgttacctatcagttgtatatgatactgtgggattaataacttagtgaaagaacgccggtctttgtgt

SEQ ID NO: 13602 - DNA, 75 bp, Artificial Sequence
  Synthetic
acacaaagaccccccgtgatttctcaaataacaagatgactagctacctattcgacacacctgttatagtgaggc

SEQ ID NO: 13603 - DNA, 75 bp, Artificial Sequence
  Synthetic
ccaatggctactttgatagggaagtctatgtaacatatatggctcacaacaagtactgtgaacaccctgtatcag

SEQ ID NO: 13604 - DNA, 75 bp, Artificial Sequence
  Synthetic
tacataactgcatggagattcctgttaagaattttggagtctccctactgcacaaggaatctttgtctgacttct

SEQ ID NO: 13605 - DNA, 75 bp, Artificial Sequence
  Synthetic
acattcttggcctcctaccattcagatggggggacagaatgggaaactctagggtcactcgggacagctttccgt

SEQ ID NO: 13606 - DNA, 75 bp, Artificial Sequence
  Synthetic
tcatgaaagacttgctcaaggacatcagtgacatgcatgactcagagttcttcagatccttccttcctaacgtga

SEQ ID NO: 13607 - DNA, 75 bp, Artificial Sequence
  Synthetic
agaaggcgttgtcatggccacttggatatccaacccttgagtttattagaatgacaaaatcagatcttaacctcc

SEQ ID NO: 13608 - DNA, 75 bp, Artificial Sequence
  Synthetic
cacacttcaaagagatctctgctaatgccacactgattatgcagatggggcagccagcactcgatcttgatcaag

SEQ ID NO: 13609 - DNA, 75 bp, Artificial Sequence
  Synthetic
ggtttgttaatgctcataagagaatagtgatggagtccataactagaggatttggtcacaaagactttccaggga

SEQ ID NO: 13610 - DNA, 75 bp, Artificial Sequence
  Synthetic
aaaacatgatattcgaggtagcctcattgcagtgtgttagacttcttaatgcagtccctgcagatctcttgtact

SEQ ID NO: 13611 - DNA, 75 bp, Artificial Sequence
  Synthetic
gtcaagtgccaaactccctcaccgccattgtgatgaagcacagatctatcttggaagatcacccccagcagcctc

SEQ ID NO: 13612 - DNA, 75 bp, Artificial Sequence
  Synthetic
taggcaatcaaaagtggactccagaccctgactcctggcttttagatgaccaggctgccaccttacatgaggagt

SEQ ID NO: 13613 - DNA, 75 bp, Artificial Sequence
  Synthetic
tcgctttaatattatctgaatctgaggatgacgaggattgatgcgctgccaaatccccctgatcctaatcccccc

SEQ ID NO: 13614 - DNA, 75 bp, Artificial Sequence
  Synthetic
tccccccaatcatatgtatatacattgattcaaatcacagccccatgtacacagcccaacaccccattagacccc

SEQ ID NO: 13615 - DNA, 75 bp, Artificial Sequence
  Synthetic
accacccaataccccgaagcccaccccatgccctcacccacaaacccccatccctccccacctgggcagcctatt

SEQ ID NO: 13616 - DNA, 75 bp, Artificial Sequence
  Synthetic
gagagcttctgaatttgttggcagccactttaatggcctctgagggcacaccattcacatcaacaactccaagag

SEQ ID NO: 13617 - DNA, 75 bp, Artificial Sequence
  Synthetic
actgaagcattttcctcctcttgtctggtccgataaacccaccattgactgctgccaacattggctgcttaaatg

SEQ ID NO: 13618 - DNA, 75 bp, Artificial Sequence
  Synthetic
aagccacaatctctccttttggcttacctctcagactagggtttattaccttcgaaaattgcaccagaaataggc

SEQ ID NO: 13619 - DNA, 75 bp, Artificial Sequence
  Synthetic
tatgagcagcaagtatggcatcctgagtctcaggtggaagagttgtgtccacaagcccggcaaagctaggatgca

SEQ ID NO: 13620 - DNA, 75 bp, Artificial Sequence
  Synthetic
ttaagcatcttgggaatccaggagataaggcatccattgcttcaccggtcactggcagaaagttctccacatgag

SEQ ID NO: 13621 - DNA, 75 bp, Artificial Sequence
  Synthetic
gcaatgcctggcaagtccagccagctaaagcagcggcaacacgagacagggtgagatcgtccctcccaggatttc

SEQ ID NO: 13622 - DNA, 75 bp, Artificial Sequence
  Synthetic
cagacttcagctgatacttcttcttcagagcaaggacagtcttttttccttcttctgacatcttgagaatcatct

SEQ ID NO: 13623 - DNA, 75 bp, Artificial Sequence
  Synthetic
tctctattttgtttcctctggttaaggccaatacaatcatcttcctagcatcttcttgccaggatgagccacccc

SEQ ID NO: 13624 - DNA, 75 bp, Artificial Sequence
  Synthetic
tctgttgcagtagctcaagcaccctcttggcgtcaaatccctgataggcaaattcattaacccaattcacaacat

SEQ ID NO: 13625 - DNA, 75 bp, Artificial Sequence
  Synthetic
ctgctatattaacaccagcctcactaaactcaatagctagtcgctcaaagtcagccattgcaggaattaattcac

SEQ ID NO: 13626 - DNA, 75 bp, Artificial Sequence
  Synthetic
gctagtcgctcaaagtcagccattgcaggaattaattcacttgataattaagaagtaattcggggttctttgtgt

SEQ ID NO: 13627 - DNA, 75 bp, Artificial Sequence
  Synthetic
acacaaagaagcccatatcatgaatgaaatattacagaatcaacctttaagtcaagaccagtacttctgtagagc

SEQ ID NO: 13628 - DNA, 75 bp, Artificial Sequence
  Synthetic
agtagcccactatgacgatgagatctttgggctagcaattcttgatttcaccataagggaggactgtggattggt

SEQ ID NO: 13629 - DNA, 75 bp, Artificial Sequence
  Synthetic
catagtagacttggatctggacggaagaggtgagtggagtacaattggatcaactgtaaaagaccatttaaagtt

SEQ ID NO: 13630 - DNA, 75 bp, Artificial Sequence
  Synthetic
aaatcctcagagtcttcccaattttgttcatgacttcacatttggtcacttggcaaacagtacagatagtccttt

SEQ ID NO: 13631 - DNA, 75 bp, Artificial Sequence
  Synthetic
tgttagcttcttcccagcagtaggagatggatttgatcacttgacaccggatgtgatgatcaaaatgccttcagg

SEQ ID NO: 13632 - DNA, 75 bp, Artificial Sequence
  Synthetic
acgtactcacataatagaatttacgacctttagagggacatctcaaggggctcaacaagctgctcttctgaagat

SEQ ID NO: 13633 - DNA, 75 bp, Artificial Sequence
  Synthetic
tggaaagtacgagtcagcatgtgagagaaggagtagagtcagtcctgtcactttctcagtgatttctgttcacag

SEQ ID NO: 13634 - DNA, 75 bp, Artificial Sequence
  Synthetic
atatggagtgtggacaaaccttgacctaagtgaggagcaggtaaatgagcttgtgtataggttcagattggcagt

SEQ ID NO: 13635 - DNA, 75 bp, Artificial Sequence
  Synthetic
gagtatatttgaagagatgaaagtgatgtttcctgagttgtccctggttgatgaagaactgagtaagacagaaag

SEQ ID NO: 13636 - DNA, 75 bp, Artificial Sequence
  Synthetic
agaagttttaggtattgtatcaaccatcaagatggattgggagaagactgagaagactttccctcactttaagag

SEQ ID NO: 13637 - DNA, 75 bp, Artificial Sequence
  Synthetic
ggaaatgtttgagaatttcagacagtcagatccagaccttgattatatatcatcaataatatctaagtgtattgg

SEQ ID NO: 13638 - DNA, 75 bp, Artificial Sequence
  Synthetic
tgaatcagaggagtcaatcttgaaggaaaactactttgagctacagaatctgcaacttagactaagagaaaatgg

SEQ ID NO: 13639 - DNA, 75 bp, Artificial Sequence
  Synthetic
gcgacaatgtgagaaggcactgagagccttctcaagcgagatggcatctggggatctgcgagatgttaatgaccc

SEQ ID NO: 13640 - DNA, 75 bp, Artificial Sequence
  Synthetic
taaatccacagtccagattcctccctgggtcacaattgaaggccctgaagggaaagatctagtgccattaaagtc

SEQ ID NO: 13641 - DNA, 75 bp, Artificial Sequence
  Synthetic
tctagaagtcaacggggatcatccaatgcagaggatctggtcaaaagtttgcaattcagcatctctagaactgat

SEQ ID NO: 13642 - DNA, 75 bp, Artificial Sequence
  Synthetic
agatagaatggtcgatgatcctgagtctgagttacaacatgctatttctgggactagagatcgggcggatgaaag

SEQ ID NO: 13643 - DNA, 75 bp, Artificial Sequence
  Synthetic
gagcaggtatcatagagtgattgttgagttggatagtgcagaactggagtatgctgcaacactcggagttggagg

SEQ ID NO: 13644 - DNA, 75 bp, Artificial Sequence
  Synthetic
taagaaatacagggaccatcattcatcaagagaagcaagggctcgcagcaagaggggcttttctttagatcacaa

SEQ ID NO: 13645 - DNA, 75 bp, Artificial Sequence
  Synthetic
tataaagtccttagagagatttatatcaggttgtactcaagagctgttagaagagggtgactactacaaaccctt

SEQ ID NO: 13646 - DNA, 75 bp, Artificial Sequence
  Synthetic
attagaggacatgcccttaaggattgaagcacagagaatccatcagcccactcatacaaggaataatggtgagaa

SEQ ID NO: 13647 - DNA, 75 bp, Artificial Sequence
  Synthetic
tgaattccttaggaaccatagactgtttatggagacccctcttggctcatggtcacaaatggtcagtctcatcgg

SEQ ID NO: 13648 - DNA, 75 bp, Artificial Sequence
  Synthetic
tttatggagacccctcttggctcatggtcacaaatggtcagtctcatcggagctgagttgtctgcgtcagtcaag

SEQ ID NO: 13649 - DNA, 75 bp, Artificial Sequence
  Synthetic
caacatgtaaaacagaagagcttcattgtgaaaaggctactgggatcaggaatatacctactgataaagccaacc

SEQ ID NO: 13650 - DNA, 75 bp, Artificial Sequence
  Synthetic
aattccaagagtcacatctttgtgtcatatgcgcttgataaactatactggtctcatgacttatcaagtggaact

SEQ ID NO: 13651 - DNA, 75 bp, Artificial Sequence
  Synthetic
gaatttaagaggtatctagatagcggagacctatttatcactgaattcacgtcctacaagctaagcaaattgacc

SEQ ID NO: 13652 - DNA, 75 bp, Artificial Sequence
  Synthetic
aacttatgtaagtgctgctcactgttggagagttctctcagcttttggacagaggcataccatgagaagccatgg

SEQ ID NO: 13653 - DNA, 75 bp, Artificial Sequence
  Synthetic
ctgagtgttgatgtgattagggatgggcgtcagccagagatcttaacaatgacaaagctttctctattgaccttg

SEQ ID NO: 13654 - DNA, 75 bp, Artificial Sequence
  Synthetic
ctagaagataaagcaagaactgaagaattgcaaacgctacttagatatgttgtcatggagggatttgtgtcccaa

SEQ ID NO: 13655 - DNA, 75 bp, Artificial Sequence
  Synthetic
cctgagctacctagaccacagaagatgatctctaaattacctagagttctgagaactgagttgcaagtcttactc

SEQ ID NO: 13656 - DNA, 75 bp, Artificial Sequence
  Synthetic
attcagagggtgatgacctccataagtaggattgcagcaaatccattcaagctcaagaagtctgatggttccatt

SEQ ID NO: 13657 - DNA, 75 bp, Artificial Sequence
  Synthetic
agctggtctggattattcaacccattgtctggatctaagctacttgacttacaaccactgataagctgctgctac

SEQ ID NO: 13658 - DNA, 75 bp, Artificial Sequence
  Synthetic
aacgggtactttaagaacaaggaagaggaaactgagccttctgccttatcagctatgtacaaaaagataattgaa

SEQ ID NO: 13659 - DNA, 75 bp, Artificial Sequence
  Synthetic
ctagagcatctgaaaccagaaacagatgaattcttaggttggggagaccccaaagaccccaagactcatgagttc

SEQ ID NO: 13660 - DNA, 75 bp, Artificial Sequence
  Synthetic
agtagatcctatctcaaagaagtgtgtgagcatgggaaagcaatcttgagaagaatgtatggacacaatgttttg

SEQ ID NO: 13661 - DNA, 75 bp, Artificial Sequence
  Synthetic
cagcagattgacgatcagatcacaagagagatttcctcacttaccattgaaagactagcaactttgaaagcaact

SEQ ID NO: 13662 - DNA, 75 bp, Artificial Sequence
  Synthetic
agcaactttgatgagaactggtacatatataaagactgcaaggacaagaattacacaagagacaagctgctagtc

SEQ ID NO: 13663 - DNA, 75 bp, Artificial Sequence
  Synthetic
aaaatgtctcagtttgcatctgaagggaagacattggcaatagaaaagttcgaggattgcatgacctctatagaa

SEQ ID NO: 13664 - DNA, 75 bp, Artificial Sequence
  Synthetic
tcaaggggagccatgcacatttgcttgtttaagaagcagcaacatggaggacttagggagatttatgttatggga

SEQ ID NO: 13665 - DNA, 75 bp, Artificial Sequence
  Synthetic
gcagaagaaagaattgttcagtctgtagtggaatgtatagctaaaacggttggcaagttcttttcttcggataca

SEQ ID NO: 13666 - DNA, 75 bp, Artificial Sequence
  Synthetic
ctgtgtaatccaaacaacaagtctaggatccctgagagtcatgcacatagggctagaaaacactgcaggtcttca

SEQ ID NO: 13667 - DNA, 75 bp, Artificial Sequence
  Synthetic
gtttggacatgtgccacttctgatgatgctaagaagtggaatcaaggtcacttcgtgacaaaatttgccatgatg

SEQ ID NO: 13668 - DNA, 75 bp, Artificial Sequence
  Synthetic
ctatgtgagttcacatcaccaaaatggtggcccataatcattagaggatgctcaatgttcacccggaaatttatg

SEQ ID NO: 13669 - DNA, 75 bp, Artificial Sequence
  Synthetic
atgatgaatatgaggtatttggacattctaaatgggcatagagagctcaaagtggatgatgaattcgtgatgacc

SEQ ID NO: 13670 - DNA, 75 bp, Artificial Sequence
  Synthetic
ttgttcaatgcttatcacggagaggtagaggtaccatggcttgagaagggtaggacatatttacaaacaaccaca

SEQ ID NO: 13671 - DNA, 75 bp, Artificial Sequence
  Synthetic
gggatgatgcaagggatccttcacagcacctcatctttgctccacaccttacatcaagaattcatccgttcatta

SEQ ID NO: 13672 - DNA, 75 bp, Artificial Sequence
  Synthetic
tcattcaaagtttttaacatgaaagtgcagccggatatgggttctagagtggtttgcgatgtcatgcagggctct

SEQ ID NO: 13673 - DNA, 75 bp, Artificial Sequence
  Synthetic
gatgatagctcaatgattataagctttcctgcaaatgaagactccacctttataaagtgtaaaatggcagcagcc

SEQ ID NO: 13674 - DNA, 75 bp, Artificial Sequence
  Synthetic
atgtgtttcagagtaaagaaaacattagggctgtacttagggatatacccatccgagaagtccacatccaacaca

SEQ ID NO: 13675 - DNA, 75 bp, Artificial Sequence
  Synthetic
gactttgtcatggaatacaattctgaattcttcttccataccagccatgtgagaccattagtgagatgggtttca

SEQ ID NO: 13676 - DNA, 75 bp, Artificial Sequence
  Synthetic
tcctgttgcagtctgccagaagtggaaactcttgtcgccagacaagaagaagcatccaatttactaacctcaatt

SEQ ID NO: 13677 - DNA, 75 bp, Artificial Sequence
  Synthetic
tcagaagggggagggtcttttgcgttgtctgctatgatacaacaatcacaatgcacaatccactaccagttgata

SEQ ID NO: 13678 - DNA, 75 bp, Artificial Sequence
  Synthetic
ggaatgggtgtgtcttccattttccctcactacagaagagctctagccagatggaaagatcctgggctgggtttc

SEQ ID NO: 13679 - DNA, 75 bp, Artificial Sequence
  Synthetic
ttcctattagacaatccatatgctgcaggattagggggtttcaggttcaacttgtttaaggctatcacaatgaca

SEQ ID NO: 13680 - DNA, 75 bp, Artificial Sequence
  Synthetic
gaattacagaaagtttatgcttactttatgagaaaagtcaaggacaatactttacctgaggaagagggagtgtta

SEQ ID NO: 13681 - DNA, 75 bp, Artificial Sequence
  Synthetic
gtcccggagacctgcagtgtcagtcctggaggagcaataataatgagttcctcattaaagtggggatccaggaag

SEQ ID NO: 13682 - DNA, 75 bp, Artificial Sequence
  Synthetic
aaattttctagactcagagataggttgaacatacctgagaactgggttgagttaattaatgacaatccagaggtc

SEQ ID NO: 13683 - DNA, 75 bp, Artificial Sequence
  Synthetic
ctatatagagctcccagatcaggagaagagataatattaagaatagctgaaaaagtacacagtcctggggttgtc

SEQ ID NO: 13684 - DNA, 75 bp, Artificial Sequence
  Synthetic
tcttcattgtcaactgggaatgcagtttgtaaggtcatggcaagttcagtgtacttcttatctgcggcaattttt

SEQ ID NO: 13685 - DNA, 75 bp, Artificial Sequence
  Synthetic
gaggatagcggcaaaccagaattctcttacctcgacaattcaaaatatagtatattgcaaaaaatgatagcgtat

SEQ ID NO: 13686 - DNA, 75 bp, Artificial Sequence
  Synthetic
gacggcttcaatggctcacatgatatagatcccgaagacatactctttctcttcccaaatgtagaggagctagag

SEQ ID NO: 13687 - DNA, 75 bp, Artificial Sequence
  Synthetic
cagttagacatgataatttatgataagggacctattgatttagtggaaagagttagctctagggaagcaactcag

SEQ ID NO: 13688 - DNA, 75 bp, Artificial Sequence
  Synthetic
tcaaaagtcatagtctttgatgagaggaggtgcatgagagtgagtccagaaaagctggtttctgacaaatggttt

SEQ ID NO: 13689 - DNA, 75 bp, Artificial Sequence
  Synthetic
ggaacccaaaagagtaaaataggcaggactgcatttgaaattgaatgggcgaagttgacccgagtaatcaggtgg

SEQ ID NO: 13690 - DNA, 75 bp, Artificial Sequence
  Synthetic
ctcaaagacactcctgaggggacaatggaaaagtctccattgtcaaatcagatccaaataagaaacttctttgct

SEQ ID NO: 13691 - DNA, 75 bp, Artificial Sequence
  Synthetic
agactagaaggcagatctagatgtgtgaggataacaggagcaccagtgaaaaagagatcaggcatgagtaagcta

SEQ ID NO: 13692 - DNA, 75 bp, Artificial Sequence
  Synthetic
gctctggtcatacgtgacaacttctgcaaaactggtcacttaagaggaatagaagacataagtgggagctctaga

SEQ ID NO: 13693 - DNA, 75 bp, Artificial Sequence
  Synthetic
tctgtttctgtggaagtcttaaggcatgtcctattttcagtcctgcaaggtccttatagtgatgaatcaaaacta

SEQ ID NO: 13694 - DNA, 75 bp, Artificial Sequence
  Synthetic
gacttgagtataaagtctttgtcttcatccagcgagattgagctaagagaaaatgatgggaaaaccaaggccaac

SEQ ID NO: 13695 - DNA, 75 bp, Artificial Sequence
  Synthetic
attttgagtatactacagagctacatatgggcagatagaggagtaattcagaagattgagaaagcaggagcaggg

SEQ ID NO: 13696 - DNA, 75 bp, Artificial Sequence
  Synthetic
acagttgggggtttcatcaagcctcaaaaaacatataaagacggtcaaattatcaagtattatggtcatggaata

SEQ ID NO: 13697 - DNA, 75 bp, Artificial Sequence
  Synthetic
tggcgtggtatgatggacggaatagatatgcagattgacatagataataagaagaatcagaacccacagattaca

SEQ ID NO: 13698 - DNA, 75 bp, Artificial Sequence
  Synthetic
agcataagagttgctggcacaaaaagcccatgggttgtatgtcaaagtctgaagctatggtgtgaagatatggga

SEQ ID NO: 13699 - DNA, 75 bp, Artificial Sequence
  Synthetic
gttaagaattcagctgacttctctgagtcagtcaggcgagcccctaaattctggctatctaacttcaaaatgttc

SEQ ID NO: 13700 - DNA, 75 bp, Artificial Sequence
  Synthetic
ggtgggaatcatcctttaggagcccctgtttacattttggatggtagaatggatgatctgcgggagatcagagat

SEQ ID NO: 13701 - DNA, 75 bp, Artificial Sequence
  Synthetic
gaggacattcttattaaagtcaggagaggaacattaaacttatttgtgaaaagcagaggaggtagtgagatgcac

SEQ ID NO: 13702 - DNA, 75 bp, Artificial Sequence
  Synthetic
atactatcatatacttcctctgatactgatttgagcccgtcaatggtcaaagaggctgaaatgtctatgccagag

SEQ ID NO: 13703 - DNA, 75 bp, Artificial Sequence
  Synthetic
ctaatgaacttatttagcagagaaccaagcaggtcttgggtaagttgctctcctctgccggttcaatacacagaa

SEQ ID NO: 13704 - DNA, 75 bp, Artificial Sequence
  Synthetic
gtattattagatgtgtgtgaaggattgaagagagtggacagaataaaccccatcaggctaagtgagataattaga

SEQ ID NO: 13705 - DNA, 75 bp, Artificial Sequence
  Synthetic
atctgcacagactcttccttaagaacaaaggttggcacagtgtactcaatgcaacagttctcagaggaagcacaa

SEQ ID NO: 13706 - DNA, 75 bp, Artificial Sequence
  Synthetic
ataattgattgtgatgacctcttagatattatgatagaggatattaggactggagccttcagtgaggttgttagg

SEQ ID NO: 13707 - DNA, 75 bp, Artificial Sequence
  Synthetic
aagatggaagatgaggtgaaaggagacaatgaggatttagattttgactacgatgatatcaatctgttcggccct

SEQ ID NO: 13708 - DNA, 75 bp, Artificial Sequence
  Synthetic
cgatgatatcaatctgttcggccctgcacaccacaaggagtatggggagctatctttagtgtcacatcctttgat

SEQ ID NO: 13709 - DNA, 75 bp, Artificial Sequence
  Synthetic
gcacaccacaaggagtatggggagctatctttagtgtcacatcctttgatggacaagtttgttgacaatgctata

SEQ ID NO: 13710 - DNA, 75 bp, Artificial Sequence
  Synthetic
tctgtaatgggcaggtcatcactcaggaggctactagagctaggggtgacaaagacaagatatctgaagatctca

SEQ ID NO: 13711 - DNA, 75 bp, Artificial Sequence
  Synthetic
agattagtttacagagccatagggagaaatgcagatgcaataagaacagatgattttagtttagaagaccagcct

SEQ ID NO: 13712 - DNA, 75 bp, Artificial Sequence
  Synthetic
agcataagtgaagacatgctgggctgaaagccctcagagctcataccagagacaagtggattagccaagatgtca

SEQ ID NO: 13713 - DNA, 75 bp, Artificial Sequence
  Synthetic
gatgtcactcactgtttgaagactagattttggtgtaaaattataaattcattaagtaatgggcggtctttgtgt

SEQ ID NO: 13714 - DNA, 75 bp, Artificial Sequence
  Synthetic
acacaaagacggcgcatattttaatgaaaaactacaatatcttatttttattgagtatagtggctgctagactgg

SEQ ID NO: 13715 - DNA, 75 bp, Artificial Sequence
  Synthetic
tcttgcactactctacaccacatctcaacaacaagatctgctttagctcaggaactccggagctacacatcacca

SEQ ID NO: 13716 - DNA, 75 bp, Artificial Sequence
  Synthetic
actactggatggaagccatggagaaatttcctgttgacaataagaagtgtgagctgggagatggggtcttttcat

SEQ ID NO: 13717 - DNA, 75 bp, Artificial Sequence
  Synthetic
cagtcacactggatgatatgcctcctttcattaaagcaatgacaacttctgatgaagccctaagatttacgtgta

SEQ ID NO: 13718 - DNA, 75 bp, Artificial Sequence
  Synthetic
taggatccaacgatagctacatagctgagctgacaacagacggcgatgttattcctggagagagccattctatca

SEQ ID NO: 13719 - DNA, 75 bp, Artificial Sequence
  Synthetic
tagattgtaagactggcgaaacagaagttgtactgtctcctgttaatgtggcaccagcaggccttaaggtccaag

SEQ ID NO: 13720 - DNA, 75 bp, Artificial Sequence
  Synthetic
acttggtcgatcatgacagagaggttgatgcagtgttgctacaaagagaccagttgatagaggagttacgtacta

SEQ ID NO: 13721 - DNA, 75 bp, Artificial Sequence
  Synthetic
gactaagagacagcaaaatcagagaagagtcagcaaaagagaagagtaagcagctgactgaggagctagacacta

SEQ ID NO: 13722 - DNA, 75 bp, Artificial Sequence
  Synthetic
tgaagaaagacatagacaaattcaaggggaggacagatgaactaatcttgcacttagaaagtgagaggttggaga

SEQ ID NO: 13723 - DNA, 75 bp, Artificial Sequence
  Synthetic
gtagaatcagtaggaacaagtcacgatggcttgaacatgaactaaaggatgcaaaagaagatgtgataagattac

SEQ ID NO: 13724 - DNA, 75 bp, Artificial Sequence
  Synthetic
agaatgatatgctcagagaaccgaaaaagaaatccagctctgaaaggacaaccaaagcatccctcaagacggttc

SEQ ID NO: 13725 - DNA, 75 bp, Artificial Sequence
  Synthetic
tgttatatacaacaacgatgatacctctgctactaggacagaccgacgccaccaaggctcttgggaagactaggg

SEQ ID NO: 13726 - DNA, 75 bp, Artificial Sequence
  Synthetic
cgaaatgctcgcatgctagaaacagaataggtagtgggaagaattctattactggtataacatcaccaacttgct

SEQ ID NO: 13727 - DNA, 75 bp, Artificial Sequence
  Synthetic
catctatagattatgaattacgctgtgactccctagaaattctgatgatggatgacatatatccctttgcatcat

SEQ ID NO: 13728 - DNA, 75 bp, Artificial Sequence
  Synthetic
ctcacatacataaacaaacaatacttgaagctgtcaatgatgggtttatcgagcaagtcaatgatggggtatgcc

SEQ ID NO: 13729 - DNA, 75 bp, Artificial Sequence
  Synthetic
agttagataacgacaggcccccaaagtgtttcgaaaatagaagtaaaatgagaccacactgcccaaatggcttcc

SEQ ID NO: 13730 - DNA, 75 bp, Artificial Sequence
  Synthetic
gtgcctctcactatctagatgatgagggtaaacttagagggctgtactgtaaagaagactcagaagtcacagaag

SEQ ID NO: 13731 - DNA, 75 bp, Artificial Sequence
  Synthetic
actgtttgaactgcagaaagctgaagtctaagcctcagaagcagggaagcattcaaatgcaagatgccatgtgcc

SEQ ID NO: 13732 - DNA, 75 bp, Artificial Sequence
  Synthetic
aaaatgtcacagtgccatacaaaggacctttgcctgctccaaggggttattgcaaggttggccttaagaaataca

SEQ ID NO: 13733 - DNA, 75 bp, Artificial Sequence
  Synthetic
aaagttgtaagacatcccatactgaggtcaggcatgttccattcatgatactaaagggatcaggaaaagtgtact

SEQ ID NO: 13734 - DNA, 75 bp, Artificial Sequence
  Synthetic
tggactccttaatcctaaaaaacaatgaggagtctgacatttcttcattcctttgttataagaacaaaggtcaat

SEQ ID NO: 13735 - DNA, 75 bp, Artificial Sequence
  Synthetic
acaacacaggtgatggagtggaagctcgtgtttataagtctgtcaaaattactgaatgctccaatgttgactctt

SEQ ID NO: 13736 - DNA, 75 bp, Artificial Sequence
  Synthetic
caaaaactacaaaatgtacaggagaccatgttttttgtagtaagttcaagtgtgaggagacatatccagaagtgc

SEQ ID NO: 13737 - DNA, 75 bp, Artificial Sequence
  Synthetic
aatgcattgttgccccaggagcaggccctgtcatggttaggtatgctggaggatgggtcctgccagtatgctttg

SEQ ID NO: 13738 - DNA, 75 bp, Artificial Sequence
  Synthetic
gttacgagaataccatagtggagctggacatacaaactggatcacaactcactgaggaagaatgtgattcctgcg

SEQ ID NO: 13739 - DNA, 75 bp, Artificial Sequence
  Synthetic
tgtacagctgcgaccctgatggtgtaaggataaggacaactggattcaaggtggatgctgtgatagcttgtgcta

SEQ ID NO: 13740 - DNA, 75 bp, Artificial Sequence
  Synthetic
gtggacattgctcaacctactctcagaagccttccaccaatgtcttttttcagtatcccggaatgtcttatggtg

SEQ ID NO: 13741 - DNA, 75 bp, Artificial Sequence
  Synthetic
atgggtcaacaattggagttcatctgtcgcatgatgatgacacaatcagctctcatatgatagtgcaatgtgaag

SEQ ID NO: 13742 - DNA, 75 bp, Artificial Sequence
  Synthetic
cgaaagatccttgtatgatcaacacatgtatcatatgcacacatacgctaattaactaccaatgccacacctttt

SEQ ID NO: 13743 - DNA, 75 bp, Artificial Sequence
  Synthetic
tgagtgcatttgtgtgtaccctgcttttgctgtctatagcactaataatgcttttgataataaagagaaccacaa

SEQ ID NO: 13744 - DNA, 75 bp, Artificial Sequence
  Synthetic
aaactgtgaaatctttgcccaggatgatgacagcaccaatacattggctaagattgctaattaaatgggtatcta

SEQ ID NO: 13745 - DNA, 75 bp, Artificial Sequence
  Synthetic
acagagtcaggcaatgtttcagaaggcaagtggagaatataaatgccgaaattggttggagaggccctccacaga

SEQ ID NO: 13746 - DNA, 75 bp, Artificial Sequence
  Synthetic
gggttgttccaatccctcgatatacagggttcatggctattatactatttctgattgtggttgtagatgggtgct

SEQ ID NO: 13747 - DNA, 75 bp, Artificial Sequence
  Synthetic
cagaaacagtgatctctgactctaaaataactaagtgttcctcagttgggtcagtaacaacctgtattctgactg

SEQ ID NO: 13748 - DNA, 75 bp, Artificial Sequence
  Synthetic
ggtcagtggtcctgcaggctggaacgataggtacagagtcttgtttgatagtgaaaaccccctcaggtcaaaagt

SEQ ID NO: 13749 - DNA, 75 bp, Artificial Sequence
  Synthetic
ctcacatgtcaatcaaaactgtgtcaagtgagcttgtgtgcagagaaggggattcctactggacatcaaattatg

SEQ ID NO: 13750 - DNA, 75 bp, Artificial Sequence
  Synthetic
ttcccaagtgtttaagctcaaggaggtgctactgggttggcgaatgccattcaaccaattgtcaagcatggtcca

SEQ ID NO: 13751 - DNA, 75 bp, Artificial Sequence
  Synthetic
atgacatggtatcatctgaattcttgaagtttggtaacgaaaccaaattaagtgaaaacaggtgttttgaacaat

SEQ ID NO: 13752 - DNA, 75 bp, Artificial Sequence
  Synthetic
gtggtgggatttcttgtgggtgttttaatatgaatccttcatgcctgtttgtccactcaaacctggaatcaatat

SEQ ID NO: 13753 - DNA, 75 bp, Artificial Sequence
  Synthetic
caagaaaggcactacgagcattttcatgctcagactggtctcacagagtgacgtttgaaatcacagacataaagg

SEQ ID NO: 13754 - DNA, 75 bp, Artificial Sequence
  Synthetic
gcctgaaggaaaaatttaccttatttgacacaggttccaagttcttttcatggggatccgtgagtctaggattag

SEQ ID NO: 13755 - DNA, 75 bp, Artificial Sequence
  Synthetic
atgcagagtccattacaggatctaattccttctcctttctgcatgatcctagttcaggatttgccctgatagatg

SEQ ID NO: 13756 - DNA, 75 bp, Artificial Sequence
  Synthetic
aggaattctcaaccaccccaaggtcaggatttgtaggagaagttaggtgttcatctgaactggcagctgtctcag

SEQ ID NO: 13757 - DNA, 75 bp, Artificial Sequence
  Synthetic
ctcataagtcatgcaaatgggcacctgatctcattaagtatagacctgtgacagattatgtagagtgctcctcaa

SEQ ID NO: 13758 - DNA, 75 bp, Artificial Sequence
  Synthetic
atctgattgacccctttgtgctgtttaaaagaggatttctgccacagtcaaggaacggcaagatgtacactcagt

SEQ ID NO: 13759 - DNA, 75 bp, Artificial Sequence
  Synthetic
ccatagataagaaatcagtgcaagcagtgtctgcccttagtataagggctacgttacggttgttaatggaaggtc

SEQ ID NO: 13760 - DNA, 75 bp, Artificial Sequence
  Synthetic
tagaagttcactttgaagaaagggtagccaactgcaaggctgctatgaggaatattacaggatgctactcgtgca

SEQ ID NO: 13761 - DNA, 75 bp, Artificial Sequence
  Synthetic
atgaaggagcaaaaatttgcttaagcatatcaactgatcagaattccagcttatatgcagaatctagctctggta

SEQ ID NO: 13762 - DNA, 75 bp, Artificial Sequence
  Synthetic
ttcacattgcattccctgtttctacaggagtgagtgattactgtagcatagttcactttaatgacccatctgttg

SEQ ID NO: 13763 - DNA, 75 bp, Artificial Sequence
  Synthetic
aagaaattctgaagtactcgtgtggaggaacagataaggagctacacatttctggaacactattgtcagtagagc

SEQ ID NO: 13764 - DNA, 75 bp, Artificial Sequence
  Synthetic
cccataatgatagaaacaagcagtcatctgggtctgttgttgtgaacccacgtgaggttagctggaatttctttt

SEQ ID NO: 13765 - DNA, 75 bp, Artificial Sequence
  Synthetic
cttgggtctcaggattgatcaaattcttaggagggccattgaaaactgctatgatagttataggactgattattc

SEQ ID NO: 13766 - DNA, 75 bp, Artificial Sequence
  Synthetic
tgtcctgtattgtgatagcaatcatcatctttgcagcccgtagcggtctcctaagtggactgttttctaaagcca

SEQ ID NO: 13767 - DNA, 75 bp, Artificial Sequence
  Synthetic
aggctctataattcaccaactcaaatcaccactcatcacacataacactccataaaactcagctggcagcacaca

SEQ ID NO: 13768 - DNA, 75 bp, Artificial Sequence
  Synthetic
ggtccgcagtatatgattgataaatatgtgtcagtttagagagtatggctttgcgtaatgttggcaggagagctg

SEQ ID NO: 13769 - DNA, 75 bp, Artificial Sequence
  Synthetic
ttggcaggagagctgtctgtagcaagaaagcagtgtgggattattattttacttggaaagcgccggtctttgtgt

SEQ ID NO: 13770 - DNA, 75 bp, Artificial Sequence
  Synthetic
acacaaagaccccccgtgatttctcaaacaacaagatgactagctatctattcgacacacctgtcatagtgaggc

SEQ ID NO: 13771 - DNA, 75 bp, Artificial Sequence
  Synthetic
ccaatggttactttgaccgagaagtctatgtgacatatatggctcacaataagtattgtgaacatcctgtgtcag

SEQ ID NO: 13772 - DNA, 75 bp, Artificial Sequence
  Synthetic
tacataactgcatggagattcctgtcaaaaactttggagtctctctgctgcataaggagtctctgtctgacttct

SEQ ID NO: 13773 - DNA, 75 bp, Artificial Sequence
  Synthetic
acattcttggcctcctaccattcaggtggggagatagaatgggcaactccagggtcacccgggaaagcttcccat

SEQ ID NO: 13774 - DNA, 75 bp, Artificial Sequence
  Synthetic
tcatgaaagacttactcaaagacatcaatgacatgcatgactcagaattttttagatccttcctccccaacgtga

SEQ ID NO: 13775 - DNA, 75 bp, Artificial Sequence
  Synthetic
aaaaggcattgtcgtggccacttggataccctactcttgagttcattagaatgacaagatcagaccttgaccttc

SEQ ID NO: 13776 - DNA, 75 bp, Artificial Sequence
  Synthetic
cacactttaaggaaatctctgccaacgccacactaattatgcagatgggtcagccagcacttgacctcgaccaag

SEQ ID NO: 13777 - DNA, 75 bp, Artificial Sequence
  Synthetic
ggtttgttaatgcccacaagagaatagtgatggagtccataactagagggtttggtcataaagacttcccaggga

SEQ ID NO: 13778 - DNA, 75 bp, Artificial Sequence
  Synthetic
agaatataatattcgaagttgcttcactacagtgtgttagacttcttaatgctgtccctgcagatctcttgtatt

SEQ ID NO: 13779 - DNA, 75 bp, Artificial Sequence
  Synthetic
gtcaggtgccaaactctctcacttccacagtgatgaagcacagatccatcttagaggaccaccctcagcagccct

SEQ ID NO: 13780 - DNA, 75 bp, Artificial Sequence
  Synthetic
taggcaatcagaagtggacaccagatcctgattcctggcttctggatgaccaagctgccactctgcatgaagagt

SEQ ID NO: 13781 - DNA, 75 bp, Artificial Sequence
  Synthetic
tcgctctaatcttatctgagtctgaggatgatgaggattgacacgctgccgaatccccctgatcttaatcccccc

SEQ ID NO: 13782 - DNA, 75 bp, Artificial Sequence
  Synthetic
tccccctaatcacatgtatgtacatatattgatttagatcacattcccatgtatatagccccaccaaaccccatc

SEQ ID NO: 13783 - DNA, 75 bp, Artificial Sequence
  Synthetic
gcccaacacccaaacccccagcccaagccctcacccacaaaacccacccctccctttcaggcagcctattgagag

SEQ ID NO: 13784 - DNA, 75 bp, Artificial Sequence
  Synthetic
ctcctgaatttgttggcagccactttaacagcctctgagggcacaccattcacatcaacaaccccaagagattgg

SEQ ID NO: 13785 - DNA, 75 bp, Artificial Sequence
  Synthetic
agcatcttcctcctcttgtctggcccgataaacccaccattgactgctgccagcattggctgcttgaacgaagct

SEQ ID NO: 13786 - DNA, 75 bp, Artificial Sequence
  Synthetic
acaacctctccctttggcttgcctctcagactagggtttatcaccttcgaaaattgtaccaagaagaggctatga

SEQ ID NO: 13787 - DNA, 75 bp, Artificial Sequence
  Synthetic
gcagccagtatggcatcctgagtttcaggcgggagagttgtgtccacaagcccggcaaagctgggatgcattaag

SEQ ID NO: 13788 - DNA, 75 bp, Artificial Sequence
  Synthetic
catcttggaaatccaggagataaggcatccattgcttcgccggtcactggcagaaagttctctacatgaggtaat

SEQ ID NO: 13789 - DNA, 75 bp, Artificial Sequence
  Synthetic
gcctggcaagtccagccagctagagcagcggcaacacgagacagggtgagatcgtctcttccaggatttccagac

SEQ ID NO: 13790 - DNA, 75 bp, Artificial Sequence
  Synthetic
ttcaactgatacttcttcttcagggccaagacagtcttcttcccttcttctgacatcttaagaatcatcttctct

SEQ ID NO: 13791 - DNA, 75 bp, Artificial Sequence
  Synthetic
attttgttccctctagtcaaggccaatacaatcatcttcctagcatcttcttgccaggatgagccacctctctgt

SEQ ID NO: 13792 - DNA, 75 bp, Artificial Sequence
  Synthetic
tgtagcagttcaagcaccctcttggcgtcaaatccctgataagcaaattcattaacccaattcacgacatctgct

SEQ ID NO: 13793 - DNA, 75 bp, Artificial Sequence
  Synthetic
atattaacacctgcttcactaaactcaatagctagtcgctcaaagtcagccattgcaagaattaattcacttgat

SEQ ID NO: 13794 - DNA, 75 bp, Artificial Sequence
  Synthetic
gctagtcgctcaaagtcagccattgcaagaattaattcacttgataattaagaagtaattcggggttctttgtgt

SEQ ID NO: 13795 - DNA, 75 bp, Artificial Sequence
  Synthetic
acacaaagaagcccacatcatgaatgaaatattacagaatcaacctttaagtcaagatcagtacttctgtagagc

SEQ ID NO: 13796 - DNA, 75 bp, Artificial Sequence
  Synthetic
agtggcccactatgacgatgagatttttgggctagcaatccttgatttcaccataagagaagactgtgggttagt

SEQ ID NO: 13797 - DNA, 75 bp, Artificial Sequence
  Synthetic
cattgtagatttggatctagatgggagaggtgaatggagcaccattggatcaactgttaaagaccagataaaatt

SEQ ID NO: 13798 - DNA, 75 bp, Artificial Sequence
  Synthetic
aaaccctcagaatctccctaattttgttcatgatttcacatttggccatttagcaaacagtacagatagtccttt

SEQ ID NO: 13799 - DNA, 75 bp, Artificial Sequence
  Synthetic
tgttagcttctttccagcagtaggagacggatttgaccacttgacaccggatgtgatgatcagaatgccttcagg

SEQ ID NO: 13800 - DNA, 75 bp, Artificial Sequence
  Synthetic
acgcacccacataatagaattcacaactttcagagggacatcccaaggagcacagcaagctgctcttctgaagat

SEQ ID NO: 13801 - DNA, 75 bp, Artificial Sequence
  Synthetic
tggaaaatatgagtcagcatgtgagaggaggagcagaattagtccagtcactttctcagtgatttctgttcatag

SEQ ID NO: 13802 - DNA, 75 bp, Artificial Sequence
  Synthetic
atatggagtatggacaaaccttgacttaagtgaggagcaggtgaatgagcttgtatacagattcaggttggcagt

SEQ ID NO: 13803 - DNA, 75 bp, Artificial Sequence
  Synthetic
gagcatatttgaggagatgaaagtgatgttccctgagctgtctctggttgatgaagagctgagcaaaacagagag

SEQ ID NO: 13804 - DNA, 75 bp, Artificial Sequence
  Synthetic
agaagtgctaggcattgtgtcaactattaaaatggattgggagaggactgagaagactttccctcactttaagag

SEQ ID NO: 13805 - DNA, 75 bp, Artificial Sequence
  Synthetic
agaaatgtttgagaatttcagacagtcagaaccagactttgattatatatcatcaataatatccagatgtattgg

SEQ ID NO: 13806 - DNA, 75 bp, Artificial Sequence
  Synthetic
tgaatcagaagagtctatcttgaaagaaaactactttgaactgcagaatttgcaacttagactaagggagaatgg

SEQ ID NO: 13807 - DNA, 75 bp, Artificial Sequence
  Synthetic
gaggcaatgtgagaaggcattgagtgccttctcaagtgagatggcatctggagatctgcgagatgttaatgaccc

SEQ ID NO: 13808 - DNA, 75 bp, Artificial Sequence
  Synthetic
taaatctacagtccaaattcctccctgggtcacaattgaaggccctgaagggaaagatctaataccactgaagtc

SEQ ID NO: 13809 - DNA, 75 bp, Artificial Sequence
  Synthetic
tttggaaatcaatggggatcatccaatgcagagaatctggtccaaagtttgtaattcagcatctttagaactgat

SEQ ID NO: 13810 - DNA, 75 bp, Artificial Sequence
  Synthetic
agacaggatggtggatgatcctgagtctgagttacaacatgccatttccgggactagagatcgggcggatgaaag

SEQ ID NO: 13811 - DNA, 75 bp, Artificial Sequence
  Synthetic
gagcagatatcatagggtaattgtcgaattggatagtgcggaactagaatatgctgcaacactcggagttggagg

SEQ ID NO: 13812 - DNA, 75 bp, Artificial Sequence
  Synthetic
taagaaatacagagaccatcattcatcaagagaagcaaggacccgcagtaagaggggcttttccctagaccacaa

SEQ ID NO: 13813 - DNA, 75 bp, Artificial Sequence
  Synthetic
tataaagtccttagagaggttcatatcaggatgcacccaagagctgttagaggagggtgactactacaaacccct

SEQ ID NO: 13814 - DNA, 75 bp, Artificial Sequence
  Synthetic
gctggaggatatgcccttaaggattgaggcacagagaatccatcaacccacttatacaagaaacaatggagagaa

SEQ ID NO: 13815 - DNA, 75 bp, Artificial Sequence
  Synthetic
tgaattccttaggaatcatagactgtttatggaaactcctcttggctcatggtcgcaaatggttagtctcatcgg

SEQ ID NO: 13816 - DNA, 75 bp, Artificial Sequence
  Synthetic
agccgaattgtctgcatcagtcaagcaacatgtaaaacagaagagctttattgtaaaaagactgctaggatcagg

SEQ ID NO: 13817 - DNA, 75 bp, Artificial Sequence
  Synthetic
aatatacttgctgattaagccaactaattccaaaagtcacatatttgtgtcatatgctcttgacaagctatactg

SEQ ID NO: 13818 - DNA, 75 bp, Artificial Sequence
  Synthetic
gtctcatgacttgtcaagtgggactgaatttaaaaggtatttggacagcggagacttatttatcactgagttcac

SEQ ID NO: 13819 - DNA, 75 bp, Artificial Sequence
  Synthetic
gtcctacaagctgagcaaattaactaacttatgtaagtgctgttcgctattggaaagttctctcagcttctggac

SEQ ID NO: 13820 - DNA, 75 bp, Artificial Sequence
  Synthetic
agaagcatatcatgagaagccatggctaagtgttgatgtgatcagggatggacgtcagccagagatcttgacaat

SEQ ID NO: 13821 - DNA, 75 bp, Artificial Sequence
  Synthetic
gacaaagctttcgttattgaccttgctagaggataaagctagaactgaagaattgcaaacacttcttagatatgt

SEQ ID NO: 13822 - DNA, 75 bp, Artificial Sequence
  Synthetic
agttatggaaggatttgtatcgcaacctgagctacctagaccacagaagatgatatctaaattgcctagagtttt

SEQ ID NO: 13823 - DNA, 75 bp, Artificial Sequence
  Synthetic
aagaacagagttgcaagtcttgcttgtccagagggtgatgacttctataagtaggattgcagcaaatccattcaa

SEQ ID NO: 13824 - DNA, 75 bp, Artificial Sequence
  Synthetic
gctcaagaagtctgatggctccattagctggtctggattgttcaatccgttgtctggctctaaattgcttgactt

SEQ ID NO: 13825 - DNA, 75 bp, Artificial Sequence
  Synthetic
acagccgctgataagctgctgctacaacgggtatttcaagaacaaagaagaggaaactgagccttctgctttgtc

SEQ ID NO: 13826 - DNA, 75 bp, Artificial Sequence
  Synthetic
agctatgtacaagaagataattgaactagagcatttaaagccaggaacagatgaattcttaggttggggggaccc

SEQ ID NO: 13827 - DNA, 75 bp, Artificial Sequence
  Synthetic
cgaagaccccaagactcatgaattcagcagatcctacctcaaagaagtgtgtgagcacggaaaagcaatcttgaa

SEQ ID NO: 13828 - DNA, 75 bp, Artificial Sequence
  Synthetic
aagaatgtacggacacaatgttctgcaacaaattgatgaccagatcacaagagaaatctcctcactcaccattga

SEQ ID NO: 13829 - DNA, 75 bp, Artificial Sequence
  Synthetic
aagactagcaactctgaaggcaactagtaactttgatgaaaactggtatgtgtataaggattgcaaggataaaaa

SEQ ID NO: 13830 - DNA, 75 bp, Artificial Sequence
  Synthetic
ctacacaagagacaaattactggtcaaaatgtctcagtttgcatcagaagggaaaacattagcaatagaaaagtt

SEQ ID NO: 13831 - DNA, 75 bp, Artificial Sequence
  Synthetic
cgaagactgtatgacctctattgaatcaagaggggctatgcatatttgtttgtttaagaagcagcagcatggagg

SEQ ID NO: 13832 - DNA, 75 bp, Artificial Sequence
  Synthetic
acttagggagatttacgtcatgggagcagaagagagaattgttcagtcagtcgtagagtgcatagctaaaacggt

SEQ ID NO: 13833 - DNA, 75 bp, Artificial Sequence
  Synthetic
tggcaaattcttctcttcagatacgctatgtaatccaaacaataagtccagaattcctgaaagtcacgcacatag

SEQ ID NO: 13834 - DNA, 75 bp, Artificial Sequence
  Synthetic
ggctagaaaacactgcaggtcttcagtttggacgtgtgcaacttccgatgatgccaagaagtggaatcagggtca

SEQ ID NO: 13835 - DNA, 75 bp, Artificial Sequence
  Synthetic
ctttgtaacaaagtttgctatgatgctgtgtgagttcacatcaccgaaatggtggcccataatcattagagggtg

SEQ ID NO: 13836 - DNA, 75 bp, Artificial Sequence
  Synthetic
ctcaatgttcacccggaaatttatgatgatgaatatgaggtatctggacattctaaatggacacagagagctcaa

SEQ ID NO: 13837 - DNA, 75 bp, Artificial Sequence
  Synthetic
agtagatgatgaatttgtgatgaccttgttcaatgcatatcatggagaggtggaggtgccatggcttgagaaggg

SEQ ID NO: 13838 - DNA, 75 bp, Artificial Sequence
  Synthetic
aaggacgtacttacagacaaccacagggatgatgcagggaattcttcatagtacctcatctttgcttcacactct

SEQ ID NO: 13839 - DNA, 75 bp, Artificial Sequence
  Synthetic
acatcaggaatttgttcgctcattgtcattcaaagtttttaacatgaaagttcagccagacatgggttctaaggt

SEQ ID NO: 13840 - DNA, 75 bp, Artificial Sequence
  Synthetic
ggtttgtgatgtcatgcagggctctgatgacagctctatgattataagttttcctgcgaatgaagattccacctt

SEQ ID NO: 13841 - DNA, 75 bp, Artificial Sequence
  Synthetic
tatgaagtgtaaaatggcagcagcaatgtgttttagagtgaagaaaacactagggctatacttgggaatataccc

SEQ ID NO: 13842 - DNA, 75 bp, Artificial Sequence
  Synthetic
gtccgaaaagtccacgtctaacacagactttgtgatggaatataattctgagttcttcttccacaccagccatgt

SEQ ID NO: 13843 - DNA, 75 bp, Artificial Sequence
  Synthetic
gagacctttggtgaggtgggtctcatcatgttgtagtctaccagaggtagaaactcttgttgccaggcaagaaga

SEQ ID NO: 13844 - DNA, 75 bp, Artificial Sequence
  Synthetic
ggcatccaatctactcacctcaatatcagaggggggaggatcttttgcattgtctgctatgatacaacaatctca

SEQ ID NO: 13845 - DNA, 75 bp, Artificial Sequence
  Synthetic
gtgcacaattcactatcagttaatagggatgggtgtgtcatccattttccctcactacagaagggctctagctag

SEQ ID NO: 13846 - DNA, 75 bp, Artificial Sequence
  Synthetic
atggaaagaccctgggctggggttctttctgctagacaatccatatgctgcaggattagggggttttagatttaa

SEQ ID NO: 13847 - DNA, 75 bp, Artificial Sequence
  Synthetic
tctgttcaaggcaatcacaatgacagaattacagaaggtctatgcttatttcatgagaaaagtcaaggacaattc

SEQ ID NO: 13848 - DNA, 75 bp, Artificial Sequence
  Synthetic
tctacctgaggaggagggagtgttagtgccagagacctgcagtgtcagtcctggtggagcaataataatgagttc

SEQ ID NO: 13849 - DNA, 75 bp, Artificial Sequence
  Synthetic
ctcgttgaaatggggatccagaaagaagttctctaggctcagagacagactgaatataccagaaaactgggttga

SEQ ID NO: 13850 - DNA, 75 bp, Artificial Sequence
  Synthetic
gttaattaatgacaacccagaggtcttatacagagctccaagaacaggagaagagataatattaagaatagctga

SEQ ID NO: 13851 - DNA, 75 bp, Artificial Sequence
  Synthetic
gaaagtacacagtcctggggttgtctcttcattatcaactgggaatgcagtctgtaaagtaatggcaagctcagt

SEQ ID NO: 13852 - DNA, 75 bp, Artificial Sequence
  Synthetic
atacttcctttctgcggcaatttttgaggatagtggcaggccagaattctcctacttagacaattcaaagtatag

SEQ ID NO: 13853 - DNA, 75 bp, Artificial Sequence
  Synthetic
tatactacaaaaaatgatggcgtatgaaggcttcaatggctcacatgatatagatcctgaagacatactctttct

SEQ ID NO: 13854 - DNA, 75 bp, Artificial Sequence
  Synthetic
tttcccaaatgtggaagagctggaacaattagatatgataatttatgataagggccccattgatttggtagagag

SEQ ID NO: 13855 - DNA, 75 bp, Artificial Sequence
  Synthetic
agttagttctagggaagcaacccagtcaagagtagtagtttttgatgagaagagatgcatgagagtcagcccaga

SEQ ID NO: 13856 - DNA, 75 bp, Artificial Sequence
  Synthetic
gaaattggtttccgataaatggtttggaactcaaaagagcaagataggcagaactgcatttgaggttgaatgggc

SEQ ID NO: 13857 - DNA, 75 bp, Artificial Sequence
  Synthetic
aaagttgacccgagtaataaggtggctcaaggacactcctgagggaacaatggaaaagtctccattgtcaaatca

SEQ ID NO: 13858 - DNA, 75 bp, Artificial Sequence
  Synthetic
gatccaaataaggaatttctttgcgagactggagggcagatccagatgtgtgaggataacaggagctccagtgaa

SEQ ID NO: 13859 - DNA, 75 bp, Artificial Sequence
  Synthetic
gaaaaggtcaggcatgagtaagctagccctggtaatacgtgataacttctgtaaaactggtcacttgagaggaat

SEQ ID NO: 13860 - DNA, 75 bp, Artificial Sequence
  Synthetic
agaagacataagtgggagctctagatctgtttctgtggaggtcttgaggcacattctgttctcggttctgcaggg

SEQ ID NO: 13861 - DNA, 75 bp, Artificial Sequence
  Synthetic
tccttatagtgacgagtcaaagctggatctaagtataaaatcattatcttcatctagcgagattgagctgagaga

SEQ ID NO: 13862 - DNA, 75 bp, Artificial Sequence
  Synthetic
aaatgatgggaagactaaggctaacattttaagcatactgcagagctacatatgggccgacagaggagtgatcca

SEQ ID NO: 13863 - DNA, 75 bp, Artificial Sequence
  Synthetic
gaagatagaaagggcaggagcaggaacagtagggggtttcatcaagcctcaaaagtcatacaaagatggtcagac

SEQ ID NO: 13864 - DNA, 75 bp, Artificial Sequence
  Synthetic
aattaaatactatggacatggaatatggcgtggtatgatggacggtatagacatgcagattgatatagacaacaa

SEQ ID NO: 13865 - DNA, 75 bp, Artificial Sequence
  Synthetic
gaggaatcagaatccgcagatcacaagtataagagttgctggtacaaaaagcccatgggttgtttgccagagttt

SEQ ID NO: 13866 - DNA, 75 bp, Artificial Sequence
  Synthetic
aaaaatatggtgtgaagacatgggggttaaaaattcagctgacttctctgagtcggtcagacggactcccaaatt

SEQ ID NO: 13867 - DNA, 75 bp, Artificial Sequence
  Synthetic
ctggctgtcaaacttcagaatgttcggcgggaaccatcctttgggagcccctgtttacatcttagatggcagaat

SEQ ID NO: 13868 - DNA, 75 bp, Artificial Sequence
  Synthetic
ggatgacctacgagagatcagagatgaggacattctcatcaaagtcaggagaggaacattgaatttgtttgtaaa

SEQ ID NO: 13869 - DNA, 75 bp, Artificial Sequence
  Synthetic
aagcagggggggtagtgaaatgcacatattatcatatacttcttctgacactgatctgagtccatcaatggttaa

SEQ ID NO: 13870 - DNA, 75 bp, Artificial Sequence
  Synthetic
agaggctgaattatctatgccagggctgatgaatctttttagcagagaaccaagtagatcctgggtgagttgctc

SEQ ID NO: 13871 - DNA, 75 bp, Artificial Sequence
  Synthetic
tcccctgccggtccaatatacagaagtgctgttggacgtgtgtgaaggattgaaaagagtggacagaataaaccc

SEQ ID NO: 13872 - DNA, 75 bp, Artificial Sequence
  Synthetic
cattaggctaagtgaaataattagaatctgcacagactcttctttgagaacaaaggttggcacagtgtactcaat

SEQ ID NO: 13873 - DNA, 75 bp, Artificial Sequence
  Synthetic
gcagcagttctcagaagaggcccaaataattgattgtgatgacctcctagacattatgatagaggacatcaaaac

SEQ ID NO: 13874 - DNA, 75 bp, Artificial Sequence
  Synthetic
tggagccttcagtgaggttgttaggaagatggaggatgaggtgaaaggagataatgaggacttggattttgacta

SEQ ID NO: 13875 - DNA, 75 bp, Artificial Sequence
  Synthetic
tgatgacatcaatttgttcggccctgctcaccacaaagagtatggggaattatccttagtgtcacatcctttgat

SEQ ID NO: 13876 - DNA, 75 bp, Artificial Sequence
  Synthetic
ggacaaatttgtagacaatgccatatccataatgggtaggtcatcactcaggagactgctggagctgggggtgac

SEQ ID NO: 13877 - DNA, 75 bp, Artificial Sequence
  Synthetic
aaaaacaagatatctgaagatctcgagattggtctacagagctatagggaggaatgtggatgcaattaaaacaga

SEQ ID NO: 13878 - DNA, 75 bp, Artificial Sequence
  Synthetic
tgactttagcttggaagaccagcctagtataagtgaagacatgctgggatgaaagaccccagatctcatgctagg

SEQ ID NO: 13879 - DNA, 75 bp, Artificial Sequence
  Synthetic
aacaaatggattgatcagagcattacatactgtttggagattagaatttggtggaatattataaattcattaagt

SEQ ID NO: 13880 - DNA, 75 bp, Artificial Sequence
  Synthetic
agcattacatactgtttggagattagaatttggtggaatattataaattcattaagtaatgggcggtctttgtgt

SEQ ID NO: 13881 - DNA, 75 bp, Artificial Sequence
  Synthetic
acacaaagacggcgcatattttgatgaagaacttacagataatctatcttatagggttggtagcatcaaggctag

SEQ ID NO: 13882 - DNA, 75 bp, Artificial Sequence
  Synthetic
tgctccactactctactcctgactctaaagtccagatctgctttagctcaggaacacctgaagtgtttgtgacag

SEQ ID NO: 13883 - DNA, 75 bp, Artificial Sequence
  Synthetic
attattggatggaggcaatgtcattattcccagctgataacaagaaatgtgagcttggtgatggtctattctcat

SEQ ID NO: 13884 - DNA, 75 bp, Artificial Sequence
  Synthetic
ctgtgaccctcgatgacatgcccaaattcatgaaagcaatgacaacttccgatcaagcactgaggttcacctgca

SEQ ID NO: 13885 - DNA, 75 bp, Artificial Sequence
  Synthetic
taggctccaatgatagcttcatttctgaacttaggacggatggtgatgtcatacctggagagcaccattcagtga

SEQ ID NO: 13886 - DNA, 75 bp, Artificial Sequence
  Synthetic
tagactgcaaatctggtgatcaaataagaaagctatctgatgtcaatatagctcctgcgggattgaagatccaaa

SEQ ID NO: 13887 - DNA, 75 bp, Artificial Sequence
  Synthetic
acttgatggacatcgaaaaggaagaaagggatatattgaggcagagagaccagctgatagaagaattaagaacca

SEQ ID NO: 13888 - DNA, 75 bp, Artificial Sequence
  Synthetic
aattgagagatagtaaagtcagagaaaatacagctaaattacgagggagtgaagcaaacgtagagttaaaaagtg

SEQ ID NO: 13889 - DNA, 75 bp, Artificial Sequence
  Synthetic
cactagaggatgctgacaagtttaagagaagagctgatgaactaatacttcatttggagagtgagagagctgaag

SEQ ID NO: 13890 - DNA, 75 bp, Artificial Sequence
  Synthetic
gccagatcagcaggaacaaatcaagatggctggaacatgagttaagagatgctaaggaagacattatcaggctcc

SEQ ID NO: 13891 - DNA, 75 bp, Artificial Sequence
  Synthetic
agaacgacatggctgaggtatcaagaaagaagaaagaagtacacagctctgcaacaaccagacgcacaggtgttt

SEQ ID NO: 13892 - DNA, 75 bp, Artificial Sequence
  Synthetic
tttcaatagcaacaaccatcctcccaatactactctttgcttcagcagagtccattaaacaacccaagatgagag

SEQ ID NO: 13893 - DNA, 75 bp, Artificial Sequence
  Synthetic
caaaatgctcacatgcaagaaataggattggtagtgggaagaatgtgttaacaggaataacttctccgacctgtt

SEQ ID NO: 13894 - DNA, 75 bp, Artificial Sequence
  Synthetic
ctgcaattgactatgagttaaggtgcgactctctagagatattgatgcaagaggacgcttatcccttttcatcct

SEQ ID NO: 13895 - DNA, 75 bp, Artificial Sequence
  Synthetic
ctcacatccataagcaaacagtactagaagctcttgcagacggctttctggagcaggcatcagaaggtatatgtc

SEQ ID NO: 13896 - DNA, 75 bp, Artificial Sequence
  Synthetic
agttagacagtagcagaccaacaaaatgttatgaaaagagaagcaaaatgagaccacattgcccaaatggattca

SEQ ID NO: 13897 - DNA, 75 bp, Artificial Sequence
  Synthetic
gagcctcccactacattgatgatgatggcaaggtgagagggttatactgtaatgagaactcagagatcactgaag

SEQ ID NO: 13898 - DNA, 75 bp, Artificial Sequence
  Synthetic
actgtctgaaatgcaggaagttgaaaacaaagccagtcaagcagggtagtgtccagatgcaggatgtaatgtgtc

SEQ ID NO: 13899 - DNA, 75 bp, Artificial Sequence
  Synthetic
agaatgtgactgtagcatataatggccccctccctcaaccaaggggctactgcaagataggacttaagaagtaca

SEQ ID NO: 13900 - DNA, 75 bp, Artificial Sequence
  Synthetic
aggactgcgatgtgtaccacaccgaagttaagcatgctcccttcataattttgaaaggggtggggaagatttact

SEQ ID NO: 13901 - DNA, 75 bp, Artificial Sequence
  Synthetic
tggattcactaatcttaaaaaacaatgaagagtcagacctgtcatcattcgtgtgtttcaaacacaaaggtcaat

SEQ ID NO: 13902 - DNA, 75 bp, Artificial Sequence
  Synthetic
atgacacaggagagggcacagaggtgagagtgtacaaatcagtcaaaatttcagagtgctctaacattgatgcaa

SEQ ID NO: 13903 - DNA, 75 bp, Artificial Sequence
  Synthetic
agaagtccattaaatgcactggggatcatgttttctgtagtaagttcagatgtgaagatgcatatccagaggcca

SEQ ID NO: 13904 - DNA, 75 bp, Artificial Sequence
  Synthetic
attgtattgttgcccctggtgctgggccagttcttgttaggtatgctggaggatgggtcaagccagtttgctttg

SEQ ID NO: 13905 - DNA, 75 bp, Artificial Sequence
  Synthetic
ggtatgaaaatgtgatcgtagaaatggatctgcacacgaacactccagctaaggaagaagagtgtgaatcctgtg

SEQ ID NO: 13906 - DNA, 75 bp, Artificial Sequence
  Synthetic
tattctcctgtgacaatgatggtgtcagaataaggactactggatttaaggtggggtctctggtcgcgtgttcta

SEQ ID NO: 13907 - DNA, 75 bp, Artificial Sequence
  Synthetic
gtggacactgctcatcatacactcaagcaccttccactaatgtgtttttccaatatcctggaatgtcatatagtg

SEQ ID NO: 13908 - DNA, 75 bp, Artificial Sequence
  Synthetic
atgggtcaccgattggtgtccacctatcacacgatgatgacactgtaagctctcacatggtagtgcattgtgaac

SEQ ID NO: 13909 - DNA, 75 bp, Artificial Sequence
  Synthetic
ctaaggatccatgcgaaattaacacttgcataatttgttcgcacaccttgatcaattatcagtgccacacattcc

SEQ ID NO: 13910 - DNA, 75 bp, Artificial Sequence
  Synthetic
tcagtgcatttgtctgcacactactaattgtgaccattttcattctactggcggtcatcattaagaagagtatta

SEQ ID NO: 13911 - DNA, 75 bp, Artificial Sequence
  Synthetic
gagcttccagattactaccgtcaatgttagtggcccctcttcactggttaaagttattgctgagatggattatca

SEQ ID NO: 13912 - DNA, 75 bp, Artificial Sequence
  Synthetic
ttaaattcagatcttgcttccagaggcaggtcaacaccataaatgcagaaataggatgggctcagcgacctcaaa

SEQ ID NO: 13913 - DNA, 75 bp, Artificial Sequence
  Synthetic
gagttgcacctatacctagatatactggattcatggctgtgatgctatgcttgttatcactatgctcagcatgtt

SEQ ID NO: 13914 - DNA, 75 bp, Artificial Sequence
  Synthetic
cagaaaatgttgtatcagattctaaaatcaccaagtgctcagcagtggacagcacaacaaagtgtgtggtctctg

SEQ ID NO: 13915 - DNA, 75 bp, Artificial Sequence
  Synthetic
gatcagtagtaatgaaggcgggatcgattggtactgagtcttgcttgattgttaaatcaccggacgggctgaaat

SEQ ID NO: 13916 - DNA, 75 bp, Artificial Sequence
  Synthetic
ctcacatttctataaaaacaatgtctagtgagttggtatgtagagaaggtgactcctactggacgtctgactacg

SEQ ID NO: 13917 - DNA, 75 bp, Artificial Sequence
  Synthetic
cacctaggtgtctgagctccaggagatgccatcttgttggagaatgtcattctacaaactgtcaagcatggcatg

SEQ ID NO: 13918 - DNA, 75 bp, Artificial Sequence
  Synthetic
acgacctggtctcatccgaattcttgaaatttggaaatgagactaggcttagtgaaaacaagtgttatgagcagt

SEQ ID NO: 13919 - DNA, 75 bp, Artificial Sequence
  Synthetic
gtggtggagtctcatgtggctgcttcagcatgagtccttcttgcttatttgtccactcaagccttgagtctgtgt

SEQ ID NO: 13920 - DNA, 75 bp, Artificial Sequence
  Synthetic
cgaagagggcaataagagcattttcatgttctgattggtcacacagaataacatttgagatcacaaatatagaca

SEQ ID NO: 13921 - DNA, 75 bp, Artificial Sequence
  Synthetic
aaagcaaagaaacattcaccttgtttgacacaggatccaaattcttccagtggggatcaatcagcttgggaattg

SEQ ID NO: 13922 - DNA, 75 bp, Artificial Sequence
  Synthetic
atgcagaagcaatcacaggaaccaatgcaatgtccttccttgaagaccctgcatccgggtttgcccttgtggacg

SEQ ID NO: 13923 - DNA, 75 bp, Artificial Sequence
  Synthetic
aggaattttcagaaaaccccagagctggattcataggtgaggtcagatgttcctctgaaattgccgcagttgctg

SEQ ID NO: 13924 - DNA, 75 bp, Artificial Sequence
  Synthetic
ctcataaatcttgcaaatgggctccaaatttgatcaggtataggcctgtcactgacttcgttgagtgctcctcaa

SEQ ID NO: 13925 - DNA, 75 bp, Artificial Sequence
  Synthetic
gcttgatcaatccattcatcttatttagaagaggatttctcccacaatctagaaatggaaagactttcacgcagt

SEQ ID NO: 13926 - DNA, 75 bp, Artificial Sequence
  Synthetic
ctattgataaaaagacagtacaagcaatttcgtcactcagcataaaagcaacaatcagaatgttaattgaaggac

SEQ ID NO: 13927 - DNA, 75 bp, Artificial Sequence
  Synthetic
tcgaagtatcatttgaggactctcgtgttagatgcagggcatcaattaggaatgtcactgggtgttattcctgca

SEQ ID NO: 13928 - DNA, 75 bp, Artificial Sequence
  Synthetic
atgaaggggcaaaactctgtcttagcgtcaatagcaatttgaacagcaccttatatgcagaaggctccaccggaa

SEQ ID NO: 13929 - DNA, 75 bp, Artificial Sequence
  Synthetic
tccacattgcactgccaatatttgctggaacaagggattactgttcagtcttgcacttcaatagtccaagtgtgg

SEQ ID NO: 13930 - DNA, 75 bp, Artificial Sequence
  Synthetic
atgaaataattcaatattcttgcggcattgatagcaaagaactacacatcacgggtacccttgtgtccatacaag

SEQ ID NO: 13931 - DNA, 75 bp, Artificial Sequence
  Synthetic
ctcatgatgataggaacacccaatcctcaggctcgatagttgtgaatcccagggaagtgccgtggaatttcttcg

SEQ ID NO: 13932 - DNA, 75 bp, Artificial Sequence
  Synthetic
gatggttctctggcctcatgaagtttcttggggggcctctcagaactgctgggatcatattattactgataattc

SEQ ID NO: 13933 - DNA, 75 bp, Artificial Sequence
  Synthetic
tagctatcattgtgatagggctagtgtttctctgtgtgaggagcggactcctgaccaatctgtttcacaaggcca

SEQ ID NO: 13934 - DNA, 75 bp, Artificial Sequence
  Synthetic
aatcactgtaagaaccacaagaaagccactctcaccctcatcccatcatccaacccatcactggcagctcaatga

SEQ ID NO: 13935 - DNA, 75 bp, Artificial Sequence
  Synthetic
tgtattagttgtaagattgatattgtggttgattgtaagaccaagggatgcttttaagtgtcttccataagttct

SEQ ID NO: 13936 - DNA, 75 bp, Artificial Sequence
  Synthetic
cttccataagttcttaagagggttaactatgtgttctatacttggaattgatttgaatcgcgccggtctttgtgt

SEQ ID NO: 13937 - DNA, 75 bp, Artificial Sequence
  Synthetic
acacaaagaccccccgtgatttctcaaacatcaaacatgactagctaccttttcgacacgcctgttatagttaga

SEQ ID NO: 13938 - DNA, 75 bp, Artificial Sequence
  Synthetic
cccaacgggtactttgacagagaagtctatgtcacatatatggctcacaacaaatactgtgagcacacggtgtct

SEQ ID NO: 13939 - DNA, 75 bp, Artificial Sequence
  Synthetic
gtccataactgcatggagatacctgttaggaactttggagtctcaatgctgcataaagagtcgttttcagacttt

SEQ ID NO: 13940 - DNA, 75 bp, Artificial Sequence
  Synthetic
tacattctggggctctttcccttcagatggggagacaagatggggaactcaagagtaacaagagagagtttccct

SEQ ID NO: 13941 - DNA, 75 bp, Artificial Sequence
  Synthetic
tttatgaaagaactcctggctgacatatgtaaaatgcatgactctgaattctttcgatctttcttacccaacatc

SEQ ID NO: 13942 - DNA, 75 bp, Artificial Sequence
  Synthetic
aagaaagcgttgtcgtggcctctcgggtatccttctcttgattttatcagaatgacagaccctgacaatagtatg

SEQ ID NO: 13943 - DNA, 75 bp, Artificial Sequence
  Synthetic
cctcacttcagagagatttctaacaatgcaactctcattatgcaaatgggacagcctgctattgatcttgatcaa

SEQ ID NO: 13944 - DNA, 75 bp, Artificial Sequence
  Synthetic
ggttttgttaatgcccataagaggattgttatggaatctataactagagggtttggtcataaggatttccctggg

SEQ ID NO: 13945 - DNA, 75 bp, Artificial Sequence
  Synthetic
aagaaccttatatttgaagttgcatcactgcagtgtgtgagaatgttaaatgctgttcctgctgacttgttgtat

SEQ ID NO: 13946 - DNA, 75 bp, Artificial Sequence
  Synthetic
tgccagatcaccaattctctcacttcgactctaatgaagcatcgtgctgagatggagagtcatcctcagggccct

SEQ ID NO: 13947 - DNA, 75 bp, Artificial Sequence
  Synthetic
ctaggcaaccagaagtggatacctgatcctgattcttggttgctggatgaccagtcatccactctccatgaagag

SEQ ID NO: 13948 - DNA, 75 bp, Artificial Sequence
  Synthetic
ttcaacctcataatctctgattcagaagatgaggatgagtagaggcgctgccaaaatcccacccaccctcattcc

SEQ ID NO: 13949 - DNA, 75 bp, Artificial Sequence
  Synthetic
ctgtaaaaaaccctatactatgtacatagaccccaaagacccacctgtatatatagatcccatccccaaaaccca

SEQ ID NO: 13950 - DNA, 75 bp, Artificial Sequence
  Synthetic
cccaccaaagcccacccagaagcccaccccttgaccccacttacccaaacccaaccacaacctggcagcttattg

SEQ ID NO: 13951 - DNA, 75 bp, Artificial Sequence
  Synthetic
agaagctctgaacttctgagctgccaccttgactgcctctgaaggaatgccattgacatccacaactccaagaga

SEQ ID NO: 13952 - DNA, 75 bp, Artificial Sequence
  Synthetic
ctggagcatcttcctcctcttctctggaccaatgaagcccccattgactgctgctagcatgggttgcttaaagga

SEQ ID NO: 13953 - DNA, 75 bp, Artificial Sequence
  Synthetic
ggctacgacctcactttttgctttccccctgagccctgggttaatcacttttgagaattggactaagaacaagct

SEQ ID NO: 13954 - DNA, 75 bp, Artificial Sequence
  Synthetic
gtgtgctgcaaggatggcatcctgagtctctggtggcaaagttgtgtcaacgagcccggcaaaactagggtgcat

SEQ ID NO: 13955 - DNA, 75 bp, Artificial Sequence
  Synthetic
catacagcgagggaagctaggagataaagcatccattgcctcacctgttacaggaagaaagttttcaacatgcgg

SEQ ID NO: 13956 - DNA, 75 bp, Artificial Sequence
  Synthetic
aagagcctggcaggtccatcctgctagagcagcagcgactcttgacaaggtcaagtcgtctctgccagggtttcc

SEQ ID NO: 13957 - DNA, 75 bp, Artificial Sequence
  Synthetic
agacttgagctggtacctcttcttgagagatagcacagtcttcttcccttcttcagacatcttcataatcatctt

SEQ ID NO: 13958 - DNA, 75 bp, Artificial Sequence
  Synthetic
ttcaatcttgttccctctggtgagagcgagtacaatcatcttcctagcatcctcttgccatgaggttcctcctct

SEQ ID NO: 13959 - DNA, 75 bp, Artificial Sequence
  Synthetic
ctgctggagtagctcaataactctctttgcgtcaaagccctgataggcgaactcattcacccatgcaaccacatc

SEQ ID NO: 13960 - DNA, 75 bp, Artificial Sequence
  Synthetic
cgcaatattaacgccggcttcgctgaactctattgctagtctttcaaagtcagccatttcttgaattccttcaat

SEQ ID NO: 13961 - DNA, 75 bp, Artificial Sequence
  Synthetic
gctagtctttcaaagtcagccatttcttgaattccttcaattaatagttaagtagtatttcggggttctttgtgt

SEQ ID NO: 13962 - DNA, 75 bp, Artificial Sequence
  Synthetic
acacaaagaagcccatatcatgaatgaaatattacagaatcaaccaaatactcaagagcagtacttatgcaaggc

SEQ ID NO: 13963 - DNA, 75 bp, Artificial Sequence
  Synthetic
acttgcacattatgatgatgagatctttggattagcaatactagactactctctcagagaagataatggaagtgt

SEQ ID NO: 13964 - DNA, 75 bp, Artificial Sequence
  Synthetic
tgtaattgactttgacatggcctcaagagatgagttcagcaccattggctccacagtaaagaaccaagtgagctt

SEQ ID NO: 13965 - DNA, 75 bp, Artificial Sequence
  Synthetic
gagcccacaggaattgccaaactttgtgcataacttcacctttgggcatcttgctgacaatacagatactccgtt

SEQ ID NO: 13966 - DNA, 75 bp, Artificial Sequence
  Synthetic
catcagtatgttccctgccatgggagatggatttgatcatttaactcctgatcttgtgttgagggtgccatcagg

SEQ ID NO: 13967 - DNA, 75 bp, Artificial Sequence
  Synthetic
gagaactcatgtcattgagttttcaacattcagaggaacatctcaaggatcataccagtcggcaatgcttaaaat

SEQ ID NO: 13968 - DNA, 75 bp, Artificial Sequence
  Synthetic
tggcaagtatgagtcagcctgtgaatgcaggagtaggataggacccataaccttttctgtaatgtccgtgcacag

SEQ ID NO: 13969 - DNA, 75 bp, Artificial Sequence
  Synthetic
atatggtgtctggacaaatctagatctggatgaagagtctgtgaatgaacttgtgtatcgattcaggttagccat

SEQ ID NO: 13970 - DNA, 75 bp, Artificial Sequence
  Synthetic
tagcatttttgaggaaatgaaagttctatatcctgaactgtctcttgtggatgaagaattgtctaagacagaaag

SEQ ID NO: 13971 - DNA, 75 bp, Artificial Sequence
  Synthetic
agaagttctcggtgttgtgtctacgattcgcatggactggggcagaactgaggcaacattcccacatttcaagag

SEQ ID NO: 13972 - DNA, 75 bp, Artificial Sequence
  Synthetic
agagatgtttgagggtttcagatcttcagatcctgatcttgactatatatcaggaataatcaccaagtgtgtgaa

SEQ ID NO: 13973 - DNA, 75 bp, Artificial Sequence
  Synthetic
taattctgaaactgcaattagagatgagaatttttataatttggattccagtcatctgagaatacaaaagaattc

SEQ ID NO: 13974 - DNA, 75 bp, Artificial Sequence
  Synthetic
tgaagtatgtgaaactgctatatccgactacatttctgagatgggtaaggaggacctcagagatgtaaatgaccc

SEQ ID NO: 13975 - DNA, 75 bp, Artificial Sequence
  Synthetic
aaagtcaactgtgcaaatcccagcatgggtgaccatgcaaggacctgaaggtaaagatctcactcctttaaaggc

SEQ ID NO: 13976 - DNA, 75 bp, Artificial Sequence
  Synthetic
attggaagtcacgggtgagcatcctatgcagagaatatggtcaaaagtgtgcacatctgcatcgctagagttaat

SEQ ID NO: 13977 - DNA, 75 bp, Artificial Sequence
  Synthetic
agacaggatggtggatgacccagagtctgaattgcagaatgccatttcaggatcaagagagagatcggacgagag

SEQ ID NO: 13978 - DNA, 75 bp, Artificial Sequence
  Synthetic
gagtaggtatcatagagtggttgttgaccttgaccagacagagctagagtatgcagctaccttgggcgttggggg

SEQ ID NO: 13979 - DNA, 75 bp, Artificial Sequence
  Synthetic
aaagaagtacagggaccatcattctgttaaggaatccagagttaggagcaaaaaggggttttccctagaacataa

SEQ ID NO: 13980 - DNA, 75 bp, Artificial Sequence
  Synthetic
tacgaagtcattggagagatttatcaaaggaggaaatcaggcactattagaagaaggaagctattactgcccctt

SEQ ID NO: 13981 - DNA, 75 bp, Artificial Sequence
  Synthetic
attggaggatatgccactcagaatagaggcacaaagaatccaccaaccaactctgaccagagagcatggtgagaa

SEQ ID NO: 13982 - DNA, 75 bp, Artificial Sequence
  Synthetic
tgagtttgtgaagaaccacaggttatttatggagtcacccttgggatcatggacacagatggtgagcctaatagg

SEQ ID NO: 13983 - DNA, 75 bp, Artificial Sequence
  Synthetic
tgccgagctatctgcatctgttaaacagcatgtgaaagcaaaaagcttcattgtgaaacgactacttggatctgg

SEQ ID NO: 13984 - DNA, 75 bp, Artificial Sequence
  Synthetic
gatttaccttttgattaagcctactaactccaaaagccatattttcgtatcatatgcattggataagaattactg

SEQ ID NO: 13985 - DNA, 75 bp, Artificial Sequence
  Synthetic
gtgtcatgatttatccagaggcactgagtttaagcaatacttagacagtggagatttattcataacagagttcac

SEQ ID NO: 13986 - DNA, 75 bp, Artificial Sequence
  Synthetic
ctcttacaagctgagcaagctgacaaatctgtgcaagtgctgctctctaactgagtgctcactaagtttttggac

SEQ ID NO: 13987 - DNA, 75 bp, Artificial Sequence
  Synthetic
agaggcttatcatgagaaaccatgggagagtatggaggtggcaagagcagacagacaacctgagataatggtaat

SEQ ID NO: 13988 - DNA, 75 bp, Artificial Sequence
  Synthetic
gatgaaatattcactgatgacattgcttgaagacaaagctaggactgaggagttgcagactatgctcagatatgt

SEQ ID NO: 13989 - DNA, 75 bp, Artificial Sequence
  Synthetic
tgtcatggaaggctttgtgtcacaaccagagctccccagaccccagaaaatgcttgggaagttgcctagagttct

SEQ ID NO: 13990 - DNA, 75 bp, Artificial Sequence
  Synthetic
acgaagcgaacttcaggtgcttctgatgcatagagttttggcatccatatccagaatagctgctaatcccttcca

SEQ ID NO: 13991 - DNA, 75 bp, Artificial Sequence
  Synthetic
tcttagaaagactgatggctgcatttcctggactggattattcaacccactgtcaggttctaaaattcaagatct

SEQ ID NO: 13992 - DNA, 75 bp, Artificial Sequence
  Synthetic
gcaaccactaataagctgttgttataatggatactttaagaataaagaggaagatacagagccttctgccttatc

SEQ ID NO: 13993 - DNA, 75 bp, Artificial Sequence
  Synthetic
tgccatgtacaagaaaattattgagttggagcacctcaaaccagatagtgacaggtttttaggatgggaagatcc

SEQ ID NO: 13994 - DNA, 75 bp, Artificial Sequence
  Synthetic
atcagatcctaaaactcatgaattcagcaggtcatatatcaaagagatttgcaatcatggaaaggcaattctcaa

SEQ ID NO: 13995 - DNA, 75 bp, Artificial Sequence
  Synthetic
aagaatatatggccagagtatcatgcagcaaatcgacgatcaaataacaagggaggtgtcttctttaacaattga

SEQ ID NO: 13996 - DNA, 75 bp, Artificial Sequence
  Synthetic
gagattagctacattaaaggcgacaagtaattttgatgagaattggtatatatacaaagattgcaaagataagaa

SEQ ID NO: 13997 - DNA, 75 bp, Artificial Sequence
  Synthetic
ttacacaagggacaaattgttagtgaaaatgtctcagttcgcttcagaagggaagactcttgcaatcgagaaatt

SEQ ID NO: 13998 - DNA, 75 bp, Artificial Sequence
  Synthetic
tgaagactgcatgacagcaatagaggagagaggggccatgcatgtttgccttttcaaaaaacagcaacacggagg

SEQ ID NO: 13999 - DNA, 75 bp, Artificial Sequence
  Synthetic
cttgagagaaatatatgtaatgggggcagaagagagagtggttcaagcactagttgaatgtatagccaagaccgt

SEQ ID NO: 14000 - DNA, 75 bp, Artificial Sequence
  Synthetic
tgggaaattcttttcctcagatactctttgcaatccaaacaacaagtccaggattccagaaagtcatgcccatag

SEQ ID NO: 14001 - DNA, 75 bp, Artificial Sequence
  Synthetic
agccagaaagcattgcagatcatcagtctggacatgtgcaacatcggatgatgcaaagaagtggaatcagggcca

SEQ ID NO: 14002 - DNA, 75 bp, Artificial Sequence
  Synthetic
ctttgtgacaaagtttgcactaatgctgtgtgaattcacatcaccaaaatggtggcctataatcattagaggatg

SEQ ID NO: 14003 - DNA, 75 bp, Artificial Sequence
  Synthetic
ttcaatgttcaccagaaagtatatgatgatgaacatgagatacttggacattcttaatggccacagagaacttaa

SEQ ID NO: 14004 - DNA, 75 bp, Artificial Sequence
  Synthetic
agtagatgatgactttgtgatgacattgttcttagcttatcatggtgaactagatgtcccgtggttagaaagggg

SEQ ID NO: 14005 - DNA, 75 bp, Artificial Sequence
  Synthetic
acggacctaccttcagacaactacaggaatgatgcagggtatactgcatagcacatcctccttactacacacttt

SEQ ID NO: 14006 - DNA, 75 bp, Artificial Sequence
  Synthetic
gcatcaggagttcatcagatcactatccttcaagatcttcaatctgaaggtatcaccggatatgggatcaagagt

SEQ ID NO: 14007 - DNA, 75 bp, Artificial Sequence
  Synthetic
agtctgtgatgtaatgcagggctcagatgacagctccatgataataagcttccctgcatgtgaggattcagtatt

SEQ ID NO: 14008 - DNA, 75 bp, Artificial Sequence
  Synthetic
cactaagtgcaagcttgctgcagcaatgtgtttccgggtcaagaaaacacttgggctatatgcgggcatctatcc

SEQ ID NO: 14009 - DNA, 75 bp, Artificial Sequence
  Synthetic
ttctgagaagtcaacttctaacacagactttgtgatggagtataattctgagtttttcttccattccagtcatgt

SEQ ID NO: 14010 - DNA, 75 bp, Artificial Sequence
  Synthetic
gaggcctcttattaggtggatagcatcatgttgtagcctgccagaagtggagacgctagttgcaaggcaggagga

SEQ ID NO: 14011 - DNA, 75 bp, Artificial Sequence
  Synthetic
ggcctccaacctgttaacctctatatctgaaggtggagggtcctttggcctaactgcaatgatacagcagtctca

SEQ ID NO: 14012 - DNA, 75 bp, Artificial Sequence
  Synthetic
gtgcactctgcactaccagcttgttggtatgggtgtgtcatctgtattccctcactatagaaaagctctctcaag

SEQ ID NO: 14013 - DNA, 75 bp, Artificial Sequence
  Synthetic
atggaaggatccaggactagggttctttcttctagataacccatttgcagcagggttgggaggcttcagatttaa

SEQ ID NO: 14014 - DNA, 75 bp, Artificial Sequence
  Synthetic
cctgttcaaggcaatcactatgacagagctacagaaggtatatgcgtattttatgaagaaggtcaaggaaggaac

SEQ ID NO: 14015 - DNA, 75 bp, Artificial Sequence
  Synthetic
aactccagatgatgatggggtgctggtaccagaaagctgcagtgttagccctgggggggctattatcatgagctc

SEQ ID NO: 14016 - DNA, 75 bp, Artificial Sequence
  Synthetic
atccctcaaatggggatcaaggaaaaaatttgctaaactgagggacaggctcaacataccagatgactggataga

SEQ ID NO: 14017 - DNA, 75 bp, Artificial Sequence
  Synthetic
caaaataaaccataatccacaattgttatacagagctcctaagtctggtgaagagatcattttaagaatagcaga

SEQ ID NO: 14018 - DNA, 75 bp, Artificial Sequence
  Synthetic
aaaggtccacagccctggggtggtctcctctttgtcaacaggtaatgctgtctgcaaagtaatggccagttctgt

SEQ ID NO: 14019 - DNA, 75 bp, Artificial Sequence
  Synthetic
ttatttcttatcagcagcaatattcgaggatagtggaaagcctgaattttcatacctagacaactcaaagtatag

SEQ ID NO: 14020 - DNA, 75 bp, Artificial Sequence
  Synthetic
tttgttgcagaagatgattgcttatgatggcttcactggatcacatgacatagatccagaggacatattattcct

SEQ ID NO: 14021 - DNA, 75 bp, Artificial Sequence
  Synthetic
gttccctaatgtggaggaattagaacagctagaccagatagtctttgacaaagctcgtattgagctgtctgaaag

SEQ ID NO: 14022 - DNA, 75 bp, Artificial Sequence
  Synthetic
agtgagttcgagagaggccacgcagtcaaaaataatggtgtttgacgaaaagaagtgtatgcgtgtaagcccaga

SEQ ID NO: 14023 - DNA, 75 bp, Artificial Sequence
  Synthetic
aaaactggtttctgataaatggtttggcacacaaaaaagtaagattgggaggtctgcatttgagacagagtgggc

SEQ ID NO: 14024 - DNA, 75 bp, Artificial Sequence
  Synthetic
caaactcaccagaattatacgttggctcaaagatactccagacgagacaatgaggagctcacccttgtcaaatca

SEQ ID NO: 14025 - DNA, 75 bp, Artificial Sequence
  Synthetic
gattcagataaggaacttctttgccaggctagaaggaagaacaaggacagttagagtcacaggggcccccgttaa

SEQ ID NO: 14026 - DNA, 75 bp, Artificial Sequence
  Synthetic
gaaaagatctggcatgagtaaactagcactcgtgatacgagacaatttctgcaagactggtcacctaaagggcat

SEQ ID NO: 14027 - DNA, 75 bp, Artificial Sequence
  Synthetic
agaggatataagtgggagttctaggtcttcttcagtagagatactcaggcacatactattttccatactgcaagg

SEQ ID NO: 14028 - DNA, 75 bp, Artificial Sequence
  Synthetic
gccctacagtgatgactcaaaactagacttgtgcatcaaagcactttcattatccaccgagattgaattacgaga

SEQ ID NO: 14029 - DNA, 75 bp, Artificial Sequence
  Synthetic
tcaggatggaaagacaaaagcaaatgttctaagcatcttgcagagctacatatgggcggatagaggtgtaatgag

SEQ ID NO: 14030 - DNA, 75 bp, Artificial Sequence
  Synthetic
gaagatagaaagtgctggagctggtactgtgggggggtttgtcaagcctcaaaagtcatataaagatgtagactc

SEQ ID NO: 14031 - DNA, 75 bp, Artificial Sequence
  Synthetic
gatcaagtactatggtcatggggtatggaggggcatgatggatggcgtggatgtgcagatcgatatagacaacaa

SEQ ID NO: 14032 - DNA, 75 bp, Artificial Sequence
  Synthetic
gaagggcagccccccccagataactagtgttagagtagctgggacaaaaagcccatggttaatatgccagagctt

SEQ ID NO: 14033 - DNA, 75 bp, Artificial Sequence
  Synthetic
aaaggtttggtctgatgacatgggggtcaagaatagtgcagatttctcatccacttgtagaaagaatccaaagtt

SEQ ID NO: 14034 - DNA, 75 bp, Artificial Sequence
  Synthetic
ctggctatcaaactttaagatgtttggtgggaatcaccccttgggagcacctgtttatgtgctagatggcaggat

SEQ ID NO: 14035 - DNA, 75 bp, Artificial Sequence
  Synthetic
ggaagacttgcgcgaagtcaaagatgaagacataatgataaaagttagaagagggactctaaatctctacattcc

SEQ ID NO: 14036 - DNA, 75 bp, Artificial Sequence
  Synthetic
aggcagggggagcagtgagatgcatatactctcttacacatcttctgattctgacataagtccagctatcgtgag

SEQ ID NO: 14037 - DNA, 75 bp, Artificial Sequence
  Synthetic
agaggcagaatcttctatgggtgatctcatgaagatctttgaaaaggaacctagcaagtcttggatatgttgcag

SEQ ID NO: 14038 - DNA, 75 bp, Artificial Sequence
  Synthetic
atctcttcctgtgcaatttgtagaggtattgttagatgtctgtgatggaatcagaaaagtcgacagaataaaccc

SEQ ID NO: 14039 - DNA, 75 bp, Artificial Sequence
  Synthetic
catcaggctggctgagataatcaaaatatgtactgactcatctctaaggaccaaggttggcactgtattctcaat

SEQ ID NO: 14040 - DNA, 75 bp, Artificial Sequence
  Synthetic
gcaacagtttactagtgaggctcatgttgtagactgtgatgatctgtttgatgttatgatagaagatatgaacac

SEQ ID NO: 14041 - DNA, 75 bp, Artificial Sequence
  Synthetic
aggaatttttggagaggttgtcaataagatggaagaagaagtgcgtggagataatgaggatcttgaatttgactt

SEQ ID NO: 14042 - DNA, 75 bp, Artificial Sequence
  Synthetic
tgaagatataaacttatttggtcctgcacactttaaagagtcaagcgaactatcactagtatctcaccctctcat

SEQ ID NO: 14043 - DNA, 75 bp, Artificial Sequence
  Synthetic
ggacagattcgttgatagtgcaattgctaagatggggagaagtgccatgaggagactacttgaggttggctacac

SEQ ID NO: 14044 - DNA, 75 bp, Artificial Sequence
  Synthetic
cccaaccagatatattcatgtttctaggctaatatacagagctataggtcgcaacccagactccatcaagactga

SEQ ID NO: 14045 - DNA, 75 bp, Artificial Sequence
  Synthetic
tgacttagaaatcctccaagacatggatatcagtgatgagatgattggttgaaagcagaacacggagaagggatg

SEQ ID NO: 14046 - DNA, 75 bp, Artificial Sequence
  Synthetic
cttgtctataacgtttgtgagaaggattattacttagtttaagattattgatttattcagtaatgggcggtcttt

SEQ ID NO: 14047 - DNA, 75 bp, Artificial Sequence
  Synthetic
tctataacgtttgtgagaaggattattacttagtttaagattattgatttattcagtaatgggcggtctttgtgt

SEQ ID NO: 14048 - DNA, 75 bp, Artificial Sequence
  Synthetic
tttatggagacccctcttggctcatggtcacaaatggtcagtctcatcggagctgagttgtctgcgtcggtcaag

SEQ ID NO: 14049 - DNA, 75 bp, Artificial Sequence
  Synthetic
gcacaccacaaggagtatggggagctatctttagtgtcacatcctttgatggacaagtttgtggacaatgctata

SEQ ID NO: 14050 - DNA, 75 bp, Artificial Sequence
  Synthetic
acacaaagacggcgcatatcttatgaaaatcatacaatatttctgttacataagttttgtggtgtcgagacttgt

SEQ ID NO: 14051 - DNA, 75 bp, Artificial Sequence
  Synthetic
tctccactactcaacacctacttattcaaataagatttgtttcagttctggttcaccagaacctatcgtcacgga

SEQ ID NO: 14052 - DNA, 75 bp, Artificial Sequence
  Synthetic
ttattggatggaagtgatggagtcatttccgccaggtcatcagaagtgtgaacttggtgacgggcagttttcagc

SEQ ID NO: 14053 - DNA, 75 bp, Artificial Sequence
  Synthetic
tgttgtgttggatgacatgcccaaattcattaaggcaatgacaacctcagaccaggctttaaggctgacttgcat

SEQ ID NO: 14054 - DNA, 75 bp, Artificial Sequence
  Synthetic
tggtcaaaatgacagctacatttctgagctgaccacagatggtgatgttatcccaggtgagtttcactctgaagt

SEQ ID NO: 14055 - DNA, 75 bp, Artificial Sequence
  Synthetic
agactgtaagaatggagctatcataaaagaactatctagggtgaatgtagcaccagccggagtgcatgctcgaga

SEQ ID NO: 14056 - DNA, 75 bp, Artificial Sequence
  Synthetic
tcttctgctagaaagtgcagagactgatgcaatattgaaacaaagagaccagctgattgctgaattgagagaaaa

SEQ ID NO: 14057 - DNA, 75 bp, Artificial Sequence
  Synthetic
attgcgcgatagcaaggtaagagaggatgctgcaatgcaaagaaataaagtgaatactgaacttctttcagaaac

SEQ ID NO: 14058 - DNA, 75 bp, Artificial Sequence
  Synthetic
aaaagacagagctgataagctgcagagaagagctgatgaactaattcttcatctggaaagtgagagggtagaggg

SEQ ID NO: 14059 - DNA, 75 bp, Artificial Sequence
  Synthetic
caaaattagcaggaatagatccaagtggttggagcatgaactcaaagatgcgaaagaagacatttcaagattaag

SEQ ID NO: 14060 - DNA, 75 bp, Artificial Sequence
  Synthetic
actggatattggaagaactacaaccaggaagccaaaaggtctcattagcctcacgacaactatgatccctctctt

SEQ ID NO: 14061 - DNA, 75 bp, Artificial Sequence
  Synthetic
gttactgatgacatcagaagccaccaagatatctaaagttagagcaaagtgctcccatgcaagaaacagaattgg

SEQ ID NO: 14062 - DNA, 75 bp, Artificial Sequence
  Synthetic
aagcgggaagaacacgctacctggtgttgaagactccacatgttcgatcatcaattatgagacacggtgtgattc

SEQ ID NO: 14063 - DNA, 75 bp, Artificial Sequence
  Synthetic
tctggaatctctgatggttgaggacttatacccgtttgcatcatcacacattcataagcaaactttactagaggc

SEQ ID NO: 14064 - DNA, 75 bp, Artificial Sequence
  Synthetic
ttataatgacaactttattacaaaggatagtgatggagtatgtgatttgcagtcagggaggaatgctggttgcta

SEQ ID NO: 14065 - DNA, 75 bp, Artificial Sequence
  Synthetic
caacaaaaggagcaaaatgagaccattttgtccaaatgggttccgtgcagcacactatatagatgatgaaggaaa

SEQ ID NO: 14066 - DNA, 75 bp, Artificial Sequence
  Synthetic
gctgagaggggtatactgtccaagcggcatggagatgtcagaggactgtctcaattgcaggaaaatgaaaacttc

SEQ ID NO: 14067 - DNA, 75 bp, Artificial Sequence
  Synthetic
aacagtgagacacgggagtatacaaatgcaagatgcaatgtgccaggaagtcagagagcagtactcaggacctct

SEQ ID NO: 14068 - DNA, 75 bp, Artificial Sequence
  Synthetic
tccagcgcctagaggctactgtagaattgggaacaaagaatacaagaaatgcaaagcatttcatactgagccaag

SEQ ID NO: 14069 - DNA, 75 bp, Artificial Sequence
  Synthetic
acatatgccattcatctctctcaaaggagctggtaaggtgtatctagatggcctggttctgcggaatgatgaaga

SEQ ID NO: 14070 - DNA, 75 bp, Artificial Sequence
  Synthetic
agctgaagggaattcatttatttgctataagcataagggccagtacgcaaccaatgacggggcagatgcacgcat

SEQ ID NO: 14071 - DNA, 75 bp, Artificial Sequence
  Synthetic
atatgaggttgcaaaattgtcagattgctctgttgtcgatagttcaaaacaggggaaatgcacaggagaccatgt

SEQ ID NO: 14072 - DNA, 75 bp, Artificial Sequence
  Synthetic
cttttgttctaagttcagatgtgagcaggattatccagaggtgtcttgtgtggtggcaccagggtcaggacccgt

SEQ ID NO: 14073 - DNA, 75 bp, Artificial Sequence
  Synthetic
attggtcaggtttgctggaggctgggttaagcctgtctgctttggttatgagaatgtcattgtggatattgaggt

SEQ ID NO: 14074 - DNA, 75 bp, Artificial Sequence
  Synthetic
acctgattatggtatgacaaaagaagatgaatgtgaggcctgcgtcttctcctgtgatgatgatggaatccgtat

SEQ ID NO: 14075 - DNA, 75 bp, Artificial Sequence
  Synthetic
taggacaacaggctttaaggtcaatgcagtaattgcttgctctagtgggcactgctccacatactctcaagagcc

SEQ ID NO: 14076 - DNA, 75 bp, Artificial Sequence
  Synthetic
atcaactaatgtattctttaaatacccaggtgtaagctacagtgatggctcaaaaataggtgtgcacttgtctca

SEQ ID NO: 14077 - DNA, 75 bp, Artificial Sequence
  Synthetic
cgatgatgacacaatcagctcacacatggtgctacagtgcgaggcaagagactcttgttccatcaattcctgtat

SEQ ID NO: 14078 - DNA, 75 bp, Artificial Sequence
  Synthetic
tctttgttctcacactctaattaattatcagtgccatacttttcttagtgctcttgcatgtacaatctttctgac

SEQ ID NO: 14079 - DNA, 75 bp, Artificial Sequence
  Synthetic
atcatgtcttctattaattgtctttgtagttaagagggctattggctgtgttaagactgttccttcagcagttat

SEQ ID NO: 14080 - DNA, 75 bp, Artificial Sequence
  Synthetic
gggtccaatgaagtggctaagagcactattctgctgggttgcaatgagattcaagcagtgtttcgccagacaggt

SEQ ID NO: 14081 - DNA, 75 bp, Artificial Sequence
  Synthetic
tcagaacattaatgcagagattggctggagaccaaacaatagagtagtcccaatacccagatacactggatttat

SEQ ID NO: 14082 - DNA, 75 bp, Artificial Sequence
  Synthetic
ggctataatgctgtcattattttgtatctgctctgcctgttctgaaactgccttgtcagactcaaagatctcaaa

SEQ ID NO: 14083 - DNA, 75 bp, Artificial Sequence
  Synthetic
atgttctgtaagtgatggcaagactatatgcaccctgaatggggctgtggtgatgaaggtggggactatagggac

SEQ ID NO: 14084 - DNA, 75 bp, Artificial Sequence
  Synthetic
agagtcctgctttatgatcaagtctcctaatggccagaagtcccacatatctctcaagacagtctcaagtgagtt

SEQ ID NO: 14085 - DNA, 75 bp, Artificial Sequence
  Synthetic
ggtgtgtagggagggtgactctttctggacctcagattactccccaaaatgcttgagctcaagaagatgttattg

SEQ ID NO: 14086 - DNA, 75 bp, Artificial Sequence
  Synthetic
ggttggagaatgtcactccactaattgccaatcttgggacagtggcaccatctcaacagagttcctgaggtttgg

SEQ ID NO: 14087 - DNA, 75 bp, Artificial Sequence
  Synthetic
gaatgagacaaggctcagtgagaataagtgttttgaacagtgtggtggagtgtcctgtggttgttttaatatgaa

SEQ ID NO: 14088 - DNA, 75 bp, Artificial Sequence
  Synthetic
tccttcatgcctcttttctcatgctagtctagaatcagtgagcaagaaagcagtacgtgctttctcatgtgttga

SEQ ID NO: 14089 - DNA, 75 bp, Artificial Sequence
  Synthetic
ttggactcacagaatttcttttgagatagtggatacaaaaggtcaaaaagaaaaatttagcttgtcagacactgg

SEQ ID NO: 14090 - DNA, 75 bp, Artificial Sequence
  Synthetic
aacaaagtttacaccttggggctcactgagcctgggtattgatgctgagtctatcactgggacaaactccatgat

SEQ ID NO: 14091 - DNA, 75 bp, Artificial Sequence
  Synthetic
gttcttgcaggatcccttagtggggtttgcattgatagatgaagaattgtcctctaacccaagagcaggatttat

SEQ ID NO: 14092 - DNA, 75 bp, Artificial Sequence
  Synthetic
tggggaagttagatgttcctcggaaataacagcaatttctgcgcataagtcttgtaagtgggctccaaatcttat

SEQ ID NO: 14093 - DNA, 75 bp, Artificial Sequence
  Synthetic
aaagtatagaccagtgacagattttgtggagtgttcatcagatcttataaatccttttacacttttcaggagagg

SEQ ID NO: 14094 - DNA, 75 bp, Artificial Sequence
  Synthetic
ttttttgcctcaatacagaaatggcaagatgttcactcagtccatagataagaaaagtgttcaggcagtctcttc

SEQ ID NO: 14095 - DNA, 75 bp, Artificial Sequence
  Synthetic
cctatctataagagcaacagtcaggttgttgtttgaaggccttcaggtggagttcattgaggaagaaaatgactg

SEQ ID NO: 14096 - DNA, 75 bp, Artificial Sequence
  Synthetic
caaggctgcacaaaggaatgtgacaggctgttacttgtgtaatgaaggagcgagagtctgcttaagtattgctag

SEQ ID NO: 14097 - DNA, 75 bp, Artificial Sequence
  Synthetic
taagctgaatgggacattctatgctgagtcactcaatggaatgcacatggctgtgcaagtgacacaaggaacatc

SEQ ID NO: 14098 - DNA, 75 bp, Artificial Sequence
  Synthetic
tgactattgctcttatatacattttgattcccctagtgtctccgagatcatccactactcatgtggagggactga

SEQ ID NO: 14099 - DNA, 75 bp, Artificial Sequence
  Synthetic
gaaagaattacacataactggtactttaatttcagtggagcctcatgatgacagaaacccgcaatcatcaggatc

SEQ ID NO: 14100 - DNA, 75 bp, Artificial Sequence
  Synthetic
tattgttgtgaatccaagagaagccccctggagcttgatgtcctggataagaggatttatttctttctttggagg

SEQ ID NO: 14101 - DNA, 75 bp, Artificial Sequence
  Synthetic
cccactaaagactgccattctagttattggtctaatactgctagctctcatcataatatcagtggccatactagt

SEQ ID NO: 14102 - DNA, 75 bp, Artificial Sequence
  Synthetic
agccagaagtggagcactcaagagcatgatccaaaaggcaaagattctgtaacagccaccattcatgtcccatcc

SEQ ID NO: 14103 - DNA, 75 bp, Artificial Sequence
  Synthetic
catcaatcatcataccataacatcacccacacagtgcagtgccaaaaccaggccctctgtgtgcaactggtgttg

SEQ ID NO: 14104 - DNA, 75 bp, Artificial Sequence
  Synthetic
aggtttagagtgagaggcagcaatacacaacagagaactgcgtcagccagtagtggagcagagcagtgtgagatt

SEQ ID NO: 14105 - DNA, 75 bp, Artificial Sequence
  Synthetic
agaactgcgtcagccagtagtggagcagagcagtgtgagattaacaattttgtgaaagagcgccggtctttgtgt

SEQ ID NO: 14106 - DNA, 75 bp, Artificial Sequence
  Synthetic
acacaaagaccccccgtgatttctcaaacaacaagatgactagctacctattcgacacacctgtcattgtgaggc

SEQ ID NO: 14107 - DNA, 75 bp, Artificial Sequence
  Synthetic
ccaatggctactttgacagggaggtttatgttacctacatggcccacaacaagtattgtgaccatcctgtatcag

SEQ ID NO: 14108 - DNA, 75 bp, Artificial Sequence
  Synthetic
ttcacaattgcatggagatcccggttaagaactttggtgtttcattattgcacaaagaatccttgtcagacttct

SEQ ID NO: 14109 - DNA, 75 bp, Artificial Sequence
  Synthetic
acattttgggtttactgcccttcagatggggagacaagatgggtaattctagggtgacacgtgacagtttcccat

SEQ ID NO: 14110 - DNA, 75 bp, Artificial Sequence
  Synthetic
tcatgagagacttactaaatgacattaatgatatgcatgattccgagttctttatatctttcctcccaaatgtaa

SEQ ID NO: 14111 - DNA, 75 bp, Artificial Sequence
  Synthetic
aaaaggctctttcttggcccttgggatacccaacccttgacttcattagaatgacaaggtcagaactagacattc

SEQ ID NO: 14112 - DNA, 75 bp, Artificial Sequence
  Synthetic
ctcacttcagagagatatcttccaatgccacattaattatgcagatggggcagccagctatcgacttggatcaag

SEQ ID NO: 14113 - DNA, 75 bp, Artificial Sequence
  Synthetic
gatttgttaatgcgcacaaacgaatagtgatggaatcagtgacaagaggatttggtcacaaggactttccaggta

SEQ ID NO: 14114 - DNA, 75 bp, Artificial Sequence
  Synthetic
agaacatgatatttgaagttgcttcactgcaatgtgttagacttctcaacgctgtgcctgctgatctcttatatt

SEQ ID NO: 14115 - DNA, 75 bp, Artificial Sequence
  Synthetic
gtcaagtgacaaattcattaacatcaactgtgatgaagcataggtccatgttggaggatcatcctcagcaccccc

SEQ ID NO: 14116 - DNA, 75 bp, Artificial Sequence
  Synthetic
ttggcaatcaaaagtggactccagatcccgactcctggcttctagatgaccaagctgccaccctacacgaggatt

SEQ ID NO: 14117 - DNA, 75 bp, Artificial Sequence
  Synthetic
ttgcattgatcctctctgaatctgatgacgatgaggattaacccgctgccaggtcccctctccctgatcacccac

SEQ ID NO: 14118 - DNA, 75 bp, Artificial Sequence
  Synthetic
ccccaatcaagagcatgtatatacataattcaaatcacattcccgtgtacataagcccttacccacgcacccagc

SEQ ID NO: 14119 - DNA, 75 bp, Artificial Sequence
  Synthetic
ccaagccactcagaacccaccccgagaccccaatcccgaatcccccttatcccaccctccctggcagcctattga

SEQ ID NO: 14120 - DNA, 75 bp, Artificial Sequence
  Synthetic
gagtttctgaacttattagcagctaccttaatggcttctgaagggaccccattgacatccacaacgccaagagat

SEQ ID NO: 14121 - DNA, 75 bp, Artificial Sequence
  Synthetic
tgaagcatccttcttctcttgtctgggccaatgaaaccaccattgactgccgctaacataggctgcttgaatgaa

SEQ ID NO: 14122 - DNA, 75 bp, Artificial Sequence
  Synthetic
gccacaacctctcccttgggtttccccctgaggtttggatttatgaccttggaaaattgcaccagaaataggcta

SEQ ID NO: 14123 - DNA, 75 bp, Artificial Sequence
  Synthetic
tgtgcagctagaatggcatcctgagtatcaggtggaagagtagtgtcaacaaggcctgcaaagctggggtgcatt

SEQ ID NO: 14124 - DNA, 75 bp, Artificial Sequence
  Synthetic
agacatctaggaaatcctggagacaaagcatccatcgcctcgccagttacaggaagaaaattctccacatgaggc

SEQ ID NO: 14125 - DNA, 75 bp, Artificial Sequence
  Synthetic
aaggcttgacatgtccatccagctaaggcagcagcaacacgagacaaggtcaaatcatctctgccaggattccca

SEQ ID NO: 14126 - DNA, 75 bp, Artificial Sequence
  Synthetic
gacttgagctgatacttcttcttcagggccaagacagttttcttcccttcttctgacatcttaagaaccatcttc

SEQ ID NO: 14127 - DNA, 75 bp, Artificial Sequence
  Synthetic
tctattttattccctcttgtcagagctaatactatcatcttcctagcgtcctcctgccaagatgatcctcctctc

SEQ ID NO: 14128 - DNA, 75 bp, Artificial Sequence
  Synthetic
tgctgtaaaagctcaaggaccctttttgcatcaaagccctgataggcaaattcattgacccagtttaccacatca

SEQ ID NO: 14129 - DNA, 75 bp, Artificial Sequence
  Synthetic
gctatgttaacacctgcttcgctgaactcaatggctagtctctcgaagtcagccattgcatggagtgattcactt

SEQ ID NO: 14130 - DNA, 75 bp, Artificial Sequence
  Synthetic
gctagtctctcgaagtcagccattgcatggagtgattcacttgataattaagaagtaattcggggttctttgtgt

SEQ ID NO: 14131 - DNA, 75 bp, Artificial Sequence
  Synthetic
acacaaagaagcccatatcatgaatgaaatattacagaatcaacctgtgagccaagatctgtatttctgtagagc

SEQ ID NO: 14132 - DNA, 75 bp, Artificial Sequence
  Synthetic
agtaaatcattatgatgatgaaatctttggactagcaattcttgacttcaccataagggaggattatggatctat

SEQ ID NO: 14133 - DNA, 75 bp, Artificial Sequence
  Synthetic
tgttgtggaccttgatttggaaggaagagatgaatggagcaccatagggtcaactgtaaaagatcaaatgagatt

SEQ ID NO: 14134 - DNA, 75 bp, Artificial Sequence
  Synthetic
aaatcctcagagtcttcctaattttgttcatgatttcacatttggccatctggccagcagcactgatagtccatt

SEQ ID NO: 14135 - DNA, 75 bp, Artificial Sequence
  Synthetic
cataagccttttccctgcaataggtgatggatttgaccatctaacacctgacgtgatgatcaggatgccctcagg

SEQ ID NO: 14136 - DNA, 75 bp, Artificial Sequence
  Synthetic
tcgtactcatgtgattgaattcacaacgttcagaggaacatcccaaggagcgcaacaggctgctctgttaaagat

SEQ ID NO: 14137 - DNA, 75 bp, Artificial Sequence
  Synthetic
aggaaagtatgaatctgcctgtgagagaagaagcagggtgagtcctgtgactttttcagttatatcagttcacag

SEQ ID NO: 14138 - DNA, 75 bp, Artificial Sequence
  Synthetic
atatggggtgtggaccaatctcgatctaggagaagagcaagttaatgaacttgtttacagattcagattagcagt

SEQ ID NO: 14139 - DNA, 75 bp, Artificial Sequence
  Synthetic
gagtatatttgaggaaatgaaagtgatgttcccagaactttccctggtggatgaagaattaaataagactgagag

SEQ ID NO: 14140 - DNA, 75 bp, Artificial Sequence
  Synthetic
ggaggtcctaggtgttgtttcaacaataaagatggattgggagaaaacagaaaagacattccctcatttcaaaag

SEQ ID NO: 14141 - DNA, 75 bp, Artificial Sequence
  Synthetic
aaggatgtttgataacttcaaacagacagatccagaccttgactatatatcatcagtaatatcaaagtgtgtgaa

SEQ ID NO: 14142 - DNA, 75 bp, Artificial Sequence
  Synthetic
tgagtctgaagagtcaattctaaaggaaaatcattttgaacttcagagcctgcagcttaggctaaaggagaatag

SEQ ID NO: 14143 - DNA, 75 bp, Artificial Sequence
  Synthetic
tagacaatgtgagaaggtcataaatgattttgtgagagatatgtcgtctggtgaattgagggatgtgaatgaccc

SEQ ID NO: 14144 - DNA, 75 bp, Artificial Sequence
  Synthetic
taaatcaaccatacagataccaccttgggtcacaattgagggtcctgaaggtaaagatttggttcctttaaagac

SEQ ID NO: 14145 - DNA, 75 bp, Artificial Sequence
  Synthetic
attggaagtcactggagaccaccccatgcagaggatctggtcaaaggtgtgtaattcagcatcactggagctgat

SEQ ID NO: 14146 - DNA, 75 bp, Artificial Sequence
  Synthetic
agacaggatggtagatgatcctgagtctgaattacaacatgcaatctcaggaaccagagatagggcagatgagag

SEQ ID NO: 14147 - DNA, 75 bp, Artificial Sequence
  Synthetic
gagcagataccacagagttgtggttgaactggacagtgcagaactggagtatgcagcaacacttggagtgggagg

SEQ ID NO: 14148 - DNA, 75 bp, Artificial Sequence
  Synthetic
aaagaagtttagagatcatcatacctcaagagaagcaagaactcgcagcaaaagaggattttctctagaccacaa

SEQ ID NO: 14149 - DNA, 75 bp, Artificial Sequence
  Synthetic
cataaagtcgctagaaaggtttatatccgggtgtactcaggggctattagaagagggtgattattacagacccct

SEQ ID NO: 14150 - DNA, 75 bp, Artificial Sequence
  Synthetic
tctggaagatatgcctctgaggatagaagctcagaggatccaccagccatcacatacaagaaacaatggtgaaaa

SEQ ID NO: 14151 - DNA, 75 bp, Artificial Sequence
  Synthetic
tgaattccttaggaatcatagattatttatggaaacacctctaggttcttggtcccaaatggtcagccttattgg

SEQ ID NO: 14152 - DNA, 75 bp, Artificial Sequence
  Synthetic
ttctgaactatcagcatctgtgaagcagcatgttaaacaaaagagttttattgtgaaaagactgctaggctcagg

SEQ ID NO: 14153 - DNA, 75 bp, Artificial Sequence
  Synthetic
aatatatctgctgataaaacccaccaattcaaagagtcatatatttgtctcctatgctcttgacaaactctattg

SEQ ID NO: 14154 - DNA, 75 bp, Artificial Sequence
  Synthetic
gtctcatgacttatcagatgggactgaatttaagaggtatctggatagcggggacttatttataaccgagtttac

SEQ ID NO: 14155 - DNA, 75 bp, Artificial Sequence
  Synthetic
ttcttacaaattgagcaagctgactaacctgtgcaagtgctgctcgttattagagagttctctcagtttctggac

SEQ ID NO: 14156 - DNA, 75 bp, Artificial Sequence
  Synthetic
ggaagcatatcatgagaaaccttggctaagtgttgatgtgattagaagtggtaaccagtcggaaatcttgacaat

SEQ ID NO: 14157 - DNA, 75 bp, Artificial Sequence
  Synthetic
gacaaagctatcattattgactttactggaggacaaggcgaggactgaagagttacaaacattgcttagatatgt

SEQ ID NO: 14158 - DNA, 75 bp, Artificial Sequence
  Synthetic
tgttatggaagggtttgtgtctcaacctgaattacccagaccgcaaaagatgatttctaagctgcctaaggtcct

SEQ ID NO: 14159 - DNA, 75 bp, Artificial Sequence
  Synthetic
taggactgagctgcaggttttgctcatccacagggtgctgacctctataggtagaattgcagcaagtccatttag

SEQ ID NO: 14160 - DNA, 75 bp, Artificial Sequence
  Synthetic
attgaagaaatctgatggttcaataagctggtcaggactgttcaatccactgtctggatctaaactgcttgattt

SEQ ID NO: 14161 - DNA, 75 bp, Artificial Sequence
  Synthetic
gcaacctcttataagttgttgctataatggctacttcaagaataaggaagaagaaactgaaccctctgccttatc

SEQ ID NO: 14162 - DNA, 75 bp, Artificial Sequence
  Synthetic
agctatgtataagaaaataattgaactagaacatctaaaaccggagacagatgagtatttagggtggggggatcc

SEQ ID NO: 14163 - DNA, 75 bp, Artificial Sequence
  Synthetic
tgttgagcccaagacacatgagtttagcaggtcttatcttaaggaggtttgcgagcacgggaaggcagttttgaa

SEQ ID NO: 14164 - DNA, 75 bp, Artificial Sequence
  Synthetic
gagaatatatggtcataatgttttacaacagattgatgaccagatcacaagagagatttcttctctcacaattga

SEQ ID NO: 14165 - DNA, 75 bp, Artificial Sequence
  Synthetic
gagactggcaaccctaaaagcaaccagcaattttgatgaaaattggtatgtgtataaagactgcaaggacaaaaa

SEQ ID NO: 14166 - DNA, 75 bp, Artificial Sequence
  Synthetic
ttatactagagataagctactagtaagaatgtcccaatttgcatcagaagggaaaacattagcaattgaaaaatt

SEQ ID NO: 14167 - DNA, 75 bp, Artificial Sequence
  Synthetic
tgaggagtgtatggattcaattgagtcaagaggtgccatgcatatatgtctgtttaaaaaacaacagcacggagg

SEQ ID NO: 14168 - DNA, 75 bp, Artificial Sequence
  Synthetic
acttagagagatttatgtcatgggagcggaagagagaattgtccaatcaattgtggaatgcatagcaaaaacagt

SEQ ID NO: 14169 - DNA, 75 bp, Artificial Sequence
  Synthetic
gggtaagttcttctcctcagacacactgtgtaacccaaataataagtctagaatacccgaaagccatgcatatag

SEQ ID NO: 14170 - DNA, 75 bp, Artificial Sequence
  Synthetic
ggcaaggaagcattgcagatcttcagtatggacatgtgccacttcagatgatgccaagaagtggaatcaaggtca

SEQ ID NO: 14171 - DNA, 75 bp, Artificial Sequence
  Synthetic
ctttgtaactaagttcgccatgatgctatgtgagtttacaacgccaaaatggtggcccataattatcagaggctg

SEQ ID NO: 14172 - DNA, 75 bp, Artificial Sequence
  Synthetic
ttcaatgttcactcgcaaattcatgatgatgaatatgaggtatctagacattttaaatggccatagagaactcaa

SEQ ID NO: 14173 - DNA, 75 bp, Artificial Sequence
  Synthetic
ggtagatgatgagtttgtaatgaccttattcaatgcttatcatggcgaagtagaagtaccctggctagaaaaggg

SEQ ID NO: 14174 - DNA, 75 bp, Artificial Sequence
  Synthetic
cagaacttatctgcaaacaacaacaggaatgatgcaaggcattctgcatagcacttcctcactgctccacaccct

SEQ ID NO: 14175 - DNA, 75 bp, Artificial Sequence
  Synthetic
acaccaagaatttattcgctcattgtcatttaaagtgttcaacatgaaagtgcaaccagacatgggttccaaggt

SEQ ID NO: 14176 - DNA, 75 bp, Artificial Sequence
  Synthetic
agtctgtgatgtgatgcaagggtctgatgatagttccatgatcataagcttcccagcaaatgaaggtcccatatt

SEQ ID NO: 14177 - DNA, 75 bp, Artificial Sequence
  Synthetic
catgaagtgcaagatggcagctgctatgtgttttagaataaagaaaacactaggattatacttaggaatatatcc

SEQ ID NO: 14178 - DNA, 75 bp, Artificial Sequence
  Synthetic
gtctgagaagtccacatccaacactgattttgtaatggaatacaactcagaatttttcttccacactagtcatgt

SEQ ID NO: 14179 - DNA, 75 bp, Artificial Sequence
  Synthetic
gaggcctctggtgagatgggtttcgtcttgctgtagtctgccagaagtggagaccttggttgctaggcaagaaga

SEQ ID NO: 14180 - DNA, 75 bp, Artificial Sequence
  Synthetic
agcgtcaaaccttctcacctctatatcagaaggagggggatccttcgccctgtctgccatgatacaacagtctca

SEQ ID NO: 14181 - DNA, 75 bp, Artificial Sequence
  Synthetic
atgtacaatccattatcagttaattgggatgggtgtgtcatccattttctctcattacataagagccctttccag

SEQ ID NO: 14182 - DNA, 75 bp, Artificial Sequence
  Synthetic
atggaaggatcctggattaggattctttctattagacaacccttatgctgctgggttgggaggcttcagatttaa

SEQ ID NO: 14183 - DNA, 75 bp, Artificial Sequence
  Synthetic
cctctttaaagcaataacaatgaccgagttgcagaaggtttatgcatacttcatgaaaaaggtaaaggacaattc

SEQ ID NO: 14184 - DNA, 75 bp, Artificial Sequence
  Synthetic
tcaaaccgaggaggaaggagtcttggtgccagaaacttgcagtgttagtcctggcggagcaattatcatgagctc

SEQ ID NO: 14185 - DNA, 75 bp, Artificial Sequence
  Synthetic
ttcactgaaatggggatcaaggaagaaattctctagactcagagacaggctaaacatacccgaaaactgggtgga

SEQ ID NO: 14186 - DNA, 75 bp, Artificial Sequence
  Synthetic
aatgatcaataataatccagaggttttgtatcgagctccaaaaactggagaagaaataatcttgaggatagcaga

SEQ ID NO: 14187 - DNA, 75 bp, Artificial Sequence
  Synthetic
gaaggttcatagtccaggtgtggtttcttcattgtccacaggaaatgcagtgtgcaaggtgatggcaagttcagt

SEQ ID NO: 14188 - DNA, 75 bp, Artificial Sequence
  Synthetic
gtacttcttgtcagcagcaatctttgaggatagtggcagaccagaattttcgtaccttgacaattctaaatatag

SEQ ID NO: 14189 - DNA, 75 bp, Artificial Sequence
  Synthetic
cctgttgcagaaaatgatggcttacgacggcttcaatggctctcatgacatagatcctgaggacatattatttct

SEQ ID NO: 14190 - DNA, 75 bp, Artificial Sequence
  Synthetic
gtttccaaatgtggaagagctggaacaattagatatgatcatatacgacaaaggctctattgatttagttgagag

SEQ ID NO: 14191 - DNA, 75 bp, Artificial Sequence
  Synthetic
agtcagctctagagaggctacccagtcaagggttgtggtgtttgatgagaagaaatgtatgaggattagtccaga

SEQ ID NO: 14192 - DNA, 75 bp, Artificial Sequence
  Synthetic
aaagttagtttctgataagtggtttggaactcagaaaagtaagataggtaggactgcatttgagattgagtgggc

SEQ ID NO: 14193 - DNA, 75 bp, Artificial Sequence
  Synthetic
caaactgactcgtgtaattagatggctgaaggacacacctgagggaacaatggaaaagtctccattgtcaaacca

SEQ ID NO: 14194 - DNA, 75 bp, Artificial Sequence
  Synthetic
gattcagataagaaacttctttgcacggttagaaggcagatcccgatgcgtcagaatcactggtgctccagtaaa

SEQ ID NO: 14195 - DNA, 75 bp, Artificial Sequence
  Synthetic
gaagagatctggtatgagcaaactagccttagtgataagagataacttctgtaaagccggtcatctaaaaggaat

SEQ ID NO: 14196 - DNA, 75 bp, Artificial Sequence
  Synthetic
agaagatataagcgggagttctagatctgtgtctgtggaagtgttgaggcatgtgctgttctcagtcttacaggg

SEQ ID NO: 14197 - DNA, 75 bp, Artificial Sequence
  Synthetic
gccatacagtgatgagtctaaattggatctgagcataaagtctttatcagtgtccagtgagattgaattgagaga

SEQ ID NO: 14198 - DNA, 75 bp, Artificial Sequence
  Synthetic
gaatgacgggaaatcaaaggctaatatacttagtatattgcaaagctacatatgggctgacagaggagtcataca

SEQ ID NO: 14199 - DNA, 75 bp, Artificial Sequence
  Synthetic
aaaaatagaaaaggcaggagcaggaacagtaggaggattcattaaacctcagaagtcttttaaagaaaatcagtt

SEQ ID NO: 14200 - DNA, 75 bp, Artificial Sequence
  Synthetic
ggttaagtattatggtcacgggatatggcgtggcatgatggatggcgttgacgtgcaaatagatattgacaatag

SEQ ID NO: 14201 - DNA, 75 bp, Artificial Sequence
  Synthetic
gaaagaccaaaatcctcagatcacaagtgtgagagtgtctggaacaaaaagcccatgggtcatctgccagagttt

SEQ ID NO: 14202 - DNA, 75 bp, Artificial Sequence
  Synthetic
aaaactatggtgtgaagacatgggggtcaagaattctgctgatttctctgagtctgtgaaacgaagtccgaagtt

SEQ ID NO: 14203 - DNA, 75 bp, Artificial Sequence
  Synthetic
ttggctttcaaatttcagaatgtttggggggaatcatcctttaggagctccagtctacatattggatggaagaat

SEQ ID NO: 14204 - DNA, 75 bp, Artificial Sequence
  Synthetic
ggatgaccttcgcgaaataagggacgaagatattcttataaaggtcagaagaggaacattaaacttatttgtgaa

SEQ ID NO: 14205 - DNA, 75 bp, Artificial Sequence
  Synthetic
gagcagaggtggaagtgagatgcatatactgtcttacacctcttctgatactgacttaagtccttcaatggtcaa

SEQ ID NO: 14206 - DNA, 75 bp, Artificial Sequence
  Synthetic
agaagctgagctgtcatcacctgaactaatgagtctctttagcagagagcctagtaggtcctgggtctgctgctc

SEQ ID NO: 14207 - DNA, 75 bp, Artificial Sequence
  Synthetic
ccccctgcctgtgcaatacacagaagtgctgcttgatgtgtgtgagggagtgaaaaaagtagacaggatcaatcc

SEQ ID NO: 14208 - DNA, 75 bp, Artificial Sequence
  Synthetic
cataaggcttggtgagataataaagatatgtacagattcttctctaagaacaaaagttggtactgtgtattccat

SEQ ID NO: 14209 - DNA, 75 bp, Artificial Sequence
  Synthetic
gcagcaattctcagaggaggctcagatgattgactgcgatgatctcttggacattatgatagaagacatcaggac

SEQ ID NO: 14210 - DNA, 75 bp, Artificial Sequence
  Synthetic
aggagcattcagtgaggttgttaaaaaaatggaagatgaagtgaaaggggataatgaggatctagactttgatta

SEQ ID NO: 14211 - DNA, 75 bp, Artificial Sequence
  Synthetic
tgatgatattaacctgtttggtcctgctcaccataaggagtatggtgagctatctctggtctctcaccctctgat

SEQ ID NO: 14212 - DNA, 75 bp, Artificial Sequence
  Synthetic
ggataagtttgtggataatgcaatctctgtaatggggaggtcgtcacttagaaggctgctagaactgggggtgac

SEQ ID NO: 14213 - DNA, 75 bp, Artificial Sequence
  Synthetic
aaagtcaagatatctgaaaatctcaaggctagtgtacagggccataggaaggaacgcagaaactataaaaactga

SEQ ID NO: 14214 - DNA, 75 bp, Artificial Sequence
  Synthetic
tgactttagtctagaagatcagcccagcattagtgaggacatgctaggatagaatacctgagacacaattcagaa

SEQ ID NO: 14215 - DNA, 75 bp, Artificial Sequence
  Synthetic
ataaaagcaatatacagggttacctatgctattcatggactcatatcctgtgtgtactctgcgttgataccactg

SEQ ID NO: 14216 - DNA, 75 bp, Artificial Sequence
  Synthetic
ggttacctatgctattcatggactcatatcctgtgtgtactctgcgttgataccactgcttagcggtctttgtgt

SEQ ID NO: 14217 - DNA, 75 bp, Artificial Sequence
  Synthetic
gactggattatctcaaggattcactcttaaggggcctaaagggaacagcttatttgatatagtcgtgtatataaa

SEQ ID NO: 14218 - DNA, 75 bp, Artificial Sequence
  Synthetic
attattacaattctcaacataattacattagcagtcattgtgactgcaatgcctcctcgtaatacgaatgggggt

SEQ ID NO: 14219 - DNA, 75 bp, Artificial Sequence
  Synthetic
gcaaatgatccagaaactgctaaagatatattagctgatctattaatggatcgacataactactttggcagagaa

SEQ ID NO: 14220 - DNA, 75 bp, Artificial Sequence
  Synthetic
gcctcctcgtaatacgaatgggggtcgatgcttttatggtggcaatatgtttcgccaaatcaactcaacatcacc

SEQ ID NO: 14221 - DNA, 75 bp, Artificial Sequence
  Synthetic
aaatgctagagttattgctaagtatgcagaggagtataagactgggccaactgtgagtatcaatgttcagcatac

SEQ ID NO: 14222 - DNA, 75 bp, Artificial Sequence
  Synthetic
ctctgttactatcttgatattgagtataaaaatgacacgccaattgatgatatcctgctggatttcttgccaccg

SEQ ID NO: 14223 - DNA, 75 bp, Artificial Sequence
  Synthetic
tgaaaaatgcacaggttcatgtccagcatcaataccaaaaaagggggaaaattggttatccttctctagagagca

SEQ ID NO: 14224 - DNA, 75 bp, Artificial Sequence
  Synthetic
agtagtgaactaccacaacaaaatgattattacaattctcaacataattacattagcagtcattgtgactgcaat

SEQ ID NO: 14225 - DNA, 75 bp, Artificial Sequence
  Synthetic
gggactgatttcaaggctagatactgtacaccagacaattacattattcacaacaggaaattatatgtattggat

SEQ ID NO: 14226 - DNA, 75 bp, Artificial Sequence
  Synthetic
tacgagttcttggggctgcgaagaatggggctgtattgctgttgggactggttgtgtctatggttcttgccaaga

SEQ ID NO: 14227 - DNA, 75 bp, Artificial Sequence
  Synthetic
tacaaggttgctgtcgataatgaatcttcagctaaaacttttgaaaaatacgacaagatattcggcgatgttttg

SEQ ID NO: 14228 - DNA, 75 bp, Artificial Sequence
  Synthetic
tgtgataaaagaagaagctctagctattagcaggataaatgctgaaatcctagaagtagagttttgcataactga

SEQ ID NO: 14229 - DNA, 75 bp, Artificial Sequence
  Synthetic
ttcgacgtaaatcatgagggcatcttagcacctaagacatatgcttgtagagctacatgttcaataagcttagaa

SEQ ID NO: 14230 - DNA, 75 bp, Artificial Sequence
  Synthetic
gtgccattgggcctggattatgagatagtcattgttagggctgacccggtacgggatgtgatacatgtcaactca

SEQ ID NO: 14231 - DNA, 75 bp, Artificial Sequence
  Synthetic
tcctacaagcacaatgtgtaacacaataaatgttctagaacctgtattgggagaacatatgcaatttgaaataca

SEQ ID NO: 14232 - DNA, 75 bp, Artificial Sequence
  Synthetic
tagtcattgttagggctgacccggtacgggatgtgatacatgtcaactcagaagatttcctccacgaattcggcc

SEQ ID NO: 14233 - DNA, 75 bp, Artificial Sequence
  Synthetic
ttctgttcaaactaatttacttccagatatagccataataaaagataagaaagtctttttgggtccaatcaacag

SEQ ID NO: 14234 - DNA, 75 bp, Artificial Sequence
  Synthetic
catacatgggacaactatcaagaatggctggtttaagacaaaggtctctatagatctggacaacacatgtgagga

SEQ ID NO: 14235 - DNA, 75 bp, Artificial Sequence
  Synthetic
cgattaatatgaacttagattttacttggttttacaatcttcgtgcattaatatatgataagtttaaagatgatg

SEQ ID NO: 14236 - DNA, 75 bp, Artificial Sequence
  Synthetic
aagagggaccttcaacccacaatgcggttcggtgcagtcatttgatgggaagatatatggagtaggtaacccaaa

SEQ ID NO: 14237 - DNA, 75 bp, Artificial Sequence
  Synthetic
aacgcttcttagaaatagctagccaaggtgaatttacaatgactgggccgtggcttgatgatgaaacgccagaat

SEQ ID NO: 14238 - DNA, 75 bp, Artificial Sequence
  Synthetic
acccttaatgttcatgcatgctttaggcaacataaatcatgtattcgttacttcaaggggtcaatcctacctgaa

SEQ ID NO: 14239 - DNA, 75 bp, Artificial Sequence
  Synthetic
atttgattacatttgccatgcattatctcgtaaagacatagtggtccggaaatgctatgaaaatcattactactc

SEQ ID NO: 14240 - DNA, 75 bp, Artificial Sequence
  Synthetic
tgtatgatcatcctatattcaaagaattctatgactccctgccaaatgagtcaaaaattaccttccagcgctcaa

SEQ ID NO: 14241 - DNA, 75 bp, Artificial Sequence
  Synthetic
atcatgatcgagtcaatctgtacaaatgcagagctgatattactatgctgcttctctgcaatctcttgctttgtg

SEQ ID NO: 14242 - DNA, 75 bp, Artificial Sequence
  Synthetic
gtgtttgacattaaaggaggccactgatctaaaagctgaaaatatagatggaagtacaacaatttacaataataa

SEQ ID NO: 14243 - DNA, 75 bp, Artificial Sequence
  Synthetic
tgaactttgatgcaacaaaaggcgacaaatggaaccaaaacctggttgatacaatacatgaatacaccccaagtt

SEQ ID NO: 14244 - DNA, 75 bp, Artificial Sequence
  Synthetic
cctacatattacatgcggtcacaaaacccttaatgttcatgcatgctttaggcaacataaatcatgtattcgtta

SEQ ID NO: 14245 - DNA, 75 bp, Artificial Sequence
  Synthetic
tgtgcttttaggtagcgcaaatgttaaaatgatgtttggagatataacttatcaacagtcagatgtcacgcaaag

SEQ ID NO: 14246 - DNA, 75 bp, Artificial Sequence
  Synthetic
acaatctctttataaaaactgcctcatctggtattttcaaatgtcatggagattacccgaaacccagcaattctg

SEQ ID NO: 14247 - DNA, 75 bp, Artificial Sequence
  Synthetic
ttattgttgctaagattctgtaaacaatgcaaaaattgcttattaccaattcatccttttagcccatgtccaaca

SEQ ID NO: 14248 - DNA, 75 bp, Artificial Sequence
  Synthetic
ggttatacaagggcttgccacgtgtggtggatgtgttgactgcttcaatgatgttgcatgtaagttaagtgtaac

SEQ ID NO: 14249 - DNA, 75 bp, Artificial Sequence
  Synthetic
tcatccttttagcccatgtccaacaacatgtatctgcgggatggtttataattctagtgaagccttaaaagttca

SEQ ID NO: 14250 - DNA, 75 bp, Artificial Sequence
  Synthetic
aaattacacaaggttggcaactaatgacagagagaataaccagcgaaagagaactaactaatgacataaacaaac

SEQ ID NO: 14251 - DNA, 75 bp, Artificial Sequence
  Synthetic
gtccaatgggatataccaatgtccagttgcatcaagctgtgagtcttatgttaataatgtatatatggtagaagg

SEQ ID NO: 14252 - DNA, 75 bp, Artificial Sequence
  Synthetic
aaaaaccttctatccacttcctttggtgtccaccaagtcaagagtccaatgaaaatatcaaaaagttattacggc

SEQ ID NO: 14253 - DNA, 75 bp, Artificial Sequence
  Synthetic
tacaagactctgactaaaacaaggtatttgtgtaaaaagagactccctaatatggtattggccactatcagcaca

SEQ ID NO: 14254 - DNA, 75 bp, Artificial Sequence
  Synthetic
aacaaatgacattaacttgaaatttcgatgcataaagccagaaataaaaataacaatatgcggccagaacatttt

SEQ ID NO: 14255 - DNA, 75 bp, Artificial Sequence
  Synthetic
tatggtattggccactatcagcacagtactattctttactttcataacccctataacagctgaatgctataatta

SEQ ID NO: 14256 - DNA, 75 bp, Artificial Sequence
  Synthetic
tatctaaaatgctccaaaagctagatggcaccagcacatatttggacgcatttaaagccattggcattctaatgg

SEQ ID NO: 14257 - DNA, 75 bp, Artificial Sequence
  Synthetic
agtgaaggcagaaatcatcaaagatactaagaagctagacttagccagtgcagaccaaacatcatatataaagga

SEQ ID NO: 14258 - DNA, 75 bp, Artificial Sequence
  Synthetic
atttctcatccaatgttgggttgtacgaatcacatacaagtaagttgaaaaatatgtcaaggcaaacatcaaaaa

SEQ ID NO: 14259 - DNA, 75 bp, Artificial Sequence
  Synthetic
gctgctatagataaaaataattcttgcacacgtgaacaattaataatgatcatattaacaatcctatgtattgcc

SEQ ID NO: 14260 - DNA, 75 bp, Artificial Sequence
  Synthetic
atttgacaagaaatgcaatacatggttatgcagagcatacaatgaaggtattggattcatatttaaaccattatg

SEQ ID NO: 14261 - DNA, 75 bp, Artificial Sequence
  Synthetic
agattgacaaaaaaattgaagctataaaaattggtacctcaactgtaatgtgggaacagcaatttgtctttgaca

SEQ ID NO: 14262 - DNA, 75 bp, Artificial Sequence
  Synthetic
tcaatcattgtggttatatcagcagttcacctgtatatacggatatgttatgtattttgtgcttattgcggaatg

SEQ ID NO: 14263 - DNA, 75 bp, Artificial Sequence
  Synthetic
ggatgagctaggtagttgggctaggtatgtactgttgatagtagctatgattataattattctgatagttgtcaa

SEQ ID NO: 14264 - DNA, 75 bp, Artificial Sequence
  Synthetic
caaacatcatagatcaccaatcgaaggggaagctcttcaaagaatttataggaattggcaaccataaacaatttt

SEQ ID NO: 14265 - DNA, 75 bp, Artificial Sequence
  Synthetic
tgtattttgtgcttattgcggaatggtacacgaaaagaagggcttgattttactagacaatttcacatctcattg

SEQ ID NO: 14266 - DNA, 75 bp, Artificial Sequence
  Synthetic
aataataaggccactaatacgttatattgtagagactttgaaagaaaatgacaaagtatataaattagaaaacaa

SEQ ID NO: 14267 - DNA, 75 bp, Artificial Sequence
  Synthetic
caaagaaaacaattgaggacattgatatctcacagcctactatattagacttcaataacaaaaacataattgaca

SEQ ID NO: 14268 - DNA, 75 bp, Artificial Sequence
  Synthetic
catattaacaatcctatgtattgcctcaatcattgtggttatatcagcagttcacctgtatatacggatatgtta

SEQ ID NO: 14269 - DNA, 75 bp, Artificial Sequence
  Synthetic
aataaaataaacactataagttgctgtaaagtacttgggttgggtggggattgattctgcaactgtaataatatt

SEQ ID NO: 14270 - DNA, 75 bp, Artificial Sequence
  Synthetic
agtgtacattccaatataaaaacgttgacaagatattatcaaagccaaatatgctagacaagatgggatgttatc

SEQ ID NO: 14271 - DNA, 75 bp, Artificial Sequence
  Synthetic
ccttacgtgcatttgtcgtgataaaagcatacacagagccaacaataattgtgttgctccgatgaaatacaaaac

SEQ ID NO: 14272 - DNA, 75 bp, Artificial Sequence
  Synthetic
agcatacacagagccaacaataattgtgttgctccgatgaaatacaaaaccgccaagtataccaatctagtgtgc

SEQ ID NO: 14273 - DNA, 75 bp, Artificial Sequence
  Synthetic
ttgaagagtatggcccacaaatttgtgctgcatcagaagaaacatgggaaacacttaagcttatatgcaacatgt

SEQ ID NO: 14274 - DNA, 75 bp, Artificial Sequence
  Synthetic
catattggtcagcaataaaggatttttcaaccttaatgaaaaacatgttggcagtgtcacagtacaataggcaca

SEQ ID NO: 14275 - DNA, 75 bp, Artificial Sequence
  Synthetic
acacattccgggtagtgacttgtgcaaataataacttatttgctatcgttatgccatcttcagatattaagacaa

SEQ ID NO: 14276 - DNA, 75 bp, Artificial Sequence
  Synthetic
actaaatcatctacatctaaagatctccatagtgctactattcatgaatttatagctgcaaatctctatcctaat

SEQ ID NO: 14277 - DNA, 75 bp, Artificial Sequence
  Synthetic
agagggcaacattggcatactttataatatgtattcatgatcataaagacaacattatgcaccatggggctttac

SEQ ID NO: 14278 - DNA, 75 bp, Artificial Sequence
  Synthetic
ccttgcttctatttctaagtgcaccatgtctatgtggtgcacacctttgttcagctgcatggattttattgtttt

SEQ ID NO: 14279 - DNA, 75 bp, Artificial Sequence
  Synthetic
atgcaacatttaaaagtgaaggaaaatatgtaagtatctcaaaagggatcagattagataaggagaggtgccaaa

SEQ ID NO: 14280 - DNA, 75 bp, Artificial Sequence
  Synthetic
cgggctacttagctcgctgggttgctgagcagtgcaaggctaatcagatcaaatttgcagaggcagctgccacaa

SEQ ID NO: 14281 - DNA, 75 bp, Artificial Sequence
  Synthetic
ggatagtttcttcccctggactatttttactaacaacactattgatgtacaataacaacccgacgattaagattg

SEQ ID NO: 14282 - DNA, 75 bp, Artificial Sequence
  Synthetic
aggatgttgcaaattttgcttttcatacatctctatctattacgaaggccatgttatctttaactgagccatcta

SEQ ID NO: 14283 - DNA, 75 bp, Artificial Sequence
  Synthetic
gtgctgagatgtttctggaaacctttgagttttacccactggttatcgacatgcaccgtgtgataaaggatggga

SEQ ID NO: 14284 - DNA, 75 bp, Artificial Sequence
  Synthetic
ggtatatgataatgaattcacttgctatatcaagtcacgttaaagattacatatcagagaaattttcaccatata

SEQ ID NO: 14285 - DNA, 75 bp, Artificial Sequence
  Synthetic
cttacgccagaggtatgggcagctgactgcagaagagtggatgacatctaagttggacgcagtcaaggctgcatt

SEQ ID NO: 14286 - DNA, 75 bp, Artificial Sequence
  Synthetic
caaaaacgagcttctcagtaattatggctaatttgattaaaaagggctgttacaacgcatataagcaaagatcaa

SEQ ID NO: 14287 - DNA, 75 bp, Artificial Sequence
  Synthetic
acataacagaagaggttagggaattaagaattaggcctgatcttagtattagggggtccaaatttacaaacaaga

SEQ ID NO: 14288 - DNA, 75 bp, Artificial Sequence
  Synthetic
aggttgatcttagaagcatacatctaacagattacgaaataactcagaagggtgttaataataatcgagatttgt

SEQ ID NO: 14289 - DNA, 75 bp, Artificial Sequence
  Synthetic
ctagagctttcctggctcaatttggtatccagatctaatcttaactgattctccagttttctttcttctcttcct

SEQ ID NO: 14290 - DNA, 75 bp, Artificial Sequence
  Synthetic
agtctccagcattaaatcattacaccatacatgggacaactatcaagaatggctggtttaagacaaaggtctcta

SEQ ID NO: 14291 - DNA, 75 bp, Artificial Sequence
  Synthetic
catcaatctggtttgagggcaaagtgtcgttgaaagaatatataaatcagatttatatgcccttttactttaatt

SEQ ID NO: 14292 - DNA, 75 bp, Artificial Sequence
  Synthetic
caaaaggattgcacgaaaagcaccatgttatgattgatcttgcaaaaacagtactagaaatagagcatgatcaac

SEQ ID NO: 14293 - DNA, 75 bp, Artificial Sequence
  Synthetic
caatggaggtgttaagttataccagcgaccaaacaaacctctaacacttgtaggcaataagctttgcattggtga

SEQ ID NO: 14294 - DNA, 75 bp, Artificial Sequence
  Synthetic
cgggctacttagctcgctgggttgctgagcagtgcaaggccaatcagatcaaatttgcagaggcagctgccacaa

SEQ ID NO: 14295 - DNA, 75 bp, Artificial Sequence
  Synthetic
ggctcaatatacctggtatatggtctagtactcctcagaaacagacagtgaatctgcctgttttgatatatgcta

SEQ ID NO: 14296 - DNA, 75 bp, Artificial Sequence
  Synthetic
caaatactgtatgatagcatttgacccaatggtagtagatgaaaatatacaaaaactggattgttatagtttggc

SEQ ID NO: 14297 - DNA, 75 bp, Artificial Sequence
  Synthetic
tgttatgattgatcttgcaaaaacagtactagaaatagagcatgatcaacggctcaatatacctggtatatggtc

SEQ ID NO: 14298 - DNA, 75 bp, Artificial Sequence
  Synthetic
tgctacagaccaatcaaatgggatgttgaaacctgaaaggtctattcgactcctcaaaacaggcgaatgtaaaat

SEQ ID NO: 14299 - DNA, 75 bp, Artificial Sequence
  Synthetic
tttctaaaaatctcctaatggacacatctagacacaattatattcgatctagaatagagaactcaaataacttaa

SEQ ID NO: 14300 - DNA, 75 bp, Artificial Sequence
  Synthetic
agcgatctatcactactatcagcacttttactagttcaaagtcgtgtattaaggttggtgattttgcagacttca

SEQ ID NO: 14301 - DNA, 75 bp, Artificial Sequence
  Synthetic
actgcagaggaatggatgacatctaagttggacgcagtcaaggctgcatttagctcagttgcccagatatcctgg

SEQ ID NO: 14302 - DNA, 75 bp, Artificial Sequence
  Synthetic
aatcaagagaatcaagagttgtcaatgctaaacttgagaaggatatcaggaagtacacaatagccaacccagaat

SEQ ID NO: 14303 - DNA, 75 bp, Artificial Sequence
  Synthetic
gctacccttattattcagccaacctagctgactgctcttggagtgaatcaactcattctactttgagccaaaaag

SEQ ID NO: 14304 - DNA, 75 bp, Artificial Sequence
  Synthetic
ttgttgaagatctgacagaaaaagccattataaggcatgccatttatgatgacttaaaaaaagctataccagatt

SEQ ID NO: 14305 - DNA, 75 bp, Artificial Sequence
  Synthetic
ctaagcccaaattgtgatctagattgctacccttattattcagccaacctagctgactgctcttggagtgaatca

SEQ ID NO: 14306 - DNA, 75 bp, Artificial Sequence
  Synthetic
atattgatgtgatgtccactaaagtatttgacgcattgtattataaaattaagcatggtgaaataacagacaaac

SEQ ID NO: 14307 - DNA, 75 bp, Artificial Sequence
  Synthetic
atttcaggccactaagcaacatgccacatataaagcccaatttcaaatcaataaatgttcaagggacgatttctg

SEQ ID NO: 14308 - DNA, 75 bp, Artificial Sequence
  Synthetic
acatataaagcccaatttcaaatcaataaatgttcaagggacgatttctggcagcaagattcaagacagctatat

SEQ ID NO: 14309 - DNA, 75 bp, Artificial Sequence
  Synthetic
cagctgtcgagcatatactccaagtcatgaaaaatcataagagatttgtctttacatattttaataaaggccaaa

SEQ ID NO: 14310 - DNA, 75 bp, Artificial Sequence
  Synthetic
aaacagcaaaagatagagaaatatttgtgggagagtttgaagctaaaatgtgcttatacttagtagaaaggatat

SEQ ID NO: 14311 - DNA, 75 bp, Artificial Sequence
  Synthetic
tgacattatagcatatgtgaaaagtgcgcgtgtagttgcgacatataaccatgactataaaacaggacccacagt

SEQ ID NO: 14312 - DNA, 75 bp, Artificial Sequence
  Synthetic
ctaaagaaaggtgcaaactcaatccagatgagatgattagcgaacctggagatggtaagcttaaaaagcttgaag

SEQ ID NO: 14313 - DNA, 75 bp, Artificial Sequence
  Synthetic
gagcatcaatgttcaacataatgaacaatgtacaggatcctgccccagtagtatacctaaaaaagataattggct

SEQ ID NO: 14314 - DNA, 75 bp, Artificial Sequence
  Synthetic
atatggcagaatacgaaattcgatatactgctaacacattaaagtccatgaaagacaaggcattgcaagaattta

SEQ ID NO: 14315 - DNA, 75 bp, Artificial Sequence
  Synthetic
gtatacctaaaaaagataattggctaaccttctctcgcgagcataccagcacctggggttgcgaagaatggggtt

SEQ ID NO: 14316 - DNA, 75 bp, Artificial Sequence
  Synthetic
gtaaatttgcagatgacttcaattttaagccacattcaacaaaaatagagataaatgcagacatgtcgaaatgga

SEQ ID NO: 14317 - DNA, 75 bp, Artificial Sequence
  Synthetic
gtgcacaagatgttctcttcaaatatttttggttatttgctcttgaccctgcactttataaaccagagaaagaaa

SEQ ID NO: 14318 - DNA, 75 bp, Artificial Sequence
  Synthetic
agagaagaagcaacagttatttccagagtaaataacgagcagttggaagttgaattttgtgtttcagagcctaca

SEQ ID NO: 14319 - DNA, 75 bp, Artificial Sequence
  Synthetic
ggattttatacttcttgtgtaattacatggataaggtgctagttattcctgatgatgtgatgacgtcgatattag

SEQ ID NO: 14320 - DNA, 75 bp, Artificial Sequence
  Synthetic
atcaacgtgtaaagcgagaaaaggatattatatatgaaatgacaaacgggctgaagcaaaactgggtttctatca

SEQ ID NO: 14321 - DNA, 75 bp, Artificial Sequence
  Synthetic
ctttgatcaaaaataggagggtgtacaaggggtcaataaacaagaaaggtgtattcaaccctcaatgtggttcag

SEQ ID NO: 14322 - DNA, 75 bp, Artificial Sequence
  Synthetic
aaagaaactggcttcagggcaacctgaattacacatctagctatttacattcttgttgtatgaatgtttacaaag

SEQ ID NO: 14323 - DNA, 75 bp, Artificial Sequence
  Synthetic
gtattcaaccctcaatgtggttcagtccagtcatttgatggtaaactctatggtgttgggaatccaaagtttgac

SEQ ID NO: 14324 - DNA, 75 bp, Artificial Sequence
  Synthetic
tccagtcatttgatggtaaactctatggtgttgggaatccaaagtttgactacatttgccatgcattatcaagga

SEQ ID NO: 14325 - DNA, 75 bp, Artificial Sequence
  Synthetic
acattatcaagaatgtagctacgctcctagaaggcgatgttttagtgaattcaatggttcactcagatgataacc

SEQ ID NO: 14326 - DNA, 75 bp, Artificial Sequence
  Synthetic
tggtgttgggaatccaaagtttgactacatttgccatgcattatcaaggaaagatatagttgtgagaaaatgtta

SEQ ID NO: 14327 - DNA, 75 bp, Artificial Sequence
  Synthetic
aagatatagttgtgagaaaatgttacgaaaatcactactattcatgcgctacgctcaaggaagctgtagaaatca

SEQ ID NO: 14328 - DNA, 75 bp, Artificial Sequence
  Synthetic
acacttcaataacaatgattcaagacaaattcccagatgatatcattattgaatactgcattaaattatttgaaa

SEQ ID NO: 14329 - DNA, 75 bp, Artificial Sequence
  Synthetic
gtacacgtgaacaactaataatgatcatattaacaatcctatgtattgcctcaatcattatgcctatatcagcag

SEQ ID NO: 14330 - DNA, 75 bp, Artificial Sequence
  Synthetic
tatgctttataacgacaatgctttactcggtagtgcatcaataaagataatgttaggcgatctaatatatcaaca

SEQ ID NO: 14331 - DNA, 75 bp, Artificial Sequence
  Synthetic
aaatatgcctgtcctttggaaaccaagctaacatgaagaagacctatgtcacaaatttcatcaaagaatttgttt

SEQ ID NO: 14332 - DNA, 75 bp, Artificial Sequence
  Synthetic
tccacctgtatatacaaatatattatgtattttgcgcttactgcggaatagtgcatgaaaagaagggcctaattt

SEQ ID NO: 14333 - DNA, 75 bp, Artificial Sequence
  Synthetic
ctctgttcaatatctatggagaaccgttctcagtgtacggtcgatttttactcaccgcagtaggtgattgtgcat

SEQ ID NO: 14334 - DNA, 75 bp, Artificial Sequence
  Synthetic
agaggccatgcaacttgtggaggctgcacagattgttttaacgatgttgcatgtaaagtcagcatgacttcaaat

SEQ ID NO: 14335 - DNA, 75 bp, Artificial Sequence
  Synthetic
tcctcggtccgtatgaagatacggcaagcaggttatctgctactcaaactgcaattaaacatggtgctcagccat

SEQ ID NO: 14336 - DNA, 75 bp, Artificial Sequence
  Synthetic
cttcctgtgattcttatatcaataatgtttatattaatgaaggcacaaatgatgtcagcttgaagtttcgatgtt

SEQ ID NO: 14337 - DNA, 75 bp, Artificial Sequence
  Synthetic
ctgttgcttgggtggcaatcgcccttactcagtggataacacatagcacttataacatgttacctggacaaaaca

SEQ ID NO: 14338 - DNA, 75 bp, Artificial Sequence
  Synthetic
atgatccactgaatgttttaacttcgcaaaatagatttgatatacctatagaactttgcggattgttaaatacag

SEQ ID NO: 14339 - DNA, 75 bp, Artificial Sequence
  Synthetic
aacatcctatatcaaagagtttgacaaaaaatgcgccacatggctatgcagagcttataatgagggaattggatt

SEQ ID NO: 14340 - DNA, 75 bp, Artificial Sequence
  Synthetic
aaaaaatgcgccacatggctatgcagagcttataatgagggaattggatttatcttggaaccattatggaatgag

SEQ ID NO: 14341 - DNA, 75 bp, Artificial Sequence
  Synthetic
atctgccaacattggcgatagcaggtttagaatcaggcaatctgacttatttggttaatttgtccagaaggatgt

SEQ ID NO: 14342 - DNA, 75 bp, Artificial Sequence
  Synthetic
ccaaagtccagctactacgtgaaagtattcaatctcaatatacagacatagagtcttgggacttaagtaagttga

SEQ ID NO: 14343 - DNA, 75 bp, Artificial Sequence
  Synthetic
gagcttataatgagggaattggatttatcttggaaccattatggaatgagttaagtttatgggggaaatatgtta

SEQ ID NO: 14344 - DNA, 75 bp, Artificial Sequence
  Synthetic
aatactccactatagttcataagaagagcgatttagttgatgagtattgtctaagcccaaattgtgacctagatt

SEQ ID NO: 14345 - DNA, 75 bp, Artificial Sequence
  Synthetic
cacagatggataagtttaagcttaagttactgaggttcatgacgttagattcagctatgagtagcgacgacggta

SEQ ID NO: 14346 - DNA, 75 bp, Artificial Sequence
  Synthetic
aggccactggcaagatatattgtcgcaatacttaaagagaatgacaaagtgtacaaactggaaaataagttgaaa

SEQ ID NO: 14347 - DNA, 75 bp, Artificial Sequence
  Synthetic
tgggagggactagtgatatgcgttctcggtctctgttaacaccacggaaatttacaacacatgcgtccttagtca

SEQ ID NO: 14348 - DNA, 75 bp, Artificial Sequence
  Synthetic
tctgagataattaaagatacaaagaagctagatttggctagtgccgaccaaacgtcctatatcaaagagtttgac

SEQ ID NO: 14349 - DNA, 75 bp, Artificial Sequence
  Synthetic
ttaaatagacataatgggagggtggtgggagttttctgctaatataataattatttgttgtggtagaacactact

SEQ ID NO: 14350 - DNA, 75 bp, Artificial Sequence
  Synthetic
ggttagaatcttataatgatttccaaaagctagtgcaggaccaggggcaaatagacgacttattcgaattcttta

SEQ ID NO: 14351 - DNA, 75 bp, Artificial Sequence
  Synthetic
aatgattattacaattctcaacataattacattagcagtcactgtgactgcaatgcctcctcgtaatacgaacgg

SEQ ID NO: 14352 - DNA, 75 bp, Artificial Sequence
  Synthetic
ttagaatgccacaattgctggttactaaaggggaaacaactgaagaatttatgaaatcaatcttgtttaggtaca

SEQ ID NO: 14353 - DNA, 75 bp, Artificial Sequence
  Synthetic
gggtcgatgcttttacggtggcaatatgtttcgccaaatcaactcaacatcaccaatgagcgaaatctgtgtcag

SEQ ID NO: 14354 - DNA, 75 bp, Artificial Sequence
  Synthetic
gagctttcctggctcaatttggtatccagatctaagcttaactgattctccagtttttcttttttctcttcctaa

SEQ ID NO: 14355 - DNA, 75 bp, Artificial Sequence
  Synthetic
atagcaggaaattcaaagaatctttatcaatacaaaacccagcacaactctttatagaacaggtactatttgcaa

SEQ ID NO: 14356 - DNA, 75 bp, Artificial Sequence
  Synthetic
atgtctatgtggtgcacacctttgttcagctgcttggattttattgtttatagttaattagtggagaacactact

SEQ ID NO: 14357 - DNA, 75 bp, Artificial Sequence
  Synthetic
attggttatcataaactggcagcaaatagggaagttatcgagtcaagtatgtcatactacaggttgtattatgtc

SEQ ID NO: 14358 - DNA, 75 bp, Artificial Sequence
  Synthetic
acaagcccatgattgattataccagcatacatgacagactttttggtatacaagatgatcctaacatagatgaca

SEQ ID NO: 14359 - DNA, 75 bp, Artificial Sequence
  Synthetic
aaaaattggttcgagtgcaatccagttcaagatattcttggaacttttatggtgttcgacgtaaatcatgagggc

SEQ ID NO: 14360 - DNA, 75 bp, Artificial Sequence
  Synthetic
ttcaagatattcttggaacttttatggtgttcgacgtaaatcatgagggcatcttagcacctaaaacatatgctt

SEQ ID NO: 14361 - DNA, 75 bp, Artificial Sequence
  Synthetic
gtacgatgataatagggaagaagacctttgttgagacgtatcgacagatacaaatagatcttaataaatttgaga

SEQ ID NO: 14362 - DNA, 75 bp, Artificial Sequence
  Synthetic
atcttagcacctaaaacatatgcttgtagagctacatgttcaataagcttagaacgagacaccggcaatgttata

SEQ ID NO: 14363 - DNA, 75 bp, Artificial Sequence
  Synthetic
tcaccaatcaagatgtcaaaaccatttatgcattttgtctaatgaatgatcctatattggtagcctgtgccaaca

SEQ ID NO: 14364 - DNA, 75 bp, Artificial Sequence
  Synthetic
ttggagtccccagcattaaatcattacactatacatgggacaactatcaagaatggctggtttaagacaaaagtc

SEQ ID NO: 14365 - DNA, 75 bp, Artificial Sequence
  Synthetic
atattttgctatctatgcatggcctgcaaatgaatcgtaacggaatgacatgttgtatgatgccagaaataaaat

SEQ ID NO: 14366 - DNA, 75 bp, Artificial Sequence
  Synthetic
tctatagatctggacaacacatgtgaggacctacatattacatgtggtcacaaaacccttaatgttcatgcatgc

SEQ ID NO: 14367 - DNA, 75 bp, Artificial Sequence
  Synthetic
ctctaaaagtaatataccactccccggctctggtgctacgagcatatgtacaagaaaataacaatatcaagggag

SEQ ID NO: 14368 - DNA, 75 bp, Artificial Sequence
  Synthetic
tttaggcaacataaatcatgtattcgttacttcaaggggtcaatcctccccgaaatcatgatcgagtcaatctgt

SEQ ID NO: 14369 - DNA, 75 bp, Artificial Sequence
  Synthetic
ctgaaccagatgaaatgcagcgtgatctgtaccatctagaggaattcattgccaaaactaaacttcgtgaaagta

SEQ ID NO: 14370 - DNA, 75 bp, Artificial Sequence
  Synthetic
tgtggctattatcttgacaaagacatatttagtgtatctgcttataccaattttttacccgtttgtgaagcttta

SEQ ID NO: 14371 - DNA, 75 bp, Artificial Sequence
  Synthetic
tgcaagctagaattgcaaaaaacgaacttaaaactatgggtagagactttaaatttgagatccaagaattaacaa

SEQ ID NO: 14372 - DNA, 75 bp, Artificial Sequence
  Synthetic
aattttatcagatatgttatgactatattaaatctactgagcataaaattaagatattcattttacctaaacgag

SEQ ID NO: 14373 - DNA, 75 bp, Artificial Sequence
  Synthetic
caattcatccttttagcccatgtccaacaatatgtatctgcgggatggtttataattctagtgaagccttaaaag

SEQ ID NO: 14374 - DNA, 75 bp, Artificial Sequence
  Synthetic
cttatactccaattgacttctgtggcatgattacaggtaatacattgaaagatcaatgctggtttactatacatt

SEQ ID NO: 14375 - DNA, 75 bp, Artificial Sequence
  Synthetic
tataattctagtgaagccttaaaagttcacagaaaatgcttaaactgcgctggttacaagactctgactaaaaca

SEQ ID NO: 14376 - DNA, 75 bp, Artificial Sequence
  Synthetic
atttaaagcaaattacagtaccggcaagaaaagcccagatagcaacatcgttagacttagagatacaaatagcct

SEQ ID NO: 14377 - DNA, 75 bp, Artificial Sequence
  Synthetic
acgagtcattgcgattaattgcacattttgcagacacatttattgctgagaattcaagaattccattccttaaac

SEQ ID NO: 14378 - DNA, 75 bp, Artificial Sequence
  Synthetic
aagttatatcaaatttcctatataagggtattcaaatgcaagtgctatacaataaaataaaggcttcgcgactta

SEQ ID NO: 14379 - DNA, 75 bp, Artificial Sequence
  Synthetic
tcttgcacacgtgaacaattgataatgattatattaacaatcctatgtattgcctcaatcattgtggttatatca

SEQ ID NO: 14380 - DNA, 75 bp, Artificial Sequence
  Synthetic
ggacaaaaatattgccaattttgttttacatgggcgatttagaacagcttgatgtagacaggtatgatgctgaaa

SEQ ID NO: 14381 - DNA, 75 bp, Artificial Sequence
  Synthetic
gcagtccacctgtatatacggatatgttatgtattttgtgcttattgcggaatggtacatgagaagaagggcctg

SEQ ID NO: 14382 - DNA, 75 bp, Artificial Sequence
  Synthetic
attggttatcacaaactggcagcaaatagagaagttattgagtcaagcatgtcatactataggttatattacgtc

SEQ ID NO: 14383 - DNA, 75 bp, Artificial Sequence
  Synthetic
aggcagaagagcagataacatggaacaattggcaggtatctagagaatttacaactggaccaattgacctgtcaa

SEQ ID NO: 14384 - DNA, 75 bp, Artificial Sequence
  Synthetic
attttactagataatttcacatctcattgcctcacgtgcatttgtcgcgataaaagcatacacagagctaacaat

SEQ ID NO: 14385 - DNA, 75 bp, Artificial Sequence
  Synthetic
taaaagcatacacagagctaacaataattgtgttgctccaatgaaatacaaaaccgccaagtataccaatctagt

SEQ ID NO: 14386 - DNA, 75 bp, Artificial Sequence
  Synthetic
taaaaggatatgggagatctataagaattgtaggggaagatacacgactgactgcagctgaattacaaatcaacc

SEQ ID NO: 14387 - DNA, 75 bp, Artificial Sequence
  Synthetic
gcatgagaaatgatatagtatcaaggcatggacagtctctgttgaacaagccacatggcttaaaatttgaaaaaa

SEQ ID NO: 14388 - DNA, 75 bp, Artificial Sequence
  Synthetic
tggatgaggtggaattcttggatgacaaactgcattatattgtctatcagttaagagatagaaaacgttattatt

SEQ ID NO: 14389 - DNA, 75 bp, Artificial Sequence
  Synthetic
aagacctacatattacttgcggccacaaaacccttaatgttcatgcatgcttcaggcaacataagtcatgtattc

SEQ ID NO: 14390 - DNA, 75 bp, Artificial Sequence
  Synthetic
agaactttcatcaacattaagcagtcatgaaattgaacttctcctgccaactgtcaagccatcatttgattacct

SEQ ID NO: 14391 - DNA, 75 bp, Artificial Sequence
  Synthetic
ataatatattgtccacaaatgcgatatatgagcataatgaaaggttaagccaaacaaggtccagaagaaataacc

SEQ ID NO: 14392 - DNA, 75 bp, Artificial Sequence
  Synthetic
catgaaattgaacttctcctgccaactgtcaagccatcatttgattacctaacaactaaatcatctacgtctaaa

SEQ ID NO: 14393 - DNA, 75 bp, Artificial Sequence
  Synthetic
ggtggatacctgtttgtccagtagcaatatcaaagtatattaatacagataggcccatactggatagaatagaaa

SEQ ID NO: 14394 - DNA, 75 bp, Artificial Sequence
  Synthetic
tgctcaatattgacaatactaagttaactagcctacaagtagctgttagcgatactgcaatggttaagaaagcag

SEQ ID NO: 14395 - DNA, 75 bp, Artificial Sequence
  Synthetic
ccagcagggccagacagcatacaatggagaacatatattcaaaataacaacttgcatttatgcaatgaccatgtt

SEQ ID NO: 14396 - DNA, 75 bp, Artificial Sequence
  Synthetic
ttttttacccgtttgtaaaactctatggcctattgctgcagagattctgcaagcaatgcaaaaattgcttgttgc

SEQ ID NO: 14397 - DNA, 75 bp, Artificial Sequence
  Synthetic
cacttgcaaaaatgtctttttttgaaggtccacctatacaatgtgggggtatagatctttcaaaattgatgcaga

SEQ ID NO: 14398 - DNA, 75 bp, Artificial Sequence
  Synthetic
cttgcatttatgcaatgaccatgttgtcaaaatgatatgccgctgcgtaatcaagcaggaggaatgcggttctac

SEQ ID NO: 14399 - DNA, 75 bp, Artificial Sequence
  Synthetic
cgattcatcctttcagcccctgcccaacaacatgtatctgtggaatggtttataattctactgaagctttaaagg

SEQ ID NO: 14400 - DNA, 75 bp, Artificial Sequence
  Synthetic
atcaaaccatcataaacttggatatcaacaagatttcctcaataagtttactggatctttgtagaatattctcat

SEQ ID NO: 14401 - DNA, 75 bp, Artificial Sequence
  Synthetic
ttcatagaacatgcttaaattgcactggctacaaaaccctgaccaaaacaaggtatttatgtaaaagaagactcc

SEQ ID NO: 14402 - DNA, 75 bp, Artificial Sequence
  Synthetic
actgtacacagtcatatcgagagcaatcccaggactggtcggtaacttactgcgacaaattcttaagtcccaaaa

SEQ ID NO: 14403 - DNA, 75 bp, Artificial Sequence
  Synthetic
gcaggggctattcaaatgatcaagatgcatttgagttcttatctgatgaagttatgaatgaagacatctctgaag

SEQ ID NO: 14404 - DNA, 75 bp, Artificial Sequence
  Synthetic
ccaatatggcattggccacaatcagcacagtactgttcttcactttcataacccctataacagctgaatgctaca

SEQ ID NO: 14405 - DNA, 75 bp, Artificial Sequence
  Synthetic
gtatgaggagtcattgcatgtcctaaataagattaagaaagacgtttcgaaggttaaccaactgaatggcatagt

SEQ ID NO: 14406 - DNA, 75 bp, Artificial Sequence
  Synthetic
agctagacagttcaccagttttaaaaatcacatatacaaagaagtctaattcgcaaaacacatttaaaaatgcta

SEQ ID NO: 14407 - DNA, 75 bp, Artificial Sequence
  Synthetic
attatacaagcttaccagcagattttcaagctgctatagatagaaataattcttgtacacgtgaacaactaataa

SEQ ID NO: 14408 - DNA, 75 bp, Artificial Sequence
  Synthetic
agaattcttgatacatattaattcgaagaatataacagaagaggttagggaattaagaattaggcctgatcttag

SEQ ID NO: 14409 - DNA, 75 bp, Artificial Sequence
  Synthetic
tagtaaaggctttagtacgtgaatgcgatcgatttgaagagatatttgatctttcagatgatggtttcacttcag

SEQ ID NO: 14410 - DNA, 75 bp, Artificial Sequence
  Synthetic
aattaagaattaggcctgatcttagtattagggggtccaagttcacaaacaaaaacccaggaacttccgacatca

SEQ ID NO: 14411 - DNA, 75 bp, Artificial Sequence
  Synthetic
atagcaatttggaactgttagaaaatctagtttggatactaaaccacttgaagaccaaccagtggtctacagaat

SEQ ID NO: 14412 - DNA, 75 bp, Artificial Sequence
  Synthetic
aagaatataacagaagaggttagggaattaagaattaggcctgatcttagtattagggggtccaagttcacaaac

SEQ ID NO: 14413 - DNA, 75 bp, Artificial Sequence
  Synthetic
tgcctcaatcattatggttatatcagcagtccacctatatatacgaatatattacgtattttgcgcttactgcgg

SEQ ID NO: 14414 - DNA, 75 bp, Artificial Sequence
  Synthetic
tgatggagtgtatccacatgtgcttatacagaaatgaaatggatcatatataccacaacttccaaataccagatg

SEQ ID NO: 14415 - DNA, 75 bp, Artificial Sequence
  Synthetic
aataagattaagaaagacgtttcgaaggttaaccaactgaatggcatagtagaattcttgatacatattaattcg

SEQ ID NO: 14416 - DNA, 75 bp, Artificial Sequence
  Synthetic
gctccaatggaggtgttaagttataccagcgaccaaataaacctctaacacttgtaggtgataaactttgtattg

SEQ ID NO: 14417 - DNA, 75 bp, Artificial Sequence
  Synthetic
tatttgtaacaaacccaattgaactgagtattaaatggttagatgtaatggaattcctagaaatgatcctttctc

SEQ ID NO: 14418 - DNA, 75 bp, Artificial Sequence
  Synthetic
aaactgccaaatataccaacctactgtgcattatcttcctgattattattgccgtcactcctgcttttagtgttt

SEQ ID NO: 14419 - DNA, 75 bp, Artificial Sequence
  Synthetic
acgattttaagtctgaaccctggatatcgataatgaatcattctatcacaaaagctattgattactcacgtttag

SEQ ID NO: 14420 - DNA, 75 bp, Artificial Sequence
  Synthetic
agcataaaaagacaagtgcacaagcaaatatatccaaattcataaagggaaagaagatgggtggtcgatcaaaat

SEQ ID NO: 14421 - DNA, 75 bp, Artificial Sequence
  Synthetic
cgactcctcaaaacaggtgaatgtaaaatagcaggggttttatctagaattgcagtgtcaataaatcagaaaaat

SEQ ID NO: 14422 - DNA, 75 bp, Artificial Sequence
  Synthetic
tgcagtgtcaataaatcagaaaaattataaatactctgctatagttcataagaagagtgatttggttgatgagta

SEQ ID NO: 14423 - DNA, 75 bp, Artificial Sequence
  Synthetic
ttgatttttaaatgagttgatggagatcagtacgattttattgacaaagtatgtttagaataagtatattattgc

SEQ ID NO: 14424 - DNA, 75 bp, Artificial Sequence
  Synthetic
agaagagtgatttggttgatgagtattgtctaagcccaaattgcgatttagattgctacccttattattcagcca

SEQ ID NO: 14425 - DNA, 75 bp, Artificial Sequence
  Synthetic
agtagtgaactaccacaacaaaatgattattacaattctcaacgtgcttacattagtagtcactgtgactgcaat

SEQ ID NO: 14426 - DNA, 75 bp, Artificial Sequence
  Synthetic
tcagcaggaccagacagcatacaacggagaacatatattcaaaataacaatttacacttatgcaatgatcatgtt

SEQ ID NO: 14427 - DNA, 75 bp, Artificial Sequence
  Synthetic
gatggagatcagtacgattttattgacaaagtatgtttagaataagtatattattgcatttaggggcacactact

SEQ ID NO: 14428 - DNA, 75 bp, Artificial Sequence
  Synthetic
cgatgcttttatggtggcgacatgtttcgccagatcaattcaacatcaccaatgagtgaaatctgtgtcagagat

SEQ ID NO: 14429 - DNA, 75 bp, Artificial Sequence
  Synthetic
acctagctgactgctcttggagtgaatcaactcattccactttgagccaaaaagtgatatcccatacagacatag

SEQ ID NO: 14430 - DNA, 75 bp, Artificial Sequence
  Synthetic
aatcatttatatctagtgttaaactctccttgcacaatgatctggtccagcaccatttcaggccactaagcaaca

SEQ ID NO: 14431 - DNA, 75 bp, Artificial Sequence
  Synthetic
aaaataatcagctgaatggcatagtagaatttctgatacatattaattcgaaaaatataactgaagaggttagag

SEQ ID NO: 14432 - DNA, 75 bp, Artificial Sequence
  Synthetic
ttcgatgtgaatcatgagggcattttagcacctaagacatatgcttgcagagctacctgctcaataagcttggaa

SEQ ID NO: 14433 - DNA, 75 bp, Artificial Sequence
  Synthetic
ttgcaagatcacaaaggtaacaccctctttgacattatagcatatgtgaaaagtgcgcgtgtagttgcgacatat

SEQ ID NO: 14434 - DNA, 75 bp, Artificial Sequence
  Synthetic
aattgagaatcaggcctgatcgtagtatcagaggatcaaaattcacagacaagaacccaggaacccccggcatca

SEQ ID NO: 14435 - DNA, 75 bp, Artificial Sequence
  Synthetic
cgagacactggcaatgttgtgttggaatccccagcattaaaccattataccatacatgggacaactatcaagaat

SEQ ID NO: 14436 - DNA, 75 bp, Artificial Sequence
  Synthetic
aaccatgactataaaacagggcccacagtaagcatcaatgttcaacataatgagcaatgcacaggatcctgcccc

SEQ ID NO: 14437 - DNA, 75 bp, Artificial Sequence
  Synthetic
gctccaatgggggcgtcaagttataccagcgaccaaacaagcctctagcacttgtaggcaataagctttgcattg

SEQ ID NO: 14438 - DNA, 75 bp, Artificial Sequence
  Synthetic
agtagtatacctaaaaaagataattggctaaccttctctcgcgagcataccagcacctggggttgtgaagaatgg

SEQ ID NO: 14439 - DNA, 75 bp, Artificial Sequence
  Synthetic
gtgataaatactgtatgatagcattcgacccaatggtgatagacgagaatatacaaaaactggattgttatagcc

SEQ ID NO: 14440 - DNA, 75 bp, Artificial Sequence
  Synthetic
ggttgcttagcaataggaacaggatgtgtgtatggatcttgccaagatgttatcagagaagaagcaacagttatt

SEQ ID NO: 14441 - DNA, 75 bp, Artificial Sequence
  Synthetic
ggcaacataagtcatgtattcgttacttcaaggggtcaatcctacctgaagtcatgattgagtcaatctgtacaa

SEQ ID NO: 14442 - DNA, 75 bp, Artificial Sequence
  Synthetic
gtcatgattgagtcaatctgtacaaatgcagagctgatattattatgctgcttttctgcaatttcttgttttgtg

SEQ ID NO: 14443 - DNA, 75 bp, Artificial Sequence
  Synthetic
atgcagagctgatattattatgctgcttttctgcaatttcttgttttgtggctatcatcttgacaaagacatatt

SEQ ID NO: 14444 - DNA, 75 bp, Artificial Sequence
  Synthetic
agaagagcgatttagttgatgagtattgtctaagcccaaattgtgacttagattgctacccttattatccagcta

SEQ ID NO: 14445 - DNA, 75 bp, Artificial Sequence
  Synthetic
tagtatatctgctcataccaattttttacccgtttgtaaagctctatggcctattgctgcagagattctgcaagc

SEQ ID NO: 14446 - DNA, 75 bp, Artificial Sequence
  Synthetic
tcatcctttcagtccctgcccaacaacatgtatctgtggaatggtttataattctactgaagctttgaaagttca

SEQ ID NO: 14447 - DNA, 75 bp, Artificial Sequence
  Synthetic
tgtacagggggtcaataaacaagaaaggtgtattcaaccctcagtgtggttcagtccagtcatttgatggtaaac

SEQ ID NO: 14448 - DNA, 75 bp, Artificial Sequence
  Synthetic
tgactacatttgccatgcattatcaaggaaagacatagttgtgagaaaatgttacgaaaatcactattattcatg

SEQ ID NO: 14449 - DNA, 75 bp, Artificial Sequence
  Synthetic
acataacattctcaataccattaatgactggactgtcgcaaggtttcacattgcaagaccataaaggcaatactc

SEQ ID NO: 14450 - DNA, 75 bp, Artificial Sequence
  Synthetic
cgctacactcaaggaggctatggaaatcaaatcgaatatcacgaattctaaaactatgctttataacgataatgc

SEQ ID NO: 14451 - DNA, 75 bp, Artificial Sequence
  Synthetic
ctataacagctgaatgctacaattatacgagcttaccagcagattttcaagctgccatagataaaaacaattctt

SEQ ID NO: 14452 - DNA, 75 bp, Artificial Sequence
  Synthetic
tttactcggcagtgcatcaataaagataatgttaggcgacctaatatatcaacaagcttcagtgcaagaaagaga

SEQ ID NO: 14453 - DNA, 75 bp, Artificial Sequence
  Synthetic
gtacacgtgaacaactaataatgatcatattaacaatcctatgtattgcctcaaccattatggttatatcagcag

SEQ ID NO: 14454 - DNA, 75 bp, Artificial Sequence
  Synthetic
cagtaagtatcaatgttcagcacaatgagcaatgcacgggatcctgccccagcagtataccaaaaaaggataatt

SEQ ID NO: 14455 - DNA, 75 bp, Artificial Sequence
  Synthetic
ggctaaccttctctcgtgaacatactagcacctggggttgtgaagaatggggttgcttagcaataggcacggggt

SEQ ID NO: 14456 - DNA, 75 bp, Artificial Sequence
  Synthetic
tcaaccattatggttatatcagcagtccacctgtatatacgaatatattatgtattttgcgcttactgcggaatg

SEQ ID NO: 14457 - DNA, 75 bp, Artificial Sequence
  Synthetic
aacaagcttcagtgcaagaaagagacataaggggccatgcaacttgtggaggctgcacagattgttttaacgatg

SEQ ID NO: 14458 - DNA, 75 bp, Artificial Sequence
  Synthetic
aaatggtgtttatcagtgcccaatagtgtcttcctgtgattcttatatcaataatgtttatattaatgaaggaac

SEQ ID NO: 14459 - DNA, 75 bp, Artificial Sequence
  Synthetic
tactagataatttcacatctcattgccttacatgcatctgtcgtgacaaaagcatacacagagccaacaataatt

SEQ ID NO: 14460 - DNA, 75 bp, Artificial Sequence
  Synthetic
tagcacctggggttgtgaagaatggggttgcttagcaataggcacggggtgtgtatatgggtcttgccaagatgt

SEQ ID NO: 14461 - DNA, 75 bp, Artificial Sequence
  Synthetic
gtgttactccaatgaaatacaaaactgccaaatataccaacctactgtgcattatcttgctgattattattgccg

SEQ ID NO: 14462 - DNA, 75 bp, Artificial Sequence
  Synthetic
aatgtacttgaaccagtattgggagaacatatgcaatttgaggtccacagtgtacagactaatctattgcctgag

SEQ ID NO: 14463 - DNA, 75 bp, Artificial Sequence
  Synthetic
gtatttgtggtaaagagatacctgtcaaatctgagataattaaggatacaaagaaactggatttagctagtgctg

SEQ ID NO: 14464 - DNA, 75 bp, Artificial Sequence
  Synthetic
tcactcctgcttttagtgcttgcatacaagaaaaagaaatcgaaacaatagatgatgctgcaatgtgtattggcc

SEQ ID NO: 14465 - DNA, 75 bp, Artificial Sequence
  Synthetic
tgtatcaaaatataactcagccaaaggagtacaatacctttgtgaaagaactctcatcaacattaagcagtcacg

SEQ ID NO: 14466 - DNA, 75 bp, Artificial Sequence
  Synthetic
agaaaggatatagtcgtaaggaaatgttatgaaaaccactactattcgtgcgctacactcaaagaagctgtagaa

SEQ ID NO: 14467 - DNA, 75 bp, Artificial Sequence
  Synthetic
gttttgcttacattagccataattgtcagtatcctgatccttataaaagtgataaggccactggcaagatatgtt

SEQ ID NO: 14468 - DNA, 75 bp, Artificial Sequence
  Synthetic
ttcatagtgctactattcatgaatttatagctgctaatctataccccaacaacttcaaaaagcacttggcgtcag

SEQ ID NO: 14469 - DNA, 75 bp, Artificial Sequence
  Synthetic
gtcgcaatacttaaagaaaatgacaaagtgtataaactggaaaataagctgaaataatctggtttgactagacat

SEQ ID NO: 14470 - DNA, 75 bp, Artificial Sequence
  Synthetic
ataatgttaggcgacttaatataccagcaaacatcagtgcaagagaaagacataaggggccatgcaacttgtgga

SEQ ID NO: 14471 - DNA, 75 bp, Artificial Sequence
  Synthetic
aaatggtgtttatcagtgcccggtagtgtcttcttgtgattcctatatcaataatgtttatataaatgaaggcac

SEQ ID NO: 14472 - DNA, 75 bp, Artificial Sequence
  Synthetic
aacttcaaaaagcacttggcgtcagcaggaccaggcagcatacagtggagaacatatattcaaaataacaattta

SEQ ID NO: 14473 - DNA, 75 bp, Artificial Sequence
  Synthetic
cacttatgcaatgatcatgttgtcaaaatgatatgccgttgtgtgattaagcaagaggaatgcagctctacaaaa

SEQ ID NO: 14474 - DNA, 75 bp, Artificial Sequence
  Synthetic
aataagctgaaataatctggtttgactagacataatgggagggtggtgggagttttctgctgatataataattat

SEQ ID NO: 14475 - DNA, 75 bp, Artificial Sequence
  Synthetic
attacattagcagtcattgtgactgcaatgcctcctcgcaatacgaatgggggtcgatgcttttatggtggtaat

SEQ ID NO: 14476 - DNA, 75 bp, Artificial Sequence
  Synthetic
gtggatgatggcgaacagattgcacagtactataaaagaaacaaagaattttataaagctgatttggagatatta

SEQ ID NO: 14477 - DNA, 75 bp, Artificial Sequence
  Synthetic
caccaatgagcgaaatctgcgtcagagatgacatatccctggttaaatccattggttatcacaaactggcagcaa

SEQ ID NO: 14478 - DNA, 75 bp, Artificial Sequence
  Synthetic
aaaaagctagatttggctagtgccgaccaaacatcctatatcaaagagtttgacaaaaaatgcgccacatggcta

SEQ ID NO: 14479 - DNA, 75 bp, Artificial Sequence
  Synthetic
agtactataaaagaaacaaagaattttataaagctgatttggagatattatacacagtcatatcaagagcaatcc

SEQ ID NO: 14480 - DNA, 75 bp, Artificial Sequence
  Synthetic
gctttgtcttagaaccattatggaatgaattaagcttgtgggggaaatatgtcctacttgcattagctataatta

SEQ ID NO: 14481 - DNA, 75 bp, Artificial Sequence
  Synthetic
gtagagctacatgttcaataagcttagaacgggacaccggcaatgttgtattggagtccccagcattaaatcatt

SEQ ID NO: 14482 - DNA, 75 bp, Artificial Sequence
  Synthetic
tcagtgtcctgatccttgtgaaagtaataaggccattggcaagatacattgttgcagtacttaaagagaatgaca

SEQ ID NO: 14483 - DNA, 75 bp, Artificial Sequence
  Synthetic
gagaatcaggcctgatctcagtatcagaggatcaaaattcacagacaagaacccaggaattcccgacatcaaaga

SEQ ID NO: 14484 - DNA, 75 bp, Artificial Sequence
  Synthetic
aacaagctgaaataatcaaatcaaaatagacttaatgggagggcggtgggagttttctgctgatataataattat

SEQ ID NO: 14485 - DNA, 75 bp, Artificial Sequence
  Synthetic
caaaacccttaatgttcatgcatgctttaggcaacataaatcatgtattcgttacttcaaggggtcaatcctacc

SEQ ID NO: 14486 - DNA, 75 bp, Artificial Sequence
  Synthetic
tgaaatcatgatcgagtcgatttgtacaaatacagagctgatattactatgctgtttctctgcaatctcttgctt

SEQ ID NO: 14487 - DNA, 75 bp, Artificial Sequence
  Synthetic
tactacagattgtattatgtcaagaattggttcgagtgcaatccagttcaagatattcttggaacctttatggtg

SEQ ID NO: 14488 - DNA, 75 bp, Artificial Sequence
  Synthetic
acccctataacagctgaatgctataattacacgagcttaccagcagattttcaagctgctatagataaaaataat

SEQ ID NO: 14489 - DNA, 75 bp, Artificial Sequence
  Synthetic
tcaagctgctatagataaaaataattcttgcacacgtgaacaattaataatgatcatattaacaatcctatgtat

SEQ ID NO: 14490 - DNA, 75 bp, Artificial Sequence
  Synthetic
tgatatctcacacagatatagaatcatttatatctagtgttaagctctccttgcataatgatctaatccagcacc

SEQ ID NO: 14491 - DNA, 75 bp, Artificial Sequence
  Synthetic
attttaggccgctaagtaatatgccacatgtaaagcccaacttcaagtcaataaatgttcaaggaacaatttctg

SEQ ID NO: 14492 - DNA, 75 bp, Artificial Sequence
  Synthetic
gttatgtattttgtgcttattgcggaatggtacacgaaaagaagggcctgattttactagataatttcacatctc

SEQ ID NO: 14493 - DNA, 75 bp, Artificial Sequence
  Synthetic
ataaatgttcaaggaacaatttctggtggcaagattcaagacagctacataacattctcaataccattaatgact

SEQ ID NO: 14494 - DNA, 75 bp, Artificial Sequence
  Synthetic
attttactagataatttcacatctcattgccttacgtgcatttgtcgcgataaaagcatacacagagccaacaat

SEQ ID NO: 14495 - DNA, 75 bp, Artificial Sequence
  Synthetic
attgccttacgtgcatttgtcgcgataaaagcatacacagagccaacaataattgtgttgctccgatgaaataca

SEQ ID NO: 14496 - DNA, 75 bp, Artificial Sequence
  Synthetic
aagaccataaaggcaataccctcttcgacattatagcatatgtgaaaagtgcacgtgtaattgcaacatataatc

SEQ ID NO: 14497 - DNA, 75 bp, Artificial Sequence
  Synthetic
cgacattatagcatatgtgaaaagtgcacgtgtaattgcaacatataatcatgagtacaagacaggacctacagt

SEQ ID NO: 14498 - DNA, 75 bp, Artificial Sequence
  Synthetic
gtgcattgtcttcttgattatcattgctgttacccctgcttttagtgcttgcatacaagaaaaagaaatagaaac

SEQ ID NO: 14499 - DNA, 75 bp, Artificial Sequence
  Synthetic
gcatacaagaaaaagaaatagaaacaattgatgatgctgcaatgtgcattggtctataccaaaatataacccacc

SEQ ID NO: 14500 - DNA, 75 bp, Artificial Sequence
  Synthetic
caaaggaatacaatgcctttgtgaaagaactttcatcaacattaagcagtcatgaaattgaactcctcctgccag

SEQ ID NO: 14501 - DNA, 75 bp, Artificial Sequence
  Synthetic
catgaaattgaactcctcctgccagctgtcaagccatcattcgattatctgacaactaaatcatctacatctaaa

SEQ ID NO: 14502 - DNA, 75 bp, Artificial Sequence
  Synthetic
gagtaaataatgaacagctagaagttgaattttgcgtttcagagcctacaagcacaatgtgcaatactatcaatg

SEQ ID NO: 14503 - DNA, 75 bp, Artificial Sequence
  Synthetic
tgtattttgtgcttattgcggaatggtgcatgaaaagaagggcctagttttactagataatttcacatctcattg

SEQ ID NO: 14504 - DNA, 75 bp, Artificial Sequence
  Synthetic
tactcgaaccagtattgggagagcacatgcaatttgaagtccacagtgtacagactaatctgttgcctgaggtag

SEQ ID NO: 14505 - DNA, 75 bp, Artificial Sequence
  Synthetic
tcaagcaagaggaatgcagctctacaaaagtagatgatggagaacagattgtgcattactataagaggaacaaag

SEQ ID NO: 14506 - DNA, 75 bp, Artificial Sequence
  Synthetic
aaaagtagatgatggagaacagattgtgcattactataagaggaacaaagaattttatcaagctgatctggagat

SEQ ID NO: 14507 - DNA, 75 bp, Artificial Sequence
  Synthetic
acaagagaaagaaatagaaacaatagatgatgctgcaatgtgcattggtctataccaaaatataacccaaccaaa

SEQ ID NO: 14508 - DNA, 75 bp, Artificial Sequence
  Synthetic
actgtacacagtcatatcgagagcaatcccaggactggtcggtaatttactgcgacaagttcttaagtcccaaaa

SEQ ID NO: 14509 - DNA, 75 bp, Artificial Sequence
  Synthetic
tacatttgccatgcattatcaagaaaggatatagtcgtaaggaaatgttatgaaaatcactactattcctgcgct

SEQ ID NO: 14510 - DNA, 75 bp, Artificial Sequence
  Synthetic
acactcaaagaagctgtagaaattaaaccaaacatcacaaattctaagactatgctttacaatgataatgcttta

SEQ ID NO: 14511 - DNA, 75 bp, Artificial Sequence
  Synthetic
aaccaaacatcacaaattctaagactatgctttacaatgataatgctttacttggtagtgcatctgtaaagataa

SEQ ID NO: 14512 - DNA, 75 bp, Artificial Sequence
  Synthetic
aagaacccaggaactcccaacatcaaagaatgccaaactccaatgtttattacatgtactgggaagagatttcga

SEQ ID NO: 14513 - DNA, 75 bp, Artificial Sequence
  Synthetic
aagaatgccaaactccaatgtttattacatgtactgggaagagatttcgatcactaatgaaacagtatattgctt

SEQ ID NO: 14514 - DNA, 75 bp, Artificial Sequence
  Synthetic
tcactaatgaaacagtatattgcttgctccaatggaggtgttaagttataccagcgaccaaacaaacctctaaca

SEQ ID NO: 14515 - DNA, 75 bp, Artificial Sequence
  Synthetic
aaatgatatgccgctgcgtaatcaagcaggaggaatgcggctctacaaaaatagatgatggagagcagattgtgc

SEQ ID NO: 14516 - DNA, 75 bp, Artificial Sequence
  Synthetic
tgtttatataaatgaaggcacaaatgatgtcaacttgaaattccgatgccttaaggcagaaatcaagattagtat

SEQ ID NO: 14517 - DNA, 75 bp, Artificial Sequence
  Synthetic
cttgtaggcgataagctttgcattggtgacagatactgtatgatagcatttgacccaatggtaatagatgaaaat

SEQ ID NO: 14518 - DNA, 75 bp, Artificial Sequence
  Synthetic
atagatgatggagagcagattgtgcattactataagggaaacaaagaactttataaagccgatctggggatactg

SEQ ID NO: 14519 - DNA, 75 bp, Artificial Sequence
  Synthetic
atacaaaaactggattgttatagtttggctgctacagaccaatcaaatgggatgttgaaacctgaaaggtctatt

SEQ ID NO: 14520 - DNA, 75 bp, Artificial Sequence
  Synthetic
aacgtcctatatcaaagagtttgacaaaaaatgcgccacatggctatgcagagcttataatgaagggattggctt

SEQ ID NO: 14521 - DNA, 75 bp, Artificial Sequence
  Synthetic
aggccattggcaagatacgttgttgcagtacttaaagagaatgacaaagtgtacaaattagaaaataagctgaaa

SEQ ID NO: 14522 - DNA, 75 bp, Artificial Sequence
  Synthetic
gattgctacccttattattcagccaacctagctgactgctcttggagtgaatcaactcattctactttgagccaa

SEQ ID NO: 14523 - DNA, 75 bp, Artificial Sequence
  Synthetic
taaaatagacataatgggagggtggtgggagttttctgctgatataataattatttgttgtggtagaacactact

SEQ ID NO: 14524 - DNA, 75 bp, Artificial Sequence
  Synthetic
ctccttgcacaatgatctgatccagcaccatttcaggccactaagcaacatgccacatataaagcccaatttcaa

SEQ ID NO: 14525 - DNA, 75 bp, Artificial Sequence
  Synthetic
agtagtgaactccactattaactacgcattgcaatggcaaatcaattcattttcaacgatgttccacaacggaat

SEQ ID NO: 14526 - DNA, 75 bp, Artificial Sequence
  Synthetic
ttgaaacctgaaaggtctattcgactcctcaaaacaggcgagtgtaaaatagcaggggttttatctagaattgca

SEQ ID NO: 14527 - DNA, 75 bp, Artificial Sequence
  Synthetic
gaatggctggttcaagacaaaggtctctatagatctggacaacacctgtgaagacctacatattacttgcggcca

SEQ ID NO: 14528 - DNA, 75 bp, Artificial Sequence
  Synthetic
ggttgcttagcaataggcacggggtgtgtgtatgggtcttgccaagatgtcattagagaagaagcaacagttatt

SEQ ID NO: 14529 - DNA, 75 bp, Artificial Sequence
  Synthetic
aagttgaattttgtgtttcagagcctacaggtacaatgtgtaataccatcaatgtacttgaaccagtactgggag

SEQ ID NO: 14530 - DNA, 75 bp, Artificial Sequence
  Synthetic
tgaagtcatgattgagtcaatctgtacaaatgcagagctgatattattatgctgcttttctgcaatttcttgctt

SEQ ID NO: 14531 - DNA, 75 bp, Artificial Sequence
  Synthetic
gcagcaagattcaagacagctatataacattctcaataccattgatgactggactatcgcagggtttcacattgc

SEQ ID NO: 14532 - DNA, 75 bp, Artificial Sequence
  Synthetic
atcaaatcaaatatcacaaattctaaaactatgctttataacgacaatgctttactcggtagtgcatcaataaag

SEQ ID NO: 14533 - DNA, 75 bp, Artificial Sequence
  Synthetic
aatggtgcatgaaaagaagggcctaatcttactagataatttcacatctcattgccttacatgcatctgtcgtga

SEQ ID NO: 14534 - DNA, 75 bp, Artificial Sequence
  Synthetic
gtatttgtggtaaagagatacctgtcaaatctgagataattaaggatacaaagaagctggatttagctagtgctg

SEQ ID NO: 14535 - DNA, 75 bp, Artificial Sequence
  Synthetic
caaatctgagataattaaggatacaaagaagctggatttagctagtgctgatcaaacatcctatatcaaagagtt

SEQ ID NO: 14536 - DNA, 75 bp, Artificial Sequence
  Synthetic
caaaagcttacacagagctaacaataattgtgttgctccaatgaaatacaagactgccaaatataccaacctact

SEQ ID NO: 14537 - DNA, 75 bp, Artificial Sequence
  Synthetic
cagactaatctattacctgaagtggctttgatcaaaaataggaaggtgtacaagggatcaataaacaagaaaggt

SEQ ID NO: 14538 - DNA, 75 bp, Artificial Sequence
  Synthetic
gtgcattatctttctaattattattgccgtcactcctgcttttagtacttgcatacaagaaaaggaaatcgaaac

SEQ ID NO: 14539 - DNA, 75 bp, Artificial Sequence
  Synthetic
aatagatgatgctgcaatgtgtattggcctgtatcaaaatataactcagccaaaggagtacaatacctttgtgaa

SEQ ID NO: 14540 - DNA, 75 bp, Artificial Sequence
  Synthetic
gtcttgcttgcattagccataattatcagtatcctgatctttataaaagtgataaggccactggcaagatatatt

SEQ ID NO: 14541 - DNA, 75 bp, Artificial Sequence
  Synthetic
cgaaaatcactactattcatgcgctacactcaaggaggctgtagaaaccaaattgaatatcacaaattctaaaac

SEQ ID NO: 14542 - DNA, 75 bp, Artificial Sequence
  Synthetic
agaactctcatcaacattaagcagtcacgagattgaatttctcctaccagctgtgaaaccatcattcgattattt

SEQ ID NO: 14543 - DNA, 75 bp, Artificial Sequence
  Synthetic
aataagctgaaataatctaatttaaatagacataatgggagggtggtgggagttttctgctgatataataattat

SEQ ID NO: 14544 - DNA, 75 bp, Artificial Sequence
  Synthetic
tgtacccctaaatacaatcatacaatggaaaattacaaaatcaatcagtacagagctcgcatcgccgagtccact

SEQ ID NO: 14545 - DNA, 75 bp, Artificial Sequence
  Synthetic
agcatcagtgcaagagagagacataaggggctatgcaacttgtggaggctgcacagattgttttaacgatgttgc

SEQ ID NO: 14546 - DNA, 75 bp, Artificial Sequence
  Synthetic
gcacagattgttttaacgatgttgcgtgtaaaatcagcatgacttcaaatggtgtttatcagtgtccaatagtgt

SEQ ID NO: 14547 - DNA, 75 bp, Artificial Sequence
  Synthetic
gatccagagactgccaaggacattatagcagacttaatgatggagcggcacaattactttggtaaagaattgtgc

SEQ ID NO: 14548 - DNA, 75 bp, Artificial Sequence
  Synthetic
tatttcttagacatagagtatcgaaacgatacttctatagtggatattcttcaagacttcttgcctccgggtaca

SEQ ID NO: 14549 - DNA, 75 bp, Artificial Sequence
  Synthetic
gtcaaaatgatatgccgttgtgtgattaagcaagaggaatgcagctctacaaaagcggatgatggtggacagatt

SEQ ID NO: 14550 - DNA, 75 bp, Artificial Sequence
  Synthetic
aaaagcggatgatggtggacagattgcacagtactacaaacaaaacaaagaattttataaagctgatctggagat

SEQ ID NO: 14551 - DNA, 75 bp, Artificial Sequence
  Synthetic
gagtgtcatccaagatattgcactcctgataattacgtcattcacaatgggaaattgtatgtcatagactacaag

SEQ ID NO: 14552 - DNA, 75 bp, Artificial Sequence
  Synthetic
gttgctgttgacgatgaatcaagtaaaagaacattcgaaaaatatgataagatttttggcgatgtcttgatacct

SEQ ID NO: 14553 - DNA, 75 bp, Artificial Sequence
  Synthetic
aataagataaagaaagatgtttcaaaaaataatcagctgaatggcatagtagaatttctaatgcatattaattca

SEQ ID NO: 14554 - DNA, 75 bp, Artificial Sequence
  Synthetic
ctgggtttggaatatgagattgtgatagttagggctgacccagttagagatctggtccactgcaattctgatgag

SEQ ID NO: 14555 - DNA, 75 bp, Artificial Sequence
  Synthetic
caaaatataactgaagaggttagagaattgagaatcagacctgatctcagtatcagaggatcaaaattcacagac

SEQ ID NO: 14556 - DNA, 75 bp, Artificial Sequence
  Synthetic
aattgagaatcagacctgatctcagtatcagaggatcaaaattcacagacaagaacccaggaactcctgacgtca

SEQ ID NO: 14557 - DNA, 75 bp, Artificial Sequence
  Synthetic
tttatccatatttttgggaacctcaatttgaacctagacttcacttggttttacaatctgagaggcctagtttat

SEQ ID NO: 14558 - DNA, 75 bp, Artificial Sequence
  Synthetic
gacaagtacaaggatgacgagagatttcttgagatagttagtcaaggagaatttacgatgaccggaccttggcta

SEQ ID NO: 14559 - DNA, 75 bp, Artificial Sequence
  Synthetic
gatgatcctacgccagaattatatgatcacccgatattcttagaattctataattctctggatgatagatccaaa

SEQ ID NO: 14560 - DNA, 75 bp, Artificial Sequence
  Synthetic
ttaaatagacataacgggagggtggtgggagttttctgctgatataataattatttgttgtggtagaacactact

SEQ ID NO: 14561 - DNA, 75 bp, Artificial Sequence
  Synthetic
gctgtcttccacagatccctcaactttgatgcaactaagggagacaaatggaatcagaatttagtggaagtcttg

SEQ ID NO: 14562 - DNA, 75 bp, Artificial Sequence
  Synthetic
tagctgcaacagaccaatcagatggaatgctgaaacctgagaggtctattcgactcctcaaaacaggcgaatgta

SEQ ID NO: 14563 - DNA, 75 bp, Artificial Sequence
  Synthetic
aagcaatatgagccagattatagtcaatttgtgaaaaatgcatctactgggattttcagatgcgatgggaattat

SEQ ID NO: 14564 - DNA, 75 bp, Artificial Sequence
  Synthetic
gcctttacgctccatcgcatctcgggctacttagctcgctgggttgctgagcagtgcaaggctaatcagatcaaa

SEQ ID NO: 14565 - DNA, 75 bp, Artificial Sequence
  Synthetic
agatagcaggggcattatccagaattgcagtatcaataaatcaaaaaaattataaatactccactatagttcata

SEQ ID NO: 14566 - DNA, 75 bp, Artificial Sequence
  Synthetic
tataaatactccactatagttcataagaagagcgatttagttgatgagtattgtctaagcccaaattgtgacata

SEQ ID NO: 14567 - DNA, 75 bp, Artificial Sequence
  Synthetic
ttgtctaagcccaaattgtgacatagattgctacccttattacccagccaacctagttgactgctcttggagtga

SEQ ID NO: 14568 - DNA, 75 bp, Artificial Sequence
  Synthetic
ccaaagcccagtaatttggaaataacacaaggatgggcagagatgagtgcaaggatcgcaaatgaacgagagatc

SEQ ID NO: 14569 - DNA, 75 bp, Artificial Sequence
  Synthetic
accactgacatcaataaacagaaaccttcaatccacttcatctgggcccccccaggtcctggttctaatgagaat

SEQ ID NO: 14570 - DNA, 75 bp, Artificial Sequence
  Synthetic
aatcattcatatctagtgttaagctctccttacataatgatctgatccaacaccattttaggccgctaagtaata

SEQ ID NO: 14571 - DNA, 75 bp, Artificial Sequence
  Synthetic
atctcaaagttaataaacctgtcaaagcatttacagaatttggatggcacaagctcatacctatctgcatttaaa

SEQ ID NO: 14572 - DNA, 75 bp, Artificial Sequence
  Synthetic
ctccttacataatgatctgatccaacaccattttaggccgctaagtaatatgccacatgtgaagcccaacttcaa

SEQ ID NO: 14573 - DNA, 75 bp, Artificial Sequence
  Synthetic
agcatgggaaggctgatggacttttcttcaaatatagggctttatgaatcccatacaagcaagctgaaaaatatg

SEQ ID NO: 14574 - DNA, 75 bp, Artificial Sequence
  Synthetic
ctcagttgcccaaatatcctgggccaaatctggcttctcacctgcagctagagctttcctggctcaatttggtat

SEQ ID NO: 14575 - DNA, 75 bp, Artificial Sequence
  Synthetic
gctcggcagactcacaggcgattagataataaaatcgaacctatcacaattggcgactcaactatcttatgggaa

SEQ ID NO: 14576 - DNA, 75 bp, Artificial Sequence
  Synthetic
gactggactatcgcaaggtttcacattgcaagaccatagaggcaataccctcttcgacattattgcatatgtgaa

SEQ ID NO: 14577 - DNA, 75 bp, Artificial Sequence
  Synthetic
cagcaatttaagttcgatacaaatgttataacccagactgataaagctaggttattcaaagattttattgggata

SEQ ID NO: 14578 - DNA, 75 bp, Artificial Sequence
  Synthetic
ggtggacataagcaattctcaaagaaaactttagacgacatggattttactaagccgactattctggacttcaac

SEQ ID NO: 14579 - DNA, 75 bp, Artificial Sequence
  Synthetic
aataagaatgttgtagatgcttgcaatttccagtataacaatgttaagaaaatgctaagcttgccgaataactta

SEQ ID NO: 14580 - DNA, 75 bp, Artificial Sequence
  Synthetic
gaaaagttgggttgctacctcgaagaatatggccagaagataagcgaatcatcacctatggcttgggacagcata

SEQ ID NO: 14581 - DNA, 75 bp, Artificial Sequence
  Synthetic
aatgtacttgaaccggtattgggagaacacatgcaatttgaagtccacagtgtacagactaatctattgccagag

SEQ ID NO: 14582 - DNA, 75 bp, Artificial Sequence
  Synthetic
aagacaatatgcagcactatgttctggtctgcaattaaggatttctctacacttatgaaaaacatgctagccgtg

SEQ ID NO: 14583 - DNA, 75 bp, Artificial Sequence
  Synthetic
aacacatgcaatttgaagtccacagtgtacagactaatctattgccagagatagctttaattaaaaatagaagag

SEQ ID NO: 14584 - DNA, 75 bp, Artificial Sequence
  Synthetic
tctcagtacaatcgccataacacattcagagttgtaacttgtgcaaataataatgtcttcggtatagttatgcca

SEQ ID NO: 14585 - DNA, 75 bp, Artificial Sequence
  Synthetic
tcagttcaatcatttgatggtaaactttacggcattgggaacccaaagtttgattacatttgccacgcattatca

SEQ ID NO: 14586 - DNA, 75 bp, Artificial Sequence
  Synthetic
tcttcagacattaaaacaaagagagcaactttagcattctttactattgtcatccacgctgaaagagactgtata

SEQ ID NO: 14587 - DNA, 75 bp, Artificial Sequence
  Synthetic
acccttaatgttcatgcatgcttcagacaacataagtcatgtattcgttacttcaaggggtcaatcctacctgaa

SEQ ID NO: 14588 - DNA, 75 bp, Artificial Sequence
  Synthetic
atgcatcatggcgcgcttcattcaacattcaaatcttcaggcaagtatgtcagtatttctaagggaattagattg

SEQ ID NO: 14589 - DNA, 75 bp, Artificial Sequence
  Synthetic
gtcatgattgagtcaatctgtacaaatgcagagctaatattattatgctgcttttctgcaatttcttgctttgta

SEQ ID NO: 14590 - DNA, 75 bp, Artificial Sequence
  Synthetic
gacaaagaacgatgtcagagattagtgacatcacctggcttgtttctattaactgccttacttatgcacaacaac

SEQ ID NO: 14591 - DNA, 75 bp, Artificial Sequence
  Synthetic
gctatcatcctgacaaagacatatttagtatatctgctcataccaatcttttacccctttgtaaagctctatggc

SEQ ID NO: 14592 - DNA, 75 bp, Artificial Sequence
  Synthetic
aatgaaacgataaatattttggatgtctgtaattttgcatttcatacatccttatctataacaaaagcaatgctg

SEQ ID NO: 14593 - DNA, 75 bp, Artificial Sequence
  Synthetic
tctctaacagaaccatctcgatacatgatcatgaactcacttgctatctccagccatgttaaagaatacatatca

SEQ ID NO: 14594 - DNA, 75 bp, Artificial Sequence
  Synthetic
aaatggtgtttatcagtgcccgatagtgtcttcttgtgattcctatatcaataatgtttatataaatgaaggcac

SEQ ID NO: 14595 - DNA, 75 bp, Artificial Sequence
  Synthetic
gaaaaattcgctccatacactaaaacgagtttctcagttgttatggctaatcttattaagaacggctgttacaat

SEQ ID NO: 14596 - DNA, 75 bp, Artificial Sequence
  Synthetic
gcatataaacaacgttcgaaagttgatcttagaagcatccatttgacagattatgagatcacgcaaaaaggtgtc

SEQ ID NO: 14597 - DNA, 75 bp, Artificial Sequence
  Synthetic
accaaacgtcctatatcaaagagtttgacaaaaaatgcgctacatggctatgtagagcttacaatgaaggaattg

SEQ ID NO: 14598 - DNA, 75 bp, Artificial Sequence
  Synthetic
gctttgtcttagaaccattatggaatgagttaagcttgtgggggaaatatgtcctgcttgcgttagctataatta

SEQ ID NO: 14599 - DNA, 75 bp, Artificial Sequence
  Synthetic
tctaacaatagagaccttttatctatttggttcccagggaaagtgtctctaaaagagtacattaaccaaatatat

SEQ ID NO: 14600 - DNA, 75 bp, Artificial Sequence
  Synthetic
atgccattctattttaattcaaaggggcttcatgaaaagcatcatgtgatgattgacctagccaagacagtcttg

SEQ ID NO: 14601 - DNA, 75 bp, Artificial Sequence
  Synthetic
aataaggccattggcaagatacattgttgcagtacttaaagagaatgacaaagtgtacaaactagaaaataagct

SEQ ID NO: 14602 - DNA, 75 bp, Artificial Sequence
  Synthetic
gagatagaacatgatcaaaggatcaatattccaggtatatggtctaatacaccaaagaaacaaacagtaaatttg

SEQ ID NO: 14603 - DNA, 75 bp, Artificial Sequence
  Synthetic
agcttacacagagccaacaataattgtgttgctccaatgaaatacaaaactgccaaatataccaacctactgtgc

SEQ ID NO: 14604 - DNA, 75 bp, Artificial Sequence
  Synthetic
aatgtcccttacaatcttatttctattatacgctattagcagtgtctggtcaatgccggccagaaacacaaatgg

SEQ ID NO: 14605 - DNA, 75 bp, Artificial Sequence
  Synthetic
aacgtggctatatactccatagcaaagaatttaatgatggacacatctcgccacaattacataagatcaagaatt

SEQ ID NO: 14606 - DNA, 75 bp, Artificial Sequence
  Synthetic
aggtaagtgcttccatggaggtattccctttaaacaaataaattcgactggaactatgtctgagatctgttctcg

SEQ ID NO: 14607 - DNA, 75 bp, Artificial Sequence
  Synthetic
gagaatacgaacaatctgaaaaggccaataacaaccataagcactttcaccagttcaaaatcatgcataaaagtt

SEQ ID NO: 14608 - DNA, 75 bp, Artificial Sequence
  Synthetic
cgatgacatttctatgattaagtcaataggaatacacagtcgcttagcagattcttctgccatagagactagctt

SEQ ID NO: 14609 - DNA, 75 bp, Artificial Sequence
  Synthetic
ggggatttttttgaattcaaatctagagaaagacaacaagttcaatcgaatataacaaagcaaattaagaaatac

SEQ ID NO: 14610 - DNA, 75 bp, Artificial Sequence
  Synthetic
agatcgaatttctcctaccagctgtgaaaccatcatttgattatttgatgaccaaatcgtccacatctaaagata

SEQ ID NO: 14611 - DNA, 75 bp, Artificial Sequence
  Synthetic
acagttgcaaacccagaatttatagaagagttcaatgaaaatgcaatggtaaggcatgccacttatgatgatgtt

SEQ ID NO: 14612 - DNA, 75 bp, Artificial Sequence
  Synthetic
gactttttatagattatactacgtcaaaaactggtttgaatgtaacccagttcaagactacatggggacattcat

SEQ ID NO: 14613 - DNA, 75 bp, Artificial Sequence
  Synthetic
ggtactagatataaatccacagggtttgctagtacctaaaacgtatgcttgccgtgctatgtgtgacattaatat

SEQ ID NO: 14614 - DNA, 75 bp, Artificial Sequence
  Synthetic
agatcagctatacctgattttgtcgatatcctgtcaactaaagtttttgatgcgttatactccaaaattagcaat

SEQ ID NO: 14615 - DNA, 75 bp, Artificial Sequence
  Synthetic
caggaccagatagcatacaatggagaacatatattcaaaataacaatttacacttatgcaatgatcatgttgtca

SEQ ID NO: 14616 - DNA, 75 bp, Artificial Sequence
  Synthetic
ggggaaatagacaatgccccaacagttgaacatatcttaaaaaccatgaaggatcataaaaggtttgtcttcact

SEQ ID NO: 14617 - DNA, 75 bp, Artificial Sequence
  Synthetic
agacagagatattggcgctatacagcttgattcagcttatttaaatcattacacaattgaagggactacaatcaa

SEQ ID NO: 14618 - DNA, 75 bp, Artificial Sequence
  Synthetic
atcagggtggtttaaatcaagggttcagattatgcttgacaacacttgcgaagacgtccatataacatgtggcca

SEQ ID NO: 14619 - DNA, 75 bp, Artificial Sequence
  Synthetic
tatttcaataagggccagaaaactgcaaaggatagggaaatttttgtaggagaatttgaagcaaagatgtgcctc

SEQ ID NO: 14620 - DNA, 75 bp, Artificial Sequence
  Synthetic
taaaaccctcaatatacatgcatgctttcgtcaacacaaagcatgtatcagatatttcagaggatctatattgcc

SEQ ID NO: 14621 - DNA, 75 bp, Artificial Sequence
  Synthetic
tatttagtagagaggatttcgaaagagcgctgtaaactcaatccggatgaaatgattagtgaacctggagatgca

SEQ ID NO: 14622 - DNA, 75 bp, Artificial Sequence
  Synthetic
tgaaatcatgatagaatcaatttgttcaaatgctgaattaatattgcttttatgcttcatagctatatctaccat

SEQ ID NO: 14623 - DNA, 75 bp, Artificial Sequence
  Synthetic
aaactgaagaagctcgaagatatggcagagaatgaaataagatatacagccaacacgctgaaatcaatgaaagac

SEQ ID NO: 14624 - DNA, 75 bp, Artificial Sequence
  Synthetic
acttgcagctatcttaacaaggacctacttagtatacttgctcatccctgtcttttaccctatagttaaaatgta

SEQ ID NO: 14625 - DNA, 75 bp, Artificial Sequence
  Synthetic
aaggtccttaaagagatgtctgcattttcagaaaccatcaattataaaccacattcaacaaaagtagaaatcaat

SEQ ID NO: 14626 - DNA, 75 bp, Artificial Sequence
  Synthetic
tgcattactgtatgaaagatgtatcaaaaaatgtaagaactgcatgctagcaatgcatccgttctcaaattgccc

SEQ ID NO: 14627 - DNA, 75 bp, Artificial Sequence
  Synthetic
gctgacatgtctaagtggagcgctcaagatgtcatgtttaaatatttttggctctttgcactagatccagcactt

SEQ ID NO: 14628 - DNA, 75 bp, Artificial Sequence
  Synthetic
cactacatgcatatgcggcatggtctataattctacagaggctttaaaggtccatagacaatgcaaaaattgtgt

SEQ ID NO: 14629 - DNA, 75 bp, Artificial Sequence
  Synthetic
tactcttgcgaaaaagagcgcatactctacttcctttgtaattatatgcaaaaaatattagttttaccagatgaa

SEQ ID NO: 14630 - DNA, 75 bp, Artificial Sequence
  Synthetic
tggatataaaacactcactaaaactagaaccctttgcaagaaaaagctgcctaacatgtttttagctgcaacaat

SEQ ID NO: 14631 - DNA, 75 bp, Artificial Sequence
  Synthetic
gtaattgcttcaatactagatcaaagggtaaaacatgataatgatttgatctataacatgacgaacggtctccaa

SEQ ID NO: 14632 - DNA, 75 bp, Artificial Sequence
  Synthetic
cacagtcatgttttttagttttataaccccaataactgcacagtgctacaactatagtacattgccacaagattt

SEQ ID NO: 14633 - DNA, 75 bp, Artificial Sequence
  Synthetic
aggaactgggtggcaataaagcggaattggcttcaaggcaatctcaactacacatctagctaccttcactcttgc

SEQ ID NO: 14634 - DNA, 75 bp, Artificial Sequence
  Synthetic
tcaacttgtaattgataaagaatattcttgtaagttggaacaaattgcaatgagttgcatagctttattatgcat

SEQ ID NO: 14635 - DNA, 75 bp, Artificial Sequence
  Synthetic
tgcatgaatgtgtataaagatatattaaaaaacgttgcttctctactagagggcgaagtacttgttaactctatg

SEQ ID NO: 14636 - DNA, 75 bp, Artificial Sequence
  Synthetic
aagcttgctgatcttatcaactatggttatcaacttatatatcaggattcgatatgtattctgcgcatattgcgg

SEQ ID NO: 14637 - DNA, 75 bp, Artificial Sequence
  Synthetic
gttcactcagatgacaaccacacatctattgtcatgattcaagacaaggtaagtgatgatattattatagaatat

SEQ ID NO: 14638 - DNA, 75 bp, Artificial Sequence
  Synthetic
gatggtgcatgaaaagaaagggttgatacttcatgataatttcacatcccattgtctaacatgcatttgcacaga

SEQ ID NO: 14639 - DNA, 75 bp, Artificial Sequence
  Synthetic
tccatcaaattatttgaaaaaatctgcttaacatttggaaaccaagctaatatgaagaaaacatatgtgaccaat

SEQ ID NO: 14640 - DNA, 75 bp, Artificial Sequence
  Synthetic
taaaagcatacataggtcaaacaataactgtattatgccgttgaagcacaaaacacacaaatatacatcaattgt

SEQ ID NO: 14641 - DNA, 75 bp, Artificial Sequence
  Synthetic
ttcataaaggaatttgtttcattattcaatatctatggtgagcctttctctgtttttggtagattcctgctcaca

SEQ ID NO: 14642 - DNA, 75 bp, Artificial Sequence
  Synthetic
atgtgcattcttgttggtggcttgtgctataaccccagtatttggaaaatgcttagataaagaagaaattacaag

SEQ ID NO: 14643 - DNA, 75 bp, Artificial Sequence
  Synthetic
gctgtaggagactgtgcatatctaggaccatatgaagatgcagccagtagattctcatctacacagaccgcaatc

SEQ ID NO: 14644 - DNA, 75 bp, Artificial Sequence
  Synthetic
tgttgaagatgcatccctctgtattggtctataccaaaatgtgacaaaagctaaaacataccaagaatatagtgc

SEQ ID NO: 14645 - DNA, 75 bp, Artificial Sequence
  Synthetic
ggactatcgcaaggtttcacattgcaagaccataaaggcaataccctcttcgacattattgcatatgtgaaaagt

SEQ ID NO: 14646 - DNA, 75 bp, Artificial Sequence
  Synthetic
aagcacggcgcatgcccgtcaatagcatgggtagcaattgctttgactcaatggataacacacaatacgtataat

SEQ ID NO: 14647 - DNA, 75 bp, Artificial Sequence
  Synthetic
agagctctcaaagaaaataagtagtcaagagattactatacttatgcctgacaggcagccaccatttgattctgt

SEQ ID NO: 14648 - DNA, 75 bp, Artificial Sequence
  Synthetic
gcccgtgtaattgcaacgtataatcatgagtacaagacaggacctacagtaagtatcaatgttcagcataatgag

SEQ ID NO: 14649 - DNA, 75 bp, Artificial Sequence
  Synthetic
atgctaccagggcagattaatgatccgttaaatgtcttcccaaccagcaacaggtttgaaatcccgatcgaatta

SEQ ID NO: 14650 - DNA, 75 bp, Artificial Sequence
  Synthetic
tatatctaaagcgcagacaacccaagacctacacactgctacattatatgagctaattgcatctaacctttaccc

SEQ ID NO: 14651 - DNA, 75 bp, Artificial Sequence
  Synthetic
tgtggattgttggaaacagaactacctactctagcaatagctgggctagaagctggtaacttgacatacctagtg

SEQ ID NO: 14652 - DNA, 75 bp, Artificial Sequence
  Synthetic
tgaaaatataaaaaaacacttggacccagctgggcctaacagcatacaatggaggatatacttacaaactaatag

SEQ ID NO: 14653 - DNA, 75 bp, Artificial Sequence
  Synthetic
aatctgtcaaggagaatgtctaatgtccaattactgcgtgaaagcatacaagcacaatatgctggagtagacaac

SEQ ID NO: 14654 - DNA, 75 bp, Artificial Sequence
  Synthetic
cttgtatatttgcaatgagcatgttacaaaaatgatttgcagatgtatattgaagcaagaagaatgtatgactac

SEQ ID NO: 14655 - DNA, 75 bp, Artificial Sequence
  Synthetic
tgggatatctctcagctgacaaccatggataagtttaaacttaaactgctacggttcatgacattagattctgct

SEQ ID NO: 14656 - DNA, 75 bp, Artificial Sequence
  Synthetic
tacatctgaccatgcacaagagattgaaaattactataaatcccataaagcccactatcgtgcagatatgttagt

SEQ ID NO: 14657 - DNA, 75 bp, Artificial Sequence
  Synthetic
atgagcagtgacgacgggatgggcgaaacaagtgacatgcggtcaagatcgctacttacccctagaaagttcacc

SEQ ID NO: 14658 - DNA, 75 bp, Artificial Sequence
  Synthetic
cttatatacagctgtagggaaagccatccctggtttggttcctaacttactgcagcaaatattaaagaatggcaa

SEQ ID NO: 14659 - DNA, 75 bp, Artificial Sequence
  Synthetic
acccaagcatcactagcccgattgaattcatataaacattttcaagaaatcatacaagacaaagctaagatcgaa

SEQ ID NO: 14660 - DNA, 75 bp, Artificial Sequence
  Synthetic
ttatgaagattcaaagtacatttttgataaactattagaacctgttaaacataacaatcagctgactggtattat

SEQ ID NO: 14661 - DNA, 75 bp, Artificial Sequence
  Synthetic
gatctttttgagttttttgtgcgaaaccctcaattactagtgactaagggggagactgtcgaagaattccaaaga

SEQ ID NO: 14662 - DNA, 75 bp, Artificial Sequence
  Synthetic
aaaatttttgagacatatcaatgaaaaaaacatcataagtatccaatcaaatttcgaattaagaagtgaattcaa

SEQ ID NO: 14663 - DNA, 75 bp, Artificial Sequence
  Synthetic
tctatattattccggtacaacagcaggaaattcaaagaatcactgtctatccaaacaccatcacaattgtttatt

SEQ ID NO: 14664 - DNA, 75 bp, Artificial Sequence
  Synthetic
gcttcagggcaatgcatacaatacaaaaactactggtgatactggtgttaaggaatgtgtaagtccattaatagt

SEQ ID NO: 14665 - DNA, 75 bp, Artificial Sequence
  Synthetic
gagcaagtactgtttgctaataaaccaatgatagactacacaagtatacacgaccggctatttggcctacaagat

SEQ ID NO: 14666 - DNA, 75 bp, Artificial Sequence
  Synthetic
tgcatgcactgggaaaagatatcggaacttggttaaaaaatacatatcatgctctcagaaattatatgttcttcc

SEQ ID NO: 14667 - DNA, 75 bp, Artificial Sequence
  Synthetic
gacccaagtattgaagatacaactatgatcatcggcaagaagacttttgtagagacttatagacaaataattcta

SEQ ID NO: 14668 - DNA, 75 bp, Artificial Sequence
  Synthetic
tgaacttcctattctatactttgacaacaaattatgtattggtgatcgatactgtttactgccactaactcccct

SEQ ID NO: 14669 - DNA, 75 bp, Artificial Sequence
  Synthetic
gacttagaaaaattcgatttaactgtcaaggatatcaaaacaatttattcgttctgcattatgaatgatcctgta

SEQ ID NO: 14670 - DNA, 75 bp, Artificial Sequence
  Synthetic
tcaagtgaattctgatatacaacaccttaaatgctttgccagtacaccagttgatcaatccaatggcatgaacaa

SEQ ID NO: 14671 - DNA, 75 bp, Artificial Sequence
  Synthetic
ttagtagcttgtgcaaacaacatactcctctctatgcatggcctagagctagataggacagggatgacatgctgc

SEQ ID NO: 14672 - DNA, 75 bp, Artificial Sequence
  Synthetic
ggcggaagctactattagactagagaagctcggggaatgcaaaattgaggataaggtggtcaatattgcagtgtc

SEQ ID NO: 14673 - DNA, 75 bp, Artificial Sequence
  Synthetic
atgatgcctgaaataaagtctctcaaagtgatataccatacgccagccttggtgttgagagcatatgtaacaggg

SEQ ID NO: 14674 - DNA, 75 bp, Artificial Sequence
  Synthetic
tatggtttcaaagcattttccatatgataccgtacgccacaagcaaagtgaactagttgatgattactgcctatc

SEQ ID NO: 14675 - DNA, 75 bp, Artificial Sequence
  Synthetic
aatatcaacctcaaaggggcagaacctgatgagatgcagagagacttataccacttagaggaatttataagacag

SEQ ID NO: 14676 - DNA, 75 bp, Artificial Sequence
  Synthetic
acaggattgtacaaaaagtttttatccatatcatcctaataatttgaaggagtgcacttggagtggctcagaaca

SEQ ID NO: 14677 - DNA, 75 bp, Artificial Sequence
  Synthetic
acaaggttgcgagatcatatgagaatgaggatacaaaagaacgaagaaaaagttatgagtagagatttgaaattt

SEQ ID NO: 14678 - DNA, 75 bp, Artificial Sequence
  Synthetic
ccagacgatatctcagaaattcatttcacataatgatattgagtcttttatttcagctataaaattgtcattgca

SEQ ID NO: 14679 - DNA, 75 bp, Artificial Sequence
  Synthetic
gagatacaggagttaaccaaattttatcagatctgttatgattatataaaatcaacagaacacaaaataaagata

SEQ ID NO: 14680 - DNA, 75 bp, Artificial Sequence
  Synthetic
taatgatctggttgttcacaatttcaaaccattagccaatatgccacatgtcaagccctcatacaagtcaatctc

SEQ ID NO: 14681 - DNA, 75 bp, Artificial Sequence
  Synthetic
tttatactgccacggcgtgcatatactccaatggatttttgcgggatggtaacagggaacactattagggataat

SEQ ID NO: 14682 - DNA, 75 bp, Artificial Sequence
  Synthetic
acttcaaggaacagttgcagggggaaaagtacaagacagctatattgtttttaatgtgccccttataactgggtt

SEQ ID NO: 14683 - DNA, 75 bp, Artificial Sequence
  Synthetic
tcctggtgcacgatacattatttgaagcagattacagtaccagcaaagaaagcacaaattgctacatccatagat

SEQ ID NO: 14684 - DNA, 75 bp, Artificial Sequence
  Synthetic
aaagatagacataatgggagggtggtgggagtttcctgctgatataataattatttgttgtggtagaacactact

SEQ ID NO: 14685 - DNA, 75 bp, Artificial Sequence
  Synthetic
gtctcagggctacaccataacagctcctgacggcttacctgtgatggatgcaatagtatacattaaatctgctaa

SEQ ID NO: 14686 - DNA, 75 bp, Artificial Sequence
  Synthetic
cttgagaaccaaattgcttatgaagcattgcgcctcattgctcattttgcggacactttcctgcaggactcatct

SEQ ID NO: 14687 - DNA, 75 bp, Artificial Sequence
  Synthetic
gttaaaagctacttattctcttgagtatcaaacagggccaacaataagcatcaacacagaccacaatgaaaaatg

SEQ ID NO: 14688 - DNA, 75 bp, Artificial Sequence
  Synthetic
agagtggtatttttaaagagagtcatctcagattttaaatataaaaatgtcccaatgaatgttctttacagtaag

SEQ ID NO: 14689 - DNA, 75 bp, Artificial Sequence
  Synthetic
tacaggcacttgtcctacagttataccaaaaaaagataattggttgacattctccaaagagcatacaagtgcatg

SEQ ID NO: 14690 - DNA, 75 bp, Artificial Sequence
  Synthetic
attaaatcttctagattgagaaccaagataattccaattttatattatatgggagatcttgagcaatcagatata

SEQ ID NO: 14691 - DNA, 75 bp, Artificial Sequence
  Synthetic
gttctacccactggtcatcgacatgcaccgtgtgataaaagatggaatggatgtcaacttcatgagaaaggtctt

SEQ ID NO: 14692 - DNA, 75 bp, Artificial Sequence
  Synthetic
gggctgtgaagagtggggttgcatagcaataggcactggctgtgtatatggttcgtgccaagatgttataaggcc

SEQ ID NO: 14693 - DNA, 75 bp, Artificial Sequence
  Synthetic
gacagatatgatgcagagaaagccgaagaacagataacttggaataactggcaagtatcaagggagttcacaact

SEQ ID NO: 14694 - DNA, 75 bp, Artificial Sequence
  Synthetic
tgaagctaaagtctataaaaaaataaatcaagaccagccagatatagagctatgtgtgactgatccctcagggac

SEQ ID NO: 14695 - DNA, 75 bp, Artificial Sequence
  Synthetic
ggtccaatagacctatcgataaagggctatggtaggacattgagaataattggcacagataataagttaacagct

SEQ ID NO: 14696 - DNA, 75 bp, Artificial Sequence
  Synthetic
attatgtaacacaattgatgccctcgagcctattataggtgagcattttcaggtggagattcacacaacacagac

SEQ ID NO: 14697 - DNA, 75 bp, Artificial Sequence
  Synthetic
gctgagcttcaaataaatagaatacgaagtgatatagtttctaggcatggccaagcattactaaataaaccccac

SEQ ID NO: 14698 - DNA, 75 bp, Artificial Sequence
  Synthetic
ccagatttaagcttaactgatcctccagttttctcttctttttttcttttttccttctaagtgcaccatgtctat

SEQ ID NO: 14699 - DNA, 75 bp, Artificial Sequence
  Synthetic
aaacctacttccagatcggatacttgaaaaaaacaagcttatatatactggccagataaatgcaaaagggacatt

SEQ ID NO: 14700 - DNA, 75 bp, Artificial Sequence
  Synthetic
ggtttgaaactagaaagaatggaggaagttgaatcgcttgatcctagactccattacatagtgtatcaattgcga

SEQ ID NO: 14701 - DNA, 75 bp, Artificial Sequence
  Synthetic
atggacaattacaagatcaatcaatatcgtgctaggattaacgatgcgagcgatccagaaactgctaaagatata

SEQ ID NO: 14702 - DNA, 75 bp, Artificial Sequence
  Synthetic
caatccaggatgtgggtcagtacaactatttgatagcaatacatatggaataggaaatccaaaattcgattacat

SEQ ID NO: 14703 - DNA, 75 bp, Artificial Sequence
  Synthetic
gacaggaaaagatatttctacaacattctgtcatcacaggcaataatagatcataaccatcagcttgaacttact

SEQ ID NO: 14704 - DNA, 75 bp, Artificial Sequence
  Synthetic
ttagctgatctattaatggatcgacacaactactttggcagagaactctgttactatcttgacattgagtataaa

SEQ ID NO: 14705 - DNA, 75 bp, Artificial Sequence
  Synthetic
atgtcatgcattatcccgtaaagatattgtagtccggaaatgctatgaaaaccactactatgcatgcagtaccct

SEQ ID NO: 14706 - DNA, 75 bp, Artificial Sequence
  Synthetic
agatcaagaagaaataatagatgggttcctgtttgcccagtagctgtatcaaaatattctaacaccgaaaagcca

SEQ ID NO: 14707 - DNA, 75 bp, Artificial Sequence
  Synthetic
aatgacacgccaattgatgatatcctcctggatttcttaccaccagggactgatttcaaggctagatactgtaca

SEQ ID NO: 14708 - DNA, 75 bp, Artificial Sequence
  Synthetic
aacaaggcgaactgatttgaggtttgttcacagcaaggataagcaacaagtcacaaatgagaatataattattgg

SEQ ID NO: 14709 - DNA, 75 bp, Artificial Sequence
  Synthetic
gtgttagataagcttgagtatcttaatattgatagcattaagttaactgcaatacaattagctgtcaatgactgc

SEQ ID NO: 14710 - DNA, 75 bp, Artificial Sequence
  Synthetic
cccgacaattatataattcacaacaggaagttatatgtattggattacaaagttgctgtcgataatgaatcttca

SEQ ID NO: 14711 - DNA, 75 bp, Artificial Sequence
  Synthetic
cacagccacagtaaaaatgatacttggagacatccaatacaaatctatgagcccggtagttgcagatttatcaat

SEQ ID NO: 14712 - DNA, 75 bp, Artificial Sequence
  Synthetic
gctatggttaggaaagctccatttgcaaaaatgaccttcttcgaaggcccgccaatacagtttggaggcattgat

SEQ ID NO: 14713 - DNA, 75 bp, Artificial Sequence
  Synthetic
gctaagacttttgaaaagtatgacaagatatttggcgatgttttggtgccattgggcctggactatgagatagtt

SEQ ID NO: 14714 - DNA, 75 bp, Artificial Sequence
  Synthetic
taatgcagtctgtggtgggtgcccagattgctttacggatgtcatatgcaaattgacaaccacatccaacactgt

SEQ ID NO: 14715 - DNA, 75 bp, Artificial Sequence
  Synthetic
ctgtcacgacttatggcaaatcaaactatcatcaatttgaatatagataagatagagtcaattagtctattggat

SEQ ID NO: 14716 - DNA, 75 bp, Artificial Sequence
  Synthetic
gttgttagggcagacccagtacgagatgtgatacatgttaactcagaagatttccttaatgagttcgggccgatt

SEQ ID NO: 14717 - DNA, 75 bp, Artificial Sequence
  Synthetic
aaccagatgcaaggttgagtcaaattgtattagttacacagacaatatccagattccagatggttcatctgaaat

SEQ ID NO: 14718 - DNA, 75 bp, Artificial Sequence
  Synthetic
ctatgtcgcatattttcttgcagaggcttctctaatgatcaagatgcatttgaattcctttcagatgagattatg

SEQ ID NO: 14719 - DNA, 75 bp, Artificial Sequence
  Synthetic
aatatgaacttagattttacttggttttacaatcttcgtgcattaatatatgataagtttaaagacgatgaacgc

SEQ ID NO: 14720 - DNA, 75 bp, Artificial Sequence
  Synthetic
aaatttaaaatttcgttgtagttcaactaaaattgatataaaagtctgcaacacacctgtaagtgtcaaatctga

SEQ ID NO: 14721 - DNA, 75 bp, Artificial Sequence
  Synthetic
aatgaggatgttgcagaggagctagatagttcacctttactgaagataacatacacaaagaaatcaaagtcatca

SEQ ID NO: 14722 - DNA, 75 bp, Artificial Sequence
  Synthetic
tttttggaaatagccagccagggtgaatttacaatgactgggccatggcttgatgatgaaacaccggaattatat

SEQ ID NO: 14723 - DNA, 75 bp, Artificial Sequence
  Synthetic
gatagttaaagatgatagaaaattagatttaacatctgcagatcagacatcatatatcaaggaatttgataaaaa

SEQ ID NO: 14724 - DNA, 75 bp, Artificial Sequence
  Synthetic
aatacgtttaagaatgcaatagtgcgagctctgatccgagaatgcaacaaatttgaagaaatatttgatatatct

SEQ ID NO: 14725 - DNA, 75 bp, Artificial Sequence
  Synthetic
gatcatcctatattcaaagagttttatgattctctgccaaatgagtcaaaaattacctttcagcggtcaatgaac

SEQ ID NO: 14726 - DNA, 75 bp, Artificial Sequence
  Synthetic
atgtggcacatggttgtgtagagcatacaatgaaggggttagtttcatattggggccactttggaatgaaattgg

SEQ ID NO: 14727 - DNA, 75 bp, Artificial Sequence
  Synthetic
gacgaaggtttcacttctgacagcaatcttgagctactagaaaacctgatttgggtattaaataaattaaagaca

SEQ ID NO: 14728 - DNA, 75 bp, Artificial Sequence
  Synthetic
ttcgatgcaacaaaaggtgacaaatggaaccaaaacctggttgatacaattcatgaatatactccaagttataat

SEQ ID NO: 14729 - DNA, 75 bp, Artificial Sequence
  Synthetic
tatatggggtaaatatgtgctaatcatatctggaagtcttattataatagtgctctttgcaaagatcatcaagcc

SEQ ID NO: 14730 - DNA, 75 bp, Artificial Sequence
  Synthetic
aatcagtggtccagcgagttgatagaatgcattcatatgtgtctatatcgaaatgacctagaccatgtataccat

SEQ ID NO: 14731 - DNA, 75 bp, Artificial Sequence
  Synthetic
ctctttataaaaaatgcctcatccggcatttttaaatgtcatggagattacccgaagcctagcaattctgaaatc

SEQ ID NO: 14732 - DNA, 75 bp, Artificial Sequence
  Synthetic
actgtcaatatacttgataagtttactcaaaaagaacgaagaaatctatagattggagaataagatcaaatagta

SEQ ID NO: 14733 - DNA, 75 bp, Artificial Sequence
  Synthetic
aatttccaaacgccagaaatttttgtcgacaacccaatcgccttaaatgtaaagtgggcagatgttatagatttc

SEQ ID NO: 14734 - DNA, 75 bp, Artificial Sequence
  Synthetic
acacaaggttggcaactaatgacagagagaataaccactgaaagagagctaactaatgacataaataaacaaaag

SEQ ID NO: 14735 - DNA, 75 bp, Artificial Sequence
  Synthetic
ccttctatccacttcctctggtgtccaccaagtgaagaatctaatgaaaatatcaaaaagttattacgattatcc

SEQ ID NO: 14736 - DNA, 75 bp, Artificial Sequence
  Synthetic
aatgattattacaattctcaacgtgattacattagcagtcattgcgactgcaatgcctcctcgtaatacgaatgg

SEQ ID NO: 14737 - DNA, 75 bp, Artificial Sequence
  Synthetic
attacattagcagtcattgcgactgcaatgcctcctcgtaatacgaatgggggccgatgtttttatggtggtaat

SEQ ID NO: 14738 - DNA, 75 bp, Artificial Sequence
  Synthetic
ttactgatcttaactagtcatgactacagagttgaaccttgggtatccattatgaagcattcattgtcaaaggca

SEQ ID NO: 14739 - DNA, 75 bp, Artificial Sequence
  Synthetic
attgactttgcagagatagagcacaaaaaaactttacagccaaacaatttgtctaggttcatgaaaggaaagaaa

SEQ ID NO: 14740 - DNA, 75 bp, Artificial Sequence
  Synthetic
atgtttcgccaaatcaactcaacatcaccaatgagcgaaatctgcgtcagagatgacatatccctggttaaatcc

SEQ ID NO: 14741 - DNA, 75 bp, Artificial Sequence
  Synthetic
aaaatgcttcaaaagttagacggcaccagcacatatttagacgcatttaaagccattggtatcctaatggatttc

SEQ ID NO: 14742 - DNA, 75 bp, Artificial Sequence
  Synthetic
atgggcggaaagtcaaaatttgacttctaactgacaactaatagtgtgttattaagttatttatttaaacaatgt

SEQ ID NO: 14743 - DNA, 75 bp, Artificial Sequence
  Synthetic
attggttaccacaaactggcagcaaatagggaggttattgagtcaagcatgtcgtactacagattatattacgtc

SEQ ID NO: 14744 - DNA, 75 bp, Artificial Sequence
  Synthetic
tcatcaaacgttggattgtacgaatcacatacaagcaagctaaagaatatgtcaaggcaaacatcaaaaaagatt

SEQ ID NO: 14745 - DNA, 75 bp, Artificial Sequence
  Synthetic
tgaactaccacaaacaatgtttcttcaacttgcaatcatcttgtacgctcttggttcctctggcagtatgcctgc

SEQ ID NO: 14746 - DNA, 75 bp, Artificial Sequence
  Synthetic
aaaaattggttcgagtgcaatccagttcaagacattcttggaacctttatggtgtttgacgtgaatcatgagggc

SEQ ID NO: 14747 - DNA, 75 bp, Artificial Sequence
  Synthetic
gacaagaaaattgaagctataaaaatcggtacatcaactgtaatgtgggaacagcaatttgtcttcgatacaaac

SEQ ID NO: 14748 - DNA, 75 bp, Artificial Sequence
  Synthetic
taggaacaccaatggggctaaatgcttttttggtggaacacaattccgccagataaattctactgggactatgtc

SEQ ID NO: 14749 - DNA, 75 bp, Artificial Sequence
  Synthetic
attttagcacctaagacatatgcttgcagagctacctgttcaataagcttagaacgagacaccggcaatgttgta

SEQ ID NO: 14750 - DNA, 75 bp, Artificial Sequence
  Synthetic
atcattgatcaccagtcgaaggggaaactcttcaaagaatttatgggaattggcaaccataagcaattttcaaag

SEQ ID NO: 14751 - DNA, 75 bp, Artificial Sequence
  Synthetic
agaacgagacaccggcaatgttgtattggagtcctcagcattaaaccactataccatacatgggacaactatcaa

SEQ ID NO: 14752 - DNA, 75 bp, Artificial Sequence
  Synthetic
cgaaatatgctctagagacgatatatccatggttaaatcaattggagtacaccgcctgtcagaagacaaccaagt

SEQ ID NO: 14753 - DNA, 75 bp, Artificial Sequence
  Synthetic
aaaacaattgaggacattgatatctcaaagccaactatattagatttcaataacaaaaacataattgacaaatgt

SEQ ID NO: 14754 - DNA, 75 bp, Artificial Sequence
  Synthetic
gaatggctggtttaagacaaaggtctctatagatctggataacacatgtgaggacctacatattacatgtggcca

SEQ ID NO: 14755 - DNA, 75 bp, Artificial Sequence
  Synthetic
gatggagacaagccttacgttttataggctattttatgtaaaagattggtatgaatgcaatcccatactagacca

SEQ ID NO: 14756 - DNA, 75 bp, Artificial Sequence
  Synthetic
atattccaatacaaaaatgttgacaagatattatcaaagccaaatatgctaaacaagatgggatgttatcttgaa

SEQ ID NO: 14757 - DNA, 75 bp, Artificial Sequence
  Synthetic
caaaacccttaatgttcatgcatgctttcggcaacataagtcatgtattcgttacttcaaggggtcaatcctacc

SEQ ID NO: 14758 - DNA, 75 bp, Artificial Sequence
  Synthetic
catgggtacttttatggttttagacattagtgaaactggcctattagtccctaagacatatacatgccgcgcaac

SEQ ID NO: 14759 - DNA, 75 bp, Artificial Sequence
  Synthetic
gaatatggcccacaaatttgcgcagcatcagaagaaacatgggaaacacttaagcttatatgcaacatgtcatat

SEQ ID NO: 14760 - DNA, 75 bp, Artificial Sequence
  Synthetic
tgaaattatgattgagtcaatctgtacaaatgcagagctgatattattatgctgcttttctgcaatctcttgctt

SEQ ID NO: 14761 - DNA, 75 bp, Artificial Sequence
  Synthetic
ctgcgatataaatattgacaaggatgctggttctgtcttactgacttcaaactctctaaatcattattccataga

SEQ ID NO: 14762 - DNA, 75 bp, Artificial Sequence
  Synthetic
tggtcagcaataaaagatttctcgacattaatgaaaaacatgctggcagtgtcgcagtacaataggcacaataca

SEQ ID NO: 14763 - DNA, 75 bp, Artificial Sequence
  Synthetic
tgtggctattatcttgacaaagacatatttagtgtatttgctcataccaattttttacccatttgtgaagcttta

SEQ ID NO: 14764 - DNA, 75 bp, Artificial Sequence
  Synthetic
aggtactacaatcaaaacaggatggtttaaaacacaagcacaagttgctcttgagaacacctgtgaaaatataca

SEQ ID NO: 14765 - DNA, 75 bp, Artificial Sequence
  Synthetic
ttccgagtagtaacctgcgcaaacaacaatttatttgctattgttatgccatcttcagatattaagacaaagagg

SEQ ID NO: 14766 - DNA, 75 bp, Artificial Sequence
  Synthetic
tggcttattgttacagagattctgcaaacaatgcaaaaattgcttattaccaattcatcctttcagcccctgtcc

SEQ ID NO: 14767 - DNA, 75 bp, Artificial Sequence
  Synthetic
tgtaacatgcggtcataagactataaacctacacgcctgttttaggcagcataagtcatgcataaggtatttccg

SEQ ID NO: 14768 - DNA, 75 bp, Artificial Sequence
  Synthetic
gcaacattggcatactttataatatgtattcacaatcataaagatgacattatgcatcatggagctttacatgca

SEQ ID NO: 14769 - DNA, 75 bp, Artificial Sequence
  Synthetic
aacaacatgtatctgcgggatggtttataactctagtgaagccttaaaagttcatagaaaatgcttaaattgcac

SEQ ID NO: 14770 - DNA, 75 bp, Artificial Sequence
  Synthetic
gggttctatcctaccggaactaatgatcgagtccatatgtacaaacatggaactgatattgttagtatgcttttt

SEQ ID NO: 14771 - DNA, 75 bp, Artificial Sequence
  Synthetic
acatttagaagtgaagggaaatatgtgagtgtctcaaaagggatcagattggataaagagagatgccaaaggata

SEQ ID NO: 14772 - DNA, 75 bp, Artificial Sequence
  Synthetic
tggttataagactctgactaaaacaaggtatttgtgcaaaaagagactccctaatatggtattggccactatcag

SEQ ID NO: 14773 - DNA, 75 bp, Artificial Sequence
  Synthetic
gatcatatcatccattgttgcagccatcttaacgaggacctacttggtctacctcctaataccgattttctacat

SEQ ID NO: 14774 - DNA, 75 bp, Artificial Sequence
  Synthetic
gtttcttcccctggactattcttattaacaacactattgatgtacaataataacccaacaattaagattgaggat

SEQ ID NO: 14775 - DNA, 75 bp, Artificial Sequence
  Synthetic
cacggtgctattctttacttttataacccctataacagctgaatgctataattatacaagcttgccagcagattt

SEQ ID NO: 14776 - DNA, 75 bp, Artificial Sequence
  Synthetic
tcctgtcaagatttatgggttgttatatgatcgagcatgcagaaaatgcaagaattgtttgcttgctgtgcatcc

SEQ ID NO: 14777 - DNA, 75 bp, Artificial Sequence
  Synthetic
gttgcaaattttgctttccatacatctctatctattacaaaagctatgctatccttaactgagccatctagatat

SEQ ID NO: 14778 - DNA, 75 bp, Artificial Sequence
  Synthetic
tcaagctgctatagataaaaataattcttgtacacgtgaacaattaataatgatcatattaacaatcctatgtat

SEQ ID NO: 14779 - DNA, 75 bp, Artificial Sequence
  Synthetic
tcttgtacacgtgaacaattaataatgatcatattaacaatcctatgtattgcctcgatcattgtggttatatca

SEQ ID NO: 14780 - DNA, 75 bp, Artificial Sequence
  Synthetic
attttctaactgtccaactacatgtatctgtgggatgtcttacaattccacagaagctctgagagtccatcgcca

SEQ ID NO: 14781 - DNA, 75 bp, Artificial Sequence
  Synthetic
atgcatgaactgcactggttataaaacgctgactaagacaagggtactttgcaagaagagaatccccaatgtaat

SEQ ID NO: 14782 - DNA, 75 bp, Artificial Sequence
  Synthetic
atgataatgaattcacttgctatttctagtcatgtcaaagattacatatcagagaaattctcaccatatacaaaa

SEQ ID NO: 14783 - DNA, 75 bp, Artificial Sequence
  Synthetic
acaagcttttcagtgattatggctaacctgataaaaaaaggctgttacaacgcatataagcaaagatcaaaagtt

SEQ ID NO: 14784 - DNA, 75 bp, Artificial Sequence
  Synthetic
attggctagtctagtgacaatactcttcttctcatttataactcccataagtgcccaatgctacaattattccag

SEQ ID NO: 14785 - DNA, 75 bp, Artificial Sequence
  Synthetic
gatctcagaagcatacatctaacagactacgaaataactcagaaaggtgtcaacaataaccgtgatttatcatcc

SEQ ID NO: 14786 - DNA, 75 bp, Artificial Sequence
  Synthetic
atttggtttgagggcaaagtgtcattgaaagaatatataaaccagatttacatgcccttttactttaattcaaaa

SEQ ID NO: 14787 - DNA, 75 bp, Artificial Sequence
  Synthetic
ccttcctgatgatttcaagaatgcgatagacatgagccacaaatgcaacatggaacatttgattatcctaggtat

SEQ ID NO: 14788 - DNA, 75 bp, Artificial Sequence
  Synthetic
attgccttacatgcatttgtcgcgataaaagcatacacagagccaacaataattgtgttgctccgatgaaataca

SEQ ID NO: 14789 - DNA, 75 bp, Artificial Sequence
  Synthetic
aaaccgctaagtataccaacttagtgtgcattgtcttcctgattatcattgctgttacccctgcttttagtgctt

SEQ ID NO: 14790 - DNA, 75 bp, Artificial Sequence
  Synthetic
gctagtatcaagcatattagcatttttcctagtactgctaattactaaggtgtatataaggtactattacatatt

SEQ ID NO: 14791 - DNA, 75 bp, Artificial Sequence
  Synthetic
gtgcattgtcttcctgattatcattgctgttacccctgcttttagtgcttgcatacaagaaaaagaaatagaaac

SEQ ID NO: 14792 - DNA, 75 bp, Artificial Sequence
  Synthetic
aatatacctggtatatggtctagtactcctcagaaacaaacagtgaatctgcctgttttgatatatgctatttca

SEQ ID NO: 14793 - DNA, 75 bp, Artificial Sequence
  Synthetic
aatagatgatgctgcaatgtgtattggtttatatcaaaatataacccagccaaaggaatacaatgcctttgtgaa

SEQ ID NO: 14794 - DNA, 75 bp, Artificial Sequence
  Synthetic
ctgctcatactgcggcatgattcactctaagcgagggatgatcttacaagggaacttcacttcgcgatatctcac

SEQ ID NO: 14795 - DNA, 75 bp, Artificial Sequence
  Synthetic
aaaaacctcctaatggacacatctagacataattatattcggtctagaatagaaaactcaaataatttaaagcga

SEQ ID NO: 14796 - DNA, 75 bp, Artificial Sequence
  Synthetic
agagctttcgtcaacattaagcagtcatgaaattgaattcctcctgccagctgtcaagccatcattcgagtatct

SEQ ID NO: 14797 - DNA, 75 bp, Artificial Sequence
  Synthetic
atgtatatgtagcaataagatgctacatagatctacaaaaaattgcataataagtatacgatataaatctgctaa

SEQ ID NO: 14798 - DNA, 75 bp, Artificial Sequence
  Synthetic
tctatcactactatcagcacgttcactagttcaaagtcatgcattaaggttggtgactttacagatttcaaatca

SEQ ID NO: 14799 - DNA, 75 bp, Artificial Sequence
  Synthetic
aataactaaatcatctacatctaaagatctccatagtgctactattcatgaatttatagctgctaatctatatcc

SEQ ID NO: 14800 - DNA, 75 bp, Artificial Sequence
  Synthetic
aataaccaatataatttttgctgttgtaattatacttgcaatgtcagtgcctgctatgatgagttgtctagatgg

SEQ ID NO: 14801 - DNA, 75 bp, Artificial Sequence
  Synthetic
agagaatcaaaggtggtcaatgctaaactagagaaagatatcaggaagtacacaatagcaaacccagaattcgtt

SEQ ID NO: 14802 - DNA, 75 bp, Artificial Sequence
  Synthetic
taataacttcaaaaaacacttgacaccagcagggccagacagtatacaatggagaacatatattcaaaataacaa

SEQ ID NO: 14803 - DNA, 75 bp, Artificial Sequence
  Synthetic
ggaagatgtgtcttcaattgaatctgcatccctgtgcataggagtatatcaaaatatttcccgtgctaaagaata

SEQ ID NO: 14804 - DNA, 75 bp, Artificial Sequence
  Synthetic
gaagacctgacagaaaaggccactataaggcatgccatttatgatgacttaaaaaaagctataccagattatatt

SEQ ID NO: 14805 - DNA, 75 bp, Artificial Sequence
  Synthetic
cttgcatttgtgcaatgaccatgttgtcaaaatgatatgccgctgtataatcaagcaagagaaatgcagctctac

SEQ ID NO: 14806 - DNA, 75 bp, Artificial Sequence
  Synthetic
ttcaaccttgaattcagaattatctgagaaaatcagcaaccatgaggttaccgccctgatgcccgaacaacagcc

SEQ ID NO: 14807 - DNA, 75 bp, Artificial Sequence
  Synthetic
gatgtaatgtctactaaagtatttgacgcattgtattataaaatcaagcatggtgaaataacagacagaccagct

SEQ ID NO: 14808 - DNA, 75 bp, Artificial Sequence
  Synthetic
aaaagtagacgatggagaacagattgtgcagtactataagaggaataaagaattttataaagccgatctggagat

SEQ ID NO: 14809 - DNA, 75 bp, Artificial Sequence
  Synthetic
tacatttgattctttaataaacaaggccagcacccttaaagacctacatacagctacattatttgaatatttagc

SEQ ID NO: 14810 - DNA, 75 bp, Artificial Sequence
  Synthetic
gttgagcatatactccaagttatgaaggatcataagagatttgtctttacatatttcaataaaggtcagaaaaca

SEQ ID NO: 14811 - DNA, 75 bp, Artificial Sequence
  Synthetic
actgtacacagccatatcgagagcaatcccaggattggtcggtaatttactgcgacaagttcttaagtcacaaaa

SEQ ID NO: 14812 - DNA, 75 bp, Artificial Sequence
  Synthetic
tgtgagcctttatcccctccaaatgtctaaacatctagacccagcaggaccaaatagcattcagtggagagcttt

SEQ ID NO: 14813 - DNA, 75 bp, Artificial Sequence
  Synthetic
gcaaaggacagagaaatatttgtgggagagtttgaagccaaaatgtgcttatacttagtagagaggatatctaaa

SEQ ID NO: 14814 - DNA, 75 bp, Artificial Sequence
  Synthetic
gtatgaggagtcattgcatgttctaaataagataaagaaagatgtctcgaaaaataaccaactgaacggcatagt

SEQ ID NO: 14815 - DNA, 75 bp, Artificial Sequence
  Synthetic
tctgcaagtcaatagcccccatatatgtaatgagcacataaccaagatgatatgtcgatgtgtcttaaagcagga

SEQ ID NO: 14816 - DNA, 75 bp, Artificial Sequence
  Synthetic
gaaaggtgtaaactcaacccagatgagatgattagcgaacctggagatggcaagttaaaaaagcttgaagacatg

SEQ ID NO: 14817 - DNA, 75 bp, Artificial Sequence
  Synthetic
ggaattcttgatacatattaattcgaagaatataacagaagaggtcagggagttaagaattaggcctgatcttag

SEQ ID NO: 14818 - DNA, 75 bp, Artificial Sequence
  Synthetic
ggagtgtaaatctacaacgagcgaccatgctcaggagattgaaaactattacaaaaagaacaaactattctacaa

SEQ ID NO: 14819 - DNA, 75 bp, Artificial Sequence
  Synthetic
gctgaatatgagattcggtatactgctaacacattaaaatccatgaaagacaaggcgctgcaagaatttagtaga

SEQ ID NO: 14820 - DNA, 75 bp, Artificial Sequence
  Synthetic
tattagggggtccaaattcacagacaagaacccagggactcccaacatcaaagaatgccaaactccaatgtttat

(The sequence listing continues in the following parts.)

What is claimed is:

1. A method for generating probes for analyzing a sample comprising a target sequence, the method comprising:
   a. constructing candidate probes capable of hybridizing the target sequence and one or more variations of the target sequence, said candidate probes collectively having a hybridization pattern along the length of the target sequence;
   b. determining an individual hybridization pattern for each candidate probe to provide a collection of individual hybridization patterns;
   c. solving a set cover problem for the individual hybridization patterns, wherein the set cover problem comprises a set of elements {1, 2 . . . i . . . m} comprising the entire target sequence and the one or more variations of the target sequence, and a collection of candidate probes covering the set of elements, and wherein the set cover problem identifies the smallest set of probes from the candidate probes that covers the set of elements, thereby reducing the number of candidate probes needed to cover the entire target sequence and the one or more variations of the target sequence, and providing a final probe set; and
   d. synthesizing the probes of the final probe set.

2. The method of claim 1, wherein the set cover solving process is a weighted set cover solving process, a partial set cover solving process, or a partial weighted set cover solving process.

3. The method of claim 2 wherein subjecting the individual hybridization patterns to a set cover solving process comprises:
   a. allocating a lower weight to those individual hybridization patterns that correspond to candidate probes that are specific to the target sequence; and
   b. allocating a higher weight to those individual hybridization patterns that correspond to candidate probes that are not specific to the target sequence.

4. The method of claim 1, wherein the set cover solving process is a greedy method.

5. The method of claim 1, further comprising:
   minimizing a loss function depending on overhang parameters and mismatch parameters such that the total number of selected probes is no higher than a threshold number to provide input parameters to the set cover solving process.

6. A method of analyzing a sample comprising a target sequence, the method comprising:
   a. contacting the selected probes of claim 1 to the target sequence or a fragment thereof; and
   b. sequencing the target sequence or fragment thereof that hybridizes to one or more selected probes of the set.

7. The method of claim 6, further comprising analyzing the target sequence or a fragment thereof that is hybridized to one or more selected probes, wherein analysis of the target sequence or a fragment thereof hybridized to a selected probe is by solution hybrid selection.

8. The method of claim 7, wherein each of the selected probes further comprises an adapter.

9. The method of claim 8, wherein each of the selected probes comprises two adapters, and wherein a first adapter is alternated with a second adapter.

10. The method of claim 8, wherein two of the selected probes overlap.

11. The method of claim 6, wherein the candidate probe or the selected probe is a nucleic acid sequence, and wherein the nucleic acid is DNA, RNA, PNA or other non-naturally occurring nucleic acid.

12. The method of claim 6, wherein the sample is a biological sample.

13. The method of claim 12, wherein the biological sample is a blood, buccal, cell, cerebrospinal fluid, mucus, saliva, semen, tissue, tumor, feces, urine or vaginal sample.

14. The method of claim 12, wherein the biological sample is obtained from a human.

15. The method of claim 6, wherein the target sequence is a nucleotide sequence.

16. The method of claim 15, wherein the nucleotide sequence is a DNA sequence or an RNA sequence.

17. The method of claim 15, wherein the nucleotide sequence is a pathogenic or viral sequence.

18. The method of claim 17, wherein the viral sequence is a human respiratory syncytial virus, Sudan ebola virus, Bundibugyo virus, Tai Forest ebola virus, Reston ebola virus, Achimota, *Aedes* flavivirus, Aguacate virus, Akabane virus, Alethinophid reptarenavirus, Allpahuayo mammarenavirus, Amapari mammarenavirus, Andes virus, Apoi virus, Aravan virus, Aroa virus, Arumwot virus, Atlantic salmon paramyxovirus, Australian bat lyssavirus, Avian bornavirus, Avian metapneumovirus, Avian paramyxoviruses, penguin or Falkland Islandsvirus, BK polyomavirus, Bagaza virus, Banna virus, Bat hepevirus, Bat sapovirus, Bear Canon mammarenavirus, Beilong virus, Betacoronoavirus, Betapapillomavirus 1-6, Bhanja virus, Bokeloh bat lyssavirus, Borna disease virus, Bourbon virus, Bovine hepacivirus, Bovine parainfluenza virus 3, Bovine respiratory syncytial virus, Brazoran virus, Bunyamwere virus, California encephalitis virus, Candiru virus, Canine distemper virus, Canaine pneumovirus, Cedar virus, Cell fusing agent virus, Cetacean morbillivirus, Chandipura virus, Chaoyang virus, Chapare mammarenavirus, Chikungunya virus, Colobus monkey papillomavirus, Colorado tick fever virus, Cowpox virus, Crimean-Congo hemorrhagic fever virus, *Culex* flavivirus, Cupixi mammarenavirus, Dengue virus, Dobrava-Belgrade virus, Donggang virus, Dugbe virus, Duvenhage virus, Eastern equine encephalitis virus, Entebbe bat virus, Enterovirus A-D, European bat lyssavirus 1-2, Eyach virus, Feline morbillivirus, Fer-de-Lance paramyxovirus, Fitzroy River virus, Flexal mammarenavirus, GB virus C, Gairo virus, Gemycircularvirus, Goose paramyxovirus SF02, Great Island virus, Guanarito mammarenavirus, Hantaan virus, Hantavirus Z10, Heartland virus, Hendra virus, Hepatitis A/B/C/E, Hepatitis delta virus, Human bocavirus, Human coronavirus, Human endogenous retrovirus K, Human enteric coronavirus, Human genital-associated circular DNA virus-1, Human herpesvirus 1-8, Human immunodeficiency virus 1/2, Human mastadenovirus A-G, Human papillomavirus, Human parainfluenza virus 1-4, Human paraechovirus, Human picobirnavirus, Human smacovirus, Ikoma lyssavirus, Irkut virus, J-virus, JC polyomavirus, Japanese encephalitis virus, Junin mammarenavirus, KI polyomavirus, Kadipiro virus, Kamiti River virus, Kedougou virus, Khuj and virus, Kokobera virus, Kyasanur forest disease virus, Lagos bat virus, Langat virus, Lassa virus, Lassa mammarenavirus, Latino mammarenavirus, Leopards Hill virus, Liao ning virus, Ljungan virus, Lloviu virus, Louping ill virus, Lujo mammarenavirus, Luna mammarenavirus, Lunk virus, Lymphocytic choriomeningitis mammarenavirus, Lyssavirus Ozernoe, MSSI2\ 0.225 virus, Machupo mammarenavirus, Mamastrovirus 1, Manzanilla virus, Mapuera virus, Marburg virus, Mayaro virus, Measles virus, Menangle virus, Mercadeo virus, Merkel cell polyomavirus, Middle East respiratory syndrome coronavirus, Mobala mammarenavirus, Modoc virus, Moijang virus, Mokolo virus, Monkeypox virus, Montana *myotis* leukoenchalitis virus, Mopeia lassa virus reassortant 29, Mopeia mammarenavirus, Morogoro virus, Mossman virus, Mumps virus, Murine pneumonia virus, Murray Valley encephalitis virus, Nariva virus, Newcastle disease virus, Nipah virus, Norwalk virus, Norway rat hepacivirus, Ntaya virus, O'nyong-nyong virus, Oliveros mammarenavirus, Omsk hemorrhagic fever virus, Oropouche virus, Parainfluenza virus 5, Parana mammarenavirus, Parramatta River virus, Peste-des-petits-ruminants virus, Pichande mammarenavirus, Pirital mammarenavirus, Pi scihepevirus A, Porcine parainfluenza virus 1, porcine rubulavirus, Powassan virus, Primate T-lymphotropic virus 1-2, Primate erythroparvovirus 1, Punta Toro virus, Puumala virus, Quang Binh virus, Rabies virus, Razdan virus, Reptile bornavirus 1, Rhabdovirus, Rhinovirus A-B, Rift Valley fever virus, Rinderpest virus, Rio Bravo virus, Rodent Torque Teno virus, Rodent hepacivirus, Ross River virus, Rotavirus A-I, Royal Farm virus, Rubella virus, Sabia mammarenavirus, Salem virus, Sandfly fever Naples virus, Sandfly fever Sicilian virus, Sapporo virus, Sathuperi virus, Seal anellovirus, Semliki Forest virus, Sendai virus, Seoul virus, Sepik virus, Severe acute respiratory syndrome-related coronavirus, Severe fever with thrombocytopenia syndrome virus, Shamonda virus, Shimoni bat virus, Shuni virus, Simbu virus, Simian torque teno virus, Simian virus 40-41, Sin Nombre virus, Sindbis virus, Small anellovirus, Sosuga virus, Spanish goat encephalitis virus, Spondweni virus, St. Louis encephalitis virus, Sunshine virus, TTV-like mini virus, Tacaribe mammarenavirus, Taila virus, Tamana bat virus, Tamiami mammarenavirus, Tembusu virus, Thogoto virus, Thottapalayam virus, Tick-borne encephalitis virus, Tioman virus, Torque teno *canis* virus, Torque teno douroucouli virus, Torque teno *felis* virus, Torque teno midi virus, Torque teno sus virus, Torque teno tamarin virus, Torque teno virus, Torque teno *zalophus* virus, Tuhoko virus, Tula virus, Tupaia paramyxovirus, Usutu virus, Uukuniemi virus, Vaccinia virus, Variola virus, Venezuelan equine encephalitis virus, Vesicular stomatitis Indiana virus, WU Polyomavirus, Wesselsbron virus, West Caucasian bat virus, West Nile virus, Western equine encephalitis virus, Whitewater Arroyo mammarenavirus, Yellow fever virus, Yokose virus, Yug Bogdanovac virus, Zaire ebolavirus, Zika virus, or *Zygosaccharomyces bailii* virus Z viral sequence.

19. The method of claim 18, wherein the hepatitis viral sequence is a hepatitis A, hepatitis B or hepatitis C viral sequence.

20. The method of claim 18, wherein the influenza viral sequence is an influenza A or influenza B viral sequence.

21. The method of claim 1, wherein each probe in a probe set is between 15 to 150 base pairs.

22. The method of claim 1, wherein each probe in a probe set is between 20 to 175 base pairs.

23. The method of claim 1, wherein each probe in a probe set is between 70 to 130 base pairs.

* * * * *

UNITED STATES PATENT AND TRADEMARK OFFICE
CERTIFICATE OF CORRECTION

PATENT NO. : 11,332,783 B2
APPLICATION NO. : 15/756546
DATED : May 17, 2022
INVENTOR(S) : Metsky et al.

Page 1 of 1

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 780 days.

Signed and Sealed this
Eighteenth Day of February, 2025

Coke Morgan Stewart
*Acting Director of the United States Patent and Trademark Office*